United States Patent 9,328,346 (POLYCOMB-ASSOCIATED NON-CODING RNAS) - sequence listing, part 59

SEQ ID NO: 12234 - RNA, 7091 nt, Mus musculus
cuggcgcgggcgggcccguccccccugccccugggucgcucuuuuuaagcuccccugagccggggcugcgcuccucuaauugggacuccgagucggggcuauuucugguguuggcgcggcuccaagaaggcgugaguucgccgccgcucggguggcuucuuuuuuuccuguaggucuagaaucuaaucacauuauuauuuauugaggccgcgcacgggccgugcccagcuuccugccccucgccauccuccaggggagcgggauccgucaguguucccucgccccagcucggaugugacacacauccccggcgggggcccgggcggcgcgcacgcagcggucucagcgccucugcccucucccgguuucagauccgcauuugcgaccggcggcgguggcggcagagcccaggccggugcccugagcccagccacgccgcacccggcagccccgagcgcgccccgccggcggccugcggagcucgcggugaguguccgcggcgcgcccggggggccugcggcgcgcgcugcccgcuuuauucccaggccccgggcuugcgcgggccgcgggaaaggggaggccgcacugugcucgcaggcggcggggccgggguggguguccgcggggcgccgcguccuccgguccccagguugagggugcccggguugcgaccguggggugcggagaccccggggaacggcgcgcggagggggagggggcgcgcgacugcgacgagcgccgcuugugcacccagcggcgcccgugcaccucgcgcucggcgagcccggccucagggaggggcgcgcgcugcgcagcggcgggaggugggcgcgcgccccccucagccagggaaguucuagaagugcgggggaggggcccggcgacccgagauuccucucuggccucuccuccgccuuucccagaguaguacugugcguggacgaggccggaucgcgagggccuggguuucgggguuucaccccccacccccacacacaccuuuggcccugccccgcgccucuucaaccuccagggccaggccugcccuccgcccccacaaacugguuccucugcuuugcuggguucuguuagaacuagucccuucgacuccccguuucugcccccccccccgcuuugguuuucauggagagaggaagggguuuuuuucuuccugcgacucgcaccagguuuccugcccccaaggcgggcuugggugcccccucuggcaggaaguggggccgggcgcacccgcguggcggugcauguggucggggugcgccguuucccgcgccuaaagggcucugcgccccucccccucguccuagcuccuagaagcgccggccuacaaccaccaggcugggacgccagcgaaggcauccucauucuggaguagagggcgccugggucuuaaccugcuucucaguaaacaaaguggcggucuguaagcauuccgcaagaaccuccauuuuaccaaguugcugugugaccuugggcuauugaggggucuucucucuauauuuaaagggggacccuuuaagacccuuaacaauaggccugccgggauguuacuccucugguaguucuugcauaguuacugaaacguugaggagccacagcgugugcacccgugugagagacaggcuggaggcccaagagagacacauggggcuuggacuccuaaaugugacuuggccaugccagaccucccugaugcucagaaacagguggaagaggugagguuuuccuuggccucgcuggacagagacucuaagcuuaauucagugggggcauuggggagagcaggugguuuagagucccuaacggcaagaauuggggaggcaccagguggcaaaacaguguccgggagacuggccaggaucuccaggcaagcuagaugcaugcaaggucuuugggauuggggcaggcuuucccccaagagcccccucugaagggccuccagcagaccucggugugaggucagugcucauuagcugauuaauuuugauguuugguuugaaggacaccugugguguaauguaagguucuaaucacagccuguaauuagagaacagaccaagccgcuaaugaugggagcuggcccagccacccuguuuaaaggagucucgaguuugaaaucucguaauagaauaaugagcagaguccgcaccaucuggggucucuugaugcuugagaauuaggaaaccguuaaguguuuuagaaaucaaaaguuuucaaaauguuuuccugucguugggucaaaauuaucccguugccucaaaucuggaaagaggguggggguggggcaacuuguuugguaagagcacugccccgcguacaggauggacccuugguuaacuccagccugguccuccacuguggcagugagguagcucugcaggugccauggagccuguaccuucacuucugcccuugcuaaggacagccugggcugcugcccaaagcuucuccuggccucuuaaguacgggacacagggucuuguggcugucuuccaauaaacacaaacacacacaccacacguguggugcuggaccucaguuaaaggacuucuugcuacccagucuuuuacuuggaagggucuauugagaaucugcccuugcccuaagguaguugcuagcuaucaaagcacaacuccaguuucucacgaagacccucggcugcucccucugcacauggccacccucuauagaucuuaaggaucuucauuuacucugggucucaggcuugagcugcggacugggacuuucccuucuuauuucaaccccuaacuaagggacaagguagcgaaaagccucaacuugccccaggucgcucugggacucucuagccgggugacaccucaaggucaccacccuugggguguguguggcagggguagcggguggagggaacaccuguguaacugcuauuuugucuccgugcaucucccccagacucacugugugcugccccacacauagagaaggagaaugagcgagucgggcucaaaguccagccagccccuggccuccaagcaggaaaaggaugggacugagaagcgaggccggggcaggccacgcaagcagccuccggugaguccugggacggcgcuggucgggagucaggugggugucuaaagcuuugcuccuguuuccuuucuugggcuggggggggggggcgggggucagagcugacucuuugcgcauguguaucccuguguaugcuuacugcccagagguguccagcucagugucuaaggucacagugaaggcagccaugucuuaacauucacccagaaaagugggagaaucagaaagaccagacccuaucuuaaagaaaaaaauuuuuuuuuuuuuuuuaauuuuuuugcccuggucagaacggagccaacaggcaggcuucgacuggugguacacgguuuuaaacaaauaaucagacucuuguucaguugccuucggggcucuacaucuggucuuucuguuucugcacuucccuaagucagguggcuguguagaugucugcuugcuuacccaccuacuuaggcccuggcucuguaguagacauugagguucuggggguggggggugucccugaacgccuggccugucugucuucacaauggagaugcccacccucucccaagugaggagaggcuguugguggcccugcgaaggugacggagucuguccucagcagguugucuuggcugggaaaaucugaugggugauggaacuuagccgaugucuccaggugguggucaugggaacaagguuccugcagaccugugcccuugccgucuggccuccugguuguggagaggguuuuggguuuggaugaaaguuugcgguccuggcucagcuugcugggugccuggauugaucaggagugggaagcaacgcauuuuacucaggccgcgagagggauuuccuaugcaaagacagggggcggggggggggggggggcgcuagcaaucauggcccgggccagaccacugcuuuaugcuugauuuaucugacacugcuagcuagguguuccccaccaggugagauccgcuacaggguggggccuuuugcagaagaccagaaacauaauauuagucaggucagggcaccuaacuguuucccuugcuugagugacaguucuccccagggaucucugguuucucuuucuuugguauaaaacuuuuagauuuuagaggcuugaggacaggagccugaugggggugucaggcaaguuuggagucuccauggugugccugcugcgucuucugcagacucuaaguuggggugaccuaggggccagcacagcucgguugguacuguuucccugacucccagacaucuuugcagaaagagcccagugaagugccaacuccgaagagaccucggggccgaccaaagggaagcaagaauaagggcgccgccaagacccgggugagccuccuaggggacauccugcauggaugccgggguuagcuucucaggucugggaaaaggcaaggugggcagagaguaaaggccugugccagcucugagcugagaaugucacccucguucaucccaaggacacgaaggguuuguucauguggggagggcagagucaugguggcaucagccucaaaaauguucuuguuuuuauuuuauuuuuuaacacacgacucauauccucugagucacuugugaaggggggagaaggggugcguguauguuggguggggggugggggcuggccagucaucaucagcuggacuuggguggaccugcuugugggguccugggcuguccugagccagcuccaucuccgucucgcugggcuugggugucccuuggguucuguucagcacuuuggacuuaaccuuauguuuuaaccccuggcccuucagaaagucaccacagcuccagggaggaaaccaaggggcagacccaagaaacugguaggugcuuguuguguuugcugggugaaagguggguuaaggaugccccagagugggcauguugaaugucugagcaugcgugaaacaugucacauaaguucaggguuaccuuccucuucagagaucccuugucuccagaaaaauaauuccugauaucagguacucacuaugggagaagcccuaugggaccuuauugggcccucaaaguguccuguguccccaccccuuauuacuguuacuaggacccucauggaaagaucaggaagugaagcucuggauagggaacuggguaccaugcagccuuguuucuaagcugcccaagacaaggucauucauuccugugcugagccaccccuuccuuaaguggaggggcugggggccccugcuggcguggcccuaggagugaguaacaggaaacuaguuguuuuuggacugugccuggcauggugggggcuguggggcccuguggcgugcuaacauucccgcccagugagggcgucccuggggcucguccuuccuucccauccugggaagggucagccacuggacaccccaggccuucuuagaaccagcccugcaccugcucuguaccgccccauggcucucccauucuugucucuugcccuucugcccccucucuggagagccacuuccucagcccuugguauagacucugggucuggccugggggggggggggugagagagagaaagagagagagugugugugugguuuguuuuuuuuuucccucccuuuaaauccuuaguuuuuaugaaugaaagcagcguggagguugcugagucacccacacacucagcccugacucaucccccuuuugcagaggaaagccggggagggaggaggggggagagagggguguuggcugagaaugaaggccaguccuugagucgcucugccucccacaggagaaggaggaagaggagggcaucucccaggaguccucugaggaggagcagugaucaccacucgcagugccgccugcuccauagccacugaggagcagcuguccccugggacuggaagcccugcucccaggccccuccccgcccccacugcacacuaccgcaccaggcaccagcugcaggcucugcuccgcagcacccaagggagcaggauucggcucagucccugugcccuccucccgaacacaccugccccauccugacaaggcuaacuucccauuuagccgcagcccgaccugcugcgcaccucccucagagccguggcucucugggcgcuuuguuuugcgggucccuucugcccugcuguuccuggcuuccccguagaggguccugggagcauucccuggccuuaaggggccccagccccaucucacucugacaaggcccaguggcugaccuagcagcagcaguguggucagggcaggggaugcuuagaucccagcauguccccaccaaaguaucaccggguggguuucucagccccuccugccccacccuacagagaucaugcacuggguuggcugagccccuugacaacaggaaguaggaugauguuggcuccacccacuuuaauguucucaccugagacuagacagaugggguuaccgcccaucuccagaguaagggccuguucucgccuccaccaaaggcaaacgggcaccaacacgccucccccaguccacucuaggcuguuccuuccucccgcagggcacuaaggagcuagccuugccgcccccuccuuuucgcuccucccugccccccaugguucugguuccaucuucuccucuguucacaaacuaccucuggacgguuguguuguuuuguuuuuguuccauguucauucuuagauacccacuauugcugcugcuaccagcgucagauguucauccuccugaauuugccuguauucucucccccacacaauacacucgaggggaaggggggcuggggcgcagcagacugguuaccuaccccacacuaaggaagauggggccccaccccguggaugcugcagcagagugaggaugggggcccacuuugaugggaaaaggguguagggccaccuccccuuguucugugggggagggguggccaguauuugucccagccuggggcuuccucccugguuucuuauuugcaguuacuugaauaaaaaacaaauagccuuuucuggaca

SEQ ID NO: 12235 - RNA, 18004 nt, Mus musculus
ccgccuuucuccgggagaccgagggcuagaaggguggaucccaggaggcuccuaccccccgagcucgguuucucagccugauuggcuuguccaggugccugucacuaccgcuuucaccguugacuggccuuuagaccgccgcucuacgcggcgccgguuccgcccccgacggguguuugugguggggcugcggagucgccgaucccgccggaagcgccaggacaauggggacccgggacgacgaguacgauuaccuauucaaaggugcgccuugugggguacagacaggcgagguggcgguagcgacuggagggccgaagccgugcuacaggaacagagagcucaggguggaggcccggacuucaacggggccuauccgggcugggagucggaggaagccggggcaaguggaguucgcuaggcuucgggcccuaguacgcaguggugaggaaagggaggcucggcgaggccuacggaccccggaugcgccggggcggggccggggccuuggggggguggggcccgaggugguaggagaggccguuggggcggggcgucccgaggggcggggcuuuccuggguuuggcgggcggacugcguugaaagcaggauuguagcugguguuaaggcgaaggagaagguugugggcgugcccacaaagccugauuggugugagccuucuaggacugacugacacacccggggccuaccuuggaguggagccuggaucaugugcaggaacccuauauuauggugcuuuggaauuggguagauuggggccugucugucgacuaguucaaacucuugauauucauggagaagugauucaguugguagcauuccuagcagcagcaugcucaaagcccuggauuuuaucacuaacaccgccuuggugauggugcaggccuguagucgcaacacuugggaggcagagguaggaagaucaaaagugcagaggccaggcuggauuacuggaacccuuucucaaaggaaaaaaagaaaaaccacacauggacaacguuaaaugcaguaccuguacuauucugaaacuuuuuaauaauggucccuuuuacuccuccuuauuaguuuauacagcccauauuauccaggaaacaggccaguaguggugcacaccugcaaucccaguacucagaguuggagguaggaggauguacuggcuaguuuugugucaacuugacacagcuggaguuaccacagagaaaggagcuucaguugaggaaaugccuccauaagauccaaccguaagacauuuucucaauuagugaucaaggaggaaaggccccuuguaaguaggaccaucucugggcuggcagccuuggguuuuaucagagagcaggcugagcaagccaggggaaagcaagccaguaaagaacaucccuccauggccucugcaccagcuccugcuuucugaccugcuugaguuccaguccugacuuccuugggugaugaacagcaguauggaaguguaagccgaacaaacucuuuccuccccagcuugcuucuuggucaugauguuugugcaggaauagaaacccugacuuaagacaggauuucuuugcaguucagagccaaucugggauggugagguagcguagguauuuguguacacugccaggccugaugaccugaguucaaucuugggaccuucaugguggaagagagucugcaaauugucuucugcccgucacagguacuccacaucacauauagagauaaacugaaaaaaaaucguguaauuuagcagaguguggugucacacaccuuuaaucccagcuucaggaagcagagacagacagagcuccaugaguucaaggcaagccuggucuacauaaacgggugaggugggaguggcaagucaacagaaugagauuuuucuuguauuuuuuuuuuuuuuuucgagacaggguuucucuguguaguccuggcacucacuuuguagaccaggcuggccucgaacucacagauccgccugccucugccucccaagugcugggauuaaaggcaugugccaccacgcccggcuucuuuuaaauuuuuuaaaagcuaacuuagguuacacauccauaguaugucuuuaaaaaaaaaaguggggggggcgggggggggaaacaaguucagaaaggcagguuccuaaggguggagcaagguugagcccaagacagaucuuaccacuuagagguuaaguuuaggggcaaagauugaagcuuagauauggaaaagacaguuguuauaccuccuuccuucaacacauauguauccaauuacaggaagagcuuuccuacuuagugagccucuguccgugucauugggguuccucauuuucugaugagcauauuuagggaucucuggcauugugacaccuucuaugccaaacugagcuuuuggguccucuaaccauucaugcuggacucccugauugauagugaaugauuuugagagcuaacuccuggauccucaggggacauaccuuugcccuucugggaguguguccugguccucaaagcuagccuuggcaucuugggacuguggagguacugggguauccuuggggcaaaaggcuccugagauggagccagacagauuucugcaaagauaugauuaccacacagcaccaugggcugggagugggcucuauccagaugugagaccaauuagcagguguuagauuccggguaucacuuuagaggcagaguacguuuuggaaagguuuuggagaccagagauuugaaaggcucucuggugaugggugggacagauucaaauccugcucuguuaggggccuguccccacucagaccacccagaggaagcuucuaggcagggcaggggaucuguucucuuccagucagcacauccaggcaucugugaucauucccugcuuguuuucggcuuuuuacuguuauaaauagccuggcauugaaugugugcccuaguccucucuuugcccugugggcuaguuccuugaugugcguucccagaagagcaguuacuaggucaggggcaauggaacuccuuugccauuacugguacuugucuccagaacucacuuccuggaagcaccaaucagcuccugcagcagcuggcagugggggaguggccgccugccccgacugcccucccccacuggccuccuuuccuggucuggcagguaccuucuucaguaagucacaguagcugccuaacccccaagguuagcauucugucugugcuuacccuagguguccucuccauuccuuccaucucaucugaggauuaacauuuguccuuuccauucagacuuuaaaccauuaaauuagaaaaaggagugcuaggaaacgaaaagggaagagagcuagcagcagacaggccacuaucuucacuugccuguauauggcaaaucccucagaaugugaauacacugcaccugccagucccuuuugagacucacagccuucagaggcucaggcuuagggcaggucagccauuauaacaaugguggugaccuggucagccuuggagagucaucuuauauucaguggcaagaagauaaauucaaggucaaccuaugcuauguagcaagaccuugucucaaggaaaaaaaaaucuaugguugcacuaaaaguguuuacaggggcugauuuugucacuuuguggcucucuuugccacccguaggaacucaggaaguauaguagucuggagccuugccccacccccaaacccuagggcuggauccaccaacuuugucugucucuaccuccuuauccuaggcuuuggucacauuucuuugacauggagggccacaagucugugcuugagacagugcuuggcucauacacaaacaguuuuuggcagccacaucacacuuuggccccuuuguccuuaaggcuggggccaagaggucucaagaguggguggccacaugccauuuguuuuccuccauaaauaguuucuucagccccaggagugagguuguuuauuuguaccuaauuauagauccucacauuucuucucccaccauuuucuccugucagccacuggccauuuuccuaaccuacugguggauccccagggauagcugugauuucucugaggaacacugacuuaggguuauugcacuuugaccauccaagcuccagaguucccagccauuagugcccacccagucuucaaggacauagauccuguaggaagcacaggaauucuguuauuuuaaguuguacccacccgugcccaaggacauagaaaggacaccagggacagggcuagcccuaaaauuuguaauccucugccaaguacaucagacuaggcagcuugucugcggggccugcugugcuagggacucgcuagccucagagaugaaggcaagaauccuccccugugcuagugccugggcuaguucgagccacuucauagagugcaccuuuccuacagugggucuccagggcugcuguccugucaggacaggccagagcauccagggcuccugagaggugucagaucuuuguuuuugccaacuggacuugccuguucaagcagccaaaugacauauccagggggaccguuucccagccagcaaagccaccaacuucuuuggaaaugcugggggcuguguccugaagggcccauuauuuucccaagacaacugaucacuuguuuucuugacaaugacauuucacacccauucuacauguagagccaguccagucaccacucugguauacugggcaccuugugccagggauggcccgagcagccucgccuuccugcuguuccccugggcauggucuauugacucucagccuggucugugcauucuuguucuaaguguguaaccuuggacuggggauuuggucuccaggguugaguagcccugacugcugugggauuauugacauuugcgucugucccugggguggcccugagucauuugggcgugagcuuggcuccaggucccguccuggucguagugcaggugcuguggcugagggucccugaggcugugcaacagaggcaggacugagaagacagcgagggugugagaggccgccugagcagggcacauuuuccagguuacuucugugggcaugagaaugagcaacaaaguucuggcuguggcagcuccugagagaaggaagcgaagggcagaugcuguggagagagauucccgcaguucagcuuguuucuguauggcucagaagucagucaauaccccaacccguguuguuagaaguucuuggcucuggauuauaggcucuugucuacuagcuccacaacuauccuuuauuuuuaauuauuuauuaaaauuuuuaauuauuuauuuuuauuuuuauuuuuaauuauuuauuuauuuauaucccaaauguugcccccucucccagaauuugacauuuuggguacccagagagucuuggaaggaugcuaagccugucauuacaugucuugugaaccaggccaugugauagucugcauggggaaugaaagccugaacugaggagucucacagacuaguggaucuugaugaggagucagaguuuguuggcuaucccugaugacugcucagguguuuugaaccugggaaauaggcaggcugaggugcgcuggguuucacugccucuagggggagaaccaggaccccugaguuguaugacagagauguaaggagaaugacagggaagacaugagacuaagauggaagagaaaggccuuguuuuagagaccugacuucacauccugccuagacauuuucccaggcaaguugcucuggacauguauugcuuggugaaugugauuggggguuugggggcaaaucugcacauaaacacaggcucugacuccugcuuuguuuccacuucccugaucauagcaggguucucauuccucaacugaaccucagucuccuuuucuauaaaaugggcuguaugaggugguguuugccaucuuuuuuucacguagaagagguuuuauugggagagagagacaaggugacagcagaaagagaagaggggagagggaggaaggaagagagagagagagagagagagagagagagagagagagcgcuagcgagcgcgggugugcgagcgagcgguguuugucaucuaaacagccucuuuuuguucucucucuuaguaaucaguuuguggauuguggugguggugggguguuguuuguuuuguaguuuuguuuuuguggguuuguuuugagauagguucucacaguauaucccuggcuggccuacacuaguuuuccaauccaaugcuaggauuaaaggcaugugccaccacaacaggcuuauuuuguuuuuaagagucucaugaagcuuaggccuguuucaaacucacuauauaaccaaggauaauaaugaacuucugaucuucugccuccaucuccagaguaauuucaggguauaccaucaggcuuggcuuuaugcccaccacacucaguuuaaugcagugcuagggaucgaacccagggcuuaaugcguauuuagacaagcacuguaccaacugagcagcauccucaguacuguuuguccauugagacagggacucaaaauauaauucaagcugacauugaguuuacuauguagcccagucugucuuuaaacucaaaauucucuugcugcaaucucccgaggccuggaauuauaggcauguaacacugugccugcuucaucguuaagccugccucagucuuauuauucuuggcucuaaagcaaccauucccaaaggugaaauggguuggguucccuguuuugccucauucucaccugugcccugaggugaccugggcauccucccaguauguuacagguugauuuggacaagguaggcaggggagacccuuccaccugcuuuggggugugcuuauuuauuccacagacauuuguuggcacuugauguauaccaggcccuguguuaggccuggagauacaacagggaacaagaguccugcuuauagcgcagauagccacaaaaaagaaaagagugaaacuagacacauaugaggguugcaauagcugggggcuuagagggaggggccuaggacagagaauggggaggguugggaaaguaguuaaaauaggauuguggagagggucuucuugaccaaguggcauccacaggcuuacaaagacaugaggcaagggccagagaaagaacgaucaggcaagaauacucuguguaaagguccuaaguuaggacuguguuugauguauuaggggcagagcgggagcccauguagcuggcuagagcaugugggagagagaaggaaggggaagagguuucaggacacauagugcugugccuuguaggccccagggaggaccugggcuuugauucuuagggacuuaggacccaucuaaguucuucugcucguaagucccuggcuggggcaagcaguauggcucuagugcucacagauguuuucuuguggccgugaggaguacaagcuuuuggcugggaccucaaaagaaggcugauucugugauaacaguguaagaugacagacaaccuggccuuugaagguagcagggauaaacacacacacacacuuauacuuugucuagcaacugaauuuguauacacaaguacauauacagggcuagggauguagcucaauugguagagcgcuuuccuagaaugcaugagacccuggauucucagcccuaguaucaaauacaccagguaggcaugguaccaaauaccuauaguccccacacucaagaggaaaggcaaaaugauaaguauuucuagguauuucucagguacaucgucaauuggaggccagcuugugcuacaugagacccuaucucaaaagaaaguacacauauacguauaauucuguaugucuucagcaucugaagccaucugauggaaccuacauggguccccagaagcauucuagugucccuucaguuacaaaggggaugcaggauugaucuuagagucugagaggaagaaagaacugaagaugacuaucggugguugucaugaguaccuuucaaguugagugagucauugacugagcccaggaaggugaagguagcaccuagugaguagauugggugagcaggagacuauucuguugugcugauuugaaauguggggcucugucaggauauaaaggcagagggugcaccaaucugagcuugcagaauggagguuaauguaagagucaccagcaguauuuacagccagaagucuggggacccaguuauguggcucccuuuuauuuucaaguagaaggauagcuugcagcagcucuaacauggguaguguggcaccacugaagcacaggaagaaacaguguaggagaaggagggcccucugagcugcugcauggggacaaggcagugauaguugaccucuuucuuguagccccuaggaugucuguagguugguauauucacugggggggggggggguccugaguuccuccugaggguucuuccuauuaugugccccucagccugcuuagcagggcuagugagcucagccucaagucuguugccugacuguaucuuuuccacugcaccauuggcuccugauccaaagaugaaugcuccucccacucccuauacccuggaugacaaugcucagucuggggccugugaagccuuggagaacuggaggcagagacagaaguauagauaguacuuuguagggguuaagugugcagaaaggaggaaauuagggcagugcuuggagagguaaagcaucaagagaauguauuccuagccuggccuuuugguucacuccuauaaucccagcacuuaggagacugaggcaggacgaugaaguuaggggucagcaggacuacccugucucacuguccucuuucuuuccccuuucucuucaccccacaaaaauguauucuuuucaagaaagaaaaaucagacauguaaacugagcagcucacuugacuguaggaagggaagggggcuaccuguugggccuugagcccuccaggccuuaaaacucccagguagguccuagguuccuccugagagcucucccacuguuugucucucacacacucaguagggccagagagcucagguucagucuguggcccugccaugccugucucucccuaggcugggagccagauccugggugaauacucuuuccuauuccucaggccuuggaugaccaagccugcagcccucccuuggcucuccacugguaggcccaccucagcuacagaguuccacaccucugcuuccagggaccacaagcuuucuggcuaagguaucugauuagaugccuacugccaaucacaucugcauuguguacaugugaacagaaaugugagcauguguacaugugaacacaugcauggugaauccugggacuaagaacagcccucccaggcccugucccugggggcagacauggcuuuuugagacagggucucacuguguagguuugaauggccuggagcuugauauguagaccaggcuggccucccaagugcugggauuaaagaucuuagauuucuaaucagccugccuccacuucgggaguucugggauuacaguucuguuauuacaggcaugcaccaccaugcucuguuuaugcggugcuggagacugaaccaagggcuugacccaugguaggcagucuaucaucugagcugcagcccgagguucauaucuucaugauuggcuccagcugcaaggaggcauucacaggguuagagaccuuuucugccugucacuguuacaaggcuaguuuuuaggcuaaaggaagccauacacacuuacauaucaaccuuauaaagagaugacagugaugggacccucuaggagcacugaguagaguaauccugaccucaggcaggagugguggccagcugugucuagacugcagccagaacgcauauuccuguuguucauuugacugucaguguugucugaagcagcuggagaagaagcauggacagggaggugcauugcuuccuguuacuuaaaacaccggacacaaacucuaauagauaguaacccauccugugcccugaacaaagccauuguaauaaugacgugcucaccugugucccuucuuuguacugcaugcuggcugguuccugacucuguguacucucauuuccaucuuucaaguaggccagcugccuuccuguucacacauguagaauagguggcccagaaagguuaagugacuuguucaaggucacucaacuucagaccuuucuuucugugaccauucuugacuuacucagcugucagguuggugaguuucaagccacccuccuacaguauggccuggaaugucaccauauucuagcugggacaaucuuccucugaaggcaagagacaggcgaaggcaccugugcuguuucugaagcuuccacuuaccagugugucccagcgugggaaaauccguggguggcagaaaucagggagccaccaugcagguuugcuggguggauaugggaaacauugguugcugccggauccucaccucuccucccucucucccugcccgcaaguggugcuuauuggggacucagguguagguaagagcaaccugcugucacgcuucaccagaaacgaauucaaccuagagagcaagaguaccaucggaguggaguucgccacucgcagcauucagguggacggcaagaccaucaaggcucagaucugggacacugcuggccaggagcgcuaccgugccauuaccucugcgugaguuuagcuagggucaagaccuagagauagcagggguguguggauauaugucaugggagcuuggaaggguauguaggggcugaacuagagcauggaaaauuugagaucagggcugugggacccagaggcagaccaauauccagccuauugcgcaaccuggcugugagguuauuacuggguagacagugaaggucuagcuuaggccuuccauuuucacccaaccucacccaggcagccuaccugcuuuucuauuccuggcaucuucucccagucuuagcauacauuuugccucccaguugcuaagacccacccagauugccucuuugugacccccaacccccuggcuguugccucaccucauuuguugugcuuugcauuuucuucaccauggccucaucauggguccuuuauccccagaggauggaaauggucccaucugugguacaggccuguuugcacaguggacacuggcacuucugccugguugcagccuuuucccuacacggcugcuguaucuucuccuucuauugauggccuuugagugucuucuauuacugagccccaaauucccuccucagucucucccauuccugaagggccuccuucaaagauaggacgacugccccuucugggcccugugcuugggccauccuguaggguuuccaugaggcugccaccgcccucccaucuaaggcuccuaucuguacuuacucugcagguacuaccguggugcagugggugcacugcugguauaugacauugccaagcacuugacauaugagaacguggagcgcuggcugaaggagcugcgggaucaugcagauagcaacauugucaucaugcuggugggcaacaagagugaccugcgccaccuucgggcugugcccacugaugaggcccgugccuuugcaggugagcuuguggcagacaugccagacugugcucugagaacuagacuggacagguucagagaaacaucuagaaguccggcacccaccuccuccagugucaaggcucauagucauagugcuuguguucagccucuugucccucaguggucccaccuacuagcagcaacucuucagauccugaguuggcaggugggcagguaugguccuggaggggagugucgugagaggggugugggagccagacccucuuauuuagagagaauuuucucuuuuccagaaaagaacaacuuguccuucauugagaccucagccuuggauuccaccaauguagaggaagcauucaagaacauccucacaggugggccccgggucuggguggccguuaggaagugcuuuauguguaggacccaguauagaccuuccuugccccacagaaucaggacauagcuagcccuugcuggcauguggacacagagguccucaccuaagucccugugaugugggcccuucugggucugcaggggaaggaaggaacaagcagccuggguuagauaggaccgguucugugacuugcuccugccccugcccacuuggcugugccugggaaccuccaagagcccaaccccgaauucuguuuuacugugaugugguagggguucccuacagugugguggagaauugucuuuguuuccuauugcuaugauaaaauacucuaaaaaaggggcaaauucggcauuuauuuuggcugucagcuuaagguacuagaagcagcuggucaugccaucacagucaggagacuggggauccaugcaagcuaccacuucgcucccuuucuccacuaaacagcugagcauccccugcagggaauggcucugcccacgucaauuaaugucaucaagauccuccccgacgggcgugcucagaggcccuucucccaagugauucuaggcucugucgaguuggagauuaggaaucaucuagccaauacccugcagaaagguaaauugccuucccuaggguacacagcuugcucacgacauccucccuguugcagaaaucuaccguauugugucacagaagcaaaucgcugaccgugcagcccacgaugaguccccuggcaacaacgugguggacaucagugugccacccaccaccgauggacagagacccaacaagcugcagugcugccagagccugugacugcccugcacuuucuuuuucuuuugguuuugguuuguuuuguuuuguuuuucuugguuuuuuuugguuuuucgagacaggguuucucuguguagcccuggcaguccugggacucacucugucaaccaggcuggccucgaacucagaaauccaccugccucugccucccaagugcugggauuaaaggcgugcgccaccacugcccggcuugcccugcacuuugacccagcgugcgugcacguccucgauccuuggccagcccuucaccaguguccucccggccccucccuugucccucuaggacaggcugcucccacccuccaagugagcuccgccugccagcccaauggcccaggaagagcaggaguccaguggccucuccuguccugccugcucaagagaagcuaaaagccccuugcuuauguaccugcucuuggauauugugggcaucuugacaggauagggagguugguaggauggacaaggccagccagaggugaggaagaugaguggaaggaaccugcuucuccuguuuuccagacuucagagaucgaaaccgccuuuccucucuggccaguugaccagcuggcccuguauccucaucccaaacucucucugagcugauacccgaagagccaggcaucagaggcugagcagguggacauucugggcucugccuccugccuacaccaccauagccagugccagcacggccuccagcauucccaggccugcgcacuccugcuccugccuguagauuuaugcugggagaagacacccuugccccucucccuccuccucugcacgcagcgcucuccucugcccauccccacuucucugucucgucuccgugucuggucaggaaccugucugcaagugaagcaauaucuucguguuuuguauauacaacugcucuuguagccuuugguuuuuguuauuguagagaacagauucuuuauacacuuuguaaaauuuacgccaaaccccagcucucgaacucuuauucucccuguagcccuugcacuguugcccguuacuaaaauguauaagccacuucuguacagaaaccuaccacucagcuucugucuucuuucucuccaccaaaugaugcaccugaaccagggcccuuuuacguguccccaauaguagguuagcguaguaccugcugaagacagugggcagacaugcugaucuugcacaguaggcugugagauaaggaucuugggcuccaaggaggggagagugaguccucugcaaguggcuccuguaguauggaggaaggaaaugauggugaccugaaguggcagccuucacuuggaacaguuuaaggagaaguuguaccagccuuucccaaaucguuuguaucuaggauugacaggccuaggaugcccccuggugugaaugggaagcaugagcaugcuugccacuuccaucugcugccaacaauggacuccuuaucuggaguccuggcaaggaaggugugcuugauaacagugggugaugucagcucuaccauggcugucuuuacucaagaaugacacuugauggggacaguagagggcaacagugacuacaaggugagcagcucuugaucuucacuggcgcuucccagaacccauugcccuuguuccuguacccaaagcagauaguaaguaacgagauguguucuucuccaccccugaaggaaaucuuacaauccaaauacagccagcuauucuagaaacccucaucucuaaaugaagagaaccuggggguguccugccuccugauucuggaaugaauguagccuccuuguguguguuggaagagggaaguggucaaucccagauacaucucucagauccaagcugggcacaguggcucagacuuguuaccucauacuuuggagguggugacaggagaucaggaguucaaggccagccucagcuacauaagacccugucuaagaaaauaaaauuuaaauuaaaaaaaaaaaaaaaggaaaaacuaaagaccccaaagaaguugggguggauuuuaugggcaucucacaauccagaaguuacccuuggccaaagcuaugauggaagguggacugucuagcagacauaagcaggagguagcauaggucuaagacucagcucgcaggaacugccaauggaguugacguacuggaagaaccaacuccaaguugucuucugauuuccacaugacacuaaauauuuuuacaaaacaaaugucacugggugggggcaaaggcucuagguaaaagugcugcaugaguacagcucccagaacucacaaaguuggacucaauguaaacaccuguaaugucaacaauccuucggggaaaugagaggcagagccaggguauucagaagcucguggacuagcuucuguagagguaaaacaagaaagacccugucucaaaccaugugaaagaugaggacucccuauaaaguuguccucccaccuggacccuuaggagagacuauuugcacacacaaaugugcacauagccacaugcaaugugcacacacaaauguauccacauagaguauacacugaugcucucacaguguacacacguaaguagauaugcaauguccaugcaacacauuauaugcuuugguuguaagaaauggaaaaaucaaggagaacugaucuggaagcuuccugccuagcuuucauagugccagaagcuguguagcagcuagaggagaacugucuuugacagcucugccuguagacccugcuacaguacuaacauguuaggcaagauaugccugcuggugccauaguggcaugacuuacgaguagcaguuccuuucugauuaaaucuaaagcccauuccacagaagugaguucacauuugguaccgugagccuagucaaaagcuugcagcuagggauguuguaggcucuuacaggaugcacaugccugcacucaccuauacuagcauugucuuucacaacaaaaauaaaauuagugcauaagcaacucauuuuauuguuuggucaagcuuuuagcugcuguguccagguagggacuagacuagaacuagaggcagaauauccagggcuaagucuaagccaaacaaacuuuuauuauagaaucguuggguuuguaacugucauaguguagcaagggacuggagaaaacacuacaaagaccaacacaugaaagacaaaaacacaaaacuacugaaaacccuuccccacaugcaacaaacggaaccugcucaagaaagcccgugaacuugggaggcaggaguaucccuuaguuugaggccagucuggucuacauagcaaauuccaggacuauacaggaaaaagagaaagcccaagauauaaaaauguggggaagcagguacaaugcuaaugcaccucuaaugaaucaugaaccuuguggcuuagcaugucugaguacauauuuuccccucagcucacagagcucuugcuguccaggccuugauuuguaauccaggguggcccugaacucaagagaucuaccugccucuaccuccugaaugcugggauuaaaggcauguaccacuaugcccagcuugcuuuuucuuucuuuuugaaacauuauguguaugcauguuuugacugcauguaugucuguauaccacaugcaugcaguuuccacagaggucagaugaacaugucaacuggaguuacaaauaguuguaaacugccaugugagugcugggaauugaaccugaguccucuaguagagcaaccugugcuauuaaucacaaagccauuuccaucuuuccuuuucuuuauaaacuuucucuuuuugucucuuuauauauguauauguugaguuugucaugucugcaugguguauguucauauguguguagagaugcgcauauaccuauggagaguaccagagguaaguuagaaagugucuuccucuauuugagguaggauuucucccagcaagcccaagcaauccccuucucccugcaucaucagugcugggaucacagaugugugcagggugacacuugguuuauuacauggaugauggcacucaaggucuggucuucuugcuuacacagcaagugcucuuagccacuaagccaccauucagcccuagacucuauuucuaaccauauguccuagugcaauucucuguccuggaacaguagacccuggaaaccucaguggguggccucgaaacucugauccgaaccugaaacaauauguuagugguguugggaagugugaccuuucugaguuaacuagaaacagaugaggucaucagaguagggcucccaugacagcauugcagcuucauaagaugaggaagagagacccagcucggcacacuuagcgucucaccuugcaauuccuucugccacguuacaaaguuguaagaaguucuucaccagauguugcaccuugcuccuagaccucucagucaucagaauagugaauuaaauaagcaucuauacuuuaaaaaauuauauucuaugucugccugccugccugucugucugucuaucugagcuuaguggacaauuuauuuucuggaauugauucuucuucacuguguggguuccagggaucaaacugaaguugugaggcuugguggugggcacccuuaccugccgaauuauccaacugacccuccucuuuccaauauccugcucccaaacccuuugucacggcaacuaaaaugaucuuagacaggcgauguggcuagaaguuugauuggaugugaguuggaaggggcuguugggaagaugaauaacuauucuggaccaagggagccggagcagucagagaaugaagagucugggauaauuuugguacuugguuaguauuagaagauuauuuuggcuggcuuaaugucaacuugacccaagcuagacacaucugaaagaagagacuaucaguugaaaaaaaaaugccugcauaaguuccagcuauaaagcauuuucugaauuagugauugauggggcuagagggcccgguccauuguagguugugucuccccuggguuggugguucuggguucuguaagaaaggcuaagcaagccaugaagagcaagcugauaagcagcacucaucuucugcauuggcuucagccuccaggaccuuacccuguuugagguccugucuugaccuucuucagugauggauuacaguaugaagugugagccaauaaacccuuuccuucucaacuugca

SEQ ID NO: 12236 - RNA, 7795 nt, Mus musculus
uucagguaguguuuugguuuauuuucuuaguguugucacagugacaggaauccccagagugggacaagaaccucuugucacugcccucugccccaggcucagccucuaggccuucccuuggccugucacaggcuggcauguggcagggaccaguacucuucccagcacagaugauaaugccacauuccgcagagguggaagcuagaugcagguauccaacaugguuacguggucaccagucccacggggcuggggcuggggcuggcuuccgcagugguuucguaaacaggugacuucacugucccaggguggcuggccaccuuucaggguuucugcucuaauauuguggccaccauguguggcugcucacuccugguaugaguugcuauguaaaccaauaggacuucauccucagaacagugcccgugcaaucuuccuccccguggccuugauccugggaaaggagcccccuccccccucgcucggaggaguuccugaggcagaggggccgcugugggaacccgggguggcagcagagggucuucugcgcugccgcaggaggaagucaugagaugcaccauccauggcauagaagacguuagcugagugugggauggucagcucuguggguucagaagagggcggggauuagcguucggcccucucuccgagcgccucccuucagugcgccaucccuccauccugcucaccucgauccccagguagcagcugcaccagcucgaacucugaagccacagcagaaucacgauuguuuuucuuaaggacacgacuaauaacacuuggagcuuuguccuggcuugucaccuugcagaagagauuaaaugaacaauaaacaagucgggcagugguggcgcacucaggaggcugaggcaaggggaucugaguucuaggccagccugguccggucuacacagugagugcuaggauguacagggcuacccaaagaaacccugucuuggcgggagucagggggaacaauaaauauaccaugaugaccuguuucccguccuuuuaacaccaaccaaaacaggucaccugugucuuaauacuuaaaaaaaaaaaaaaaaaaaaaaaaaaagccgggcggugguggcgcacgccuuuaaucccagcacucgggaggcagaggcaggcagauugcugaguuccaggacagccagggcuauacagagaaacucugucuccaaaaacaaaacaaaaaacaaaacaaaaagccaggugguaguggccaaugacuuuaaucccagcaccugggaggcagaggcaggcggauuucugaguucaaggccagucuggucuacagagugaguucuaggacagccagggcuauacagagaaaucgagucucagaauacaauaaaauaaacaagaaacccaauauaguggcugccagugccccaucagccagcccacguagcucccagcgcagcaaagcugcaucccugugggaaaacugcuggcucugaucacgucauacagcuccgaaaacucagaucguggcucacuaaugcacaguugccaccaacaucaaacaacugccugaguuccacagaagcuacaauugaguccuggcuacccaaaccaagccgaaugccuaauaagguaagguccgccccgccccaggcucccucaccaggaugcucuuguagacgcugccauccucccccagcuccaucuggacucggaugauucggcaaucagaggacccuggcccagauaccccgcccccacauccagcacuccuagaggucccuucuccuguguuuccacucaacggagacccacaggaggcugagcgacggugaccccgggaaggccuaggggaggaggcuggaggagagagguggccagggucagcagggcugugcaaggaggggcugcuuuccagggcagaguccagagaugagacugauggccacuucaugugcuaggggcaaagaggugaggucaugagcgaacggaggccgaagggaaaaguccugauguggucagaggcgagagcaggcucaccugggcgaggcgagucagcagaggugcugggguuccaggcaccucaucucccccgacacugggccgaucccaggacacaagcggaguggggccuccaacagagcccagaacucugcagaggcaagauaucagacagugacagcggcagcagcaaguccccaugaaaccagcucccagccagccagccagcaguguccucacuccguccacugugugaucacuaguguuggccgagguguccuugcagcgggggagucacuggucccugguggcuccacuucacaggauacacggugacuggacaggauagccaugggcagaggucaggacaugccaccaauacacacauacacacauguccccgagccagaguccuagaacccgaccacccagccauucaccucugagcuucaguuaaaggcuggaggcccuggagccauugcuggauaucagaguuaggucggaggucguagccacgacauucuuucuggaggcgcaacagcuccgaaaggauagcaaacuccugggaaggagcccucagacugcaggagccaaaacucagggccccugacuucaccucccucucccccuuccugggaacacagagagggaaauccaccacccagccccacccccacacuccucucaccuuccuccgcuugucaaaauugauguagccauucugcaagggcaguaggagggggauaaggggcuaacccugcucaggcgccagcgagaacauccccucccccaagcacaccucggcaucccaucccuccucaccuucccagucacgucucagaccugaacccaucuugacuugauccuuuuuuguuuauauuuugagacugggacucacuguguagccuuggcuguccuagagaccuucccccaacccccaccccaaugccuccaaagugccgagagaucacaggcgaugcccagcuccacuugacacucagagaguaucuagccacuagaugagaaaauggagcccacagugggacaaggaacuuucuggaagccucggcguuucauuuucuuugcaacgcuggggauggaacccggggucuugaccaugccagggagucagucacaccaccgaccgccaccuacucagccuuuguauauuuaauaaacuguaugugccgaagcuuccaguaugcccugagcacuugacaaauacaaaagcauguaucucucccacuaacaggcuguuguacauacggugggacagauagugacagacuacugacguacagagguugaacuacuucccgugguaacagaaccugacucgagagacugcccuguuucuccugccuguagccucucugugaaaggcugucugccugaccugaggugcacauguugagucacccagggcagaucacacacacagacacacaccacaccacauacacacacacaucacacacacacacacacaccucacauacacucacacaccacacacacacagaucacacacacacacacacauacacacacacacacacacaccacacacagaucacacacacauacacauacccacgaucacacacacauacacauacgcgcgcacgcccgcucgcgcgcgcacacacacacacacacagaucacacacacacagaucacacccacacccacacauacacccacacaccacacacacacugaccuccagcucauccuuggaggccgcauccagcaucacgagguccuucaggaagguucccagguagggaaccacacccugcaggcagagauggcagagaucaggaugugagcccuucucccuuucccucagacacaacuguguauucuccucaccagguaagccacccauucccagccccacugaacacucaccccaccccugaagccagaccuuggggccuucuuggaguguggcuccacagggggcugcggcuucacuuccuggugacaaagcaaggugagagaggagggggcuggggaggagggggcaggugcagagaggcuggggaaagcaagaccgcccucaccugcaugaggagcucucugcucugggaauaauuauccuccucugagaaaaucuggcacaggcuggaaaagacucggaggcugucccuagagaggaagaacaggccucugagcacaagccuggcguuccgaagcuuccgcaccccaggccucgggcacuucaguccuccuaccugguugucuccccccaggcugcccgaagccuguggauagggcuggacugcagagcggacacaacagcauacacugaggagaaguuccgaagcaggcggcacuccugugaggaccggagaacagucaaggcucuagggucccucaccacuccggagacgaagaguccccagccagcaggccugcucucucuuaccucggccacacggauccacuucucuaggagccgggcccucugugggggccgcaguggucucacagucaccucucuuggccccucuccaauugagguggcccccaagacagagcuaacuaccgcccccgccaccuuguugaacugugugacgguagcucggacagacgggcagaggugagaauguccuggccggucucugugaccccagaggccucccaaacacugagaggggaucagauuaagaaacaguuccugcagggcagagguuacaauuuagagucaagccagacaaguuuccaguaucagggaucugaggcucuuaaguggccagggaccaguggggccagaguucaaggggaacagccaaggggcgaagggcagagaagggucagagaagcagacacggaagaggaacugcaccaggacaauuggaagcaagaaaaggauccggagccaaggagagguuaguaagggggcagagaguguggggucaaaggucaaggucucaccgcaucuagcagggucagcuguucggccaaguggucagcgaggaacaccaggacauccguggggucagcaggggaaucgccaggaagggccaggggcuuaggaaggucgggggcccggggguccacccgggcccggagguuucggaugaggucagcacugccccccacaacacccucccgugcugcauacccuguccgaagcaagaagcucucaagccggucaaguugacccuugaccucagagccaaaauccucagggugagaggccagccaaguugaaaguacagagauggcuacccugagagaaggggaaucagccaggggucagaggucuagccucagcacccugaggggacugagguucagacagggccacucacccugugguccucucuagcucaccgggaggaugagauucaagggcuuccagccuggggaugaggagagggucuaccuuguggcuuuuccagcccccgcuggugcugggggugcucaaagggaauccaggagccuccuaacccuuggccccugaccugucagccacaagcccaaacagggcaggaguggaggugaaggcccgguggguggccagcaaggccggagugaacaucaugucagccccugcuguccuggcauccaagaggugucugaccagggccuccagagugccagcgcggagccgucgggaggagcgagguggaggcaagggagccuggagaacauggagggugucucaccgacgggccuccucaaucugacugcuagacaucugggauaauccagaucuagcuuauuucugccccgguucagaaauggcuuaaaucacacaacacagaacuaccuucacacuaccagaacuucuucaaccuaauguuccggaaaauaaauaaauaaauauuaaauuaaaaaccgagaggcaagaccucaaagucgugaucucaccaaggggucaagaggccuguacuggcggcuugugacaguaaaggucgcaccauccuccuccucgucccagacugacacagaagccuggaggagcaagaagaggaagugaguuccacagcaccuccaguccccagccauuguccccaggcccuguuccucccucugcaccccucaccugugauggcgggggacaauaccagcgagugcgagggguagaggguacuggugaccccaggucuaccccacccuggggcucagacagcccccccggccaccucagagcucggugggauggaagagguugcagugaggguuucaacugaaugcaggaaccccucuucuggccaccuccaaccccccuugucccacagcugagcccaacgcagaaaagcagggcgcaaagucaggagcagagcgcgcccgaagaggcacaaagccaaaggaagagagaccugaagcagagagaagcugaaacuucacaaggcccgcccucccugacagaaccagaggagcccaaauuuaguccuuccgcagagacuccuuuuccccagguccccaauacagcuuccacuuaaucucagcacuggggacccccugaagguggcggcuccaaucccaguuacaagaaggggaaguaaggaugauggggggggggggcgguagacucagagucauguggcccuagccccucccccgaccgaucccgaaaaaccagccuugcuagucacccuaacuuuaccaaugucggggcccaggagucuggauccucgggcuccgaaucuaacuucuggacccuccugaaucccuaaaucuugcugcggacuacauccuaucagucucuuuggacgaagaugaccacgcucuaccuaucccgggaucaucucuccaggugccggaaccucuuggcuugcugcccucuauugagcaccagggggugggggaagaggcggcgaaaucugaggguucccuccccaauccuagagucugaggagcugguuacuguggaaacaaaccccucccagccaaacaaaaaacgaggagggagacagggaccaagauacaacugcccaguggcacccgucuaagcagguaugggcaaagagggccugagccccgcaggcacagucagcccgucugccagccagccauucugguuccggcagguuccuacgggcagguuccgagcagacagacagggcgaacuucauagacaccaggacccgcagccaggggacagauauccagagagaguguggcgggcgggaugcgagugaggcggggaggaagagaccgagggacccagagacaccgaaaggaggagagucucagaaauauuuaaugcccugccucccgccacccgcgucucaccucuucuucuuccucauccucuuccuccugccccccgcccacggcccggccaccuggguccccacccucuucggggucccggcuccggaagcugcucagcacgacucccccggggggggucguguccaaaagcagccgcaggggccgcgggagcauggccgagagaagcaaucagcggggucgggccaugggggcgccuggggagagacgggugggauuggguggagucagacgggcgugggggagacggacaagaagggaccuaggugggagucccugaggaaggcugggggagggagauacgggaguggggaaacccaagcccucggugcuugcuugggacuugggggcuaacuagugcggaaugggcagggucacccggugcuccggcucugaccugcucgggaagggcgagggcugcgcgcgggucccgggccucuguucuugucggucucuggcccucuaccgaguccccuccccggcuuuuccgcgaugccccccuccugcaccccgccgggcucccgggcccucccgcccuuuccgcuuccc

SEQ ID NO: 12237 - RNA, 206724 nt, Mus musculus
uucaauauggccgccaaacagacucauccauucugccgcuagaauucaaaacaguuggggaacugcuguggcuuccgucagcgucaacaccaucauucugguuaggcaaauuuggauuuaauagcgugcugccauucgaggugguggugcauggugggaccauccuggaaggagaccggucucccccggguaccauugggaacugauaggaugcugacgaaguaccauaguagagauauggagugcugcuggucuggaaggguccacucuggcuuugggaagagccgggguagggugguggcagguacgugugguagugagugguggcggacaugccgagggacaugccugacgugacuggcgggguguagguaaagguggcuggguagugcauucguggguuggagaagcggcucucagugagggaugaaaugcuugggaacugccuggggucugaaaaagggcccaguucugaagcaccuaaaaauuacaacagaagauggggagggaaacaucuguaaauaucaauuaaaaugauagaaacguuacaaaauuaaaaaaaaaauuaaaaggaagaugaggaaaacuuagcuuucucccaaggcacagcaagucacacacagauuucaaaugcacugcucaacucagggucuuuacuuguuuaccuuacagucucuauacuauuuauccuugaggucuccacaccgggagagucacaaagggcuuuuacaggcacccuguggaagccaccucaacucuaggcacaggaucacuugccagacuuuaaggcuggaucuucauugguuccccaccaccaccaccaccaccucccuuuuuguuucuuauuacagucuagguaucugaagugaaacuuuuacuaaaucaaaccaacugguuuuuccuaacucaguguaaaaauuaaauccaaaguaauaggauuuauuaguguuccccucuugguggggcuucuuuguuaggaaaaauugcaucaagcagauucccuuuacauagucuuucuauuucuuuuaaccuuuaagagaauuuaaaaucuuauuauaauccucaucuuagucacagugaaauuaaagcagauuucaguaaucuaacacuaucucgcuuuucugggggugucggggagagucuagcccucagaaauucucccuugagucauaaacuagauaagaagguauggcgagggaagguggaggacggguuggggggaugugguggaggguggaggaccuugacagucagagccuugaugagugacauaggaccugauuuaggccagauacccauagcaacuuuguuuaagggcugaugccuaggggagacugagcugggagaugcucccugcugggucccugucccugcagugugagcucuggagccuucaaagauuagaggcagagauggcugcuccacuagcacuuccacaagcuaucagcggcuccuugggagcuacuucugcugucuaacucccgaaagaguggcuagagacuuugcccguagaaacuaguuuucugaaauggauaaaacucauaagcugugaucuugggguucgcuauaauuuucuagagucggcagaauuacaacaagcccuuuugguacaucacuauuuccgugcuaaguuuguggugucuucuaaagucccccucgcugauuggcuuggagucuuccgucugccuuugcuacagguuuuagcuguaagagaaaaugcugggcaaaucuugaagaccauaauugucccucggccugauuuguacucaacacagcucgcuaugugucuucaaagggucugucagagggugguaguguuuguuaaaaugcacauugcuugugaucuucaccguacgcugggauuucagugugugaaaugcauuugucauacacagugacugcuuaaaagcaauguaagaguuaauaaaaccuucugucucacaaaccagaagacaguagccauaagacaguccagcccagcccagcccagcccagcccugcccagcccugcccugcccagcccagcccagcccugcccagcccugcccagcccagcccagcccugccccgcccagcccagcccagcccagcccagcccagcccagcaauugugaaaagucucaccugccuggcucuucuuacugagagaggaaggccagaggcagaagucagagguggcagugucaucaucuggaaaaugaggggacgaacucuaaguucccuuccagcucuaggacuggcaucuggucuacaucauuaauuccaaggcaggaggagaaacaagggccuuggggguggugggggugggggggucccaucccucacuagugccuucccaggauccccaggcccauuugcagaagguggacagcaaaugagccgccuccaacaccagaagcaaacacuuucaagaugacagacuaaaacgcaugcagccaggcacucuguagucugcuucuuauaaacccccuuuccuuccuugacuggccucucccucacccgucccaucccccuaaaugaaauucugacaagcucaaguuuuagaagguggaaauaauaaugagacaguggcagacucagacauaggagcagaugagaguacccaccucccuucccuguguuuauaggcugccucaaacaagaccccaagcagaggccacaggugguccucagcagcccucuugccccacagcaucuaggugaccuaauagauauaggcaggccccuuccaugugcauuaaguucaauacccagggcgugugaagaaagccagaauagccgggguaauuuaaaacggaaagaagucacacuuggaacaucaacauucacccuuccaggaagcacagacuucacacacagauagacacguugcuuuuuuuuuuuuuaaggcuucuaacguguauuuauuuucccuuaaaacuauguuuuaagaauaauuaacauuccauaugguuucacuuauuuugaugcagaaaucucauuaaaagucuuuaugagaggacccugcuaguaaacucugauauggcuuuguacuucuuaccacacaccucuguuuuagcugcuacauuuugcugauguuuugauuacucagcggaauaugccaagaucguuauagcuuugggguugagaaacguuaccuaacacaaacugauggucauuuuucagugaaagagcucugguuggguucguuuaucucaauggaaacaaggggauacgugucacuuccagucauuugagacugugauguguugaggaucaacuucuuaaaugacugaacuaaaguagaucugaaagggauuauaagagacuuuuguaaucgauggacauccgcauuuucuggaauuugcucagucauuuuaggcuaacgagcauuauuucugaaguagacugcaguguauuuaggcacaaagaaauaaugagagauugucauguguggugggcaggugggggguggauccuaauagaaaccuguuuguuuauaaucauuguuucagaagagcgaaaugcagcuacguuuucucucccugaacgggucuucaugugaaccuguaaucgggcuguaaaaaagcugcagugugucagaccuccuccuguuuggauguuauugacaaugacacuauuccuuucuguuacagccacaacacuuuaaaaaaaaaaaaaaaaaaaaagaaccgauacugaauugucuauggaaaaugucaauccgacuuguuaaaaaaaaauacccauaagauaaaaccccaggagaguucuagaggugcuuguaugccaucuacuuuguauaugcaaaugcaccucuaucuacuuuguauaugcaaaaguaccuccaucuaauuuguauaugcaaauaugccucugucuaauuuguauaugcaaauccaccccaaccucacccacacccauacccagcuccaaagacaagccuguaaucucagggcaacccaaagccauccuaaagcuccuagcuacugaauaagucaagccaaggccauucucuuugcuguugcccauggaugaucuuguccccguacaagguacguuaaacugugcugaaaaaauggaagcugccaggaaauagaggguucaaccauccacgugagaucuucugguucuaaugcuuuuaaaauuaaccuguuaugggaggacaugaccuguaaucccaggaccaaggggauuaagauaggacuauggcaucuucaagaccaaccucuaagacauggugagcuccaggcuaguuggggcuucugggcuaagaucccuaucucaaaacaaaaucaaaguuucaaaauggcaucuggcugugccugggggcuggcgggaguuagugaaaccccaagaggaugcuaguuugacucaacauggagacaagagugacgcuguacaguaaauuugaaaaaccaugacagggagaggacugugacacuuuggugaauuuuuggauaaauuaaaaaugacuaccacaaaacuguguacuuaucacgcuuucugcuauguccccugauuucccauggaccucccucugcuggucaggcacugaugggagauucuaauggacugucaucuaaucuacauuugacaacuagggaggcugaagcccagaggagagccaugcacacagugaaggagguagagccaguaugcagccacccuuugguuucuaggagaggacaggcagucugcauuauccuuuacccucagaauaugauugaacucaccacauccuccucccauucuucucacuagaucugucuaaauggaaaggacuuacguagacucuuuugguaucucagugucaccccagugauaauuacuaguuugggggaacccucuuaaccuccacuuuggcgacacugucgaucuaaucugauaaaacaguuagcaaccaguuucaguugcucaggguacaagaaggaugggggucggggucaaggggucaaggucaagagcuccguucuccuggcuuccuacagaugugcuucauuccaaagcugcagucuccagucccagccacagcuggacagcuugcaaacaaauguagcugccauaaggaagaacugaaagagccuugcucgggaagcaguaguagcagcagcagcagccgccucucgagcucugagacauacugggaagaauacauuaauaaaaugcccgugagguccaaauuaaaacaaagccaauguuaaaaguaaggacacucugccucucucccugcaaggucuguaagaggaaaggggccagacagacucucuaccuagucggguuucugggagucuucagagaaggggggaaguaugugagcccaggcaagggggauacaagugagccucuggcucuucaagcuuccaauccuuaccguaggucuuucauucacugcuacuuacccugaaucaugucugucucccaauuaaagacagcuguugaaggcauagaucucucaucagagcuugcuaaugggaauaaucagacuuucuuucuuuuuuaauaaaaagguauuuaauuuauuccucucucucucucucugugugugugugugugugugugugugugugugugugugugacugugugucugugugugucuguauauucuauacauguauggguacccauaaaggcagaaaggauuagcauggaaccaucucucuggucccucuccccuuuuuggacuacaggggauggaaccuacaaucucaggcaugcuagacuaccuugugagcuccagcccacugcuaauaaucugcauuuccaagcccuaucuuuaaucugcccuaucuuuaagacaccguuaucauuuaggauaccuuuacuaaacaaugguugccugaccacaggcaaggaggucuuuauaacaaaaggaaccuggaauguaaggauaauggaggaaguacuugucuguaaagggcaccggcuggggaacugggcacgguuagcuuccccaccaaauacuuaguagaaugacccagcaggaggaggcaggggcugaagaaaugcagagccuugagucuagcugaaccuacacuggcacacccagagcccaugcuugccugugaggacaucacugcucagcacgaaaagccagcagaucuggcagcgaggcguuaacuucagcgcuauguuaggucuggcuacacggcaaaucucaaauaaagcucaugaacuuuuuuuuauuauuauuauuagcgugagacauccuuccugggaacacagaccacacaagaccuacucggggcugcugucuucugguagugcgcaggcuucuuccgcuucaacgcuuuggcugccucauuccaacugccugcuuacauaauagccuccuauuucaguucccuuccaacagcgcucauuuccuacgccacuggucugagcccuugcuggagacugggcugacuuauuauuauuagcuguuucuuggucugcucgcuccaacuagagucagcuuugcaagacggaggauuuacuuuccucuuacaucccucccagaacccgaugcaacuguaagggcuucgaaugcgaaaaauaugugggcgguuggaggaaaaaaaaaaaaaaacaaagcaaguaaaugaaugaacguaagcaucaucagcaaggcaucucagugacagggcccgggggccacaacacagacacagcacaggcaucaggagcgccgggggagcuggggagauggcucagcaguuaaagcauucgcuguaacuccaguccaaggggaucagauacacccuggccuuaagggcaccugugcagauauaauauaaugcauacaaacucaccccauagucaugcgauuuacauauaaauggaauuaauaaagacuucccuuuuuuaaaaaacaaaacaaaacaaaaaaacaaaacaaaacaaaagugcagguggcucaggucuguugucucaggacuccagaggcugaggcauacagaucacuaugcgauuagguccagaggagacaacauagugaauuugaggccagcuuagguuggcuacauaggaagaugucuuaacaacaaaagucaaauacuguagaaaaagaugcauuaagcaauguugacaugaaaucuaaaguguagguugaguacacugcacaccuaaguccgugcuaaaugcucuuuuuaaugggcacaaagauguucucagcccucagcaagucaccugaccucagacuucagagcacccauccagcaacaucugccacuaagaaacagaugucccuguuuuauuagcauccugucccuuccuuccugacacccacucuaccuaagagccagugagcacuggcaagaccuuggggaagagaugaacagggaaguggggagaagcagagcagacgugugcccuuccacacagcugguacacuugucccugcccaagagccugcggcaucacugccauuaaagucaugggguuucuuuggagucaguaagguaaugggggaguaaacuugaaucucucugaacaucugcacuuguaugaacagccagcauuucagagucauugaucaucauuaauggggcugggauguagcgccacgguacaagcacuugccuagcuugcaaaaagaccccaccuuccauagcuaaaacuggaagaagaggaaaggaaagaagagcuaaagagaaugaaacauagauaauuuugacaguuaagacacaagagucuaugaguccaugagggucagggacaacagggacuccaaaguguccuccggucacagacccaacaucuccccucuccauccccuuccccucuccucugccaccugauaagacagaaagugguggugggaagggcaccugaugagacucagcagggcuacugugcuaaggugggacgacaaggaaccuuuguaugcaugcacaguugguuucuacauagccuguccuguuccuccggauguggaugcuuccuguggauggucacaaacuuggggcucucggcuaaguuugacuguggcuaccccacacaggguucccagagcaaggaaagcaagcaccaacugaagaacucaugaccacgagcagaacgcccaccucccaugguguauaaaucuguacuacuuccuuaucaugcauaccugggauauuuguguccauaaauacuaccaagccauuuaaaugaaaacauggacauuggcauuaauguuguuuuuagauagauauuuuuacuucguaauuuuaaaaagagcagauuaacauagccauaguggaaaucaguuuggaggcuucuuuaaaaaacaagcaaaacaaaacuccuaaaaacagaacaaccauaugacccaacuacuuuucucuccccuugguguauacccagagaauuccauaucuugcuauacuccguguuaauuguugccuuauucacuagaggagagagcuggaaucaaccuuaguugucccuccacaagugacuggauaaugaaaaucggauauauaugaaauguagauagauauagauaucacauuuaauauauauaggaauacuacuuaacauauauagaauaauauauauacauacacacacauuuuuauauauuacauaauggaauacuacuuagcucuaaaaagugaaauuuaaaauuugcaagaaaauggaugagaugcauauuauuaaguaagaucacaugaucucaaaaaagaaacugcauuuucagucucucacaagugggauauggccaauaauauauguauauauggaaacaaaugugcacauggcuacaggaaacauggagaaacaggacaagguaaauauacaggggagcaggaagggcagaugcagauaaugcacaugaguuagaagagagaauacaaagcugguuguuuuucuaagucgaacucuauccuggguguuugucugucugguugguugguuugguauuuuugaugguagauaagugcauaaaauagauccaauaauaaaaguguaaaaccuaauucacagcuuccauucugaacgccaauucucacuguauaaaagcucacuggguuguauagacccuggcucugguuaaucuugguaugugagguuuuuacuuauuugcaaaguuuuuuauaauaagguuuacuuuaaaacauuauuuuguuaacuuggaagaacauauuaagaaaaugaacucucuuguguuguguguguugugugucuugucucucucuugugugucucuuguguuugucuccuuucccuuccccuccuuucucucguguaugugugugugugucaguguaggggugugugugucaguguauguaugugugugucagugugugucaguguauguaugugugugugugucagugugugugugugucagugugugugugucagugugugugugucaguguguaucaggguaugugugugugagugugugugucaguguguauguauaugcauguuuacaagcagagcccagagauuuucagugucuuuuucaaucaccuuauguuuuugagacagagucucucucuaaacagggagcuuaucaauucggcuggguuggcggagggauccaccgguuuguauccccccaccccccagcugacuuuucuuugggugcuuaagaucugaacccacauccucaugcuucaaaggcaggauuuuuccaagugacucuucccaucccauccuuccuuuagauccucuacaauacauaauggaaaagcaaguacugcugggcaaauggauagcaguuuggucuccagaagucauaauccaagaaucaauuuuagauugcacauaaaacauuccucuguaucuucacacugagauuuuaaagggauuuuauaucgguugucucugaauuggucccuucauaccaaacaugacuaagcagaacaacacuggacuccacuucauccccuaauaauuagaaaaacacaccuuugggagaagugcagaaaaccaugcuaaaggaaacaucagaaugagaaauagagccaauauuuaagacaaugaaaugacuaacaagcucugcaguuacacacacacacacacacacacacacacacacggugccucaaaucuccaguauaaauauuuguuuucaauguuguaauaaucugugcuuuucacagcauuacucacaaaaucagacagaccagccgauccuaaggcuaggaaagucugucacacuggaggaaagagagcaggcaagagcaggggacccuggcaacagcaacuacuccuuaaacccaccccaguuuuaaggauauugcuggaauaauauacuuccacucugugaaagggaaaggggacagaugguaaaagaugugugagcuuguguguuuguauccagagacccagagcaaaggagaaggaaggagccaaaggcugugcggguggaagagaggaccgggaagagggggaacgaucuugcuaggccuugauuaggaacauuuuaaaggaaggguggauagucuuugaaaccagauccgcugcaggaaggaggccagcacccaggacacccugucuuucagaaggggccacccacggugccgcgagucauaugacugcucugucacauccugaagccauuuccagcccaugcacacgucugugcucccauuuagagaggaugggauauauugggaacacacauauggaaacacuuucagagaaucaguuuccaugaaauucauaaugagccaaguggcuucagauguggcugcguuccuccgauuagccaggaaaaaaaaaaaaaaaaaaaaaaaaagaggaggggaaaaaggagggaaaagggggcaaauccacccuuucagacccuauuucaguuucagaaaaauuaaaaaccacuaaugaguuauggcuacgaaaauauggagccaggauuaaaaugggagaaacuaggaaaacgaggcaaagagauugggaagcaguagucuuucccccuaaaaauaacagcuucuauaucguaaucuuaucuugaaucuggggcggcuuuccugugaugguaucuacccggagcaguguaauuaauuuucugacauccuggccgaaagcagugaagugcgcaugugcgcacgagggagcccagggaggcggggagcaggggcgggaggcagaggcuaggagagcaacucuuauuugauagcauauguggucaauuaagauuauuuuaaaaauuacaacuaaaugauaaauuguuccuaagaaaaaucuuuuucuuucucuuucuuucuuccuuccuuucuuauuuuuauuuuuaaagcuagaauacagagagugcagccugguacuuucucaugacuugagcuagugguaacuuggacuguauuaaaaguauaaaguuaguugacaucuuacauaugugacaccaaagcuuaagcugacaggaagccauggaacagaagaaaacagcaaguggaaaggcuccucacgggauaccugagugauauugguagcuuaaaauaucuuauauuaagacagacaaaaaguucacaugauuuuuuucuuagauaaaacaugagauuugaauauacucuccucaggguuaacuaugggugccaaugggcuggguagcauggggaagggguccucaguuuucauuugcccuguggggugcaguggaaagcugagcagcauuuccuugcagccugggggcaagccuaaccccacgcugcaggaaugcuccgaccugccauuucgggcugaugggcugggaaccagaccuagugacugcuuaaccaaccaggcucugcucuuccccugagcuccucuaaguguucugguauuuacaucaucccacaugugaacggagauuggcuuaaauggaugaauggccaacccagcagcugaggccgcgcuaccacagcucuggugagcaggcaggaugacauccauaacacccuugcuacuuauauuauaaguagaucuuccacaacggagacugcgucaccaaccccaucuucugaaugacaaacucaaagcucaaagaagugauucccguaaaguuacaguucuuguaagcagaugaguacacagugacccuggcccuagaacugugugucccuucugccaccaucucugcuaagguacucucucaagucaacuccgaugaauaacagucuagcuaaggcugaugguaacgcagguggcggcuguggggauggagcugagauagggcauggcgaauuggugucugcuaccucuugccauaacugacccugcucuugaauguggguauugucaauaucacugaugcccugugcgggccuaaguaaaucacauuuuauauuccuuaggcucccuggcuccugccccagggaaacagugaaagcacauggccgacaucucuucuucuuaccucuguuacugauuauugggagcaagcuagaaaacccaugaauccagacucugaaugcucaaguuccugacuggcgcacacacuuggcccaaggguccaaccagagucuugucuaaaagacucugccugggaagaggggcaugugacaugggaaaaggagacuaaguucuacuguccucuaauacacagacuguauuuuuuagauagaguuucacauuuguccuauaaaguggccccucuauaucaaaucccaacccagccucagacuagcccucuggagugguuugaaugagaugucccuacccugugugcccacaguucuuaagcauuugaauaauugauccccaguugcuggugcuguuuugggaggcuuaggaggcguagccuuguggaaagaagugugucaauggugacagaccuugagguuucaaaagccccaugccauucccuauuagcucuguuuccuguuuguggucugagaugugggcucucagcuuccaacuccagcugccaugucugcuauucugcuguccccgacagaauggaccauaacccuugggaaccauaggccccaaauaaacucuuucuucucuaaguugccuuggucaugguguuuuaccacugcacuagaaacauaacuaaaacaucuuucaacaaaucucacacugauccacaagacaagccaggggaaggaguugguuccagaugacagauaacuccaagacagaaucaugccaagucuaaccuaugguucuccgagauagacuaagagggcuuagcauggugaugagccaauguagacccuggggcauccuguccaguccaaacugcccaaggcccccaaaccuagauccugaaccagaugaccacccgacuuucuuucucguugguggcuugcaugcuccaggucaaccgggaucgcuuucccucucuguuacccacaccuccccacuccuucccauuccuuccccuuugccucccucccuccauacuggggacugaaccuggagccuucugcaugcucgguaagcacucuaccacugagcgagcuauuccuagcccucuuuacuuuauauuuugaggcagggucgccgucauucacccuguagaccuucaacucauucugaugcuuuaugagggaacugaacuguauucuccugagggacuccuccaggccucugccugcuggguaguuaggaucacaagcucaugggguccaaguuugccuugguauuuguuuucucuucuccuccccuugaaccuuucucuccucuugaaauugcaaacagccuccaaaucugccuucacgaucccuucugacugggacuucccuccucuaccccaugggcccuagcacucucaccugcugcucuuccugggguuuccaauugggcccugcauggguucucaaagggacaaaaaaucacccugccaccuuuacugaccuaaguucucuuggacuagaacucuguucugcucccuuugaacaacucaaagcccuucucggagacauagaugagagauaucacacacaugcucgaggcaaggauaaaggcauggcauuacaauugucaauuauacaauuacaacuugucuuugggacaguuuguguguuccuucugacuugugccuauauaaccagcugccuuuccuguaauacuauaccuauaugaauuugagcccacagaacucaccugaguuauccccauacucauagaucuccuacacuccccccaaccgaguuccacagugcaucucuugcuauaaccccugcccugccuugcucccuuauccuauggacaacacauacuuaaacuucagucccagaaacaaucaggucucacacagacacugccucucaauaguuauaauuacauuuaaauacggacucucucugugaugguuucuauaugcuuggcccauggagugacacucuuaggagguauggcccuguuggaguaggugugucacugugagaguggauuuuguccuagcugccuggaagccagucuuuuccuagcaaccuucagaugaagauguagaacucucagcucucagucugccuggaugcugccaugcuccugccuugaugauacuggacuaaaccucugaaccuguaagccagccccaauuaaauguuguccuuauaagaguugcuuuggucaugguaucuguucacagcaguaaaauccuaacaaagacacucacauucauccauuucgaaacguucaccguuuuuaccaacuccuggcuuaauguucacaaagucucugugagguaggcguggcaagcagcaaugacagagagccuuugucaagaaaggaagcuaccccuugcccccacgacccagcuaguuacugguggggcguaaacaaaauuguguccccuuugcacaccaggcuugccuuguugguaccuacuacuugugugcaaauagaauccugacaggagaccacauaaaauuccuuucaaaacaacugucuacauuugcuuccuguugccaugauacauacuaugugcaaacgccacuuggagagaaaagggugugcuucaccuuagggguuaagcucuaucacagagagaagucagagcaagaacucaaagcuaaagccugggagugggaacugaagcagaggcagauggagggaugcugcuugcuguccuuagcucauucgucugcuuucuucuaucauccgggaccaccugcucagggguggcaccgcccacauugaacugguaccuucugaaucaaccaucagccaauaguacucucacagucuugccugagaggccaauccaaugggggcauauucucaaugaagguuuucauucccagaggacucuagcuuguaucaaguugaugaaaagcgaacuagaacaucagggaacuacuuaaccaggcacgguggcaaaucccuauagcccaacacucaugcagcugaggcaggaggacagcaaacugaagaccagucugggcuauuccacuagacacccugucucgaacaaugaaagaaaacaaaacccaaggaggaccagcuaauuuuuauccaugagagcugcuaugcuuccucauguggcugcugagauccagugucaucagaaaccaaagucucaccucgacuuaacugaaacucugacuuagccugaaaggauuccuuucucuuuguuacuaagauuuagccuaaaaccagggacaaguggcucggcucgggacuacuguaagacaaagcuccuuauguaacuuugggagcugagugugccguucccgcacucauuccuccgacaucucaaaggcuuuccacucaaggccugcacacagaauuaacucaaaaccucugcaaggaaaacggcccuuuuagaguuugauuuggcauccauuucaaagaacuguuuguauauuuuagaauauggagacuuuuccuuugauugaaaccucucuuuuaacaauggacaagagacgauuucccccucugaaugacuuaaacaaaaacaaacacauccuaguuacauagacccuuguucucagagcagcauuaaaaaaaagagagagagagagagagaaaucaagcccuacagauuguuaagcauuuggcaaaagccuccaaaaagcaaaacucacacagagaaauucuccuuuuuguaggagauaaauaaauacuagcaccaagugggacuccuuucacuuucucuuuacucgauaacauuccacagucuacacacacacacacacacacacacacacacacacacacaccccuccagaguuuauucuuggugcuauagcaauaaacucaccagcaauggaccacuugcagcauuaguuuguggcugccccugaccccuugugugucuuugagacacggaacccucuguuucccaaggauaaauagacacaccuaacuguauaguaaggugcuacuuguuuucauuaggagaaaaaagugccuugcuaucuucccaaggggcuguggaacaugaggcaagugcagaguaugcuaguguagcucuucaacuaaugggcacucucugucugcuaagaucaaaacccaaguuuuauuucucugagucagaauauagagcccacacuagcuauagacccagauaguuccagagggaagaugcugcgaagccacagggcaaaaaaaaaaaaucuaugccuggggcuaccaggacagcucagaggguaagagugcuugccuccuaugugugaggagcugagcucagaugcaaacccuggguaaauggacagcuauggccauauacagaccuauaguuccagugcugugggaaagcagagaccagaggacuccugagauuuguuggcugccaguuaccacagcucuagguucagugagagacccugccucaauggaacaaggcagagagugacagagcaggacacucaguguucucuuugggccccugcaagugcacacauucacacgcauguauucauagacuauaugcauauuuuaugccuucaccuaacuucacgucaagaugggagaaggcaagaagcaaaaagaaggauggguuaacucuagguggggaggucucucucuucaacuggucaccauggcuguguucaguaaugggaagaaugcccaggacggaaugugggcucugguccuaguccugucuaagcaaaguaucagaaugaagaagucccugcgcccuggccacgcagacuccucagcaaggaaaggugagaauucacucuacuacccaucugacaagugugagacucuccaauagacuccuaacaauccuaccaaaugcacccaccaugcuugucgagaaugguccucauuuacgaagaaaaaguauuaccguugcagaugagguaaucaauuagcaucagauucacugugcaaaacaacacacaggcuuucuugcuacaaaauaaaagcaucuaauuauuuaaccggggguguaacacagaccaaaagaaaaugaggaguagggguugcaugaguucugggcauccaaacuaaucugaguaugaguuauguuucuugaagccuacucuguuugccugccucacuucuagguaacuguucucaacacgaauggcuccaagguggguucuucugguacaguuuuaucugaccuguuauaaauccuguaggaagauuuuuuuuuccccaaaaacuucuagcccugcauucuguaccuuacaacuugaacuccgaccuuauuaaaaugugaguaggaagacuuauacacuggguucauuuugaaggaaccaaaagauagcaaagaggaacagaaagguacaauggaucuuccuaaggagaggacaaugcacaacacaccaccuaugauagaagucauaguuuugcaaguccaaagccuaccugucaaacagcagcuuguagaucuacaagggacgggggagggggggugggauucggcuuaucaguaaagucccugccaaacuagcacaaagaccugaguuuggauccccaggaaccaucucaaagccaugaaguuuaccuauagucacaauguuaaaggcagguggagggagagaugggcagcucucugaugcucacuggccagccagccuagcccaaucugugggagagcccauugcaaaaaauaaaggugagaaaaggggagguaguugauggcagggguggggggaauagagagggaaauggggugaaaaugaaauguauuacauuaauauauaaaacacaagcaguaaagaaauuaaauaaaaguagaggugaaaaaugauuguaaaaacaccugcuuucagcccugggccuccaugcacagucucaugcacaaaaugcacguguucacacuaauaaccauacccaacacacacacacacacacacacacucucacacacucacacacacacacacacacacacacacacacacacacucacagacacaccuuaaaagacaaaaauaaaaaaaaaaauaaagucuacaaagagcgaaaccuaacacaucuuccguuuccuaccuuaaggccccuuugaucuguccuuaacuuauuccuucugcaguaacacaacgagggaggggugguaccaaagccugauagccaggagggacgcaagagucaaguccaauucccacauuaggaggaguggaauuaauacaucuuuuacacacuguuauaaauccuuuaggaaguucuuuuuuccuaaaacguuaggccuacguucuguaccuugcaguuugaauuuuaaucuuauuaaaaggugaguaagaguaaauaucuagacuggguucacucugaagaaaccaaaauguaacaaaagguacaauguuguuuacaaaugcauaaaggcaucuuggcuccugggggagaaaacacccucuguccaauagaugacccaggcugugcacugugcuguuugcuuugggugacucuaucugcugcuauucugguuugccucauccuuucacugauuuuuauuuuuaacuguagcccucuuucauugucuugggugguuaguucugaaugucagccugacaggcucugcagucaccaaggugcaaaccugugggcacauuugugagagaguuucuggguuggguugagauggagagaccugcccuaaccuugggggagggggggaacuaccauuccuugugcugagguccuagagaaggaagcgagcugggcacuccauucaucccacuggucagugacugcaaaagucaugugaucagcugccucuggcuccucccaccacaccuuccggcuaugaugacgggauccuucagagcugugagcugaagucaacccuuccuugaaccgcuuucuucaaaugcuuugucaaagcaaggagaaagcaaagcaaguagagagggaaggagggaagggaggagagagauggaggcauggagagagagugugugccaaaggacacaggacacucuguaggagucaauucucuccuuucacuauauagaaccugggaaucaaauguagauugacaugcugggucacaagugcuaccuugaggaaaaccucuuugcagcccaaagaaguugaggagagaguggagacaaggacaauaccaacccaaaccuuucuucuuucauuuuagcuuguaguuaugugauucugccuagaacaagcucccaggucuucugaggucaaggucuuucuacugagaauucaucccccauucuuguggccucugucauccgcucauggcaucacucacaccaugaagaggcucaccccacugggacuuuucaaacgaacaaugccagcuuagaagccugaauucacuacuggcuccucagccagcguucuccucacuccaugggcauggcggccuacucccagcaugccugucuggugagcauuugcagagcuggcuuggucacgccuaugugcugaccuugaaaguagucaggggaacuggaugcaaaucuaggaaaguucugaaaacacaagaccugcauuuuaggaggaagaaagcacacagagcccuuucagucccagaaugcaccuuguccaucgacuucugcugcacccaaaucuggcuuugccacugcucuggccuaaaaugagcuugaguguccacacuagcuaagguauccagacuuucacugaggggucuggucccugcaccgaggguuuggucaccaagccaucugaccauacaaaagcuccaagagauuuuucugccuugcucaucgggaucccuccuacaggucgaauagauucaauggaugagugaguucacauugguaauaacuuagguuaagacauauuuuauaggacuggagaggugacucggcaguuaagagagcaugcagcucuuccagaagacccaugaugggcagcucacaagugccugcaauuagaucuacaaagggacucagaaucucuggccucuucaggacaccugcacacuggaacgaacacacacacacacacacaucaacgguuuagcaagaaugcuguuaggacucaaaucaugcuuccuuuaacuggaucuauaacuaaucaguagaggcuuguccucuagucucaccuauucuccaagaguaauuuguucuuucuuuugucugucuuguugucauuuuugagaucagggucuuuguuucucaagcuggccucaaauucaugaacucaaaugauccucuugucuccugccugggaggcugagguuauagaagaggggcuguggcccacagaaccagcuguuucuagauuuuaguaacacucauucuuaagagaacgaacacaaguuagccacauaaugucaugcaaaaaugaagaaguuaagucccuuaauuaaaaagauuuaaauuuuccauguucagucugucaguggauucugacacacacaccuaugaggcucuauauuaggcaguggcucagcugggaucaguagacagaguugaaugcugaacauuuuggguauuaaugcccucaugaucaagcgaaaugacaaagcauaacguucuuugacaucuauuggaaccuguuaauguuaacugaguucuucgaugaauuacuacgcgucgccuucaugaguauuacaggcagugcauuugguuugcuguugaaaugacuacuacaucuuuccccuauggaaaacccacauuccuggcuuuaauuugcgcucaucaacauccaaagcacucuaugaucuacccgagaagauaccuagccccacaaauucugcucacucguggggaaaacuuagaccuguagaaacucagcaaucagcucaagaacccagaggcacacacaaaagacaguuccucacaccccagccauguccugggcccagcacacucucacugauguuaucuauggucggucaguggcugugucaugugccugcuccauggaaaaacugcuuuccuggcaaaccacgucaacacuauuugauugaccaacugguacuuacucgauauuggguccaauaccccuuuagggcacuacccuaugcaaagacuucaaccacuuauuaaauuaaagaggcccguggaagucuuauuaacgcuucaggagauucuuugacaccuggcaauuuccaaggucagggaacuuuaacuuucuccguuaaaugccuagagacccgagcuuuccuuuuuagaaucacguagccaguucucccugggccuuuaacccaugaugauuagauaguauucuccuaauguacagacagggagcuuaagggcugauuucuuaaacgaugaugagcacaacacuauuauuaauuuuuuucccuuaagucuguuuuuauuucuucacaguuauuuguuuggaagggguucuucuuaaucaugcauggauuucccguggccacauugauguguugauuaugcaucaugacuccacgcccuccuuggcacagggcgggauguguucagaaccauccuuuugguuguuauuauuccaucaacuguggcauuauuacuaauuacacagacagcuggaaccaugaccacuuuggcuggagagagcuugaagcauggagaccagcugcgcgggaccacuguucgcucagaagucagaucucagugaagcagcaggcaaugaaugccaagagcaagggacuuuaacgccuccauucuuccuagaaugcaggacccugguuuguauuuauuaucacgacaaauggcacaccucuuguucuaaguagcucuugucaaugggacacaagcuagagucaccuggaagaaagaaccacaacuaagccacugccuuuggauuaauccauuugcaagucugugggucauuaucuuuguuaaugcuugguaugggagaaccagcccacugcggguggugucaucccuaggcugauggcccuaagauaccuaagaaagcaggcugagcaagccaugggaaacaaaccagugagcagcaccccucccaccacagucucugcuucaguuccugcccugguuucacucggugauaaacuguuaccuggaaguauaaaaugaaauaaacacucuccuccccaaguuguuuuuggucauggugcuuaccacagcaacagaaagcaaacucgggcacaugucaugaauacuugcaugucugucuauucuaacugcagugaguuacaaacauaugggcucaugcauguuaaagaauaguucaaacugucuuguugcacuuuauuaagggaagccugcugauuccauacuguaucucauucuggaacauauauguacuuacagacuaugaaauucagguaaaugacaacagccauucgucuguuguccugggaccccaccucuaaaggcauuaacuagucuuaaguaacucucagcauacugagccccuaggcuuacagcacugucuauugggcaggcuuucuggcugaaggcaagggcuucccaugggcacauaugcaagcaagcaggguguggaaguaggaauuacagagagauagaaaaggauuauggaaccuaguuggaggccuaggggagcuuucaaucuagccaaaguuacagagagauagcaggagauuaaaagccuagucccugggccugagggagcuuucaaucuagcuaaggaaaggcaagauuucauacauuccuguuagauauuuuuaaaaaaauuguuaugaagccaaauauaauauaggcaacuacuuaaguugcaaauauaaaauuguugaagcaauucagaauaaaaggauggucuuuuauuaagaaaaguaucugauuuuuuuuuuuuuuuuuguaauucccuaaaggcacuggcuuuaaguuggcuacauguuaauagagcagaagagagaugcaggaggucucugcucacuaagacuccaggcaucuguggcuucugcuggccuauccugggcugcaucacagaaugacugugaucuagcuccuagcuggccaugucaugucugcuagaugagaugagaugggugacaucuuucuaacagagagacucugcugucuaugucugccauuccuugccugcuuugguucauuucaaguauaugcgagccacuuauugaguugacaggaaguaacugaaggaagacacccaacccaagaaggaauguaaagggcuaacaacacacagggugcagcuuaacccucgggcguucuuagcagguggaaaauaacaaauuuacacaaauggccauugcagccgguaagcacggaggcugagaauaaagauggaguuugacucugaguaccaggcacgaagaagggcaacaguagcacccccagaggucacugacugggaccauggggugacaugaaacuguacgugaaaaaaaccucaggaaauuuggcgccaggaagagugagguuuaaugagaaaugacaguugucaaggagagauugugagcucugcucuggaagaacagcuucuccuuccauuuaccacuggguucauguaauguccaucauuuucucagaaaagcccuugacacuuuauugcaugauggccguaauuaaugucaggcucaaaauuagaaaucaaaaaaauucuauuugauccuucgguuucaaguuggaccuagaguauguuuuggcaugauuacuaacuguuagcagaaaguucuggaaacagauggagucuugauaugugcuuuaaauaugaaacacauugcaaaaggagcuggagauaaaaauauauacugcuuaugcacacuuuggcugugucacuuccuguccuuaucaacaagaaaagucucucuaaguuuuguccuuuuguuguuccaggugaacaaaaccccccccuucuuguuuaauuaagcacauuaauuuauuuguguguguaugugcacacgcgcaugugucugucugccugccugccugccuguccucaugacuucccccagccccaaacacccgauggcauaaauguggaguucagaggacaacuuacaggggucaguucucucuugagauccauggguugucagguuuggugacaagugccauuacucucugggcuaucacagagcccuuccugucuuccugucuuuguuuguuuccucuaucuucuuucgugcgcaucauuguuuccuuguacuauacugagcaccagccacaugccaggcuacaauaugguaggcgacaaugauccaagaacauguaugacuaugacauagccguuguccuugaaaagcuugucuuuucgugaagagaaagccauaugucacguaacgccagaguugacugaaaacaagcauguaugcagccucccuguauguauucuagaggcagcagagauggaccacuguuuccucagaagcugguaagcaugcaauauauuaucuucccagaaagauauggagacugcagaagcaccgacagaguucagagacaguagagggggcaguggagauaagagaacauuugcuaagaggaaagugcuggcuggagaugagaggccugugagacagccaggggcccugcacccagcucugagagcccuggcagagagugcagcaguggguucuuaggaauuccagguaucugagagaaaaggggaguaaacuccucuaccuaggagcagcaaagacagccaaucggcacaugauggaccaugauuuuugaggaaaucuguucuguguuugcauucauaugaacagucugucuaugggccaaauuaagaagagggcccgugggaugcaugguguguguguguguguguguguguguguguguguguguguguguguguguguguaaagauuuucuaacaaaaaaaugucaugaacagagucuauggccaaagaggaucaggagguacagaaagagugcuuauguuuucaauauauauauagcauucuccuaccauguauauuuuuaaucccaguuauuucaaaaguucaaaaccauagaaacaguaaagacaucuauguuuucuagggucuuguaaagaggaagugcuauuaggugguaugaagagcagaguaggguagggagccuacucuauaguauuuugcaauggaagauacaugguauuauaggauuggcaaggcccacaggacugugcaaugccaagugugaacccuaagguagacugcaugcucagugucauaacaguagaacaacauucagcuauacugaugcaagacauaaaugacaggaguaggugggugguggcagaaggauaugcgagcucuauguucuacuuagucuucgugcaguaagguaaaacugcuaugaagcacaaauacucauuuaaaaucauacauaugugguauacauacauacauacauacauaugcauacacguaucagcauuuucuauucuuucaaaaguaauaaugcaacuugguuuucucccugacauuuauuugguaaguccugaugucgccuugcucuuuguaaaauucugagacacacagacaagcaauguugagucacuucaauccauggagccacugaggcacaauaagccaagggaugcagaugagaacgguagaaagacucguagugacauugaaacuaaaaucagguuuuccucagcuaaacuguucccaugcucuuccaggaucacagcagccgcuguguccugagaaaaucagugccucuggugagagccacacacacucccaagagcaggcugcaucaaaccauacaggaaaacgugugaccacgugccugcugucucuacauaagccugggcccuuucucuaauagaucuuugcccuacgugugggugguuguacaugugucagagguaaauuccacccccacccugccccggcaacaacugacaagaucuauguauuuaaaaaaaucagagucuaaaaccacacacacacacagguuacaccgagcugggguacccaaggcuaacuacaaauaacugcaauuagccaugcaaacaggcuuagucagccuuccgccugcgccaacauucuccgauggacaggguaggauuggaaaccaugucuuuguucccagcacuagaguaaauugagguucaagugggauuaaaaacgccaucugcucuugucggaagacagacuauuuuuagggaaagcaagaugaacucugaccuacaaauuugaaaaugcuuaggucaaucaccauugauaugaggagaggaauaugggacaugccauuguuaacacauggggcuugccuuuguuuaggguccauuaaauuuaauaacuucccccuuuauggcuuucaacagagacccucuucaaaauaagagcggcucucauagaacuuaauuacuugccgguggcugcuguaacagagguguuuaccaaauagguucuuaacauagaaggagguccacagaaaaaaacucuaguguuuuauuaagguugcuucaacuuucugguuuauuaauauuaagugcugaagcuuucuucuucuuuucuccaagagcgaggcauugcucccucuugggcauggagaagucaguccuccccuggaugggacacacuacuggagcuauugaauuuaaaauccagacuugacaggguucuuaaggagcaucuuuuaaaugagcuccaucaaaugccacuggguuuuaaauuacgugggcugauccuccuggcacaucucaagugaucacauggucccccaacuccccgcuggcaauuucucuaucuuguggcauugacacaaucaucgucagugacuuuuuuuuuuuuaaacugagcuaaugucgauucugcugaguuugggaaaugucaacugagagcccuuaagauggaaagcucuucaacagccuugugaaacugagcuaaauugcuucugauacuaagauauuuaaagaaagauucaagaccauuugcuuauaugggggguugggggggagaaaaacuuucagggaaaaagaaauaacauggcaugaacaccaugagaaaguucuccauguaacuccuggugaccgcuucuaaaguaaucaaggcagacaacaucuaugauucuucccuguguguccagugcgugucauuaaugggaccuccagagagcagagaagaccacgagaaagaagucucggggaagugccugcaccugucccuuccaccuccacaucacagaagaggugguucgaugggagggagagagagagaaggagggagggagggaaagagccagcugaaguaggaaggaccugcagauucugagguaggaagagaacaaggcuuccccauuaguuuggggcugggggaagucuuaaggauucucucuucucucaggggcaggguugguacaugaaacacaguuugaaggucaauaauuaucuacuggguagucugcaaugaccuccagaaaacuaaguauaaucauuaugugaagccacacaagugcucugcacacacccagcagcacgggugacagcacugucacagugguaaagccccgauacagccuguacugugugcauccuucuggucucuccauggucucaaccuguuucuuuaaggaagcacugagaaguuacucugccuacuuccguggcacaucacaagaugaggugaggucaccuuuaaagccaccuggggucagggugcucccaugcuuaguuuacuauagaaggucuuacuuauuguaauauagauggugggguaagaagcccaggauguccagggcugcuucugcacugugaugucacuaggcuggugucugauaagcugaacuugacuuuuauaauugagcugaguaugcuccaaagccauuacaacaaagaaggaccccuuugucagcuagacgacgauagaacaguguuuguaagcgacccuuguuuuuacuauuuaaggcugccugagagaaaguggaaacgcccugauuuuuuuauguugugccugugaacaucaagacuucuagcagcacggcuuucucgguaaugaacugggaggcacagguagcaggccuccaucauuuuaguagaccuuguuguguuccuggcgggcuuccagaaagaaaacgauaggaaauagacagagcaugcuauggacauaauacuuuagguucuauagcugaauccacacuagaaaagucagaggcaugggcacacagaaaacgaagaaccccgccgcccuacuggucuucgaguacaucauucagaaucucucuuuugaauagcaucuuagggggaacuggaauuucuuuagaaacucgucuuucucauuguuucuauucucgaaacagagcccucccaccccuaguaaauacaaccuaagauuuuugauuuauuacauaguuaacuuuuucuugauacuuuaguggcuuuuugugaaguuuaacugaguuuaacucuguaaauauucauuguaaaaccuuaguaacaauaaugugaauacuuguaauucugugugcuauauauuuuaugaagugauuucuuuuaacuucauaggaguguuaacucauuuaaauauugaaagauuccaaaucacuuauuugucuuaaauauauucuggagggauucauuuuuauuaagcaaaucaucuccuuuaaaaaguuuagguuccuauuuauuacauuaacuuaacccaggccuugccugcaaaugacauacagauauacaaccuuaaaaacaauuuagcuuugguauaucagcuauaaagucacaugcugugugucaggucuucccugaauaguguauacuuucccaguaauuaauaaaguuuuauaaaccuaaguugggucacccagcagcaucggcauguauuuuuguauaucccuuuggauggggagauauggccugaaagcaucgugaaggugaccacgagacuucuugggguauggugauggaagucagcacuugagcuguccauguuagaggcaaaagguaacuguccauguuagaggcagaccagaggaccgggcaagguacacauagauugcauccaaaggguuuuauuuucuagagagaaagagagaaaacccuucaagucucacuuguaggaagaaagucagucucacguaucuugaggauggauggcuuuauauacugaggugaaaaauuaucaugauagaaauugugcaauucggccccuagaacccuacaaaagaaccaucucuccaccaggaucccaagggugugcccuggggaguggaccacacacucgcuccucacagugucugagcccaucagguugugcuccaguucaggcacagucccacaaccaggagcgaggucaggagguggauggaggguucucucagauccugacaguccacagcugccuguuccuuccuguuucuccccacgcugacaggagggauuuucuguucucuguaauguuuauacagaaccucccaccuuggcuccaugugacuccuuuaccagucacgacucacugaggugcucagagaggaggacaaagcuggacugaacugccuuuuaaaaaccaguauaaagugggagcacgcuccugccuuuggcuugagaucaauaaacagcugcauaaccagccagcuucgccuccuaccuccuucucuguagaacagaaagagcuauaaugucacuucauggaaaugcuugaagugacaagaacaaaauaacugguuuggucugcaucacaucugugaauggcaaacccugaugcggagcccacuggguguucagcuguuuaagguuguauacagcgguuuccauggugaaucuauauaugaacacacuucguuaacaaaacgauguagguuugugucucuauagcaauuauuguccucuggagcucucucucucucucucucucucucucucucucucucucucucucucugaagauuuauuuacuuuuaucuucuauguaugugugauugccugagugcaugcauauguaccaugugugcaccuggccuccacagagaugagaagaggcuaucagauccccuggaacuggaguuauuggugguuuugaucugcccaauguguuaggagacaaacuuguguccuuucuaaacagcagguacucuuaauggcuaagccaucucuccaucccacuggagaaacaucugcuucaacugcaaaggguuggucugauggaagcccaaaaggacccuaaacucacacaagucucacacaaguccaugaggaacuuugacucuauguaaaaccaauucuucaucugaaauacaguugaaaccaucaaaauuaagucgaccccagcccugugcauacuuucuaucccccuguguaucuuccucuuccucuccuguauccgugauugauaucuugccuaaaggagauagugaucucacucaacagaggaacacugaacgucucuacuguacuauccuuggcccagcucccaacagaugucacgugauucagaagcacagcaucaguggucaauaaaaugugauaacaugguuauccagagaaccuuccggcuuucccuccaccaucucccaacccuacucaccccggggaguccaucugcagcggaaaaugugaaggcucugggaccagagagcccuuuccugcuacucgcuugagaaacaaagccuucccuccucccaacuugaaagaaacaaaggagaguggacuaauggaagccugcugguggagcuucagcuugucagugacgacucagcggagagagcaacggcuccgagcuuugcagagaauugauagagagagauacggaaacagaaacacagaaagagagagagagaaagaaaggcauuaaccuggccaggagucaaacaggugcuuggggcccaaaggcugacaugagacacaguagcuguguggcccuguggagucauaucugauuauuaaugagggugaaguauacaucaaagugaguggagggguugcuuuccuuauuuaugggacucauauggucgggugagggccuuuggcuucucacucuacgugucugucuuaagucuucacuguaacuuucuggcucccucugcuaaauucuacaggacggagaagaggguggcuaggucauuucacacacacacacuuccacuaugauccacaagcuuggcggggggugggggugggguggggggucucugguuugguggauuuggggugggcgggacggggagcugccacacagaguaccagugugccuugcuauugagcugcugcauacugccucucaaggcuccucuggggcucacagugcucugaaugacuaggucucucauaaguauccuaaggugaucucucuuggaacuaacuacuguggagcccggacuuuaugaaugggggugggggguguccuuuggcuuacaagcagaggaagaccuagcaugugagcuuugggagaagauucuaucuguaagacagcaccccucaaauauacaguucagcaggacacuguguaauacuaaagguuaucuuaagaaacguaugccaucucgggcagauuuucaucucuugagugaggcuguucaagcguuugauagccccguaaaugcagaagacugaguaccuagugucacuugucuccgauagagugacugugagcagcauagauaagccagguuugguccaucaccacccccgcccccgccccugugcaggggugggcuucuggugaaagcuuggucuuuaccugaaauacgccugggcacgucagugauggcagguagcccggugccccguguggaagacagcggcgugguggaguggauggauggggaugucaucuggcucagauaggagggguaagacuggucauaggaccacgguggggaagacugugccugccugggaucugggaagaaaaaaaauaaagagaugaaacgcaaaacccuuucaguaguccagcuaccgcagccuaaaaaaccaugcagcccagaacuuaagacacagcacagaagaaaaaaaaacgagacucuaaaauaaauaauaauaagaagaaauaucucccacggccucucccuuguaggccucaaauagcccagagcucucuagacuugaugucucaaugaacaugacaaaauggguguguguauaugugugugugugugugugugugugugugugugugcgagcacaaguagauaaggcccauuugucucucuuaugcauaaauauuucuauuuggaaaguccacuggccauuuagaaaacaauccacuuugcuuauuuucaaaaggcggaauuuauuuuauuuauucucuguauuuucgaaaauuccuucccugaacacauuuuuuaaauuacauuuuuuucuaucaauuaacuuguauaauuugucaaaagauguagacugcgccuuuaacucuugcguaucuggcugccauguuuugugggugcuuuucccuucuuagagggccugauucugggcuuccucugcaaugagcuuucucucugggagucaguggaauggcagcuucuaaugggggugucaagggguaaggauggggaagagagcagaggaagggcagcacccuuacugacuagaaaaggaagcaagauacauuaucuaauaauaaagcuaagcuuauuuuagaaauaaccuuugagaaaagacaaaagucaauuuaaaaaccaacugugauugaacacugaaaagcuauacugccacccagguucaaggccaagcacaugaguucccgacagcaagaagauggccucaacccagaggauaggaaaaugcucucacccuacugaaaucucuccucucucucucucucucucucucucucucucucucucucucucucucucucucucucucucuaagugucauguguuugaccuguggcuuagagcuuccuacaguugcugauaauaaaaauaaugagcagaaaacugaucaagguuaacugcugagagcugacaaugucguugacauaucucugcuggguucugagacauggaagcucaaagcuaagaaguuuauuaaaaggccaucaucuauuuguauaagaaaagagaaggcaauuuuguuuuguuuuccccucuuagagccucugccaccugguauucccaaggggucaccgaaucaaguacugacuaggcccaacccugcauagcuuccuggauuaggugaaauuggguguguucagggcgcuuugggcagagauaagaaggcaaacuuguugcuauuuccaacauaaagacuguguuuuaauaguucucaaaagucuccuuacagaaucguaagcaaauuucacuuaauugauuuuuaaaugcaaacuuaaaagcuguuuugcuaacuuuaaacagaaacagaguuggcuuuuuacaggacaguugguguauuugcacacagaugagcuuuggaauuuuuauaacuggguccccacuuggccuugaucacacagagccuggguuuccucauucauaaagggacuuuuauaauaaccugaucaugggaauacaagauuccacggaaaacuauuuaggaggagauuacuaggagugugugugugugugugugugugugugugugugugugugugugugugaugagggcaggugccugcaggggccagaaguggguacuggauccccuagagcugggcuugccagcaguuggaagccaucaauugcgagcugggaacugaacucccauaccccuggguauaacaugcuguauauaacccaacuuucuaagccaucucugcagcccucauucuuacauucuuaucauaaaacagaaccaacaaaaaacaacaacaacaaaaaguacucuugauuguucaucccauacuuaaaacacaucagaggcuuagcauauuugcaacagguacucuuauuuuuuaaaaaaucaacagcuuaauuuuuaaaaaaaagaauauaucuaaauagccaauucagguuuauuucucaaaauaaaaaugaauacauaaugagacucagcuuuuuccugggcuaguuccucuuuuaaagccucuagguuuuucugugcaguugaaacuguugaguuucagcuauuccuuguuuauuuguucaguuuggaaacaauuuauuuaaagauuaucuaaauaggacauacuuccuugaguggaaauaauuaaauucaucuggguauuuaucugauguuuacugacauuaauagauaugggaggggggacacccccaauucaaguuuaagaaaccuuuaccugaguuugugauucaagaaaaaggcaguacuguaauaacauaaacuuucuucagaagucuaaaagauauuugaugauuaaaacuaaugaauuucuaugcuuuaaaucucccaagguugagauuggacagauuggcagcauuucaacucagagugacugguccuuguuauccucagauacugauauaacucuuugccuuccaccacgaaugcaaguuacuauuuagagaacugggaaaccaucuucagauggggaaggguuggcuccuuacagaacaggaaaacugucucguaaagccgaggggcuggagucaaagcacauucucaacagaugaaagggacaacugacaaccgccacacggcuacaagauggaggucuggaugaauacaaguuagguuugcaaagucuagauuuagcugcgccagacaacuuccucagcaagcagcuuggucuguguauccaguccucaaaggcaacagugaguuagugggauacuccucucugccuaaacugaaggaaaucacaacaaaacccaaggaaagacaguggugauuaaaauaucacacaggaacaauagacagagcucuaagagucuuguagaaaugccagggaaggaauugggggacccggaggggucagggacucuacaagagaacagagacaacuaaucuggaccuuugggggcucucagagacuaaaccaccaucuaaagagcauacaugggcugggccaaugccccccugaucaucuguagcaaaaauacagcuuggucuucaugggguuggggaaggggaggcaacaacccaagcuguuucugacgcuguugccugccugugaauacuguucucuguaacuggccucagugagagaggaugugccuaguccugcagugacuugaugugccaaggugaguuggcaaacccuaggggagggcuuuguugggggcucuuccuucucagagagaagaaggggagggacuaugugagggggagaauggagggagacagagggcugagaucuauauguaaagugaauuuuuaaaaguauguguguaugugugugugugugugugugugugugugugugugugugugugugugugugugauacacacagaaauacacacacacacacacacacacauaucacaaagggauaucacaaagggauuaaggguauuugguugugacgugagccugaguuguucuccuuuugccaagagauggcccagcacacugggaaauaaacaggccuucuaguaggacaacaugcaguagaggagagccagcuguuuagcuacauagcaugacaucagcuacauagcaugcugaagugaagauggccaaguggcuaugcccacuggccgugaagagagacugaagcuagguuuacagcucgccguugcguugaguaggucacuuaaacgccuagccccagugguuuaucugugaagugggaauaaugauccugauuggguuucaaugagcaugggaggaaccaugcccgauuugauaagcuaucugccuuucgugguaccuauuuaguagccaaaaguuucugucugugaaaugaauacaauaauaacuauugccauguuuggaagacuagauggcaauuaagcauuuugauaacuccuaggaucuaugugaaaaucguugcacuuuucaacucacaugggcaggcucgaccuugugaccuagggcgucuuucguagagcugcugauuuuaaaugaagguggcaauaccauuucugaauuaaccucucauggccaaaucaaauaauacacagugaaugcaucauuaucaaugaaauaaaaaugggacuccacacuggacgaucucugugugcacccagcucugaaauacuucugagaucagaugguauaacuaauguaggacuugagcauacaagccacucagcaaugaacgucuggguggcuuaaauaaauaccacaauaauuaaaugucauaauuaaucauucuaaauuucuccuaagcuaucaaagagcuauuguacugagaaguuucacauaaaauuucagccugccagguaucaacuagaaugguccccuaaaggacaacuuugcuucgaguggaagccuuuuccaaggaugugcucacuaacaccaaacaagggaagaacgcuuuguccuuugucccucagaggauuggccgcagcucagucaaucuccuucaaugucaggucucauccuaugaucauaugacaauggcaggggaaggcacgagagagacuaaagaaagacaaaguauaagaagugucauaauguauccacuagguaaggucuaaggagcuacgaccuuauauuucuauugaaggggaaucuucugagucgcccccaucccaggccuuaccuaauacucggugaaugagcaaaccaaccaucgaucgcacaggugccauuucugggccacugacuggacaaaggacacacuugccuaagcuucaauuuuaucagcaacauagggagaaacaaaacaucuccuugccaagcuugugaagaucucagcacauggucaggaugccucuggguccaucaugcagacauccugaaucauuucuuuaucuuugacccugcuccuucuuggacgugguuucaucucagaaagagaaauucccaucuuuucaaauagcauggucuuguggugggagaaaaagagcuaaauuaucuguuuccuaagaauguguaauccuaacuuaaauauaugcgcacaacaaauguguguucauguguauuugcuuaucugugcauguguauuuuuguuuguguauauguguguauauguguauguauguguauauguguuuuuacguguggaucuguuuguguguguuuguguaugaguguguauauaugugugaguauauauuuuuguauauuauguguguaugaguuuguguaugugugucuauguaugaguguguauguauguauacauauguguguguguauaugugcguuaguguguauauguaugugagugugugugugugugaguguguguguguguguguguguguguguguguguguguacaguaauuaaugccuacagugaagauaaguaaccuuaacugguucucaugagugcuuucugaacugcacuuccugaagaaaccugagccuucugggauucacucugcccucugaugagucagcgcaguaucgcuacaaucacuacuagaggacguuauagaaccuagcucugcaacagaccuuaggcuuaaccaugaaucggcucagccuugggugccuuugccugaacccaucagagccacaugauguggcuugucuuucugcgccuucagaaacaggacgaaagcaucgggagccgacuccaaacaagaagagugagaccccaaaguaugaaagcaucaaauguggccugaggucacauccugagugaguggcaaugacacaaaagcaucuaaaaucucucagaagauaucgaaauaaaucaaaacugauguugagcuuuuuaagauuuguuucuaaagacuuauguguuuuuauuuuauauguauguguguuguuugcaugucuguaucggugccaaaugugugcagccuccaaggaugacagaagauggagucagagcccauaggacugguguugcaggugguugugggugcugggaacugagucuggguucucuggaagagcagcagcgcccuuaaccacugagccaugucuccacucaccguuguuaggcuuuugauauucccauuaugcuuuaaaaccacaacucaguguccaaaguuccucacugcauugcaggaguguaaauguuuguauacaaauauuaaugcuuagaaacaaaaccuuuagcaucacaauuuaugugugcacauucucgugugcucgagaaaucugaaauaguaaauuaucacauacauguuucaauaucauuccacaaacuccugcugccuaaaaaaagaggaguuuagcaggaaccgaaaaucaaaucugaccuguaacauaaauuugagagggaaaaaucaggucuuuccgauaauggaccugcuguccuuacaggcacgauggacaaagaugauugcaugggagaacggggagagcagcagagaugugggugaaugguccuccagacacagaugaacccagaaagaaaagccuguagcugcauggaagcaagcucucggcugccaccaggaacacucagcagccauauagugaucuugcagaacugcugggaucauguaccuugaggaaaucccagcuaccucaagaaaccaggagcaguuacuaagagcuugagucaaauucucauuggaaacuagguggagucagggggagcuuuaaaaaagaaccaagcacuugacauaaggaggcaggguaucccaagcauguaacuguguuuucaagaaugcuccgagguuagaaacgagccauaaagcaccaacagcagagcaguuuucuaaguucuccaccuccaacagugucccugaaccucgacucugaguuccuaagagcauuaugcugccuuccucuuuauaaaccccaaacacggcagcaaagacagcaccagacccaggcugcuauaaaacaaccagaaaggggcugcuugggugucugacuuccaucaacaaaacugcaaacagccauccaugcaaagggagggaccccaggaaagcagacuguguucacagaacuagaccagagggcgguugcauacucccucagcugauaugugagggguugucugccuucauacucacaaguaacaaaaauggccaaagcaaaaaucccaugucuguaugauugagccauuagacacuaagaauaagaaacacgagggagggacccuccaaacuggcuacaggaaaacuugugaaacauucugaauaucauuagggguagaagugggauaggcagagagcuuuguuaaagcccggcagaagagagagagagagagaugagggaacgagacugcuagacugaugucagcaaguccccauggauaaauacuugggucacucaugaguguauaaaugguacuaggcuucacauagagaagagaggacacagggaaccauggaaaagccugggcuagcacacaaaagcuucuuucugcuggcacugccaauagaauuguguguaaagcaagacaauggagacucccauucagugugucugcaguagccacagcuacagguggggagcacagcuagagcuccuccacacugucaccucuuaucauuuauccaauuucccuacucaauguucaagucagacugugugaagcucagguauucauugagaaacuagaguauuucaacugaaguguaaacagagucuacuuuagcaccaugccucuugaccacuaacuacuaggaucaaucagggccaauuauguuaacaguuaaccaguauccucuuucccacauacuucugucacaauaaacauauuucacagucauccauacuuuuauaguucaaaacaguguauaugaaauauucaaggcuacaugcuaugcguucuccagaaacccuuuuggcuagacugaauuuucagaaugagauugucucacuccacucggauccuccuguugaaugacuagcacuauuuaaacaugaauagccuccucugcuuaagccugugcugucacagaccaguaacgcacauuaucagagucuugcuguucucucaaaguaagaauggauaugggaaagcuuuucccaccuauaaaauccugugauucgugcucaggcaagugagcccccuggucaguccuuucaggagacagcagcugcaacagaagggacagaagccaugcaggugcugacuugagaugacuaugaaggacagcugaugggaaaugucacuuccgucaccaaguggcucacacuagagaaagccugagaauaggauucuggcuucucaucugguccccgaaccaagcaagcuagcagacagaagcacuuggcaggaaaccaacccacugagccauggagccaugcauggaaauuucaggaaagagcagcaagccauuuggauaaaacugggugcuccguaggcacgccaauggguuauuaaugcaaaagcggggcuuaaugaaucccuggagacaauagcaaggaagagaauaagaaaucguaggugcagacaaagauagcguaucuuagagaaaugguggaaaucagaaacaaggugcgcuucucagcggggucacaacagguguguccccauugauagaagcaccgggcagugugagacagaaaaggaggggcuguccauguuuaaagaaaaccccaagagaagacucgggagguucugccauaugucacauuaaccuggccuuagcuuugucauaaccuggaccucucuggugacguggacagaggaaagaaguaagguucaaaggauaugcucacaauuugaauuauaacuuggagguggggcuggccaaaggguaugacacuaaguucaaaucagugugggugugguaaaugccaguucaaauugagcuggugucaaucaaauuuggucagauaccuggguaacauuuauaucagguagauggugauugucuauuguccuccggcauucauccauccuuugaaaacuauugucuguucugguacuguauugggcucuaggaauauuagugauagauacaaauagaacuagcaaucccuccuuucuggaguuuacggauggauaggagagaccaacauuaaucaaaucguuauggaacugugauaagugcuccccaugacacccuagggacagauggugggagaaaccugggcaucaggcauagcuuuccuaaagucacggugauuaagucaagaccuggccaggaggcagaagcucagaaggaagcuguggagcugacagggggugggcaaagagacagcauguaucuaguuccuggggaagagacaguguggucucuuugaggaccuggcagauagugucuuuauggaggcugaccaaaugcugaauguagccugagaugagaacgcagaaguaggaggagccaggugacacgagagcugcugcugccggccugcgcuggaaccaccagcauucacuaagugcaaaggaaggucauuccgccuuaguuuuuuguucugcuuuguuuguuuaaugggguggcacaaucagucaguggugcauugaaaacucucccuucugacagcaucauaacagaaaaagggcaggaauccagccgagggccagacccagggaaggacgugcagggaaaacagcagcugaaacgaacuccaaggcagagucuaggggcugcacuugggaaaacugagggacaagcagaagacacuaaaugucucaacacaucaccugacuguaagaaugaggcucuuugacaccgccugggcggcgucaugauuggcccugaaugggcaaagugacccugggguguuagaacagggaauuuuugcuggccucaccuccuauauucugauucaaagcugaagaaccuuuuuacagucucccucaggugauacuaaacuauaccaaagauugaagacagugugugugugugugugugugugugugugugugugugugugugugugugugugugugcgugcgugcguuuauaacccuuuauuccaucuuucuuuuucugaaaaugucuuugcugucgguaaaacucuugguucugauuacuauuuuggcgccauugcuagcaucagcaugccuccaguccacuaaaaaagcacugacguccugcucaaaagccuggauacaaaacacuuuuucacacuugauuaccaugaaacucagaaggcagaaggggcucaccuaaaaguugcccccaggacucggagggcaaccgguuaguagaaagugcacgggccuauggcguaccugaaucuuagcaagguagaugcuuccucugugauguauaagcagcaaagaggucuaccaggaaguggucauuaauucaaaccaaagccagcuuugaagaaaacaucuacuagcaaucugguccuacaucugucuguuauuuuuaccauagcccagaaggguuagaagccaucuuuccaagcuucacagugagguaggugugaggaauaaucacuggaugaagaauuugaaccauagaacaaguaucaaagagggaucugagccaguccagccagggcuugcucuggucaacugcgagagacaggauuggggggcagggggugggguaauccaacggcagaguuccccacagacugcaagccacaugugauccccaaaagucaccacaaccagcaauuaaaaagcaagucaaguuuuuaagccuuuccccuucccucucuucacucugauaaugucucacaccuaaguuaacaccucccaaagcuuuccaccucuccccacuuaaagccacccugucaaagcuugcuaccagacacauagauuuccuauuucagcucaguggauuucaaaaaaaucuccucaggcuccaauuuucuuagucacuagauaagucaucacugacaaccucugccaaggcuguuguguuaaauuccauggaagccaauuguuucuaaacuaugagaaagcagguccugauugaacgagaccuccaaaaauuaacuagauguuuauaagugcauagacuuaugaaauuuuguuccuggaguacguuuuuauauguuaagugauaaaauaugacauacaaaugaguauuaaguauuauacauacauacacauauaauuuauauguucaauauaucaaauuaagaauggcuuagaacaugcuucuggcuugaaaauacauaauacauuauuauugucauucacuccacaugggcaaugcacagugggucucugcgagaagccccagaaacuuaaggaugaucaaaauauagccuaccccaccuaggucagaugugucugacagccucccccuggauugccuucugguuguauauucccauccauugcaguccccugagccuuggccuccaggccaucacugaaagcaaaagguggugagcaaggucccuaggcaacuaauaaagaggaauagcauguauacauauauuacauacaugaucauauacauauauuacauacauuuacguaaaaccaacaugaaacuauaaggaaaaaagaugaugucauagaaaggaauggaagaaugaaaucaacacguucucuggagagaaaccuaaagacagauucaaccagaaugaagcaagagguagcacacagauucuucuugcuauuacuagaugaguccagaaagaagaaaauacaaaauggagucuuugggacaagaauuugauuguucucagauaaucaucccucucugauucuaauacaaucuacagagacuaagggaaucccaucagacagaaauccgagcaccuucuccacgucacuuuguggacauuacugacaggccaaagaacagcaugagccuguggcugccagucccucccaggagccuugcucuuuaaagacgggaacucacgcuucaucucgacugugcgcagaaccugccucccacagcuaacagacaggagacaguguuuacacacaggauuugugcucuuuuuauaaaugagaauugugaucagcagcuuccuccagugagauuuccggcacacacaugggcgaagcagcaagccuauuuaccuggacgcccugcccagugguucucaaaggaaggagccuggacaggacuuuccggugacugcagaaagucaaacacagugccaccaauggaaaacagaaugacuuccaauggaguggcuguuuuugaguugguggccucaccucuuuuaggcuccauggugccucuggguaauagggacacauuggcuugcuucccucuccaaauccauacugguggacccagcagccacucugucugagccucucuuggguuccccgucagucacauucacagcuacccccauccgacccaugcccacaucuccuccuggcuugucuccccucccagaacuauguggucacuuggcauuugaagagaauagcaauuugagacacacacuacucagcuguccuguccuacuucugagaggauuaugcugauaaacgcuucaggacaagcaacaguggacugagccuaggucagccaagcgugcauagguuaaucccacuagcauaguuggcuagagauccucuuaguuucuaaaggagcuuuauuccccccgagggacuacagaaucagauugaaguggaggaugaugaccuaacccuuaucgagguaacugcucgugcaauuuauauggccuuggacuaucugguaaaucauuccaccuaguuaugauuuuuaaaauuauuguuauaaacacaugcuuuauagaacuacacuuuaaucauuaacaaugauuuugcugcauacuaaaguaugagcuagauacuccucauguaucucuuuuaggagaccaucuucccugggguuccuaaauaauacccaguggaaagcagaaaauggaaguggucacacaugacacguguucacuucgaugguuaaugacauguucaaccugauagagguacagguggcugccuccuaaaaauuugacacucagaaacaacgacuguaacaauggagucgacuucagccaccuacaucuauuugcagaacaucuuaaggcaucaauaaacacuuuaaaguacagaucagaaacuccagaaguagcccuuuaagaagugugucuucucuagcacacaggacaguauucaauuuggcccuggaacuaugcggauguuucuuaaaucuuuuauuuaauagucaggaguuguacguaggauccugggagagcuacuuuauuuuucuggcccucgguugccacaacaauacugccuaccuaaaagccccauugugaaggauugugacuuaaccucauuggaacagugccuggcucgugauaugcaacaauaaaugauagcuaauaagaauccaaucaaauagaaacuacaaagacuaaguccaggauaauauuccaucauacuuccugaagaaaucaaugaccuauuuauucauuuaucaccaagcccuaggcauuacugaagacaauagggacacaacgaugaauauaacauggccucagaguuugaaaaauggaaaaucugaugcaagagacaauguguggucaagucguuguccccacauggaacgugauguaauggaguguugcacaagguggcaagggagccugacucagugaguggaccagaagaggccuggcagaggcauggcaauuggcccaagucuggaaaaaagaaugucugggggaaaacaauaaacagaaggauaugccaggaaaaaguagggauaugguggcauauuacuaaagagacugugagugaacugucagaugagcggcacgcacauuccacgaggagaaagccacuguaaaggauacaauggcccaucuaguagauacccaagaaucuaguccugccugagggucuacugaaaauggaagucauaccagaaacaaacaaacacuauccuaaauacuuccagcaucuacauucauggaaaauuaauuuucauuuaguauuuaacuaacaacucauacccuucuccaagucuucccccacaccauaaaaugauaucccuguucuccagcugcccagguaaaaaagcuccaaguucuacacucccuguagugucauuagaucagccccuggagcagcaccuugaccauaagccugcuucuaccguuggcccaugggaugcaugcacccuauacagagcacccgaagguggcauguaaacaugucggugauuagagaacacccaucccuugguuccuauccuucaguggccccauccucugagguccuccauagcuuugccacggccugcuuuucugagucugcucauucucaagaguccucccaccugcaugaguccucccacugcuuacgugcugcuccucacaggccugucuccaaagauuccuuccccaacuuuacaaucgaaauuaguugcuucccuuccuccuaaguugcucucuguacuaagugcuucauuuucugcuccuggacacuuauuuugaaacgaugucauguguacucguucuacuccuuuauuggcuguaaaugucacugaaauguaagcuaaugagagaggaccaggcccucuuauaaaaacauauuugcacagaagauuacaugaaguagacugcagauauaaaacacugcauuuucaaaauuucauaaaagccauugcaaaaacugcaucuauuugauucacuuacaacagugccuagcaaaacauuaagccucaauugacuuccugcauaaaugauuaagagaaaaauaucaguauauacuguccuuccagugaugagaucaaaauuccaucccacagagcccaagggcaugaaucaccagaauuacuuuuacguacaacugugucauacagagaauuuacaguggcagcugucaugagaagcgccuccuagcauggcaucuucaaccuccaaaaccauugccacaugcugagucaaaggggguuggcauuugcaacaggcuagguguuuccuggugccaagagacaggcagcagaugucagaaugauaaaaaagaguuggggaggaggcaacuuccucaggaagcuguggggaggcccuggucccucaggcagaaagaacaugagccaucaaagacaucaacagagcggcaccaccggccuggcacagcagagaagccagcccaccauauggcuggaaccuuuggcccuaggaacugcaagagacauuagaaaaggcuaauuaugaaccacuaagcacuaacuauuuccuugaacuucauuuugcugugcugggacucugaagaagucaucugccuuugauguugggcaagacgaagaacuucagaugcgcauacaaccaugaccacugugugcugugaggggguaaacaccucaagagaaccaagcuaacaagagagaaucaggcucugugacaaacauccuugaacagagaauuacaugaacuagaaugccgauaggaaaugccaagaaguuaccacucuaggcaagucucaagaaugugaguucugcagcuccuucuaguaugaaaccaacugguuuaacagcagagaauuauauagaaaugugguuucugccauaguucacuuucaggaaacaagaauggccuggauaagaaauuagaaagcacgguccaugcuaacaagaaaaucaugauacaguucugcuguuuuugcaccuauuucuucucuauuggauucucaucaagucuacauuuagugagacucuuugcuucagagaaguccacaccagccaauggagaaaaacagauacacagaagcugagaaacaguggcauucccacaaaugcucagagaauggaaaggagcuuuuggagaaaggcucuucccaggaagauaaugaagagaucuggggaggaauuccaccuccucaguagacugacuacuaugaaaagcauggugcgugagggccaagauccaaaugagccucuuuggcuagaguagaugaagaaaagcacuuuucccugcucucugcccugccaaagaugggcucucugcaugugcugggaucaaaagcacacuuaguaaauaaacaagaaggugaauccugagauucacccaugauguagcuacuguccuggguguuccuggauuuccugcuugucuaguuucaaagacucggcauacccuuuacuacuugcaggcaucuuuguccccgcauccucgcaacaacaugaggacauuuaaagaacauccacacaaccaagagcagagcauguccagauacaccuguacaccuuugcuuugggaggcuggagaaaaagcuaucaugaccaaaagaggacaaugaagaaaacugugaaaacaacugauccuuaauuggcccaccaauaccaaagccccccaugugaaggaccaguaucuuauaagacagacuucuaggaugcuaucaauaccuguggaaugccauaauuucauuuuaagaaauggacccagggaauauuagcuguccugcugcuucuaacaugccaagcaacugcgagcaaggagcucaaccuuccugacccucucaagagggaugguaguggagagauacugcugccaacuggaggugaaccuauucugcagaaggggaggucaaacuccugaucuucgcagaugcucugcccccccauaagucccugcuuucucagaagcuuacucacacgucugcaugcagggaugcuguuaaagguagccccucccccacugccuuuccaaugucuggcucaaggaugucuaaaguaccuuuagguucucggcuuucuuguuguuguuuguuuuguuuuguuuguuuguuugaggcgggguuucucuguauagguuucucuguuccagggcuguccuggaacucacuuuguagaccagguuggucucgaacucagaaauccgccugccuaugccucccaaguguugggauuaaaggcgugcgccaccacugccuggcuuacagagcucuccugugacuuuacucauagauuuaggccucuuaaguggaucaagcaucagccagguucaaagggccauuuuaaagucccauagucccauaggaggcuagaaagaaugaagagcaaugaagcucagcaauaaagagcucuuguugcucuuauagaggauccagcacccauaagcucuaguuccuggggaucugaugcccucuucuagacucugagagcaccacauacaugcacuacacauucauacaugcaggcaaacacucaugcacauuaaagcaagcaacauacuaaaaccauuaguugucaauauguuaacaaauaguuaaagauuagaacauagaaaugaaaaacuuaaguagccuaguaguuaccaaaucauaugauguauauaugcauauaaaaguaaucaugacuguaaauaauauagaaacacauacccuccucucucucucucucucucucucucucucucucucucucucucucucacacacacacacacacacacacacaaacacaugcacacauacagacagacugagaauuuuuauaagauggcuauuuugaaucuugaucaacugaaguccaguacuuuaaaguuauaacauccacaggcuagugugaaccucacccuugcacuuuuaucaugagcacaucuagcacacauuuuuuagccauuugcuucaugaaugcuguuuaaaguuucagacagguuaaaauaugguccucucacagaguacuaacauucuuccaguauacugagacauauuauuuuuuauuuuauuuuuuuuacaauuccaaauuacuuuuuaugcaacugcauucauuuacuaaacaaacccaaagaaagaaaaggcuacucuuaggaaauauccaagaauacauuugcagagcaugggcaggagaccgaaaagaggugggucagaaacauuucuguuuugagaccguuaugcauacuuaaguauagccacuacagaagaaaaccuagccaucaaaaaaaugcacauuuaggguuuauugcauguuuuguuuugacuuguuuucucauuagucuacucugccucuagcaaggacaacaagaagaugaaguaauauucuuugaccucuugauauuuuugacaugcagauuaaagaucugccacgauccacacauucuugucaacgggaccucaaagcaaucaaacugauccuaaaguaaggucuguauuuguaccaguuggguagaaaaccaaaaagagcugggaucuuaaugcaucauagccaguuaugaccugaugcugguguuaagaagaaacaaagugaccugcgcacugaaacauauaagcagaaaugcaguguggagaaccggagcuaauuaugaauccaaaauggguucugucugccugaagaacuauucacugacccugccucuaacuaccaaucaaggcuuccuguuagcccuuggcuauuuuugaagcaaacuaaaugaaacuguuauauguguaagaaauuuacacucaaauccgagucggcaacacuaaucuuccaauggucagggugugaugcuguccccugcaccagcuggauacaauauagaauuuauaucacacauucucccacagcacagcucuucccaccccgccacaguguacacgacacagcuguaaagcccaacauuagcagaaaccuucauuuucauccccaaguuaucaaaugucaaaacggucuuaauaaaaggaagaaaucaguaucuucgcaucuuaaguuuuucacgagccgaucgcagcucuggaagucacgaaaugaacacaucuuaucugguagccccucacccccagccugccagacuccaagugaaaccuaugcgucugucuuaccuguaaucugacucuguccuuguggauuaaaaggacuuggugcagaguucagggagggccguggguucugaggcgggacaccuacucucauacugggaugaggaaugcgcccuaaaucacugaggcgaucagagaacaaacuagguuuagagucaucaagcuucugucugugcccuggaaacagcaaaucauaaaauaaaagcacauuaauuagcugaacaauugaucgugcuauauagauauguguaacauacauacugggugguuuaagccaaggaauuaucaacacugauauuuauuaugauccgucuaugcaagcugcucuucaagcaucguagggugacagaccuuccuaauucuaucuguaugcggggacugagggucccaagagugaccugaaucaaggguucaagaggaacucucggggugccuccucuagcccugcaauaagaggaugggaagacugagugcucuggggaaucccuucucgcuucacaauggggagccccgucugaaagcucagggagucagcuacauucucacaaacccagggcaggaacacgggcaaacgcuuuuuggaaggcagauuuccauagugucucuagugaucuguuuucuuuuuguggugcagcuagcuacuuauuccuugcugaaaaguuaaaacucaaaaaagggaaacagaaaggaagaaggaaggcaaaaggaaaaggggcagaaaaugggggggggagauagaagggagggagaaacauaaaaagaaaagaaauacaaauacaaauacaaagaaagucagaaaagaaaucugacaaagaaaaucagauuuucaaaacggacagaucuggggauuuugagaugugcuaaagcccaaacgcguauaauacaccccauuaaaucacauagaauauguuuucuuuuaaaucuaccacuguagcuuuaugcaagaaaguggaaagugguguugggccaaauaggugacugugaauguggucacccauuaugagagggagggagagagggagagaaagacgggggggggggggggaaggauggagggggggaggaagggagggaaggaggagagagagaaaagaggagugaagagggaaggaggagagagaaauagagaaacagauaggcagacagacagaccuuuucuuucuucugguuuauucaaguuauacagcaaaggaaaucuggguauuaaagaaaugugcaaauuaaaaauagaucaaguacugaaacaucuucaaaagucacaaacucaucuacuauaagggauguggcagugucuuggugcugugaccauguguggcugugcaccuaacaggagaggguugcugugcuggggagcccuaucugcugcucagcacuuuagaaugugugcucaaacaacgggaacugaugcaaggcaugguaugggaaugaugacugaaugagaagaugcguucugaagcaaaacucagggaaccugauuauuacucaucuaagaaaaaacccugagcauggauuaugaauagccucugucgggaauggguaucugucauggccuuaagugcugugacaccuuaccuuccccuacauucagcacaagggagacaaauaugucaggagaggguuaaguugagcauuagaauucccuagcuauaagcugucuucauaagacaaauuccuuauuuuauuugccccaaaauguauuuuccugucucccuuuucauugccuacccagcccaaagaaaacagacaggaagccaaggcuugguaauaugaguguagcugucuccacagccaagcauguuccaacugggcccauuaacugaaaugcacccaccuccuacuuccugccaguguguguuuugggcaguggauguaacagaaggacuagaccuaguugaaaacaugaucaggaaaaaaacaaaggaaauccguuguuaauugucauuuucccccaguuuauacagauugcaaauagauuuuacacaccuaaaggucuuuagaggugacccaaaaaagccucuagacccaaacgaauaaauuauucauaggugaaguggccaaagucugcccaggcggggcaccuaggccaugacccucaacucuuaacuagcuuggccagcaccgcuuuacagcuguuacauguaggacgugagcuuccuagucaucaugaggucucaucaaugcuggcuuucugucuuccucucugagcugccucgggucacucaguguagcuagaacacuucagaaguaagcucagcgaggugucaagacuaguuuucaaccuaagcugaaagaauagcuaaaauucaaucacaauaacucacccauucucuuaauaaauaaauggcuguagcagacugucuuuguauagcucccuggcucuaacuaguuucacaaucagggaauuauuauacaaagacuuguuauagucagauguauagaauaucuuuccuccucuucuuucuuuucugaucucucucuuucucugucucucucucugucucucugucucugucugucugucugucugucugucucucucugucucucucucugucucugucugucugucucucucucugucucugucugucugucugucugucucucucucucucucucucucucucucucacacacacacacacacacacacacacacugacauaccuauuaaaagcuuuuggagccacuuucuggaauggagugguaacuucccugaaggcuaaagagaaggcuguucaaucuuacauggacucauauagaccacacuguguguucagcauguacaauauaugggcacaucuuuauuuacucuuagcccagugcugguccuauuaggagaaugcagacaagaggaaaggacuuugaauaguccuugggugugaaaaauguaaagagcaggugaaauuuuuaaaggcccaacgauuuuuuuucauuagaguuauccucaaagacagcuaccucagaugugcagacaaccuagaauaauguauagcguaucuuucagaggauaccaauauagaaaagcauauggauuuucuguguuucucuauccucuucuagaaaccaucacaaccacuacaagauccuuacaguacaaugcuaaacaaaagccaaauagguucuucaucuuucaaccaugacgaauaguggcugccgcuaaaccacaucacggggcacucaaaugacaggcuaaaagacaugcugcagucaucagcaccaggcaaucccuccagaacuaagaacacaggacacaacagagucacacacugagacaaggacagggugacugguccugcuguuuggaggacuaaaccuuacuugcuccuuaagaggagcuaugccaagcagcaggcagaugcagagagugggcaauuuuuauguuacuacucuagggggaaaaagucuagaggaaagacucuaggaucugaagauaagcacccaccugccaugcaagcaacaggaccagaguucggauccccagaacccagcaaguguggguaagcauagggcucaccuaaucccagcacucagaagggacagacaggggaucuccagaacagacuggguagcaagacuaccccauaccagugagcucuggguaccagugagagacucugcuucagugaauaagguggacagcaacugaggaaggauucugauguuaaccucaagcuucuacacacacacacacacacacacacacacacacacacgaacaccugccucuacacacucaugaaaacaugugcucaaaucacacauagcuauggggggaggggugcugugugaaagcacauccuggagccuccccucuagcugaagcuucuuucuccauaagucggucauccuucuggaccggcugaauaggaaaagacucccucaagcucugaaagauaugagcacccaggucccggaguggauggaggaaaguuaucuuccuaaagcucccugucaucuaauacaaaggcggggccagaaaaaccacugcccaagauugucugagauccagcauaagccccaccuucacaccaaugacuccucaacuucuagauggagccccaccuucuguccugaguccuagguuucucucucccauugccuccuugagggaucccuuaggguguaucacaggugucuuaaaugcauagacucaaaacggaacccuugagucauacuccaaaacagccuauugcuccaauauagucccuaaugucaaugaacaucacuggccacucagacgcuugcagucaagagcuuagauauuuuccuuaguccuuaugucccacauucggccuaccccaaaugcugggacuccugccuugauacauucuccuaucuccucaguucucugcauuccuccaagugcaaccuuagucucagacucucugagugucuggcgcugucuccucugaagucucccaugccaggacuucccuauacuccuaagaugaaaaucuugauuuuucuguauggccuacuccuuauugauuagaucuagaguaacuacuaccuguuuugaaagccucgcccugauucccauaaccaaaauauguccccacgcucuggagcacagccuuuaccuuccuuuguagcaguugucacaaucuguaauuaucuuguauauuuauuugucccuccucaaaaaacuugaaaucccaagcaaaugaguguccugucucuugugaacagcuggguucuuauaaucuacucagugccugcauuacaguagaugcucaauaaauauuuaugcaagcccugacuagcucaauagacuccccuuucagagaaacaucuugauuggaagaaaacuuacuggugcagugcaucauauuacaacacuaucccuucaaaaugcuucauggcuuuuugcaacauuaacggaagccaguagccaaaggcuuucuuuagaaacaggcccugauuggugcuuccuggaaaacuggacuaguggccacacauuuaugcuaaaguucacuggcuuuuugaaaaacucccacuucucucagugugauccuuaagcacuguugaaagcaauuuaaaacuggagagauggaaaggguagcagauauaaucuaaacucuacauuugaaagcaauguacucuuuuguggaugaggacccagggaggacccugaguucccaugggaggacauggcuuucccaaggucacaugguuaguggugggacuaacccuuggauuuccugaucauaagcccuaauguucuuugcucucccaucgccaaccagcuuauuuuaggacaugacagugcagcagaauccauucaggggaagucaugaccaaaaaugaauuuuaaauggacaagaacaaaaaguaguuuucaaaaaagauuucuuucaaaaagucccaguguacgugggugaauaugacuuuuguugcaauagacgcaggcccacaagaauaaaagcaugagcaaaaggucacagcauucacacaugcuuauagcagacacaugaggaacugcuaagccccugggccacaguguagccaacagcccugcugaucccuacgcacacaaaggauagcgacuggccacucuaacuucugcuuucaaaacucagacaucugaaauuggcaugaagagacugggaaguguguggucugugagcaaugcaaauaaagacaucucugcagcaugaucugugucgcucauuuuuauaaccaagacacugagagacgccucacgucuucugagaacaauguccaccccagccagaacuucccacuguaggcaacugucuagccacaugugugaugcuagccaguuagauuguuccuccuccagaaugccagauacaccaggaagagacuggauaggguauauuucaugaugggugugcugugaaaugucagguccacccuaacauggaaugaaaaaagucccaccggggauugccauguccacuucaaguucaucuaaucuagucgaugaguauuauaaauuugccacaugggagccacacuaggcacacuaagcaggaggagaugggaaaggaaaugagauaaugucuugccuccaagaagcucaggguauaguuggaggaaaaaggcagccaucaugggugacagaggaaucgcugaggugaagguaacugggacacuagaauaggagcuguuaaauauauuuuaaagucauucucuguaugauucuuuuuguugaguucucaagagcacugacauauacuuaagggucaaaugucaugguaucgagugcucacuucaaaacauuucagcuaaauaacagaugaaacugguauggaaaguauauauguaagguacuacgugguuacaccuauauuagauaugauauuuucucuguguguuuguaagcuccuucauuguaaaauaaaacugaucaugaacagcacuaugaaaagcacaaggagucuuugguuuugacaaaaaggaaauuuccacugcugagaccacugugcucacccuagggccaaaauucugaucagcagagagggacagcuagcuggaaggcaugugacagaaacaagauaaauaucauaugagacuagaugaugucaaacauguaugugcuguuaaucuaacccaggcauacccucuucagaucacuuuguaacugcaggccaggcauuaguucuuuuuaaauuuuugucauuguaauccuuucuuguuauauuuuagauuuauauauuaaaagcuuuauuuuucuuucuuucuuuccuuauuauuauuauuauacuuauucacuuuacaucccacucacugccccccacccuuucaccccucccacaauucuucccucaauccccccuucuugucugagagaguggggguccucccuggguccccccaacacuggcacaucaggugugaaaggaugggauggauggccaaauguccaugagaaugaauggaaaucugcaacggacgggguuguggggguagagagcaucuucaggaagagacagagaccugggauaaaggauaugcccaagaaucaauaggugugucccuagcugugacucacagcauuggggauaugggaccuaaagaggccacaucauauauucaggcaggaaccccaauggagugugauauggacaccaacccaccacgaaacuuucgacccaaaauguauccugucuaagcauugguucuuaagcuaugugauacaguguagagagcugucuucuagagccagaucuccuggccuacaaaaugauauuuggcagcccucuaaccucugccaugcaugugggcuuccccagagcagagauguacgugacugggaagaugcuagcuaaugacauugucacugaguaugggacagcucaagaggucugaagccacaggauguaacagcuccagaauauugugauugacagugaaaagagaagauugcaccucuuuuccagggcaacugcuaugggucagcagagcuauuauucugaagcugcucugggacaaagcaacaaggccccuuaguucaaaccccuuuaucccaacagcggcccaagcauucuaacaagguaugaguuuucagggagcaggguguauuguaaaacuggcaugcauucagcgccauauugucccuuggaauauugauuauuaccuuuuggccacucccccuacaaagagcuucgauuccaaaugacuucuguggaaaucugcuacugagacaagagcucccucggcucugaaucgcuuggcauuucgguugaugguuucuagcaaauacagggaggguugcgcagacucuugugaaagcuaugacaagggcugacccaaaucauuuaugaucccugaggcucuggguuaaaggcucugagccucuccacuccuacacggguguaaaaaugaaaaugcccuugagaagagcgaagcugugccccgucuuuguucagauguccucaugucaccacgugcuaaggguaggaaucaaaggcccaugcucccccacuccauaguuagccuccuuugcucucucccaucucaaaccccccaaggcagcuucaucccugcuucccuuaugucuguaacaucaccaccuuuuagucuuccagguccccaaauccaguguacaucaccuccucuccuagagcccaugugaccuagucagggccauuccuacaugguccaaaggaaugggaucuuuguuucucauccccacuggagcgacucccuaaaagucuuggccuuaggcucauaucucagagcagcagcagucuagcacauucaagagcacacuaucugucauaugaccccagggagggauucuaggacuuaguuucuuuaccaacuauaaaggaaagugugagcuuccaugaccccuaacacaauuucugccccgcacccacaaacuuccaaacucauguuacucaccugcucagauucaucggaucucuccagguacagccccaccuuaccccccucagacccagcaaagaaaaaccugaaaauauggcccuaguguguguguuucacucuuguuugccauguuucacacugguccauccauugcucuucaaagaaaucugaugucuuuguccacacuguccccucaacuuaacacacauuugcucaucaauugcacuugguaaaaucuccucccaaggcuggacuggguuaucauacugguguuuucggucugugugacucccccugguuucuaucucgguagcugagcacagcccaccuacgugcuauguccacagcccaugguuacacuuaggugcaagaggcaggcauccaguaagcaucagccuguugcaaguugacauuggauauuuauauagaauuucaaagccuauaauucuauagauaucccucaccuugccuagccaucccuuguggauguuugucauguguuauaucuaccacaaucuuaauggaggcgcauacaagcaccuauugaacuaacaaagaaaggagauaaacuugaaauuaucuucccuuuuguccaguggaaggcagaaaggaggggggagaaaagcuggaaggcauuucccacgguaaaauugaugagucgcucaucucugcugggaaaggcugcugaaucaucuuuuuccuaaccauauacaucugguuuaggccaaaacuauuucuagauuagaaugaucaaagcacuuagaaaccaucuucauagcuaaggccucuagccacucucacugauaagaacggccaugcaguauguugugggacagcucaagggcgggcacagcccuaggaaauuuuagcauguggcuggaaacagaggaccauauguaacaagcaaaucucauuccagaagauucuucucugauggcauuucaaaaaugagcuucucuuagcauauuaaccaauuucuugaggaaaacaagcaaaaucucuaccaggaaucucugagaguucccuugcccccaaacagaaucaggugcacaggaguuuauccagaguuuauccagagagaagacaggaauaaucguuccacccgagaaaggacugaagcucuuccaggcucuuggguaaaauguaauuauggagaagaaaaauauaaucuacucuagagacauaauuauagaguuagcccauagacuccauagaaauauucuaggaacuuuaguucuuuuuuuuuuuuuuaauguuaaaaguugaguuugcuuucuuuuaauaagaggccgaagucuagauuaacagcauaaaguccugucucuuaauugcauaugcgagcauuguuuuuaagguacaauuaucuaaugugagagagaagugagggccugccagguaagcuguccguuuccaaaccuacacuucugaaaguugacaaguucaagaucuuucaagaaauaugcaaacgaaagagcuggugccaugcuaauuugcaugaacagaaauucaaguucuuuuauaacuuuuaccuucuggggauguggcaaacacagcaaucaaagcauaacuaucgggguggggugggggagaccagucacagcucaggaauaaagccucaugaaggaguuuaaaacagcuucuccugucuuggaauaguggacuuagggaauuucagauauuuaagcugaagaaaacuccugagagcuugaacagagaaauaggguuuuaguuaacuucuguccucucucucuccccucccucccauccucccucccucuaaccuucccucccucccacccucccucccauucucccauccucccucccucccuccgaucuucccucccuccuauccucccucccauucucccauucucccauucucccauucucucucccucccucccucccucccucccucccucccucccucccucccucccucccuuccuuccuuccuucucuccauuuuccuccuccugccuccuuccuacucugcccccugccaccuccaugcugggagaucaaacacagggccuugcucaugcuaagcaaggacuggaccacugagccauacauaucucuagaccugagaagaaggauuuuuaagaauguacagagaaaaccaucugaaaauauaaugggacugcauaugagggggugggagggacagaggagagagcuacagagcaugcaugugcaugcagacaugaccacacccacagugcacauguagggggucagaggacaacuggcagaaguccauuuucucauucuauccuguggguccuggggauuaaacucagagcuacaggcuuggcagcaagcaccuugugagccaacucauggguccaauagcaaauucuuuccuuucccuuccauuccaugauuaauuaauuuccagaaaaaaaauauuguugacuuauuuaucaguccccuguccugacucaaaugucacaagaggaacaaccaaaagagagaagaagugaaggaugaaagagcgagaauuugcugcucuuauccucaguccuucugacucucuugaccaugauacaucccaucccacuaggaacaccucaacauccagcaacaugccuggccauaugggaaauacacagaaggcccccuucuucucccugucuacacuuaacuccaacacuuaaugugacacaggaaacagguccauuggguucuuucagucuuguauauucacauauaccauaguucugugugcuacgacaguuacaaaacccugugagaaauaugagguugcuuuucauguuaagggaacucccaugguugaacccaaagcauugcuguuuguuugacagggaccuagcugaacauggauggcauuauucuucaaaguguuuagugacaaacagucacacaaucccuggauccugggcucaguuucccucagaugcucacuggguuucacacucaugauaauggccugggacggguguuucgggacggggauggggagagaggaggaaggauugggaagugugaagcacucaucuccuggacugcuacccaccccgcggccauggcacagcauucucaauuuucccauuuucuugaggagaagagaauguuaaaaaagcaacaaccaagggggaaaaaaaucaagccagcuccugucgccugaauggcaguaaagaucacagaugaaaaggggaagaauggggggccgggcagggggagcggauuucugacuuaagcuggacccguuccagcuggcaagaugaggugauuuucuuaacgcuugcaaaaccugauuacuuuucgaaaggaacaaagaauggggagauguaaacacagccauuaaggcagauuugccguacuuagcuuuaaucuagucuaaggcuucccccaguuguacacaguucugcgcuucuccgcaugugagacaucucgaugacagcggagguggaugucugugcccucugacuggcagauuagguugacugagcuaugcuguuacccucucaggucagauguggacaaaagggguagcucagacaacaauagaugcaucucugugaaaaguaugcguggcgucugacagagucuguuuuuacuacguuaagggaccaugguguuuauauaucuaugcaacaggucuuaaacagacuguuuaaacaugauuuaaacaagagaugccuuuaagaaauccucuaagaaaacucagauggguacggagcugaaaaaacagucaagaauauaacauaaaacaucacuucuucuaaacugcaaggguaugacaagauaaacucucaaauaaaagggauuuuuuuuaauaagcgaaacuccaaggauuacugcauauaucagcaccuucuuacaacagaauagcauuuauccauccauccauccacucugccuuaacggcacuacacaccuuccuacccuugauagacagauaauugcucuacucagccguguguaaugaagggagucugcgguguuaaucccaacauucucaucuucugugaacuccgacuaaggaacucagaagucugaaccuucauccccacacuaccggaguuugacgcuccuacucagaucugcuaaaguauucuuacauuccacucugucaugaaaggugccagguauuugaguaggaucaagucaggguuuuauaaaaugaacuuuaacguagucuucaaggguguuagaaggcagcgagcuuugccucccuuucaagacaggauaucagaaaaguccauuguuugcaagcuaaagccaaagugaguugugaucuguuaaugucuguuaaaaacuaccagcaauuaaaacuaaaacuucuuuauuucaaaggcaaguuaauuuuguagacuucugucuguggguuucauauugaaucaucauuuuugacaguuuguccauaggaaacauagaauauaugcguuuuccagacauagucauguaugaguaaaaauugauauuacuccucuaccacacccauacauguauaugcauggaaagagcaggaagguccaguuaaggggacagaaaugcuacuagccaaguucuagauaguuguagcuaucagaccacugcaaauagauaccauugucucaaggcucagcuugcuuuacaguaaugugcuucauaaacacacgucaagaaaccucugcuuccuggacguaccuuucucuauauauaaaguucccagccuucagcccgguucggugccuuuuguugauuucaaaaaugauacaugcucacugggaaagcaaaagugggcugaaccaacuaaagaauuggucguggucugacucuuucuucucuggauccugucuaucucauggacuucauacccaauauguucucagaaauuaauauuccuucuguucaguauauacacucuuaugcauauuaacugccuaauggcucaacaggccuuacuaaccauccuuaaaaucacacacacacacacacacacacacacacacacacacacacacacacgggggugggguggggggcgggacacaacaguguacuugaaagagugagcaggcaggcaacagacagagucuugcuucuaaagccaggcgugacugcacaagugcauguaacucugaaacugucucuauuuauugauacacagacaauacuucucaucuccauggcucgacauucuaaucugucaaacgagaaaccuauagcacuggauacccucgggaugaaauguaugagaggagaaaaaccaccaggcaaguggaacacaaacucgccaguuaccauuuccagauaauguaccccgacuaggcagcuuacaguacacugaaggucauugcagaaaggcaaacgaguggagcaguguggucaaacagagcagaagaaccauaaacaaacaaccuagaggacauccagaaaaauaaaugccuaauuuccaagagugauggagagggccucccaucauugaaaggagaugcccuugcguggauuuuauagguaacuagaguugcaucaagcaagugcagaagacacugcaagcagagggcacagcaggugcagaggcacagauaagggagcuacagagugaagcaauugggcacgguuggcacagggccacaacagcgcgaguggaaggcaguugggcagaucggaugcugaagggccuugucaccacgccaugcugucugcacaucaucccacaaauaacaggagcugcugaaguauuuaaagcaagggugugccgcgagcugguuccagcucagggagaccauguuauucgcagcagaagacagauaugccaggagacuagcaagagggacgggaugagcuaggaaaggauuuuucuauuacaggccagggauguaaaugcugagcuugcauggagcuaacacaguauucacagggacaagggagagcgugucagacaugaucagaagcacgggcacauuaaaaauuacaagauguaacgcugagaggaugaguuuacuguuugguugacugagcucaaaacugcaaaagcagaaggaaguugguguuggggcagaaaaggcuggccucaguggagguugggaauccuaaaugcuaugcuuaagauaugucuguagucuuugcagaacucacgcagguggggccaccaggaagugagggagagugugugacacguccaagagucaagugcacauggaaccaacggggaagaugggucagaaugcguggaagaaagugcccugcaggggucgcuguggagaacagacacauaggugggccccaaaagaguucugagucugcuccugcugcaaagaccccaagaagcuuucugggagagccuuuuaucccgggugcaaggggaugaaaugaauuuguucaccaugguuaagauucuccaccacuuacuccauacccaauucccaagcgaccugguugauaccagcgacaucaagucugcaaagcugcugaaaugcaaguccagucuccucugagcugcagccgcacaugccagccaucuccugggcacuguccuauaaucccucuaaggguuaugguaaguucgcacagggcucaccuguggccaugcuguuuuacagaaaugaaauucuuggccuaaaauccuucaccaagacacagcagccagucuuuuccgggacaagucacaagugagauuaugauucugcaccucguguuugcacagauuagagugagcaaaaugguucuggcuucaauacuacacugggaaauguugggcuccgggcuggccuuaaagauccaagagcauacaaggaucacaaagugacagcaaacauccuugaagcuugccaucuucuauaaccuuugagauuaugacuuaaauuauauuucucccuccccccuuuucccuccaauccuuccuauauacccuucaccgaugcucuccuucaaauucauggccugugauugcaugcauucuguguguguaugaaugcaaauauguguguguauauguguguauguauauguguauauauguguguauauauauauauuauauauauuucuaaauauaaccuguucaaucucuguaaugccaccuuaugcaaguuuucaggguugaccaauuagcacuaaacaaccaguaggugugccaguaggaguggcccuagagaggccacuccuuccucuucccagcuuuccccaaagccuaaagucuuucuguagaguugcggccuugugggcuuuucucugugugguuuggcauguccaucacccauguucaucucgggucuuaucugaacacuuccuauaauaugguuugccacucuggugagcuuaaauggaaucaggaacagaugaaguggacucaggcugucuucuacccccucccccaggcccugcauuugugcuccuugguccuguuaucaggagagaaaagaaaaagugucugucugcaguggguaagggcagggcagggguucaggacaaagaaccugagugguaccauucacaaagcugcagccuuuuaagccaaaaggcacagauaaagagaacugggaaagaaagcucaagccaccaaguuggccugaagauucuuggcucucuuccuuuuuccuauaugaacauaaagcuccagagguagcuaaauucuagaacaauuuuccaaaagcauuuagagaauaagcacaauuauuuaugcauaacuaggcugucaccuagccuacaauggaaugugccacaugacagugugucucucuuccuuaacgccagccugaaaauaaagcucaacggcuauggauucaucucacucagaagaugcacaguagauagcgacagugcaggcaugauggagcacacaggcacagcucggcaucugcagcugaguuuggggcaggguaauuacuguccuugagaagguagaauuggaaguuagcagugaauguuaaguagauccuauacuaauugaggggaaaaccaggugcuagaaggaacuaccugagccaaauugaaagcacgagacauuuccacaucauaccuuccauccacagacccaaaaagggagccggagacaagauggaggcagggaggggagggucacaaagaugaaagauacacagccugggccuucugaggggcacagacuaucuaucuaccuacaauucuauauacccaaaguuuugccaguaagucuaauuguugauaauugagauucuacucaaaugucuuacuaucuuaaauaagauccuccugggagcucccaaaaugaaaguggagugcuccugagugucccccgcccacuucagcccuuagguucuuauggccuuuuccaguuucugaggcuuucugucauucggucucauagucauuaauauccacagcuuaugucucaagguaaauuucgugagucucuuucuucuucacuuucuuucugagucaagugauaggucagacaugacuaggucaucuauuccuacagugcuuuugaaacuaugcuugguugaaacccucugcaugcuugcugaauaaauaaaagauugacuguaggauguggaucagugacugaaggaguuuaauugcuagccgccauuuaaucuuaaaagaaggaggaggagaaaaaggaggagcagaaggaggaaaaggaggaggaggaggaggaggaagaggaggaggaggaggaggaggaggaggaggaggaggaggaggaggaggaggaggaggaggaggaaaggaucaccacagaaauaccuaggaaaaaaagaaacccuaucagccauucagaguugagacagcuugccuucuacuuagguauaaaauaaaaggcugguuuuugccaggugugguggcucacaucuguaauccuauuauuaagaacacugagacaggaggcuggaaauuuugagagcaauuugggcuccacguaaguucuaggccagccagaacuacacagugcauaggaaagaagagaggggagaaagggaaggagggaggaagggaagggagagaaggaggaaaaagggagagaaggaggaaaaagggagagaaggagggagagagggaaggagggagggagggagggagggagggagggagggagggagggagggagggagggaggguagugucuauaguaggcagucaaugggagucaaguaccacuuuugaagacauuucagcuuucuaacuucaccaacagccugaacaaagcucuauggauucugauaaaauuccggguuuaugauggggcauaagcaaguaucagugacuugcucauauaccuccuaccagcaaagacuaaccaggagcaucccccaaaagagaacauuuguaacaauucaucacaaugcacacacugcacuguccuuaaguacucuaacauggagucaucauuugauggaguuucugaccucauuuguuuucaaauaucccaucaccaggagacaacugcacaucuuuugaccugaccuuccgcucuguccgagcuaauauggggcacacuagcauggggggugggggacacucagaggacaauuuuacacagguugauuaugcugggcaaaggcaaaacucuguagaagcagcugacugugcacagagguuuuagacugaaggccauugccccacccucaagcaggacuuccaguguugacaaaccacaguucacugguuaaggguacuuuuuucuuuuaagaacagaaucccuugguccugauaauaauucaaaccuuuaugccuaguggugcuauguuccuccugcuagccagcuucuccucagaggacauuauucaaacccagcgaccacgauggcauuugaggaaaagucauggaaaugucugccuuucacagcugaaagugucagcagggcccugaauggaagcugacauguguuucucucccccccccccccaauauacgcaacuccuuucaggaacuccugacucaaagugucugagggaaguggcgggcuaugaacaucucuuuugagaauagugccauaugguuuuaacagagguucguuuccugaacccaaagagggcuauugaaucucaauccaaguacaauaauuaugcagacaauucuacuccauugcaugcagcgcagcccauucugugugguccucacaugccugcugagaccuucaaagggacauuaagccauuuuuauguaccauacccuuaauggguggaauacuaggucaauuuccuagaagauuagcaccugcccaggacuuaagguaucaugacccccucccuuucuuuggaaggagauggacagguuaaguuaacaauuaucaaugagacugggacacaggcauagaggugauugauuaucacagaaacauacucauaaaugccaauaucccaaacacaaggagagagagagagagagaacugaaaauacugcaucucucagucaccaucgaugccuggaaugccuucagacacaauugaagguaagaggacuagaggaaggaacagaaagcugaagagaccagagaaccgcucccuugcauaaggucuguaacauucaacuacuaaccuuaaaauaaucgagaauauaggaaaauaaaaucccuucuguacagaagcuggacaacacaaaugcugaaaaaauaaagguuuaaaccaaagaauacaaauuucaaagaccacgcuuuaagccuaagaguauucuccuaagaacaaaauaugcgagcucaugccagaguguucuugagucugaauuuuaguacuguaacuggcuaccaaacgaacuagcucucacuuuuagacuauuaaauaucaaguccgaaaaugaacuggugaaaccuuuucauuuugccaacauaucuggagcguuacaaaaaaaaaaaaaaucuuuuuuuccccuucauaagaccucugcuuuccaaaacccacccaccucucuuugaaucaauauaaaaauaccucucuucaaaaugaaagcaagaaaaugugacguuucucuagaugaucaugggaauuucacuaaugugagccaaaaucacaaccccccuuuuuuuaaaaaaaugaaagacagagacaaagacugcaggaaaaucagugaccacgccgccaaggucagagugagaagcagggacgagccaggccagugcuaaccacaaggcaggcccgguggcggcuucuccugggcuguuuucuuuagacugccuaaaggccuugccaagaaacaggcggauacugcugaaagaauaucuuccacagcugagcaucugcaugugugacagacagccuugcuccuguguguguggccuauggaacacaaggggcgacugccuggcaagauaggaaaaaccuagguuuuuccaggugagaguggaacaagauuccaacaucauacacaucuaacugaauccaacacacacacacauacacaugcacacacgcacacuuuccuaaucucccggaaguucacuuaguaauuacccagaaacccuucugccugccuucauuuucaguaaaacucucacacuuugauuuuguuccagccaauaccagacauuuuugcauguuuguuuuuuagcaaucuaggggaugguuaaauaagaaagaaagaaagagagagagagagagagagagagagagagagagagagagagagagagagagaagagagagagagagagagagagagagagaaagaaagaaagaaagaaagaaagaaagaaagaaagaaagagagagagagagaaagaaagagagagagaaagaaagaaagaaaagcugccgaucucaaagccucuuuaaaaaaauaaauaaacagcaaacacccuugcugugcacaaaaacuguuaccaagcaaauuuggguugaauuuucuuaaaugauugaaaaagcaaaucuacuuaaacuuccuuuaucagacuucuuuuucuucaagcauucaauagcaaagcuugagggcggcagugguguguguccuggcuaaaagaauguacuaagcacagagcucugagaaugggagaggaaagaaggcaacaaugggagcuggagagaugguucagugguugacuacguacucuugaagacaaccccaguuugguuccuacuauucacaucagauagcucacaacugccucuaacuccaaauccaggggccucugaagucacuugcauguacauacacgcacaagcacgcgcgcgcaaacacacacacacacacacacacacacacacacacacacacagugcaagccgaauaaagccuuuccuccccagcuugauuuuuagucaugguguuuugucacagcaauagaaacccuaacuaagacaaguugguaccaggaguggggauugcugugacagaccuggccauguuuuucagugaauuguggaaggacguuggaacuuugggcuugaagggagauaaaaaauguugagcacagugcagaggaugaaggccuggcuugugaagauucagagggaaguuuaaagaaucuacugaggcuguuugcuacacugaauugagaaucuguucuucuggucagcuaaagcuaaagagucagcagcaacuaauaagagauugacaacauugaagugaaaaccuuuguguuacuaggauaauugauggcacuuagcuggagcuaagaaauuagcagugauugagaggccaguaucacuuaggugaaaucuucuagaaaguauuuucucagaguaagcacagguaggcuauguaccacauggcugagaguguaccuuauacuggcaagcaaacuuaguaguaugagagucaccuaguacuaauucugaagacaugaaggagucauggagagcagcugaggcacuaugagaggccauuggugaaggugaagauagcaguugaaggcccagaacugaaggggucaugcaaacaaguucagacuugaaaccaugaaaaacaaaucuauaugaggcuaugggugaaagcacagcccaguugcagcagaggaccacagcauuuuggagaugccauuaccaugggaugaccaccaagagcagcaguugcagcagaagggagucagacagggcccagaagacaguccaugugugcugcagagggcagagguggagaaaugacucaaguuucuuggaggagcccagaaggcugggaaugaaucccagguaaguagacacugaauaauagauacuguuggagcuugguuuugcuugguucagauugugacugugcccugguucuuccaucuugaagaagauauuuaauuuaauuuugauuuuuuacagaauccacaucugaaagacuuugaacuuuuaaaauaaauuuuggauuuuuaaagagguuggauaucucaaaaagacuaacuuuuggguguuuguuucuuuuuugguuuuuuugagacaggguuucucuguguagcccuggcuguccuggaacucacucuguagaccaggcuggccucaaacucagaaauccaccugccucugccucccaagugcugggauuaaaggugugugccaccacugccuggcaaaauuaacauuuuaauguguuuggauuuauaaagacugugguaauguuaaaguuauguuuuuaaugugacaucuugaggaugaacaaggaaaaagagauaugguuuaauagugacauguuugugugucagguugaccaggagucaguugugcuaucuagccuuacgucaauuugacacacaaacuagaguuaucugaaaggaagguaucuuaauaaaaaaaaaaaugucuccauaauaucuggcuauaaugcacuuuuuaauuacugacugauggggaaggcccagcucauuauggaugaugccaccccuaggcuagugguccuuccuggauucuguauaacaaagcagucugagcaaaccaugaggagcaagccaauaagcagcacccuuccauggucucugcaucagcuccuaucuccaggcuccugcccuguuuuaguuccugugcugacuucuugcaaugauagacuacaauguggaaaugugagcugaauaaacccuuuccucccaaguuuguuuuuuuuuuuuuuuuuuuuuuuuuuuguucguugguugguugguuuguugguuuucgucaugguguuuuguugcagcaauagaaaccuuaacuaagauacauacuaaaauuaaaucauuaaaaagaaaagaaaauuggccccaaugaagagccccuuuaaguagagaaucagaacucaaugaagagaagaaaggugaaccuggaaaauuaaccauuaauaacagaaacaugcccuccuaaccuagcagcauauucaaaaggccaauaagaaagguccaugggugaaggcauuugccagagcugacuuccauccuguaccccaugcaaagcugagagaagagacaaacucugcaaagcugucuucugauguccacauacaaucugggacacgcaugcacauauuugcacaagugcccacaggugcacaugcacacaaacaugcgaguacccuaaaacagugauccuaaaauaaauauacguuuuuaaaguagcaaccaucuucuuggcuauuuuaauuaaaggcugagauugguguugcacuugcuuagcauguagaaggcccuggguccaauuccaaagaauugcuuuaaaggggccaaggaugagagguauagguucugccaugauucugcacagugaggaugagaagagggagaaggggagaaaggagaggaagaauaagaggagaaggaggaagaagaagaggaggaggggaaaugggaggagacagcagcauaauacaaaacauucuccaugaaguuauaaauagaacaauucugaaucauauccauaagugucacuaaguacuaucaguucagaauaaagacacauacacucauuacauccaggacauccucuucucuggcuuguuuuaauguagcgacccagguggugacugugagggggaaccacucuacagaaauuuaaaaguuggagcacauaugcuaaaaagaguggggaaaaccuugguagaaaucuccuagccccauccccaagccucaagggccccugccugugugagggcaggggacauggugggguugcuuuuccugcauccuuggcacuaauuagaacaagggggaaagcuccauuuucaugaccacaacaauaucauuagggguuuuuguuucguuuuguuucauuuuugaagcugagcaugauuuuaacuacuaauuugagacagugcugggguccaauccagggcuuccugcuaaguuacaucgcuccuggcuaagcuacaucccaaguccccagaacaccacuguuguauaaaauuguacuaaaucucaaaugugggaauuugaacuuacaauacgaaggagguuauaaaugagcccauggaacuucuggaaaguugauugcuuucucaagagccacaggcccccugugggggucuucagcuaacaaauauaagaacaugguuugucuucagagaugcauucaaguuugaaaccacaagccuggaaaaacugaaaggcccaugauacucaaaaaguuuacagaucucagaauuuuuggaccaugaauucucaacugucaugucuacaaagauauuucaaaauccauuuacuacagggucugaagcaccuccgcucuaagcauugaauaagagaugcugaguuauacugcagagggaaaacagacuggaugugagacacugcgauguccagccuugguacuccagagggcacaggcccaagggacaaagcucauagaaauucugacaauguuccagauaccagagaaaggaucaugugauugacagguacuuuggaagagacccagcaucacuggggacccugcaucugugcccugcuaucacuuuuccacauuuaacacacuccugugcacacucucuggcauguauuucugaguuucuuggcucuagguaaagucccugaagacagaggcuaucucuauauaucauguugucucuugagcuacaagaagaguugguuuaaauugagaaaaaauuuccaauggcuguuuuuuuuuuuuuccuaucaagcugagguccaagcaagcuccaagagaucugaagagauggaagaaaguaaugaaaauuaaucaugucauuuggccguaucacuuucuuggcuagcucuaugaggccucaacagucaaagagaaauacuuccuacuucagggguaggaaaaguguacacaaagagcuuuaaguucuuaucauaaacacuagcgacacguucauugagcagcaccuaucauuuaacucuuuagacaugaagacgcagccauggaagcuacccaaugcccgcacgcugcagcugaacugacaggaaagagaaugaauaucuacucuucgagcagcaguggcugcaggaaugugcaguagcuuaaauguguuuuucauugugggucgggucugauuucuuucagacggauauugguuggaagcugaggauuggcaauggaguucagaugacagaaagugaagccauggcaggaaaaacugcacagccgcuucacgcuccccuaguuagagcugaaaggcgggcagacugagcacuggauguuccuaaucauaucacuggagagggaugcuccaaaauaccaaaaucaguggauucugggaacuccuccuuacccacuggaguggauagugagauggggaucuugggagaauuacccacagcgguuuugaguuuucugaauaaaggcuggaugggggcggagggaggcagggaaacuguacaggccuccugauugacuucaaaguugauuuuaucugaacauuugagaauugaaugaaggagaggcacuuuauccacauuucccuacgauguugguuucauuuugccauggagagagaaugaucuuaucuuuaguaacaguuccaaugaucauguauuuguaaauacauacacagaccgugccauagacccacuaaccuucaguguguucuuuuuucuauuaauuuguauguacuauuauauaaaguuuuaaaagcugaagucuuucuuuuuguuuucccacaaauacuauuucugcacgaucgauucauuuccucccuugacacccacuaggcgggcaggccacuuguuauaagauuaaacuaaaaccccucauagcgugugcucugucugcuccagaaucuuaaaagcuaagauuaagguaaggcagaagcagcacauaacaacugucaggaggcgaugagcgcuaagaguugugaagugucacagccauaggacugcgggacuugaggcagacagacaccccuccugaaggaaagcuuaacgcuguacgugccauuuaaacuaggagcugggcuuuccaaaggguaagauuucaaaauguagaaacgaaagaagccuuuucaaagcggcaggcaaagcaugaaaauagacaugcagcaggcgaggcauggcaugcucaggagagaaugugcagcaagagaggcauggcgugcucaggaaggaggggacacgcuggcugaagccucagaaagcuuuucccuaguuagcaaacuguuccaacuccugugggaguuguggauguccauggagacagcuuugcuugucacauccuagauaccccacgauagucugaugggcaaaggccgaugaugacagcugugcuccaccacauggacaaggccuccagaaugggaagguuuccacaucucucgcugguuccaaaaagacggcaaccggcacucaaauaggaugaguuauuauacugagccuagauccuaacacuucucuucuaacucauuauauucucuauaauuaaagcuaucuagaaaccuaggaguagaguucuacauuucaggaaaucuucaccaacaacagcaucaccuuuggccauuuagccacuaauacacacaccugcauccaucuugguuuauacccauagcauucagggcgcaucugcacaugcuuauguaccuaguuugccugauucuaugcuucaagacguugacuauucuuuuccaaguaucuagguaucgaaaauaaguaaaugaaauuuuauuuaaagugauguuucuuucuuuucuuucaauuauagcuacaguauuauauuuaucuuuugaaaauuguucagacagauauaaaacauaaggauuucaucucaggauaacaaagggacaguauuaaauuacugguauuaaauaaaaaaagaugcugccucugauacauucuagaaccauuggaauaugucuaguggauugacagaaauaagaugcugcuaaguuauucugagccuguggaaaggacagagaaaucugccauugauuggaugauguaaauacagaacaacccugaggauuucacagcaggacaccccagccccauggugacacaaucagaguuaaaacuucagagaacugagcuauaguaccaaguaagaaacgguuaaggggagaggcagacacugguagccuaggcagcaccaggaauccugguuuauuacaacucccugugucgaggcacagaagggguagcuuuuacagggagauuauuuagagaucaaacggauuuuguggcguuuguuuuaaggauaagaaagagguggaaauugaagaugguaaggaugaaagaaaaauagggauuugagagcuguuuacaaaaucaaagugacuguucaugggcaguguuuuaaaagaacgagcaagggaacagggaggcacgaagccaaguucaggacuucuauucauguccacauaggugggagcugaaaaagaugaagcacaagagaaaagggggagaggccagacaggcagggguaccagagcaggaauagcaaaagacaagccuauaaaaaaggaagcaaccacgggauagaggcugcagaagggacaggaugagaaagcccagcagagggaagcaagugugggccagggcuagcaaucuucaggcugcaguguagcuggggggaguuagaagccagacugccggagacagggagggagugggcgaugcggaaguggaggcgacaagucugacucuuucuagaacuucagugguuaggaaaagagagagagagagagaaauuagauauuggcuccaaagagcaauaaacgaaagggaugcuugugggcaguaaaucugacccgcugaacaagaaaacauuauggggacuguuuguguauuuuccuuugcugucaaauaaaaaaaaauaauugaaccaaaguggccuuuguugucacucugaaauuauguggcaaacuucucaguuggacaaacuauacugauucagauauauuccuaaccaaauaauaauaauuuguaaaguggauuuuaucucuccauaagauuaauaggugaaaagauaugcauuugacucuuucuguaauguacuaaaaacuacaaagcauuggaauacuugaagggucaccagggcaaccugugaugagaagccaagucaccuacccuuccugaggaucuaaaaaacggcuaugcaaccagccagagauauacaccagccuggccagaacccaggcuugguccacaguaguggauuccagucuggcacugagacucacuuagccagggcacuuugguggaugguuucauuucuccaggcuuuugcccucguauuuaaauuaagauugcauccuuaccuacuuuauaggguuaucauaaauacuacauagugguagauacuguuaauauuaugugugugugugugugugugugugugugcgcauaugugugugugugcauaugugugugugugugagcacuccuggacaaauacauucuuguauaugguuguggcugggugggaugguugugacugggugggaaccauguugugugugcguguguguuucuguguguaugucuauguguguguaugaguguguucauuguauauauguguaugugaauuuauguguguuucugugugugugucuauguguguguaugaauguguucguuguauauauguguaugugaauguguguauguuguguguguauauauguguguaugaguauguguauguguauauguguguguguuucacaggacagucucagcugucaguccucucacauuccacuuuguuugaaacaaucuuuuccuugcuuuuccacugauaccccaggcuagcuagggcuucugcgaauuuugcuagcacuguuucucauauucucauagaaaugcugggaucauagucauugaagcuacacauucgacuuuuacacugauucuggggaacugaacucagauugucacacuagcaaguuaagagcuuuugccauggagcaaauaccucaagauuaaaacuacaaagugguuuuucccaguuccuauagacacaaaaggcaagccucuaaggaaaaagaauggacaugcugacuaaagggaucuaccuuguuucuguuuuuuuguuuucauagccugaagagauucuaugagcucaaguacugauguuugacaaggaaguuuagcucuaaaauuagaguccuuugagaauagaacucucaugaccaauaauauuuaccuguuggcaagugccuucaaauauaauguaauuaaugugaaaggcucuuauuacaguaaaauaaaguaaaagucauuguguuuccauucuauggccuuauaugauucuccugagcuucuaaaggcgccccaagggcgacauggggacuuagauacuauugucugaguaacuacaaaauguccaucggaaacggcuuaggaaaggcacugacacaccauaacccagauagccuuugcuauagaagcaggccccucucuccagacucacugggagaacuagaaggagcucugccagagacaacaggucacauuuuaaauucuaaagaauucaccuuuaaggcacagagagcagcaagucugauuuacucaaggacuaaggucccagccuucagaguauccuuauuucaaaugcagcaaagaagccauagcccccagauauguaggcugccaccauagaacugugcacuaagagauggcguuguucauacucaacugguauuuuguccagacaauuuaaaagcccauuaaucuggcugaggcacagacuggucacccaugcuaucaaaaugacacuuucuggugcaacuggugguauggggauguugaccggagagaagugagagacaagauguagaucuacccaauuccagauccuccauuuccaguaagaaaguaaguacuggauaacgcugagacacuggccauagcugguuuuuccagcuccauaaagagcaaagcaaagggcucaauaaucugguuugaggcggcucuugccaccaagagccacuuuagaugcagcuucugagcacugaccuucaacaaaaugaaaggggcaaucuggguuucauuuuucauuauuccucauguugucaugcugguuugcugaaagguggggguggggggccuuggauuuauguucaccacaaccauauaggagucugaggagcugagaagaugaugucagagcccuagaacaggccacugugagccaucaugucggugcugagaauugaacccagguccccugcagaagcaacaaguacuauuaacuacagagccaucucugaagcucuccaaaccauguuucuauuuagggcaagucuuggguuuggcaaccacuaggcagaucucuuauuccuuugaacaucuuacuacugccaaccaaggaacagauacuaagcugugaccuugcuuggcaaggugaagagacaguucuuucuucauacagcaagacacguuuauguaggagugaaacgcucucagccauugugacacuuugcuaauuuuggauguaacauacaaagacuaguucaaccuaucccaggaauuaacuugcaggaaucagacccagaugcaaauccuucacuccacugucucaaaacaugaucuauaucuaaacucacaaacugagauaaaguaaacagaaaagaguguggaaaagaaggagaauaacuuuuaaaaaauuaaagccaguuucuguaugacugcauagagaucucuguuuucguacuauaauacuaaggcagagaaaaagcgucacuuuuaacucuauuagcaagaugaaagggauaaaagggauaggccaaaugacauuauaggcauuaguguugcaaaaaaaauuuuuuucuccccagcagaagagaaguacccccuuuccugggagaaauaagggcaccuaaaacaccccaauagagccagauauagugacucaaaucuuuaauuccagcacuuggaaggcagagaaaggaugaucuuugggaguucaaggagucccaggucagccauaacuagacagugaaacccugucuuuaaaaagaaagggugaugggaggaaagcagaccugugagguaaugcugcugucuuagcuuguguuuuauuuccuauauuuaccaggcaaucagaagagaucugggcacucuaugucuagguguucucuuaagaagucacugauggauaucaaauaagggucuggccuuaggauguuccucaccucacacccagguggagucugcuccguaaagccacuggcccugggcuugucaccacucagacucugaugccuaacaccaaagccugaugcuccaaugacuggcugcaagucugggcuuuuucaaaccuuuucucaugagagugugcagagagagcauauuaugcuaccaauuccagaaagugugguaauccgugaugcuuuccagacaugugugucaaagcgaaguuguaguuaaugcccgcuugcuuaaauuucauccauucguguucaaaucaucugcucugaaagggaaauguuuacucuuguacacauuuggguuuuaaccucgaaaaccauugcuagagauuaaucucagccacugaacaucugcuucaaaacccaaacucaaguccaucauuucaauggcauuacaaauacuccauuccguuuucaauacuccacugcgggcugugacauccuguuaccacacaaaucauuaaagccaaagcuaguuauucaaaugauagcucacagagauaccggcacccaccauuucugccucaaguugcuuuguaguguguagaaggauguauuuguucauguguacguuucauguaaaucuacauacacaauuucaugugaucuucuccuacauaccuuccaaaacucauaaaaucuauaagaccaccagugcugaggaaaaacagaagccgacuaccacgcccauuagcuuaauguagaaugaguguuggcacaucaguacugccugcuuuguuacccccucuuaaaagauccaguacuucccaagugauuagaaagacaagcaugaguuacugcacacaacacuauaaauaaauguaguguacccuguggacucuaaaugcuugcauguguuuaaaucaacuugcuuaacacagacugucagaaaaaggaccuuuguccccuugguuuuuaauuaaacuuuucuguauguucuuuuuuuacuuaaugucuacaucugaauauugacucaucugagugucaccaaagugccugaaauggcuuaggccugacaguuugcuuuagcaguuggacaagccagaucuagucacgcauuccugaugcagcugccccagcaauaauuuuaaggcuuaauuaaguuauacugccuaucacacuuuaaaaaaaaacuaauauugcuaauucauuuacuaaauauaacuaauuccuuuagcaaacagccaagauagacacacagaaaauuagacagaaguuccccccaugagucaaaaggacuaucagaucagccuaguccuugaaugguucaaccccacccccaacacacacacacacacacuuccuguuauacuuugugguauagucugagcuagaauaaagcuugaaagagugccaacagacaucaaacagcaguggcacacaguagguaugcaguaagcaugugcuagcugaugaccuacaacuuauuucaugcuuugcuuuaagagaccccuucacagaccgcuccccuuucuucucccugauaugaacauugauuuuagaggcacgcacaccuccugaucuuccacccccauccuuaacacacuugggauguagaagugcucucuagcuggcuuccgugccucuguauguuccuuacuuccugugucuuccuuccaaucuguuuccugugucccuaucaaacucaaauagccucucugauucgaaacucugaggcuccucuguggacagaaucccuacaauucugcauaagguaagaauucaaacccugcccuuucgaugagccuacugaagaacuaaguaccucacauccaacccuccugccuucucuaucuacucaggacuccuaucaauggcugucuucccucaacaccauccucuggaccaggcuagacucucucccugguaagggacccugcagguacagccagugauaaaggauaaacuccagagaguauagugucccagaagcaagggacucaguguugcugaggaauggcccgcauucccugcccuuucucuucccuguugcuguaacaacugcuuccuucuaucuggauucucaccuucagggcucagcuuucuccaaggugcuugccuuuccuuuagcauuucuaucacacacuaacaaacacacggauacugugcuugugugacagugcuagggaguuuuuguuauguuccuguguugucuugccuugaucaugcuagggacagaaccuaggguccccuacucuaccacaaagcuacacucccagcccuuaaugaaugaugaaugcuuacuaaacucucucuuacaaucaccuuuauaaguagacucucauuauaaacagacuuugucacucacauuuuucucauagagauacugauguccuggaauggaaagugguuugucaagggccacucacuccgaauaugucagggugagggcuucaguuuuguaacccaaaguccagauggacuuccuuucaugcuguuuccucucuucaguucccucaguuccucuccccuccucacagccaacacuccugaagccacggucuaaaucccuuagcccacuuuuuucaccauuacugauuuccccccagcccugggaaucugucucucuacugggaucccuugggucaaggucacucauggcuuccauacugcccagcccaauaguaguuccuagaaaugaaaauuaaacacaguagaggccgcaccucagcagcccugagucccuugcuucugggacacuauacgcucuggagcucuuccuacgccccuggcuguaccugcucagggacucucgccagcucuucgauuuuaucugacuucaaaucuggagucuuuucucagcgcccuguccucagcuuucucuucugucuaacaugauuucuuauguucuauggcuuuuaauaccacuccaggcuuaacacauccuucuagcauugcgacaggacacugucauuacaaaguccaugaucaagggcugaacagucagucacauuaugaaggaaaggaaggaaggaaggaaggaaggaaggaaggaaggaaggaaggaaggaaggaaggacuguaaagauagcucaucacuuaauaucacacccuaaguacgugagaggacccaaguugggauccuaacaccuacauuaaaugguucacaacuaccuauaauuccacuuccaagagacccaauaccuucuacaagccucuaagagcacucacauacauguggcauacgcucacccacacauacacacacuaaaauaaaccuauuuuuaaaaaaccucacuaaauagcucuuaguguuuuauguaaguuuauacuuuguugcuagccugaagcacaugcagccugcaggccacaaguuugacacacuugaacccuacaugaccuagaccguccagugccaugucuaugcacaccuaccucuggggcuuugugaccuacccauucacccacucugcggaagccauucuggcccccuugcuggaccuuaaauaagccaaaggguuuagugauaaugccugcuuuugacacccugccuagauccuccuccugggcacuuacaaaugauucacuuguuaaugagauucagcucucugccuacauugcuccaucuaccacucuuggaugaaaaugcauguaccugccuccaugaucucugaacucugucuccuuccucucuuuuucuuuaaagcacuuagcaucauauauauaauguguguacgaauauaugaauauuuugcuuauugucuucuuuauuccaacauaguagaggaaagcagaucuguuaaaggcaggcuccuugucauagauuauaucuuccuacaacuagaaaaugugcagaaaauaaaacuguggcguacucagccuuaaacaggacaucuauaccacauccccacacccauuccaaggcuaaggcauaucauugcagacaaugggcuggaaaaaugguaugaaccuugcggggcaugguggugcacgccuuuaaucccagcacucggaaggcagaggcaggcggauuucugaguucgaggccagccuggucuacaaagugaguuccaggacagccagagcuacacagagaaaccuugucucgaaaaaccauuuaaaaaaaaaaugguaugaaccagaggcaguggauaaacacaaccgagcacauugcccagacacaacagcgccguugcacuggauucagugguuucuaugcagacucaagccagauaaacccucagcacgggugcugggguggucauggagcgcccagguaaggagcugcucccauuggcaagcugcugggagaagagagucgguuuucuuuuucuuuuccccgagacaggguuucucuguguagcccuguccaggcuguccuggaccuuacucuguagaccaggcuggccuugaacucagaacuccaccugacucugccucccaagugcugggaauaaaggccugcgccaccacugccaagcaagucaguuuucuuuaaggguguggcccugcgaaugaaccaagcuccagugcacugccccacagccaaguacaagcuggacuucccuguuuguguuugcuacuaaagagaaugcaaagccgagugggaagggggagggggaggaccugcgggggggggggaggggaaggaucuucggggggagggggaggagggggagaucugagagaaauuggggaagagggaugaauaugaucaaaacacauuaugugccucucuuuccacugguagcauauaugccuuaguacaggggaacgccagggccaagaggugggagugggugggugggggagugggugugggagggugugggugacuuuugggauagcauuggaaauguaaaugaaauaaauaccuaauaauuaaaaaaagauaaaaaaauacauuaugugaaagucucaaaaaaauuaauaaaauauuuuaaauuuuuugaccaacuguacuagagcccaauaaauacuuguugaaaacaauaaguacacaauagcaucauacaauucaauauugacuguauuaguuauuaauggauggcuaucuuuugaaccauauuuuaaugccuuaugaggggaacagcaugccuuaaauuccaaucuguaaguagcugggaucguauacacagaauaguucaagaggccugcugcugccuggcugguuuaggaaauggagaaaguucaaaugagcauuuacauacagucaauacagagcagcuuugguggugguggugguugugguuguuguuguuacuguuguuuuagguagcccuauauguaaagacuuuaauggagaaaaagaaucaauauagugucuuucuugugagaagagagaucugugacaacaaaaaaagaaaucagugucuauaaauagaaaaaauauaaauaaaacuacaauaauaaaaauaaauaaaaacaugguaagcccagagagugaagaaaccgagcgaagcaaacucagcaggaagguuaaacuaagagcuuaggaugaagagaggauaugagguuucaacucugggggucugcacagagacugcacagggcugaacgguuacaaagaggaggacaagagagaguccucaagaaggcaaggagaagagugcgcugcaaagcuacagguuuuccagaggaggaggaagggcaggggggaggggggagggggagggggagggggagggggagagggagaauaucaacaguuguuuguugccuuaauucucccagggcaaaaauaauuagaaacccaguugguggcacugcuuaccaacugacacagacagggcacuaaaugagcgcacacuuucaaugagugcacacuuccagugaauacacacuuucagcccacacagccgauuucucaguagccuacugcuucuuccucaugcuccagaucuccaaggggaaauccagacucuauuagcuucaucaagaaacauagaugcugaccucaggaggucgcucuguggagcccuugcugagcaagcauggggacauggguuaaccugagcuccaucccaggacccagguauaaaugacagacauacaguaaguaaauaaacaacaagagaauagcccaguguaccagcagcucucagccugugggcuguguucccuucggagacccucuagcuccaaaaauauuuacauuaggauuccuaacaguagcaaaacuacaguaaagaaauagcaauaaaaaauaauuuuaugguugugggucaccacaacaugaugaacuauaugaaagggucacagcauuaggaagguuggacucuuaaugccugcacuggagagauggagacagggagaucccuugggcuugcuaggcugccagccugagguaggagcucugagccaauaagaaacucaaaaaaacaagcaaacaaaaauggugagcaauacuuguggaucacuccaaaguugaccucuggcuugcacagacgugugcuggaacucacacacgcauauauacccacaggcacacggauaauuuuggauguuaaauuuucuguaauaccacucuugucguuaacugcacaccucagagcuuacaucucuguuuggagucugcagagucugucagagcacccugcugcacuggucucauuaaaugugaagacguccuugagaaccccaaaugugcaguuuggcagagcuuuauuuuugaggggaaggguuggagacacgguuucucugcguagcucuggcuguccuggaccucucucugcagagcagccuucccucagacucuuugagaugggccugccuuugccucccgcagcugggauuagaggugcacaccaccaccuuccagcugacagaaugugucaccucggugauuggcuaagccuccgauuucaccuucucagacccucccaaucgaagucaccaacgcccugcacuguucugugugacauacaggucccaguuuaugguuccaacuucuuuuuucucaucuucccuuagccucugugacauuaaaaucaagcacuuggcuaugguggcacacacugguaggacacgcuggaaaggcagaggcagaaggaucgugaguuugaggccagccccgagccacgccucuuccucccuuggcuuuguauuuuuaaauaaagccaaccacugaaggcuggucuucuuuucaaaagcucugaauggagaguaacaacaguccaguuugcacuuacaggucgauuucauagcauggcauuuuuauuuaaaggcauuagccaagucagaugcuucuuagccauaaccuuuccagguguccuuaugaacagccacaucuuggagucuugagucuacauccuaccgcugcccaucuuucuugagcuuugggaauaaagaagagacaguguuugaccuugcgucuucccgaccccuaccgaguccuagacacccaucuucuguggaggcaagcaagugaggagaaauccggcacccauggaguugguuacagcagauccaaacuguagccuuugcuguuggugggacuuagcuaagccuuuugcuucuauccccaaauaaaaagccugucuccgugaccaggcaaucuucccuacacagacuuugcccucucauuuuaugcuccaucagaaaagaagagaauaaaaacaauaacuguaaaacuacuaauacuuaacucuccacaucgaccucaauccucucaccucuauauaaguucuacacacacacacacacacacacacacacacacacacacacacacacacguaaaaaugcugaagcaaucuuaaauuauuuuaacuauggcaauuuaauaauacuuucucuaugucccauuacauucucaguuucaaaucucaauguuugacucaagucuuagugacauuaaaccauuuuuaaaguauucacuagagaugugugaggcugucaaggcccucgacucugcaaacaagaugacucuuucucugucuacuccaugggguuauugugacgccguaguauuaacgacaaauuuuguaaaugaugcaaucaggccaacagaaccccuccaaaggaugacacauacagagagagcucugaagaaauuugaagacgggacgcaagaaccucucggagcaugucaauggcgcccagcauagccgacuggaguuuuaugaaacauacugugcauguggaaagcauccacuaaagcagagaggugagagggagaacacacacgguaaacaaggagccaacucaaccaugcaagguuacauucugaggcaggcaagcauaacaggaaauaaccaaugcagcaagcuagaacacuuuugagagcaauggggauagaggaugucuucacaccgauuucuggaaagaaaguuuuagaauguucaucuuuacaaaacagcugagcucucauuuuugaguugagagggaggaucagcagacagcuggcuacugccauccaaagacaaagucagcuuggaaggugaagacaacauauaaaauaggaaguauacccaaauauauucacauauaucagcauacagguaaggagcagauacuacaggaauuaucccuaaauaugaaauaaguccucuauggugcuguguuugaaaugacauguuuaugcuuccugaauuuucugcagcuuuuacaaauguuuuccuuacgugguaauuaagugcuauuagaaauguaaacaaagaauccugaaacacugcaugucauacauaagccuuucuuacuagccucauaauuuuauaacuugcaaaacugaaacauuuuccacagcaucuaucaaaaauagaggguauuacugccucucaacgguagcauaauauuuaucuaugagaucuuaaaagggaauaaaaagcaaauccuauguaguaggugagauuauuuaguccuccugacuauacucuuuccaguuucuccaagcagagcacugguuuaguggcaccugcagggguccgugugcagcugauucccaccuugcuuuccuucccagaacccuacgcuuuauauccuaggcuuucagacuucaaguuucaugccaauuaugauaaaauaauauuugggucucugaauuaguuuagacuccucuuagccucugauacauaguugcucccacccccagaacuaccccaggaaauucaagccguagaacagauacuggcccaucauaggaaaagcaaaaucaacuuuccuuccaugaauaacaaugcuccaagugaugcuucaguguccuccuuuguaaaaagggacauuauuggacauauagaagccaaugcaggcccucaugagccaguaaaaauuacauuguauccucuccacaccacauuagaugaguauuugggguuuggguuuggauuggguugggcuggguuuuuuccucuguuuagcuguagagccuggaaugaguaauuuugacuguuaaccuaacuggauuuuuaaaaacaccuaucuaggacauuaaugaagcugcucaucuuuaggugugucuguuagaagauuuucagggagaauuaaugggauaaaggcaugcccugaauccagguaccaccacacugucaccuggagucccaaaaugaauaagaagggaaaaggaggaugacccauuguggaacaacacugcccugucucugcaaugauuugauaggaugugggcaagcagccuccaaggccacuaauaggagaugcuccugucgucauagcuucccaccaugaugaacugaccgagcacugagccagaauaaagucuuccuuuuguaaguggcuucuuugcagguaucugggcagagcaauaaaaaaaauaacuaguccagaaacaaaauucaaacucaaauguguucagggacccuugaugccaagcagagcaguguuccccugcccuggccagaaaggagguauggugucucaaggagacaagaaagcagagaaaguacacaaagcguaaaccaagacucgggguccucaaggauagagcggguguucuagagacaggauaguggcuggaauggaugauuggcaagauuggcagugccauaggacuucugacaugugggcuuuuagaaguuacuggaaauuaaauugagggcuggaggaugcucauuuucucuacagacuaagcccuuucuggccagauguacucaagcuuaagagugaguucccuccucucggcuucauccccgcucuguuggcaucuuuuccgguaaguucucaaagcuauuucaucagcaucugguacucaaaggcacuaaacaagagcaagccaaggaugaauguguuaaaaaaaaaaaaucaguuuuuuuccuuucccgcuacuuaguucccagcaacaacaacucugacuaauuauuuauuauuaaaugccuaggccauugcuuuggcuuauucucuaacucauaacugauuuaaacaugcaaccuauucuacgugucccucucagugucucccacagcgucuuccucgagucucucauuuuagucucucaauauuucccagaauccccuuucuuccugccagugucccaccuccuauuuccugccucagcucauuggcuauuggcuuuuuaauugacagguggugcuucuaagagauucucucuacgugaauguuuguccgauuaauauacacauaaaggauaaagacguguuauuaaaagcagaguuucuuccuuaagauugacucauuuucauugccaacaucacugagaauaaaaaaccuaauguaaaucucaacagucacuggaauacaguuugggucaccaaccacaaaaauaaaaugaaagauuaaaaugauuaaaaaaaaagcuuaggaacacaauccuaauacacaaaguuauauuuuaaaagcagugacauuaaaucacuggcaaaccuuaagcuuuccagcagccuagcuaaagcguucugugaugacauucuccuccuaagaaaaccaucaaaaccaaccccaagaacugggcagggauggcaugaugcuagaaugaggcuacccuucaccuucggggucuuggcucucuucucuaaccccccgcacuggagacgcugaaguccaaggcagccuaaaccacacagugaaccucaggccaggcugggcuaaaagcaaaaccguauuagauauuaacaacgagucaucugauaaguuuuucuuuuccuuuuggaagaauuggucccaguuuaaaaggaauaaaagucagcauguauaaauuagccagaaguucuugcuacuucucccaaaacagggaguucuuccuucccuguaaaguuuuuauuuacagucauaaaugacucacugcaucucaacaugcagcaaaagugcucauaaccaaagccaucuaucuagaccaucacauuuccuuccucuggucaguuugugccacaaaucucaugggacaaaggcuacauuucaucuuuuaaugucagauuccacgccccccccccccacaguuaaaguuguuauuuuucaacaaaguaaaaugaggugguggguuaaaacccaucaugguuucuccagagcugugacugacagugaacaacugacccccagaaaaaaaaguguguguguguguguguguguuuacaucuguguguguguguuugggacuguucgucuugcaaagugcaucucuguuaguucacuuccauucaauguuuccccugggcuacuagggaacaaauuaaguauaauuuuaaaaguuucugugccuucuagccacccuuagccccuuucuagauagcuaagggcaaagcaucccuccuuccucaucauucaggcucuaccaaggaaaugcugcaccggucaagaaagucuaucaacguauagaagcaugaguaucguauagaaaagaggcaaaaaugagcuuguaaaacaugaaauggcugaggcuggaggaagauggcucggaccuuaaaucgcuuauugcacaagcaagagcaacugagcucuguccccagcauccaugugaauagcugggcuuggugauuacccuaguaacccagcgcuggagaggaggagacaggcagaaccaugcagcuugaggaacagccaaucagggcacgccaguuucagugagagacccugucucagaagaaugagguggauggaugguuccuaaggaacaagaccugauguuugaccucugaccuccacauccaucugcacacacacauuaacccucacacacaugaaccugcacucacacaugcacacacaaacauacacacacauauacacacauacacacacauauacauguguacacacacacagacgaagcagguauuuauucugcaccuuggaccagcuacauuuuuuucuauuauuuagaaccccaaaacucuggccuuuaaaagaaugucccguaaauccagucugugccaccaguguguaauuagccaaggagaauucaaggaaccccugaagaauuaacacgcgggaccugucucaauugugcaccuuagaucccuugagucuccagaccuucacugaagccuuuguccuucucagcugagauguggacauucucacggccacacagccaaccuucugcagggcccugaccuggaaaacucuuacccaggcuucugccacagcuccacuuaaacuaaaggagcuagcucacagucuuucucuggaaaagaaauucucagggaagaaaagaacugcuaagggcaaagggggugggguggggggguccuaagggugcaguguggacucuuccucagauuaaccccuacacagucaacugcauuauugauuccucagaagaaaaaaaaaauggucaacuacaguucauaaccuuucaaagguguuguaggaaaagacaagaguuauuuuuaauaaagauuaacaauacuuauaaccccuaaaaggaaugacccaagaaagaccccuuucuuucuugucaccuggcuuucuuuccaaucgucacuaugcuggccucaagggcaaagagaagggccuuaauccuuuuuagguuagcccagcagcugcaaacucaagaauucuuggaggugggguucuuggaaauaagucacaugggagagacagggugagacccaaauguagcaaccacucaaagagcuaaauaaagaaagaccuaagguaccaaagccaucaaggaaaguuuacagacaaggaagcaagucgggcauaaaagagaaguggguugugacuucugacccuguaguggcuguggguggcucugucauggugacccaugcauuggcuucagggucuaaaugugcuccaugaucccagaaacccaagguauuuuagaaagaaagaaaaauagguuuucggagucuucucccuucccaucgccuggugccacacccacucaaccuucucgcucuaugucaccugcuucaaaagcccguuuugucaucuaauuauuuuuccccuucagagaaaacaggacccacuuaguucacagcagagaacucaucugcaaaccacagaggcgagcgcuuuguuucucagcauccagcggcuuaaaggaaaccaucugcagauaugcuaaugugcuauuacaaaagagcuucaggaaggugugugcccgaugcagacgggaggauugaaagacugaacaauaaagcauggggcugaggagagggcucaacggauaagcacuuaucauaagagcaaagaccugaguucaaauccugagauucccauguaaaaguagggcaccuaggugugugccuguaauccugcugcuuuauagaaaguggaauguagagacagaauagccagaagcccaugaggcagccagccugguguaggcagcacaaaggagaaagacucagucuuaaauaagaagguaaggaccaaugccugagguuguccucuaaguuccacauacagccuaugacucacuugcacacacacacacacacacacacacacacacacacacguacaaacugagacgcaugacacaugacugguucucugagaaagcaacauaacaacuuagcacaaagugcucucugcugcccgcaaucucuagccuugaguuagagaacgguguggucggucagcuuuucuuucacagcucagcucugucuaauggcuucacaccuccacuagcuuuuauacccauggaaguuucugguguggggagacaaauuccacccaccuccucucuccuauccucccaugugaccguggaucccuugagggugaguuuuuuuggaucauaucacucaagauccagguuaaacuugguuugguguggccuggaaaugccuuucauuucucuuaguaggagaaaaaugaaccaacuucauaaaacacuaccuuuggucccuggaacacacagaucaaauaaacccaagaguuucugccaagagaccauucucacccggaguccuaaauuccucacaauggaucuucucugguuauuaauagugauuuuuuuuuaucacauggcagaccuguuccucuuuugggucauauuuuucucaauuaaagauucuaauggccacugaagcaagacaaauuacccucaucauuuauguccacaaaccccugugauucugagccucagaaccguaaugggaaacagaaaucaggccuuugauuuuuuuagaagcagaaagguggcauuauugcugccugucccaagcacacaaaggauugcuuagaacgggaucugaagagccccccaacuccaacugucaaucuccaggaacccauucugcccagcaauucucccucagccaaccugcucuuccuuaaaucucacccacaucccucaugcuccaguuaaaugaccugcucuucuuccucugacuucccccgaaacaaaacagcuggccaccauacagagcuuaauaagucucauaauuuccaagucuguuauuaagucauuuuuuucagccuccucuucaugaagcuaaauaaucccaagucuuucaacuuauccuuauagguucaauuuuacaauccuuuaaucaucacaaugcucucugcucaacauucucaaguauuccacgucgcucauguguucugaaacccagcucaccuuuggaauuauuucucaucguccagaaaagcccaggaucuucguguguuacacaugcacagccccaggagaauucacuccaacagguaauugauugcugcaaugucugguuuauuuuuuaggagaaauguccccuccacaugcugcccgggacccaguauucugaccaagugccagaugcuggugagcuaucccggcuccaccggcacccacuccauuuccucaggagaguucuucaaggucuugcuuacacccauucccuguuaaguugggucuuacaauccuccacaguauccgguuaaucugaucugauccacuuacuguugaucagccaaaagugguguaaggcauuauccuucacacacgccaucuacacacacacaguccugagaaccuucacucagagaguaagcucaaagaccuccgaagaacacuaacggggaagcuugaagccagcagaguaaagacacagggagucccugucuucuccuccacccgagcccgaccaaccacagggcgaucacugaacacacaguuuccgagugccagaucccuacauacucuuuuuaucaaauuuccuccuccuccucaacuuuuaggcuccucuuuccuaucaaaaucagauacucaauuuugauaugcaucaugcuaaggucucugcacacaacauauauucugcccugaagucucuuccccagcguguccaguuggguucuccucagccugaagguucuauacccaguguccgcccuuuagagggcuauuguagaaugcgcucuucccugucuccacugcccgcuggcuuuuauuacuuauguaaguucccugucaccacagccugugagcagaugugaaagauaaaucugccuuuuaugucuuaacuaucuuugcuauagaaauuuggcuccucaaagaugagggcccugcuguuaccucugagugcugggcaacauaagcaugcagcacuccaaccaguuuaugcugggagacugaaccccgggcuuugucuacccacugagccacacccccagacuccauaaucaugcuuuucuuccucugacucuacuccugguagcugccuaacaugugaggggcagcuuggaaauaauuuggcagugaagaaauguucccacuucaauaaauauuuagauuuuaaaauguaccucuaacaaacaaacacacacacacacucaugcacgcacgcacacacacacacgcacugucagcuauaauguagaaagguuguguuuuuaguggugggacagguuagaggaaggauagaacuuccucaaaucaucuaucuucgaaccauucagucuuugacugagguagccauggucuggaaaccacaucaggucuuauuaucucgaaggaauggacuuuugcuuccagugaucacuuuuuuucaacuucaaagcagcuguucuguucugcagaguccuacguuucuugaggccacuaugucacugaaauacucacacuagcucagaaagguaccugggguggugcauaccacagcaucaaucguaccacucaaaacagacacuaagguagauaauugcuauuuucuuuuaagaguggacaguccucagguagcccaggcuggccucaaaaauuacugaguaccauagaguaauguugaauuucaauccucuuuccuccaacuccagaguucagggauugcgaucuugcaccaucaaucacacuugguuucugaggugcuggggagugaacccagggcuuugugcaugcuggacaagcaauuugccagugaaaaacaucugcaucuccaguaaucauuaauuuucuucuuuucgacuguucaaaaauuauuuuauaaauuuaugugcauagguguuaaugccugcacagauuacuacauacaacuuucgugccuagugucugaggaggcccgaagagggucuuggcuccccuggaacuggacuuacagaugguuaugcgcugcucugggaauugaacccaugaccuuuagaagagcagucaaugaucuuaaccacugagcuaucccuccagccccuucuucugauguuucuucucuaaggauuuuugccacuuccuauuugugucauuauuuggagguuagugcauuuucaagugauagcuuuacuucaauuauuguugguuaacuucuacaaugugucaacuucaccucacaaaaagugaggcuuuuagagacugcagaaauguugcugagugaauucagggcccacuaaauccacgcagagauacauacauguauaaucgcaugugucuguguguucccuuauccgucagacuucuauucuauugggugagguggcagcacaguagagcugguuucucacagugcacacuucuugacaguaauuaggaaugugcugggcucaacgcuagaagccuccauaacuucagugacaaagacauucgagagcuucuuguggugaauaacugaacaggaagagggcugggauccuugcccagcaccauaaaucaucugcugacuugcagcgugacacagggaaaauuagcuuucaggugcucgugccucaguuucccuuccuguaaaaugcccagugccucucugccagggcugugaagacaaucgaugagguaaugucucagcguuuggaagucuuuggcagaaaggcgcuauauaauuacuauuugguauucacgcugccccucgugggugccaagaacuuuacgaucauuccucgggaguuacucccagcuacugugaacuugccuucaugucuacuuacaguuaaagaaugaagaaaucgaaccagggagaagcuuagagaugugugcggggucacuaagauggcucccaggucuucaaaugagggucuugcacaucacccacuucccuucaccacaggcaaagccacaccuucugucuggaccagcccagacaggguuaauuuccuguugagagccucugaagcugucuuugggguacaacacauaaccacuucagcuuagccaaauuguuaagaaggcgaaaccaaaaucaagguucuaggacuagaagcccaggcuaacccuucuugguuuaugcaccucucuuucgccucacuuucuguucaaccaucagcauuggguaccucagccaucgccuugcaggagccacgguuuacuagcccuaaggaggcauagagaacagugcauguagucuuaaguccccauccucccgaucaaaagauaugcuaucauagaaacucagagugguacucagcuaaccucuuccccaccagccgcuucuugcuuccaaugguagauacaccaaucuguagcacagucaccauacccaccuugcccaaagacagcucacaguagaccacagacucuugucucucugguccacacauaugcuuucuaaccuuucauuugacccacuuacaucuaaaagaagcaucuuuugguucugaggcuagacugucauuacaaugaccaaaagcauacagcgucagcaugcgaugauggucacucugguggauccguggguagauaacaucugaggcucagguucaaugauggagcucuuugacauaaauggaaauaggaaaaucccauagcaacugauggucuggccagguaaaacucaagaagcaagauucuaguucucgcccuuuccuugccuccucuuaggggauauucuuucccagcuccuccccacugcccugcugaacucuucauggcucccaggaguaggcacuuaaagccacuccccuuucucuuuuccaggagaguuuaucugcuccacauuccacucucuuacccucuacuccagccaguaauggccugggagucuuaacucaaaggacuaccuaggaguguggaucucagauagauggaucaccucuaguacuucgcggaagccggcucacccaacugcugacauucagaaacaaaaacugagcaccaacuacccugaugacaccacaggcugucaucagagggaacacagaaggaccuagauuaagagaaugggaagcaaggccagaauagugggugacuagaucaaugacugucaccaguaauguaaggucaguauaacagguuauaccacuggggacuaauccugaaagucugaaauaagggcaaacuagaaugucacucaucaggaaguauggcaacugcaguuuagaacauguagaccuuuuuucuuuacaaggacagacagcaugauuaauuuguuaagaagauuaugaacacuacacuggugaauguaaccagcaaaaggaaagaauuacagaaugcuuuuccuccucggaggggaagaggcgccauguguaucuagaauaaaacuagacaaggaaaauucuauggcaggaaaucuuugcaagagaagguaaguucaaaauauagacgccccaccaccacaaccaccacaaaaaaaaaaaaaacaaaaaaaaaaaccacuccuacuuuaaaauuacagcagcagcaacaauaacaaaaacauauucugaaguaguguaccagccaugaacaguacacucagcccccugugagaaccgacccacagccaacgacggugcuuaaugcugguguccgaggucuccaagaggagcagagacuuaugaugcgugcacucuggcugucucuguuuacuuucuacaucuuacuugccaagaccuuggcaaguagaaaucacucagcaauucuuccucucugccuugaacucugcuccuacagaaggagguucccaucacauuuauuuauuuauuuauuuugcucaugaacacaagccugacuuaacuguuucuggagauguuauaaguuaaagccucaaccuucaauuuuuaacggaaaggcuuuggucuacuagcaaauaggcuuucagcaccagagaacagcagacuaguagagaacagcagacuaguagagagguuaccagaagcacaggguagccuuucacuugcuacuugggcgccacaucauaaagagucucuucuuuuaaccaucauuuauaaaggccguauuaauccuuaagaacucaguguuuuuauguucucuuugcuucccaaaucacuucaaagucaagaacaauuacguucccauaaguugccccaauuaaaacuuacacgugaauuuuaugugaagggaaagccaugcuucaguugacagcauaaaugucaucaauaugaaaauccuaccuaggaacaauuauggccacaaaaaaaaaguaaaacaaucacucucucucccacuaucaucugucaguauaaacuaugcuauacaaaucaaguagccacuggguaaaauacuacaugacccaaaacagaagcaagggaucucucagugaucuaucacaaguuguuucucagaagaaagaaaagccauuuucauaaauaagaaaccuccccauuuuaaaaaaaaaucaaucuuuuuuuuucagucccuagcacuauuuuaagaacaaaccguuccugaccugagaaaguacugacacauucgaauggagccugcguguggauugagaacccuagaacacacguaucauuugaaugcuauauuuaguuagaaauaaauccaucaacugggaugggaugcauguggaaagugggccuccccagcaaggcugcuguuaacuccagucccaggcgaugagaaagcaagccuagcggggggggggggggggguagccaggggagugcacaggagggacaugagcauguuuuaacggcugugauaauuugccaugaaaggaugcuaaggccauagcuccuugcugcagcaugccaugcgcuccugaauuaaauuacugccaugcagucugcuagcgaaggaauguguaaacaggccauauagccuugcaucagucccagacucuugcacaacgcaaaaugccucucgaugugucauuuccuucuuggccaccuucccagcuccugacagucagucaacaacagaaagaaaaguacugaaagagauuuaaaacugcucuucuagagagcacauuccaccaaauucuaccagacaccagggccaaccuccaccagcacuguuuccuuaaagagagggggugaguacgggaagggaucuuccugcuguuacuagaauuuuaaaauaauauuuuauauaguagggggccaaaugacuggcaucuauaccaaucaagcugcucuuuauagaugcaaguuugcaaauaucaaaauauggaacuugccuguaauuuccuuugcuuggggaccuuggaaaacagugagcaagccaggugaaaaucuaguagucaaaugcuuagggcugaggagacggucugauuaguaaaggccugcuacacaaaccugaggccugagugcagaguuccucacacccgcauuaaaggcugagcacagcagugcaggccugaggugccagggcugagguggaagacccgugaagauccuagggacucaucugcagacucagugagagaccuggccucagaaacgacauuaaccuuugaccuucacacaacgcucacaaaugugcauguagaccccacacacuugugcuauaugcacacacgcacacacauucauauguaagcauguacacccaccaccacacaguuaccuacacaugugcaugcagacacacacacacagacacacacacauacacacuuacauguguacaugcaccccacacacauguguguacaugaauauguacacacagacacagagaaagagagacagacagacagauagacugacaggcaggcaggcagagacauagagggagaacuuaagggcuuuuuauucauguuucucagggaaaacuagacuucaggcuacuggcaucaguacagggcccaggaaaugccuucauagacagcagggauguagagauaggaagcucucccagaaacagcacauaaucuuaaaguguuucuacacuucauccaugugacacagcuuaccuguccccgcccaccucuguucacgagugaccagucucuaaauacucauccaccauuccuaagcaagcaaaagucacggccagccaucagaaaaagcucaagaaggauacaaaguaauggcagagaagaagggugagccaucccagauguuaucuggaaugaggaagagaaagccuuaacccuccaguccucuccagcacuucauaggccugggggacagcccagaacccaauagagcuacacaaagagcaaggagacacugcuuugaccccugccuucaguguaguaagguaaaacuucugccagcagacaugucucaggaauauggaggaagggcuggagggaaaauucagcagcuaagagcacucacuggucuugcagaggaccauguugggguucucaggcacccccacugggaagcucacaaugaccugugacuccagccccaaaagcuccaaaguccuuuucuggccucugcaaaugcccacacccauaggcucaggcccauacacagacaugcgcacacacauaaauaaaaauaaaucuugaaggaacaacaacaacaacaaaaaaagaauacagaggaauaaagccucuuuagagaacaaaauuuguugaugcaauuggggaccauuggaaaucuguaaaacaggaggaagaagcaguuugucuucaggacccaggucacaagcuacacaaaccaccauacuaaggcuuccuucaaacacagugacuucccagacacugaagagaagagacgagcagagagagguggugcuaccuccccgugcccugcaccugugggaaagggauuagaaugcugaggccaaagcaggguucuccagggcuucuccauucucccaacguggcagggggagguggccagccacaucgaacaaaguccugcagggagcauagacucggguauuuugaaucucuccuugagaguagauggcuuacuuccuggagguucaaugcacagaaaugcucagauguccacucacucacauauaccuguuacaugucaaacauggauggcaccaacgaugagauuucaggcuuggauacuuguggaugcauaguucugcugggggauacugugcugcuaaggcagccuuguaacaucauuuuuuuccuucucuccuauggauauugguguggcucccuuugauauuaauaugcugauuaauaucagcacggcaauguaauacccuuucgcucacuacauauccuggagaucugcuuaagucacaaugaagcugugacuguaauguggagucucucccuggaacuuuaagaacuaagcaugcacacgugccuaccacacuuacagucuggggagccacccacaugccacccaagccauugacuuuguauggucccuuccucuucuaccugugcuugaccugugucuugauuuauccaagagaguguaggagugguagcaccaugcuggcucugagccuaugccucacgacaaccuaguugccucuauucugcaccuuagggagccuugaacugccaugcaggaagccaguaucugcuugugagaacuucuagggagagcauguggagagggagaggcugugaaacaccauggcggagggagaccccuuuuuccaaggucccugccaaagcacuagacgcaugaaugaaaccauuguggacugcccaguauuggucacccaccaucugacuacggccacaugucagaccccaaacaagacuaucauaaaaaccuguccagguuaauucuggccagcccauggaauagugaaaaauauuuauuuaaagagagaaaaaaaaaacuagugauuguuuuaagucauugccugggggucauuucugaagacucggcaugaugguucaaaugacuuaacuauagcgacuuaccugcuaugggcucuucagucaacaguaucuguuucuaucaguccuaacucagaacauaguucccuaaccagacaacauggcauggcuaacugaguuuccaccuccccgcagaaauucuuuaaaccaggcuggcauuggagccgagugcagaagcggaccagaggauccuaauaggaagugauguguaaagaaguuagaaauccaaacgcauuccgggggcugccgcugcugcacuggcuucuccugcuggcgaacagacggcacuugcucuucaaagcuaaguugccaacagcaggucaaagcgccgagccucuguacaagacuuacaaauuugggaucuucagcaugaugucaugucuuaaaaugauaagcugggccaaggagagaaacugcauuuugcaaagaacgugcgcccauucucauguuuacgcuacuuuaagaugaagggucuaauaagucaugggcuauguugcuuuaaagggaaguuuuauaacugagaugaaucacaacugccggagaucaaaguugaaaaacaucaaugaugccauaggguacuuuuuaaucuuguaaugagugaugaucacguguucuuaugaagugaguccaacugccaacgccagauguguauauuagaaagggaguuguuugugaugcgacaggccuggcucagcugccagagacagaaaacauggaaggaugaacccuuucaguuuugacugaaaagcaagucuuggcagauguguuguugauaaguagggccccagagugggguucggguaccaugcagcaccccgccugggcguuuguagcccacaaaaagugucgcucaucagcucugcacagcucuccccaggcagugggauauaaauauguguucaaaccacgauuuauaacacggacccaugucauuuacuauugugugaaaauuagugaagcuuuauuccagaaguggggaaaaaacaacacagcagagagcagauuaaacgagccuguuuccugaugcauacuuaaaaguuuacagcaaacuccucccagugggagaagacuaauguaguaauagcugauguuuaaugagcacuuacuacaagacagcuaccacacuaccuaguuuacauaucauauaucguucaacuuucuuaacagcaacugaugcagaagauguguuccguguccagagcaaacaaaugcuggcucugggauuucagcccaagcaaucugacagacccaaccagagaacucagaauaugucaguacccagucaucuggggcacuggaaacaauguuucaguauacacccaggucuuuaaggaaagggcggggaauuccacugauaaacagaaaccaacaacgcaaagcccucaguccuucaaaccucucaaguaauagcuagaaauaugcugcucagauggcaaaucacagagacuucaggaauuauaauuggagggaagagagaguagaucaguuguacugauuaucuuuguuuucuguguguggagaagccuuuuacuaagccuuucucuguugauggcugauaaaguaagccaguuggaaaucuagagcaaggauggaaaacuacaaguugugggccacaucuggcccaccaguuguuuuuagaaaguuuagggaucuuuaaaaaaaaaguaucuuuauuauucuuuauguguugccucaguuucugugcacaauaugcacaccggaggcuggguucagguccccugaaauuggacuuauaggcagcugugagucaccuaaugugaggguugagaaccaaaccaggguccucuacacgagcaguaagcacucuuaauucaugagccaucucucuggcucuguaaauaaaguuuuauuuaaacacagcuugaccacuuguuugcauaauggcuuagacugcuuuugcaguaaaaaggcaaaguugggucuuuaugaccgauggccaagagcaaggcagaaggagagaauccagcaauguccaaguuguaggguuaaccagucgcucauaccagauacaucccuacauucaagcaagugaccauacaguggcagggaaaugacaauacauuuucaaauaguacuuaauuucuaagaaaugcuacaaggacaggaagucuuccuuuccuagaucggugucugcuucuccacugcaccccaccccccccccauccccucaggacuacccaaagcauagacugagaucauacauacaacauguaucauguagucccagcccccauagccgccagggcacgugucuuucuuaguagaccuaucugcuaauagaugcugccccaaaacaaucucuuugaaaugagauccugccauccccacuggaauccgaaguaaguguaccaagccaucagcccucuccccuuuugcaccuccuuuagaauggcuggccaccaauccuucccugcuucucucccaaccaccaauuuagaagcaccccucucuacaguaaacacacguacacuuagacaggugcacacaauaauggcuuuucugugcacugaagaaagcagccgggaucuuucaagggcaaauauuaguggugaugaauaaauauuaaaaggccauugugccacuuuaugcauuagggggaugggacugccucuuaaguaacccauggacuugucaggucaaugguuggaagaugucuggccucagaaggaaaucaacccagauuuauagcaauccagaaaagacuagcagagcucaaaccagccaagcacccagaugugcucucuucaccugugcugcguaaccucugguccucgagacuuaggauuugagaacacacacauacacacacacacacacacacacacacacacacacacacagagagagagagagagagagagaacgcgcgcgugcaaaauaccuaauaggacauucccaaaaugaacagacagggccagcacugaccccacguuaggaauuuggaagaaagccuuauacaugaaaggaagaaaaaaacaagccucaaagauuucuuuggggcagaaaaccucccuugcucaggcaagccuuugugacaaagacaggggcauaagagauggaggugggggugggggcuacuguaagauugaucccauugcuaaaagaugcacaguacaggaagaggcgaagcccucuaggccuccucccuuacuucuggggauggaaagaauccguccucacugucuagguggaagaucaaguuagaacaaacacuuccauugcugccugcccccaucaaaagccaaauuuaaccuccuaauugcaaugccugggacuuccaauguauucagccugcaaaggcagcccauucuaugcuauuuacauuauauuaugugcuacagaacucgucucaccucgacuuggaauaaccuuugcucuguagauguauuuuagugccaggcuugcucaagucacugugggcggcaguggaagucagucaggucugacccagauucaggaagagaauaaauccuggccuagacagagacacuaccugcagcugagcaccagauaaagcuuugcaagacauagacaaagaaaccaagguggacaugaaccuagcuuguaucuaucucucuguuaaagaaacuauccaaaacaguuacuagaaaauggccagacaaccguguuuguaaugaugaagcaaguuaucauuugcaaauaaauucuuuguaauuaaguccugugcucuuuauaaagggaacugagugggcgagcuuaaaaaaaaaaaaaaaaacaaaacaaaaaaaaaaaaaaacaccgcauucuugggccaugggaaacacacacaaaugcuuuuuuacuaagcucaagauuuuaaaguuuauaguuugcuuccucagccucgugggucucuuuggccccucccacugcacagaagggaugagcggagugccuuagcuaaaaaguuaucaugacugaauagcuauccacuuguuccccaaaguuauaaagcaguucuaugggaaagacuaagcuauaauuuuauuuucuauuaacuguaaaguucuaugaacugcccuucccugaaauguauucaaaaauaaaguacgauaaaguuugcagaggccauguguagugacagugacacuaacaccuucagagugaauucuucacaggguccccacaaacucuauuagcauuuucaauagaaagguaggcacuuacuucuugguucccggggaccguccacugucacuuuaauagcucugugguaaguggccacuuggggaggauuugugaagacuguuauggucaaggugaaacucuugccugcagauuuaagagaggaaacggugacuauaaauggguagcagugaugaccuuacaauaauacagacauccaaaucucaccauggcaucucugaggcagcaaccaaucaggaauugguccccuaaaccagaaacccucugacagccacucaagaacaccuguaaauuugaucagcaucucuccugcgguucucugcacgcagccucuacccucuacccccacccccaccucuacccccacccccaccucuacccccacucccaaacaaucucuuugguaacagaaccaaaacucuggggcugcuucaagaggcaucucugauuuuuuuuuuccauuuuucuccaacguucuccaacgucaggagcacaucccagcgugagggcagacaauuuuagaaguguuuauuuaggauaaggucaugaccccuugagagaacaaugguaaauuauuacugguggcguuacuuacaucacagggccuuagcacugagcugcucagauaaacuuccauaagaugaaagcgggaagcuccuauggcaaucauuucuaggggagcccgugucuccaggccuucaugcgccugggggagaugauuucaucuccaagcagucuuuccccucccuuaccacacaucucaucaauaaaucuggaaggaucucccuagggugacuuaguuucugcuaagcaagcaugacaccucucgacgcaaacauguuuuacuuuuaaaagagaguuucugcaaggcugcauucccucugaugcuucaaauuaaugagcuuuaaacgugaugaggaaugggagggggcagggaagagagugugguaagggaucugagcgucugcuuucuccaggagaugccggccucuguucuacagaugcacugacaguuguaaucaguuagauuugcaaugguuagucaugucagauaguuagaacugcaaacuguuacaagacaggaaaaggugggcgagaagcggugacucaauaaaacagcagcgagcugagccccaguacucaagggcugccccuguagcagauaaaagccucccuuuguuuugcuuuguuuuuuggucagauuuuuuuuuccccauucuacugaaagcugggaguauuaaaucaaaacacaaaucuuagacaauauguagcaaugugaaguuuaaugcaaucuuuucauagcuuaauauggaacagguucuacgccaggcuuaauggggaacaggucuuuggcugucaagucuacugaauggcuuuucuuuucaaaccagaccauguaaguugcuaaaaucugguuaagaaacacaucauuuguuacuguguguggauagucuuaagaccccuugacugccauccguggcuacagggguuaagaggcagagggcaugcaggaaugugggaagggccaacaauaagacagaugaauguugaucagaaacucagucagcuccagacuggucgaccacauuaucucauuuaaucuuccccaguuagagucaucgccccagcucacgaaggaggaagccuuagccccagagaaacuuagucauuuacccaaggucacacaguuaauaaaugggaaacaucagaaaccaaacucaaaucuuucugaccuuaaauauucgaggguagagauguaacucggagauagcuagccuaugcaaggcccuggauuuaauucucccacauagaaaagaaggaagaaagggaaagaaaaggcauggaggaagaggagagagggaggggaggaaggaaaaauggagggaggaaggaagggagggaaggaaaaagggaagagggaagaagggauagggggaugacagaggaaagggggaggggaggggggaagacagaggaaagggggaggggagggggaugggggaagacagaggaaagggggaggggagggggaugggggaugacagaggaaagggagaggggagggggggaagacagaggaaagggggaggggagggggaugggggaagacagaggaaagggggaggggagggggaggggggaugacagaggaaagggggaggggaggaaugaggaugaaggggaaauaaaaugaggguuuuuuuuucucauuuugcugcagaauauggaaagggaauuaggaacugugaguccccauuagcucccugugcccagaaauaauaaaucucuaaauggaugaaugugucagaugaauuuaucuaucuauaagcaucauugaggcagcauauuguaguuauuacauacaagauaguacauggguuuaagucauuugacuccguacagaagaucuguugugaacauucacacuggccagaagaauaagacagccaggagucuaaaccagucccaaagaccucaaagucaaccaaaacucagaucaaaaaguugagggggaggcccagauuaagaacuaaaaucauggccgagucucuggauucaaaguuaauuugaauuaaaacauuuuaaaaacauucuucugggugagaucaguaguccacaaacucaggauuccguuucuaacaguaucuccaaagagcaugauuggaagacagcauccuuggugcugauguuaauacaucaaggauguguaugcuuuucuucagcaucucugaaggcucugcuagugauaaugucaguggauauaucaugacugguuugggagauguuuccauuuuaaaucuuuacaaccugcuugguuuaauaagcugccuaugcuccucccaaagucagagaaacaaacacacugccuauagaaacaaacccagauacaaaauccacccuucaagaccagagcaacaaaauacucaaagauaaaccagucuuccuuuuugaaauccuuuuagggccagagaauuggcucagugguuaagagcacuuguuguugcaaaggacucagguuugauucccaguacccacauggaggcucaccacuuccuuaggcaccaggcacauaugugguacacagauaugcaugcaaagcaaagcacucauacacauaaaauaaaauaaaccuaaauaaauauaaaugaaugaauaaauaaagcugaaauuaaaacaaacaaacaaacaaacaaagccugcuuuaagaagaaguaagguuggggaagaaacuccucuuucagacuggauuccuaaagcucaaacugugcuuuaacaauaaaacaaagucaaaaggggacucuuugcacuuccgauuagucccagccccuaaaguguggaagaaacuugcagaaacucuguccagacucacuaauuagcucgucuuacauuaaugcugcauuuccggagucaaaaguuuauguggguauucaugauuuccuuaacuuaaaacaaguuucccaauuuccacuuuccaaggauccaggauuacauuuuuuauauauaauuuuaugugcguggguguuuugccuucagguaugucugcccaccacguguaugccuggugcccuuggaggucagaagagggcauuggauuccccuuggaacuaaggugaccaacagugccagcagccauguggggugcuaggaauccagccuagacuggauuuucuugaagagcaacaagugcuuuuagccacagagccaucucuccaguccccaggauuaugaauuuuaacagugccaggguggaaaguuaccauccauacaugauccacuaaugcaagacuauggaugacauuuaacacaaaucuuacuuaagcuggaaacauagcucaggggguaaagaaguccugaguucagauucuuggcacccauauugagagagagagagagagagagagagagagagagagagagagagagagagagaaagaauggugauguaugccuguaacuccagagcuggggagcaaaguacagagggaucaugggaaacacugacauguccacccaggcuaguggacacagucagcuaccugagagacuaugucuugggaaaagcaguggagacaacauggaauaaggcaugucagcauccauugcugagggccccaugcacuacacacagguacacaugucagcacacaugugcaaacacauucauaacccccugacacacagaauccugcucaggcaaagccaauuauaucauccacagcuucaucuaggaguuaaucccaaaauaccacccaaagucauaucauuucuuagcuacauagcaggaacucucacuggaagacaauuccaauuuagccuuaaaggcugccaggaagagccagaagacauagacuguacacaggauuguguccuaaauugauaaaaacaccaugcucugugaguuguaaaugcuuuaaaaagacuuguaaauuaaaagcagcaagcuugauguaaaaagagagcaagcacaccaaaagaagagaaggaggaggaagaggagaggaaggaggagaggggaagaaggaggaggagguggaggaggaggaggaaaaaaaggaagaagaggaggaggaagaggaggagggggaagaagaggaggaagaggaggaagaagaggaggaggagaaauggucaaaaccauuuguguaaacacuucuguguaaaauacuaaggagaaaagggaagagacauugccuggccacaugcacgucucaggggugcuguacuuuguacugagcaguuuugaauguugugguccugugaugaucuaggaagcaaaauggaauggaagcauggaaacauggaugcuuuauaaucuaaggccaguuuucaacuucagagagucuaugauccaauugauccaacagugaaaagguuaaaagaaauauaauguuuauggaacuuguuuuuuuuguuuguuuuguuuuguuuuguuuuucuuuucuucugaacaccaucaaagacacauuugguaaaguugggagagaaaguccaguggacaaagcccauggagaagaauuagcagcagaaaugaagauggacagaaaccaaagaggaagcuggagauggucuuguaaaaagcaggucacgcuagaggguuuccugccugagaacuugacucauuuucaucgagggccaccucucguugaugcacucugaguuugugcucuccauuuuagcucagucuuacugcuuccucuuauucaaaguaauacaguaauauaaaaaucuauuauuagugauaaaucaauuucucucucucguucucucuccacccacuccucccccuccucccccaagccucgaagacaagucuggaccaaguucuccauccugccucuggcagcaggcagcagcacuucagauccucuaccacgucccggcugcuucaaaggaaaaauccuacuuucuucaguuaagaucauaagaaauauagggggagggggucagcucuguuuggacauaauuacacuucaucaaaagaggcuuccuucaucuuccaugcgugaaaagucugcaagcaguuaagucugucuuuuuuuuuuuuuaauauaaaaauugcuauuugggaaaccagccaaaacucagaaagccaauauaguaaaacagugcacacccuuuguuuccuuuugaaguuucuuaaauaaauauguugaggguuuacaaaguacacuaucauucugccauaguuucuagucaaauugaucaggaaaaaagggggggggugauuuagcaucuauauaacaugugauuuagcaucuauauaacacaaaaguacaauaaaugaaaacacaaguuuggaucuguaaaauaaaauuaagaguagcgccccauccuuuaaauacuaaaauucaucacuccgguuacaguaacagaagacuaagguacaauuuagagcauaugcuauguuauccuguuuacuuuagagcauacaggugccucauuauguuuaguuuuguguuuguuuguuuuuuuuuuuuuccagaaagaaaaaggagaaacuuuuaacuguaucgugcaacaguaacuaaguuacugcaacaguaacuaagaaacaaaccaaagcaaaaggaguagaagaaaggaugagugaaugucugcaccacccugcacccuccaauccuagucaggagauagaagcuguguguucuugcucuucugaugaaggagcccagaggaccauucuaguuagaugcugucagaggcucugaaccucauuuugguugaaaccaccuuucagcgacagcaucucauuagcaugcauccuuuuugucuuaaguuguacuacuuggcccuauuccuagaaaguaacuagaacuucucaucggaaacagccuugcuuaaauuucccuuaucaaguuuuuacaaugguaauaauuugacauaugauccaaacuagagaguaauuauuagacacaguuuagagugguguuucucauuuccugauucaaaccugggcuggagcgaacacacaggcucuaucguuuugccucacuucaguccuaaaggggucccacuuuuuuuaauucucuucuuagcguaauacuuaaaaaggaaauuuuagagccaauaaauugaaugagcauaauacuucugauaggcgaguaaccaaaagaagucucucugaggauaaguaaauaaaaacaaaauauuggguggguggggugguggagcacucucauagaggcagggagagaaagcaugggauaggggguuuccggagggaagaccaggaaagggauagcauuugaaauguaaauaaagaaaacauccaauaaaaauuuuuuaaaagaaguauugaucuccuuagagacuccagcaaaaaaauaauaauaauuccauuucugaaacuauggugagaauuccuuuaaaggaauauuuccugcuuugcgauucugcuaaauguuccucauaucuuaguguggauucaaaugauugaagacccuaaauacugugacaccauugagauacccaugaguugucuaggugauuuuauagucggucuucugagcaguguacauaguaaggccagccagcucuacucaguaagaccuugucaaaaaaaaaaaaaaaaaaaaaaagccuaaauaaauauuuugaucaauucuuauuaugagaauacuugaaaccauccacaggugauaucacuaaaggacaauaagagcuccaacugucccuguaugaacgcagaguaagcggaggucgucaggaaauaucuccaaagccccuccuuucccuguugccucucaggccacucacgucacgugacuccucauaacucagaaccugauccuccaaacauucuuuucccuacuguacgugcuaaacccccaugaaauuaggagcgaguucuucggaaaacauuguuugacuccccuauauaauaaaaccaacggaaaaggccuagcugcucaggagaacacucaggggcaucuggauuuauuuaagcaaaccuacggcgguuguuucaauaagggaaggagaugcuacuucguuuguacauauagacaaguuugcuugcaccagagagccuaacgcgcuuaucccaggaucaguauuaaaaaucggagaccuaccucguccgcuccggcccacaaaucucagaucguugaaccuggcuacuugguuuuucauaacagcggaggcauuucggagcucggcggaguaguucucaucauucccggccaugacgguaaccacagucccaucugguaccucuccgagggcuacaaccuacauaaaacaggaaauacagaaggaacaguggcacaucagaaacacuuaaggacagagaacacaugcucccuguaaauggugucuuaucaggaccuggcgcugugguccggcgguggcagagcagaagggaagcaucuguaguuggguugugauaccacuucaaauacacuggcgauucaggguccacccacuuugaaagcaagcuaaauuugucuuuauuuauuguucagcucuucacagaauauauguaugcuuuuauuaaauccccauguuaggcugucugcgggaauuauacuucagaaagaaggcugaugccccaucugcagauugcaccauacauauuaaggcaucuccugucuacagccacaagagcccugggguguggucucgagucaggucuugagcuaaaagcagaaggggaaugggggucacgugcuugcuacgcaagcaagaggacucaaguucagauccucagcacccaugugagaaguugagggaagacaguuuguauguuaccccacugcuagaagguagaaaauagacaaugggggggggguuggcuugccagccacccgccuuagccuaaucugcaagcuacagguuacauaaaaccuaagguggagggcagaaaggcuaggcuagcucccuggauuaaguacuuuccaccaaguuugaugacuucuguuccauuccuggggccuacaugauaaaagagaaacaguguuacaacuuguccucugacuuccacauggacuugagugugauuauagacauacauaaauguaacuuuaaaaugggacagaaagcaauugaggaagauaugucaauguugaccucuggccuccauggucuccauauguacucugauggugcauguauaugugaguacacacacacacacacacacacacacacacacacacacacacacgcagagaggaggggggaggggagggggagggagagggggaaggagagggggaaggggagggggaagggggagggggagggagaaaccugauuggcucuauggaaaaggacucaggugaaacuccuaguccuggcugaaauacuggauacagaucuguuaagggacuaaauggucaccuuuuaauggcacugugaauguauacugcauccuuaacugugcgggacccagugggauagucaaagcuaucaagagaaccgucugggcauagaacagagaccuauccagggaugaaaaaugacaacugaguucuacauucaagaaacauaucucaagcuagggagagagcuggguugguaaagugccugccuggcaaguauguggacccaagugugaucacuggguaccuuguagaaagccaggugguaugguauaugcuuggaaucccaguguugggaaacaggaauggggagauuaggguagaccagccagccaccuuaacccuaaucaaaauguccuaagaaagaucccucccaaaaacagaccgcuccaaaaacugacacccaguauugaccucugaccuccaaauacacacacauguuugagcaccugcacaaaagucagcacacacucguacccacaaguccauuuuaugucaucuaccauguuggaaugacacgguugucccccccagucuucaacaacucaucugaagcuuuucagacgagauacaggaucaucugucgcugaggcuaacccauucggaaucuccuugugccagguuagcugugcacacuggguuagcaugcaaccuuagcgauggaaugccagucaccgggaaccuuccuuguccccuguucuccauccaucaccaagacccugcuucacagagacagucccuuccucuccaguaacucccaggauccucugcccagccuguucccaugucuucaccuagugcccagaguuccccaguaacugggcaaagccagauaaggcaccacucuaacaaggcgccccgugugccugucugucuagcaaggugccccaugugccugucugucuagaaaggcgccccgugcgccugucugucuagcaaggcgccccgugcgccugucuaucuaacaagcacccuucacuuggucuuuccccacuucugcuuaugagcucucauuugucagaagcucuaggaaacaagucuagauacuccugaacgcacuuguuauguguccuccuuaaacuuucuuguucagugauaaacaggacugaauuuccccucucuguaaccucuaucccagguccgaccccucauuauauccucucugccagccaggaaaacacaaaauaaaaccucaucaagauuuucuguuacucuuacuugacucuuagaccauuuguuucucaguuucuccaaccucacacccuguucagugcaaaaucaagaagcuguuccuuauaguguaguguagggcucacauucccagugccccaugcuaucuagucacccucauuuuuacuauauacagauugaugauuaaugacgauuuuuaauaaauuaguccccagguuuaaggaauggccuucauuucaucuaguuuauuuacaaaccucaacucuccucacacuaucuggcauauucagaaguguuugaugaguauuaaaaaaaaaaaaaaaggagguagaggcugcgcagugguggcacaugccuuuaaucccagcacuugggagacugaggcaggaggauuucugagagagugaguuccaggacagccagggcuauacagaaaaacccugucuugaaagaaaccaaaaauacauauauacauacauacauacauacauacauacauacauacauacauacaauaggagguagaaagaagauucagugcauaaaguguuuuuuauguaagcaugggggcugauucaaauccucagagccaauguaaagggcagacauaaaaagauguaggucugaccuuuguaauaccagcacccuuacugggagauugggcaugugaccugugagucauuuagccugguacacagcagcaaacagcaaagagacugccugggacaguggagaacacaaggaccaaugucugagguuguucucugaucaccacaugcuugccauagcacucuaugacaucacauagcaaugugcaaacacacaugcacacacacacacauuuauaugugagagaggaauaugugaguaugugucucugugugagugcauguauguguguaugucuguguaugugaaugucuaugucugugugacuguguguaugucuuucuguguguaugucugugucugugcaugcgucuguaugugucugugcaugugugucugugcaugucuauguguguacauguguauguaagugagucucugugugugcauguauauguguauguauuuguguuugcauguguaugucuaugugucuaugugugugcauguguauguacgugugucuuugugugugcauuuguauguacgugugucuuugugugugucucugugcauguguauguaugaguaugucuguguauguguauguauaugugucugugcaugugcauguguguauaucugugugucuguguguacacguguauguguguguaccaguguguaucugugugugugcaugcaugugugugugugugugcaugcaugugugugugaguguguguguguguguguguguguguaugaaacaaauaaaugaaagaguuccauagaaagcacugcucucagcagccagcagcucugugggcuaccagcuaaccugcugagggaaccaguuacagaaugagucagcaucccucagacagcacuguccucaugcagaccggcauuaccuggaguacacagcuacucucaacucgagaagucuccugggucaaaagcaaaugccuugagccucucugucaccucugucuagcaacuugggaggggcagagaagguuacuaagacaagugcugggcuccugaagauggaguauuucucugaugccaaaaaaaggcacguuugaaaauacagaaaugauugacuauaucugccagcauucaucugaacaugaagacaucuugugucuucagcagauuguaguuuaaccccugaugccuggcuuucuauugaaaaugauuauuaauaaaggcaaaagaaaguaacauucucuuagaagggacuguauguacuaaaaagcauaaggcuccguuucccccuacuuuaccuauauaucucugacccuuauaccaaucauuccagcucuaagaaccagagcuccccaauauacauuggaaauaauguuuaagcuguaaaauguagaagaugccacauaagcacagagugucacuauagugaucuugguuuuaguaagauaaagagagugaugguugagucugcugcuaaacacgggcuuuuagugguaagcauccguuaagagugucacuguguaugugaugccucacagccucaaauguucugcaguauuguaagguaaaggacugcucuccagggguuucacuccagcugaacaguguuucagaaaaaaaaaaauauauauauauauauaaagaaaucugccucaguuuaaagguuuucaagagcuuggaaaauuauuauuuuacuacauauuuuuuaacauaaugaacuuuucuuuuaguuaaaagaaaacaaaaauugauucaauaagggaaaaugugaaagaaaggauuccugagagugaaauacauaaauccacuuuauuaaagcaguguaguaauaaucauauuaaauauggguuugcuuuguauaucauauuuagcaaaacagacaguugugugcacauucuaugaugcuuagaccugggucugaagaacaugccaacacacacaguggcaaucuuucugauaaggcugaacucuaaugcaaggacuaaaauauauuguauuuucugcugucauuguaccagaccugacugaccagcauuguuucugaggaggagugguguaugucuugggagggggaguacuguauuuaacuuuauaucagucagaaguauaauuacauguuugagacuuuuuaaguagaugucugaagcuuaaaagucuccuuugaauauucccaaccauguuuaucuaaaagaaaaccaaagaaugaggaaauuuuuacacauuucaucuguaccaaacccaagcaauugaaaaacauucuaaagagcaaaaagaacaaccacgaaagaaaggaaggaagaaaggaaggaaggaaggaaggaaggaaggaaggaaggaaggaagaaagaaagaaagaaagaaagaaagaaagaaagaaagaaagaaagaaaggagagagaggagagagaaagaggaagaggaagagggagagggagagagagagagagagagagagagagagagagaaagagagagagagagagaaaaaucacucuuuaacuguuaagacuagacaugaacuaaauuuuuuuccaauguuacccaacaugaaguacuguucugcaaagaauaauucacaaugaacucauaauaauuacauuucuagguguucuuaaaauauaagaauuacaaagucaagaaaagcaagagaagagagaagucacuuucuguucugcccucacagaauugaggaagaauuugcuuuauuuagcuuaccucacuguagccagcauuuaaaccacacacuguacaguuuguacaaaaugaaguuaaagaauauuuaacucuagugauguugagauuuugucugagucccacucugacugaaucugggccucacucugaacaaggagcgauaacaaacuuaacuuagacuccuguucguguggucucaccauacuggaaguugaacauugcccaugacauucccaggacagcaauucagucugagcuaaucaauugcucuggcagagcaacuuuauguuggcacaaugcaugugcaggaaaaugaaauauaauuauuugcaagauagaaucugauuguaucuuucuuuguaauaaagagaaaggcaacucaguaauugcaagaugcaaagacaaaacaaaacuauccuuugaaaguaaacuauagaacauuuucaacaaauacuauagugugguuuuugaauuccauccaggaaggcuuccuaaacucaggagggaggaaaaccaauugaauucuaaaagaaaagcagguacaaugugucaucucaaaaaauuuuaaauauauguccaacaaaaaauuugacaaaacguuuuucaguuuaagccagcaaucuguaggucaugaaucacaguagcuuagaucaucuaacaguggcugucccagaacucugaaaauacacagcaguugauguuaaaggagaaaauacaaagaggcagagcuaccauaccuccucaaauggaaauauuccaaaguuuuaaaaauauauauguucuaucuaaaauguauucuaacuuacuaauaaguuauauauauauguauacacauauauguauguauguauguguauauauguauggguauauauauauauauguauguauucagccccaaaauauuucccuuuaaaugaguuuuacaaaaaaguacccugucgucauacaaccugauguacuaugauugacacaauuuuucaaaaacaguuugcauuacgcuuaauaaagauuugacaagcuuaauaaugucuucacuucuuaagcuauaauuagauuuuuuaaagauacaaagucugaacauuaaacgcuuaagaaagauacaaaccacuaacacucaguuauguauauguugcaaacuuacuuuuaaagaaagaaaaauagccaauaacugccaacaagucagucucaaauagcaaucgcaucauuuaaaaaccucaucagcacugaaagaugauauuaaaaauauaaaauuaacuaugaguauuugaucauguaucuaaauacacaguuuaucuuuaacauuacuagaaagaaugugauauuggugaauauauaugaucuucuguucucuaacuuaaaacagugauaugggccuauacuacuuugacucauaagauauacaucuggaugucaacauaguguuucagcuugaagcuauuuaaggcagcuuaguuaugaacccugaacacccggcuucacagugaagaugcugacaggacccuauaacucaaagggcgcuacuagaugcagggucaauguguucuauacaguccaacuaccaaaccaagcaucaacuucugagcugaauuugcaaauugcucuguccuggcacuaaaaucaucugugacagaaagagccuaguauccucgaauaguaggccuaaacuauuuuaagguuuuagugagauacaccugaaagaaauguuaaaaauaugcauuuccauuuccuugacaccuggaagaacugacuguuucaaaacugcagaacuuugguaaaagugcaaugguaauaaauaacuuugcaugaagacuacuagcugucuuguauuuuuggcgugucaaauacaaaugaaauaagggcucuuuuuaaauccccaaauuauauuacaugaacaauacuaauaccaauagacucuacuuuuuaauauaauccauugucgauaucauggugaagcacuauuuuaaguuaucagauaucagaacaggcuacugaauucauuucuuguugacugcagugaacuuugugccacaaaccuaaaauauaggcucaauaauuauuguguugauuugaacacuagauuucucaacgauauuuuuucucucagucgguggcagggggggggguggcaggggagguuguuuuaagagcauuuagcucucugcuuuccaccugacaauaccauaacuuauuuuguacauagcucuggauaugauagccaaauugcuguuaccauguuugaaaggggggacuucuucauagcauuuccuuaggacagauguauuugauuauguugagagaggauaagaagcccgcuaugcucguguguuuauucccaaagcaaguuauuuugaaaaggcuguuguuauauuguugaaaugaaaauuauaaaaguuacugucaaaaaaaucugaaccucuagauaauccauauuuuuuuuuaagcagagagaugaaacuauuagggugagucucagugaucuuuaacucaauuuauuacaaauguaaauguuguaauaagcccuaugcuaucaauggccuguuuacuguuuaaagaaaaaaaugcacucugauuagaagccauaacaacaaagagagaaauucacuuucaaaauaguuuuagaaacuagaaaauccagguuccaaauccaaaagccgucagacugaaucacauugcaucuucauccccaaaucuuuucccugcagaauacuuguacucaaaaaucaaugcaccauuuaagaugaucaguucacgacaauuauauccugagcguauucagcaccagaagggugcacagaacacuagacauugaauuaauaaaguuauuuuuuuacaccuuaauguaugcccuugcauuauacaaaauaucuacuuauuuguauuuuccccuguuuucauccagguuuggaaaaaguuuuguuuuuuauuguuagaauaaugucuacccucgcugaggguacuuagaaaauucugggcccuuggcugauaaacauuguaaaagauagcucucaauggaaauaucauuuucuacaauuuccccuauaucugaccuuuucacaccacaaggaagaaaacaaucgccaaaauggaugcucucaaaaaggaaaaacacguguguuuguuuaggaccacugcuugauccaacuacaaaaggaaacuggccacuacagggccacgcaccccccuuccaaaacaauccauucagauuucuguucagauaggagaccuaaagagauaacugcucuaauugaccugggccccucuugcugcuccacccacacauggaaucugaauugcugcgugggguaccgggugaucaacaacugggaaaugcaggggcccgugggaguuuggcaccagaguccgagaugaaggaacuggcacaauuccgccuuuuuuuuucuuucuuucuuucuuuccucucucucccuuuuuuucaagaccauucuuaaccuguucaacagagagccgggucccagacucgcccacuaaaacuggaugcaucucucucgcuggcucccccaacugaucccuagcgucuggaccaggagaauggacagccacccauccagccaagucucuuccggggauggggggugggaggggugcuccgcaccaccaccaaaccccagacugcaucauagauauggccagggccuggggacccgcacacuuucaaccugcugucagcugugcgugacuccuaccgcuaucggugcuggcaagcuaacgggacuuggaagaggaggccacggggacgcaccuuggagcccaggccuccggcaggagccacccaucacccaucgauuuccccaagcagaagggacaucugggaguucuggcucuuucaaggcaaauaaaguuuucaccucuguuuauucugaccaaccgaaguugcuccacaggauucccuuuuccucccaggcaaaaugaggggggggggggaagcagccuaagccuugcuccccuuccccgacgcucaucacucccgcacucgggggcgcagagccccgaaccccccgcaacucccugcuccugccuggcccugauagaagccgaaaccccggcggccccgccuuccuccaaguaacgggaaccagugccggccgaggagggcgcgaaugucccgucuguccccgcucucccgcguccauccccaaguuuacugagcacucucaaccuacgcuccucgauuggcaccucaucucgccccaggcgcaagcgcccuccggugcuggcacccugcaggcaaccgggccaagccggggagcagccgggagugccaaacggcaaccaauccgggaaagggacaccuaguucgggguagaggccugcgucugcaaaggggaaagcgggaaggagcgcacagaaucccggagaggagaggccgggaugcccguguggagugaggagaccccgggagaagggggcgggaggaagcuugcagcucacagugggcgccucggggcgucugggggcccaggagucucacagcagggaaagaggcaagaaccgcgccuggaagacugaaggaugaagaagcaagggaaccuaggcuuacaugguagugggcgcacaggugagaagggggaucugcucgcgguggccgcugcgggguauguagaucagagccaccucgguccccugaguggagccaccaaggcuggagucuuggaggacacccaugggcaccgagaccacggcgggaagguuccauggggccgggccaggaucugggggugaccagucucuuaccuugaaggccacgggcagggucuuguugcaccgccagugcgagggcagcacggagcacaggaaguugggacugucggugcggaccaguucggccgggugguccgcgaugaucuccaccauggugcgguugucgugcggcggccucaaucggggcacugcggccgccgccgcugcugccgccgccgcugccgccgcugcugcugcggccgccuccugcugcugcugcugcugcugcuguuguugcuguugcuguuguugcugcugcuguugcugcugcugcugcugcuguugcugcugcugcgcagccaccaccgggcucacgucgcucaucuugccgggcugcaggcugcuggagggggggcugaagcgccggcuggugcucggaucuacaggaauacgcaucacaacagccacaaguuagcgaaguggccgggggagggggaggaggguggaaauggggggcgaggaggaggaaaucgaggggguggaggcgagacgggggcggaaagaggauggaggugacgggacagaggaggugagaaaucaaguucgaggaagccgugugccgggcggagucugcugggggccggcgacuggagaccggacagagucgggguagcggguggggacacccgagaggcgcggaucuccaccgggaggcuugggagucccuggcgguggcugcaacgagcgggacgcgggggcguguuuggcccagccgccgcaagggacuugaaguuaacagcuugcaguaggggccccuuggggcaccguguccugggugcgcuggcgccccgcuccggguuccaguacgguaguggagccccgcagguucagcaguccaucucggcggugcguguggcuccucgcuguccgccaccgccaagcagagcgcggcugcccagcucgcggcgccgucgcuugcccgcgccgccuccuccgccuccuccuccgaggccgcugcgcgcuccccgcgccggcagcgcgcuccgaguccuccggccgccgaguccuuccuuuccccggcuucuccucucgcccucuccuucgccgccgucuagcucgcagccucgucucuccugcucuuugcaaagugccccgggccccccucgcguuucaaggugccgggagguaagugggggcggggggagagcggaucucggggcgacagaucuggagccugcggaucgcagccgcugccgccgcccgccggccgcuagaagcgccgcugcgcucgcucggcgcccgaagcuguagggaggagguccccgccuaggacaucgccgccugcguccucggcuccccacuucacccucaggaccgggaaccacuucucggucugacgacgcuaaagcugagaagcgggagagccucaggcugcuccgacuggcguuaauuuuucguuguuaacuucaggagaggaggaagggaaauucucaagucuccacguugacuucugagcacucuucacccugcccccaaccccaccccacauugguuggggcggggggcagguuuuuacaggcuucgggagugcccccccuuaggugacaccaaaaugggugacaggaguguuugucaaaauaguuuuagaaacucuaacggaugucuggacacuuuucuuauauauuccuucuugucauuauuggagaauaaggauggguugcuuuuuuaauaaaaagaacuaaaaaaugacagcuugguaauuaaaauaaguuguaaguugauaaaaugcuugcugggaaagggggaauacacagcgguuauccauucauuucccaaucuuuuauuaaguguagucuucgucucagacuaagucuagugucuaacugucuuucuagccacuccccacuuugggggguuaaaaauaaaaaguuuaaaaaaaaguucaguaauuauuuauuuauguuuuuguuucccggcguuauggggggaggcgauuuuggaauccccaaaagauugugguugagagaugaaggagugcggggagcggcagcaguuuuguuuuuuuuuuguuuguuuuuuuuuuuuuuguuuguuuuuuuaccuaaaaugugguuuuuggaggcugggauuucuaaugauuagguuuuugugguuuauauagacacgacucaaacugaggcgaucauuauacugaugggaaucagaagcacgugggugucuccgaccagccucaaauucugagccuucaaaacaaaucaaacaacgugcggcggcgcccacagaagccgggaaauccgccggaggcugauacaccccaagaaccaggcagaagcaauaucgggcuggcucaccucucagcgugauguucuguuauaugucuugccuaaccuauuauuuuaaaacuuccaacgcuuccaaauagaaucauuuuaccaaaauccccggcgauucguaacaagguaguugacgcaacugugauuuggugaaaucaaugaaaaauugggagucguccccuaggaggacuaaagaagagggcuagcuggguaacauuucucaccauccgucuuauuuaaagcucuucacguagccauuaauuuggggcuuuuacugcuggggugcaaaugccuuccaaauucagcaagggaccugucaugacccucccuagcgcaguugccacucucugaccuucccuccccgcgcgcccagcagggcccagaaaagguacccggagcgcgcaaaagagguuguuugcgccucuuugcaacucgagacuagaaaauacaaaaaguggaucgcugugcucagauggucuggggacccgugcuccugugccugagaggcgcucuggggguugaggaguggacagaguugagugugacugcuugcucucucacaggcuagggaugauacuggggagcacuccugugcccucccccuuugagucacugcuucugccuccccuuucugcuugcaccacuuacaacuaugcaaaccccccccccccccgccgccgccgccgccgcccacgucccaugucggucuuuccuugucucuugcucucuuuccggauucuuccaccaguccucccucagacuugagucaccucccugagccacucagucucccucuucuuccacugcccgcuccucuaugccacuaccuguggcgcccacaucucccacccgacuuccucguagcugguggccucugugucccuagcgcucacucccgauauacauuacagguggagcgaguuacugagcugucuccuaagggugcuacuuuaaauaucuuuuugaucacaggggagagcucuaagccugaauacugccucaccgcgugugugcgcucccuugcacuaaucgccccagccauagacgccagccuagaaaaggaagccaggcuuccuaacccaucuaagagagaaacugcacccaaacuaacuuguauccucgcaaauucauaaccugacgucaugacucaauuacauaccuaccccuccugcccuuagugggacagcuuucuuuaguggcacagcccacagagauggcuugcuuucauugccccucauuuuaaguguugggaacugcagaagagcagagaguccccagaaaucgauagugucgauagugggagaggguauuuuguucuccucccaggaaacccacagaacaagggacuuccacaaacugacagaacugagaaacggcccauguuucaaauaggggcucccagaguggggcuuuuuccaacaagaaacucuacagucguuugaauauaagaaauccuaucuuggggaccuuugcuuucccgccauugcuguuuaguuaccaccacuccaugcucccccuuuuuuacuugaugcauaaugagacaugcaggccucaaugguuggggauuuuaagggcaauuuaaucaauggugagauuauuuauuuuaauuaaucauauccgguaauucagcuuuauagccuugcugggcauccucccuccauuaaacauuucaguagaacuaauguaagcagcucuuggaaguucccagucuuggaucccuuaaaauauccuacaguuauuuauaauguggaaaugaaauuuuccacugaaugcccuaccaacggcucagguaucuggauuucagucugcuuucaagagcgcucuugcucucagcuggaacuggcguggucuuugcucugaacauuaaacuucaaguaggaaacauuuccacagccccuucccucaaacuuccccuagcaguaaaagcauaggaaaaaaacgugggggcuuuuguguaugcguccuuacugcugccaugaaaugcuaagucucuuagauuuuuuuuuuccuacgugaaaauguucuaaccaagggcugacugagaguacagcucacucaguaaagugcuuacugcaggcacaggagguccugaagccagugccuaagccccacucacccagauaucaaaauaagaugguguuugaacccuagugcugggaaggcaagcuaggcuaaucccugggaccugcugccuagacagccuagcugacucaaggggcccaggccaguaagagccugccuuagaggacaggguggauuacaugugagggaucacgcuagagggugaccuuuggccacuacaggcaugcaucuacacacacacacacacacacacacacacacacacacacauccuauacacauacaccccaaacauacccuauacucacccuacacauacacaaacccccuauauacauacccuaugaauacacacccuaaauacauucccuacgaauacacacccuauauauacacauaaccuacacacccccuauacacacauacacaccuuacacacauccuauauauacacccugcaacacauacacacacuucuaaaaaaaaaaaaaaacacccacuagauuccucuguacaaauauucuucuuuucaguuguagguuacagcacuaaaauaaauacauuuuuucugaagauuugacuacugugaaagauacaagcauagccccuucuuaauguuaauauaacuguuuugugauaacaccuggcaacuuucacucuccaaagaaggugugauguuaaaacagucucuucucucucucucucucucucucucucucucugucucucugucucucugucucucugucucucucugucucugucucugucucugucucucucuccuugcuuucccguccuaacuccuuccacauuauuuuauauacuugugauuuuccuuuuuuuuuuuucauguugaaaaguccuguaaaaucuuaaauaccuuucagugaaccagcugauaaaauaggauggcuacuggaaaauuaggaccacugugagcuuucugcucaugugugaauguguguauggaggggaguggggaugggauggguguugaaagcagaaaggucuuuggagaguuuucuuugggcuuugauuguaugaagcuagccuagaggucagugcugucacccaaccaacaguuauagcagagcccauagacuaaaucuggccuaaagucucuuuuuggcuggccuauaugcuaugauguucaugcuaauguguaugcguguuuguacauucaugcauaaaccacguggcuacacguguguggauaugcauggagaggcccucaguugauguuggggaaucacccuggauugcucucaaacccacuagccaauuugaaccggggauccccagucuuuggaaucugaacucacauccucuccugcauggcaagaccuuuuaaccauuuuuacuuacucauucuauguagauugggcauuuugucugcaugugugucuugcaaugcuugagugccugguaccuucagaagcuagaagagggucuuccuggcaacugaaguugcagauggugguaagcugccauguggauacuugggauuagaccaaagucuucuggaagagcagccagugcuguuaacuguugagccauccuucuaggcacauucuaaccacuaagccaccuuggcagcacagauaggauuuacuagguucauuacucacuuuccauccauagcuccaaaagaaacacaaauggggcuggugggauggcucagaagguaagagcacugauuguucuuccgaagguccugaguucaaaucccagaaaccacaugguggcucacaaccauccauaaugagaucugaugcccucuucuggugcgccugaagacagcuacaguauaauuauguauaauaauaaauuuuugccagguagugguggugcaugccuuuaaucccagcacuugggaggcagaggcaggcagauuucugaguuugaggccagucuagucuacaaagugaguuccaggacagccagggcuacacagagaaacccugacuucaaaaaaacaaaaacagcaacaaaaagaaaacaacaaaauacacacacacaaauggacauaccgagaauuuucuggugugcacaagucuuacauacacuuuuaagacagcuuaagaacucccgugauuccgaggccuucugacaugcuuuuccuguuuaauuuuagacaguuaaaugcugccugauuuguuuuaagcccaguaaauuuuuccuguugucaguggaccuguaacaauuugcauggcuguaaaaagagaugaaauguucgcagcggaggguuuagcaucauaaaccucuccucauuguucuaguuaacauucccgugggggcauuuccagacccucauaaggguacaguguuguuguaaagcggugaugcuugccaugugaucccucagagcugcaucgagggagcuccuguggaagcuuuaugcccuuaaaggggacuuacauuuugguugacuaaaauaccaacuuccuaaauaauauucuccuuaccugaagaccaagauucuaaaaauuagucuuacuucauuuuccaccauucagagaagugaaauuaauuuuccuuaauuagcccgcuggcauuuagguguugguuggcuuuuggucugugguggcagcaauggucaauggcggaaugaucuauauaaaaaguuuacaggguuucgugaugaaacauaugagaaccccuaaaauuaaagguuuccugugggaauccaaucaucuuaucaaaugcucuccucucacccuaaacucacccaagauggcgcuguucaguucuaaucucucugcucaaggcaccaaggccucauuuuagaccuagagaugaccaaaugucaugcccaaacaaugggagaaauggaaacuaugacaucuuugcuccaaauaacagaguacaaaacccaccauuuucaccaugucggaaacuccuauuacaauagaaagaaguagaaaaagaaaccgggugucaagaauccaaaucguccuaccagcugacuguacgcaggcaguccguuacuaugagugguguucugcguugugaggucucacccgcagaaacugccuaucacguugccaccuaagauccccuggaaauggauuuuucuccuaucuagcuaggaucaagucccauaaacaauggucuagucaucuccuccuaccuuuagcgacugucccaacacaucauuucaauggccagaucgggacugggcgagugucugaauggcuuccauaggccagcugcagugcuguccuaugugaguuaauuaaaauauggcaauuuuacuuuuuagaaaggugggcaggucuuucuccuggucacauuccuaucggagcuucugcuuccagagccguuguucucccuuguaagguucaguuaucaacuuucugccucucagcucaaaguucucccauuucaccaguuguguaucuguggcccauuaacuauuucucauuacuagcuggcaaugauauuccacuccgaagaggauaaggaagagacauuucgggaagaaagaauuuuuggucuaguucucuugugucuacagcaagucucugcagucuaacacaugcagcacacacacacacacauacacacacacacacacacacacacacacacuaaagagagagggaaagaauuacuccagacccaagugcuacagcaaagcucccuuguccaguguugcugggugcaagcagcacauaucaaccaaaagcaguuagcagccagccccccacccuacacuauagacccucccaucugcauuguucauaacaauauuccuuuaaggaacagcuuaguccaggugccugcagacaaccuuucugucuuccaguauucuaagcuauggaagguuugcaucuuagcuuugcauguacacaggcaaggacucuuccuugguugcccugagaauaggagauauuuucuauuauuccucuuucuugcucgcuuucaguccugaggauugaacuuugucccccacccccuagucauuacuacuuuauuggacuguauucucaguucuuuuuccuuauuuuuauuuacuuauuuaucaaacagggucuugcuaaguuacccaggcuaaccuugaauucucuccguaacccgauuaggcccagaauuugagguucuccugccucagccuccagagaagcuagaauggugggccuuuuccaccaggcucagcacuuguucccucucccucccucccugucucccucccugucucccucccucccuuuccuucucccucucccccucccucccucccuuccuuccuccccuuucucugugccauuguuuguuuguucauuuuagguuuuuuuuaaagauuauguuaugugugugauuuuuuuugccuauauguauaaaaguacucuaggugccagcaaugcccacaguggccagcagacggcaucagacaccguggagcuagaguuacaggcaugcuggaaaucaaacguugguucucugaaaacacucuuaacaguuaagucauuccucuguccccuacuuucuguauucuuuagacuucauuuaccuuuguuaggucaauuccuuuuugcuccaauccccugauauuaucaguaauuauuuaaacuugccugcucaaaucauucuguggucuuucuucacuggacuugguuaugcuaaggcuuucacgugauagcccccagcauguccucagccacacugguuucuacuuggauuaccccuuugggucauaugaagagcacucuaaggacuacaucauaucuacuagaugauuuauuuuuaccuauugagaagcauaguuaggagauauacauauucaagagaugaagaugccaacagaggcaaaagaugggugucuuaaaacacaaggugaaacuacuuggcauuucuucuggaguucucuuucuauauuucauaaaauccuacagcucaugugauaaugaaaagauauauaauuauggacaauaguaaauggagacaguuggaugcauauguguauauaaauguagaugaauauuugugugacauuaaagauauagagaucaugaauuuaggaguggguguacaugagaggaaucagaggaggguaggaagggugguagugguguugcaguacucaugcaugaagcucucaaaaaguaaaauaaaauaaaaauuguuuaaaaaauacauaaauaaaaucacaggcaaaaacuccaaaguugaccuguguucagaucugacaagagccaguggcagagaaggauaucucaagggaccagaaaggcacaauguuagguuccaaggaaaagaggagcagcaacauguauacaaugccugggugcagcugagccaaggacugggcaagacuauaacucaauuaaaaaauaaagcuagggacuggaaagguggcucagcgguuaagagcacugacugcucuuccagagguccucaguucaauucccagcaaccacaugguggcucacaacaguauguaauggguccgauguccucuuccagugucugaagacagcgaugguguacucauauacaauaaauuaauaccuaaaccuaaaaaaugaauuaugaaaaaaagaaaauaaagcaaaggcaauaugggauuaaacaaaauaaacggguugaauauugcuaauuuucugcaagcucuuaauaugccacauacauuuucaaucuccaugagagaaacguaaaagcaauguuuaagaguuuaaucauugcuuccaaagaaagcucaaggccuuggaaguauacagaauuguugguugguugguugguugguugguugguugguugguugaaugcuaacuuaacuaaagcaaagugggaggggcugaguuagaacauuaaagaggcgucuguaaagggauauuauggaaauagacagccaucccugucuguaaacuacugugacguauuugguugggcuguuuacaucagucacucgguccugguaccaugauucucacuuguguaccucuucaagggaggaaacuuaucgaggcugccucaagaagccacgccccaacccuugcccacauccuaucccagcagccuccucggugggguggggcaggagugguucucuagguaccgcugguuuuaggggaaggagaagugugagauuaagguugagauuccccacuugguuuuaaauuuuuauacuuuguucaucgugggauuuuaugguaucaaaauugauuuuuaagaauacuggguuaagucaggcgugguggcacacgccuuuaaucccagcacuugggaggcagaggcaggcagauuucugaguucgaggccagccuggucuacaaagugaguuccaggacagccagggcuacacagagaaacccugucucaaaacaacaacaacaacaacaacaacaacaaccagaaaaaaaaaaaaagaaaagaauauuggguuagggguuauuagagauagcucagcaggcaagacugcuuuccagugguucagaacaugggacccgcacacacaaugagucagucacccacaacucaagccuccaaauauaaauuuccauguggggaccuuaugauuauuuuuaugucagacuucccacaacgugucagauucaaagaacuuuuccagaauugagcugacuuauucugcuuaaaauuuauuauucucauggcuacugaaaguauagguugcaucuacuaguucuauugaaucuaguguuuuucuucuccuguuucugaccuaccucaccccucacccuaccccacccccacccccacccccauccccgccccgguguuuaucuuuaguaaugugauuaugcugugcuuguaacugcguuaugaaacuugaugaagguguuagauuuuaacauacaugucauucacaguuuaauccuggucucccaggaaacuaaaaauucucuucaaaggcagcuccgauccaauuggaccauggaaaauagacuaacgagagaguuaucaaaagcaggacccgugagcagcagaacauagcguacagucagccuuggaaaauggaaaggcuuucaauuuucaacuuugcuuugcuagcaguuacaaaugcaaguuuaaaauggcgaaacuggaaggaaauccuuggagaguugcuuugcacuugucacggaaagaaagacaugaaggguaucaguagaaacaaucuaucagucauucugauugcacaugcauggagagaaaaauaaauucaucucauucacuccuccuugaaaucauucuaucauaugaguaacauauguggccuugauaaauuuaauacgagcuacuugguuuucugaccuucuccuucggagaguauagaauuggaagucacagaggagaaagaauggacuuucagaagguuacuguuggagaggauccuuggugucuucuguuuaaagucacaggcaacaagaucccuggggucgggggaggggucuguuucuauagagggucuccuaggagaacggauguagcuacaacuuggggaaucuagcuggguggcucacuguaaaacccugaacuaacccuagacuaacacaugcuacagccucagagaagucucuaagugaaguuucuguaaguuccucaacaccaaaaugcccacuauguccacuucacuguuuaggggggaaaaagauaagagagacauuuauuuauguuccugaagcuuaggacacaguucuuaucuuugccaucaauguauauaggauugggacuucuacgguaagagaagcuaugcuuuuuccuuuugguucaaacauagguaaucuagaccacugaagucuagggaaagaaguucuagcucuaucccaugaacagguagugugcggugucuacaggagucguggaaugggcuagcccuagauagcccuggugggaagcagaaagccuagcagauacuauaugaucgauguguauuaguugauuuaugaacaugccuauguaggcagaaacuuggguccugagcuauacuaaucaccacuuucuacauuggccugucucuucauucuguuaauccuuuauuauuccuuaugucuauauccuccauuacccuaaaucaggccuuuaucaucucgagucucaccugucauagauacgaaacguaccuugcuauauccauuuaugcacaguucaaucacaauccacucucggcauaagcaucugugcucucccuuaagagguugaaugcuaucacauugcacagcuuuaaacucuuacgugguuucauagcauccaccccacccccaccccgaccaccuaaggacuccugggcagggagauggcucugcagguaaagugcucuccaugccaacaugaccugagauaaauuccagcacccacauaaaagcgagucaccaacauagggauuuauaauccuaguacucagggaggguccuggggcuuugguggccagcuagccuaacuaaugucaaacucuagguucagcaagagaccuguguaagaaaguaaaaugaacagugauaaagaaauguggggcaaugggcuaugcacagacagccuggucuccaguugaacuuaggucuugaacgcuggugggaccuggugggugguaauuccugccuacaugggacggaagguguucgaucauggcuccugucgaaguuacccgcccccacagccccccacaggagaggcauguggcuaucagucacauagacaaugucccaagcuucuggcauucuggcuagacuccaaccccacaguuaccuggaaacagcaagacagcccagcucuauaaggggggcugcuuggccccuccucacucucuuuaagcuuuuaccuuucuuacucucuagcccucuuucucuuccccucagccucccccccccccccacguagccauggcuggucucucucuuucuaccuucucuccuuucucccugccuuucuaccacaaagcucuaaaaccuuagacugucucugaucaugaaggucugccaugcuuaaaugaugggauaggccuaacaagccaugucuaaccucccgccagaaggccuuccuacacugcagccacagaccagacuaaggacucuucccuucguggaaaccacccagcgcccucuucucccccugcccucuagggccuuccuccccagagccaagugcggccccaggggccccuauucagauccuccaccuuaucugacauggaaugcaggaggcugagaaccugguaccugaggcugccccuuguccaccacccacccuguggggucagcggccuaacacagccagaugcccaccuggggccgcguggaaaguaucuggcaguccucccaugcccagagcaacggaacucuggugagacgcagguucucuuccacuccccucuuuucccuacacccacagccccgcaaagaaagauacuugaaagucaacauuaaaccuccauagucacuuccccagacacacacacacacacugcgcuugcacacagucacacacacauucauacaugugucaccacacacuugcaugugugcauacacacacaaacucuuacacauguuaaacccacagaucacacagacaucucacacacacacaaucacacauacacacacacacuucacuugcacacagucacacacacauucauacaugugucaccacacacuugcaugugugcauacacacacaaacucuuacacauguuaaacccacagaucacacagacaucucacacacacacaaucacacauacacacacacacacacacacacacacacaugcacacauauacuuaugcacacgcaugcacacacacucugguccccaaaguucauuuuguuuuguuugucacaaguuucacucacuauguagcccugacuguccuacaauucucucuguaaacagguuagccuugaauucacagauauccuccugccucugucuccugagugguggaauuaaaggugcaugcuucuaugcccaacccucagaaauauuuuaaucaaaacuuauauaaccuaagacaguuaacaagguaugauucuaauuuauguaccuuuuuuuccuucugagaaauagucagguauuauuaauuaaauauuuaaggcauaaaauauauauuaauauaguuuaugacaaaaauuuaauaaaagugguauuaaaaauaaggaaggcaaauuuuaugagugacaaagaucuuguucauacacuuucuuaguggaugaaggugacuucaaggucucggcucacugugguauuuaccuuguacacaauaaaucugaaggcaagguacaucuguuuuaagugucaauuauuacaauaaacuguaaauaacauucuuuacagcuauuuaaacauguaagauguuagauguuuuaucacucaagucuaaugggaaagcagguucuuuuuaagcagaaugaaugaaacacaaguugcauaacugaguagucaacaggggccauaagcaacaauggcuagcaacaagugcaguugcucccaaucuggggcuauagaaacaucaggacgcgguguucuaacuacgccucagaaagcaaggccaucuaggaggcaggagcaugaugggaccacaccaggaaacauacagauaucuggugcaguauggaccccgggaggcaacacaugugcuucugguuauagacucugcagcugaggggaggcagagaacuccagcuucuccagagccccagcuucuccccuaugccugggugacucagaaaccuucauuucagcacuggauguguccacagcuucuguauuuaaaccucuguuaaaaucauaugaacagagagguuugggggggggggagacagagagagagacagagacagaaagagagacagacagagacacagagagagagaggaaagaagggggagggagggagggaaggagggagggagggagggagggagggagaggaagaggaguggugacagacagagggagggaggaagaaaugaaggaaggaaagaaggaaggaaaaagaaaggaagacugagaaaaaugaacuaaaagaguuuaaaagaauaaaauaaagccauaaccgaaggcugacaugggagucaugugauaaggaacucaggaauguaauuuccugaaacagcagaacaggaagagaggauuggcaaaugggcagugcaggcgucgacacaaacugggguuagccuaugagaaggaaaaacgucagaaaucuacuuuacaucauaugcaaaaaguaacucaaaaugaaucaaaggucaaagcaugaaaaacugagcgacaaaucucaaaagcaaauagggucaauuuuguaucgcuaugaacuagacagugguggauucaaauccaaaauacaaauaacuaaaugaaaauaaaucagauuucaaaaaacaguuguauucaaaggcuacuaugaagaaaauguaaaaacaacucaugaaaugagagcagauauaggguuugcaaaucaucugucuuguaagaacauaguaucaaaaauauauaaagaccucuuccaacucaacaacaaaaagacuauccaauuuaaagcugggcaaagaaucugaauauaggcauuucuccaaagagaaacucagauggccaaucaguguaugaaaaggugcucaccuuuuuuuuauuauuugucaugagacaaauacauaucagauaaucugagauaucacuuuacaaauuauuaugguggucacagaaacugagcauuuucaauaaaacaauaaaaacucugaaaugcucuaaaaucugaaacuacuacucuaauacugugaguagaaaauuuuacaccugaccucucacaauaaaacagucaaaaacaggcacacuaaaaguagcauagcuauuuacauucaguguauguguguguguguauguguguuuauguguauguauguguguguauguaugugcauguguauguauguauguguguauguauguauauguguguauguauguguauguauguauauguguauguauguguauguguguauguguguguauguguguguguauguguauauguguguauaugauuuauauauaaggcauggggagugucauacauauaguugagacccaccucuaaguuauuucacuauaucuacaaauauccccacaucccaaacuguucuggacaagugccuguaaucagugaagauggauguuaaaaagaaaauuggcaaagauauggagaagcuggaaccaucauacauuucuacuggaaauauaaaacaguacagccaccauggcagacaguuugguagcuucuuaaaaaguuaaacauaaaaucgacauacaacacacuaaucaaugucuaugugcauacccaagagaaaagaaagcuuaugugcacauauaaacaguacugcaugaacucagcaaacuuuauguacacaggcaugugccugcauguauacaaauucauauauauuauauauuuuguguauuuaaaugugccuauguguauauguacauacuuaaauguauauguguauauguauguauauauacauauauaaaucauauguauuugacuaauuuguauauguagacacauauacauaauuuaaaaugaaauauauuuuuaaaacauuguauuaauaaaagaagccagacacaaaagacuacaucauuuguauccauuuauaauaaauauccauguccuucuaacugcugugauauauauaaauauauauucauauacauacaaauucacauguuauauaauguauauacgcacacacauauaugaagcaauaauaauuaaagaauugaauugggagugcaugagaggaguuagaagaagggagggagggagggugcaaauuauguagauauauaugcgugacagacuucaaaagauuuuuaaaaaccuuguaccuuguauguaaauacucauaauaagcaaaaugugggaagcacucaaccagagaauaaauuaaaacuguuauauucauccaaagaauauuaauucaacagcauaaaaaggcaugaacuauugauaaauacuguggcacuguugaguuuugaaaacauggugggaugggaaggauuguaucagugguuaagagcgcuuucugcucuuguugaggacgcaaguguugcucucagaacccacaguaugccuucuaauuagcuucaacuccaguucaaggggauccaacaccucuggccuccaugggcaccugcucucacaugccuauacccacucagacacacacacacacacacacacacacacacacacacuguaguaguuuaaguaggaauggcucccauaggcucaaauaguugaauucuuccucauugagaagugguauuauuugaaagagauuaggagguguggccuuguuggaguggguguggucuuagagugggugaggccuugauggagugggugugucacuggccagugggcuuugggaaucucagaagcccaagccaagcccagugucuuuugcacuuucugcugccugugaauccagauguagaagcuucaagcuccuucuccagcacuuugucugccuggaugcugccagacuuccugccugaugacaauggacuaaaccucugaacuguaagccagccccaaugaaaugcuuuucuuuguaagaguugccguggucauggugucuuuucacagcaauagaacauugacuaagucacaaagauaauuaaaaaugaaauaaaucuuuuaaagcauuauauuuaaaaaaagcagccagacagaaaugacuacauaucauuuguauucauucauaauaauaaaauguccauguccuucuauugcugugauaaaacacccugaccaaaggcauccugagaagugaaggguuuaguuugcuuacacuuccacaucacagccugucaucaaaggaagucagggcaggaacucuggaggcaggaacugaagcagaggccauggaggaacccugcuuaguggcuugcucaguggcucgcccugaggcuugcucauucugcuuucuuauaccgucuggcaccuucugcacaggcauggcacugcccacagugaguggaacccuuucacaucaaacauaaacaaggaaaugcccauaggccaaucuaaaugugagcguuuucucaauuaagauucccucuuccuagauagauuuagauuuugaaagaaaaaaaaaaaaaagaaccccaaaacccaaaccaagcaaccaaccaaacaccaaagcaaaaaaccagcauagccuauaacagggauguccauggagacaggaaguaaauuacuauuugccaggggcuggauggcuguuauugaguaugggguuucucuaaaggaaauggaagaggucuggcccuuggcggcaguaauccccaccaaucuucuuugaagcuucuaaaucagauauuuugaaguuuuuuuagauauauguaugagugccugcaugcaugucacgugcacuguugcauacgcagugcccguggaugcccgaagaagguaucagcuccauuagaacugaaauuuaccuugugagugcugggcacggaaccaucucuccagcccuugaaucgugggcuuuuaaaccaaugaacccuguaagauagcuuggugaguagaggcacuugccacccagccugagggucugccuucaagcuccagaauccacacagcggaaggagagaaggaacuaaggcccaaaagauuucuucugaccuccucaggugugugccaaggcacacacauauacauauuuuuuaaugcuauuuuauagaaauuauaucuuaauuauaaccaaauugauaggaaacauugaguggacacuuuaauuaugcgguuauucccuagagaaacucuguguucuuuaagagaauguagagacauagcaaaaaacaaaaacaaaaacaaaaaacaaaacaaaaaaccaaaacaaaaaaccaaaaaacagggacauuccagaagaggagagaauuucuuuuuuuuuuuuuuuuuuaagauuuauuuauuuauuauauguaaguacacuguagcugucuucagacacuccagaagagggagucagaucuuguuacagaugguugugagccaccaugugguugcugggauuugaacuccagaccuucggaagagcagucgggugcucuuacccacugagccaucucaccagcccaaggaaagaauuucuaggaagugagauuucaugcuuguacauccugcuuugguucaggauacccgcguggcucucucucccuacuauuuuaaaaagucacugcuucagugaguuucuaugucaguuaguuguaauuauaucccucguggcacacaccauuuguuguuuauuuaccugagguuauuuauuaguuuauaaucuauccucucccuuccucuuucuucucacauggaggccguagcugagugagauccugaguguuuuguuuacccugaccaccuaauguucagaacagugggcauccgauaaauaugagcuugacuucagugugauaagauaaucagacacagcgagggcauucuagcuacuggcaugaacccucaccacuggaaugcuggguuaaacagaccucuacuaacuaauaaaucaaaaugacaaagcagcuaugguuaauuaaaauugauuagcugcugaagcuaaauagaaauccccaauccuguuuuuguguuaaugguagacuuaaugaaaugguaaaagugcucauuaaaaucuaaccauguccacuuacucuaaccaugucccugugguuuguuuacuaagcuagagugcuggggauugaacccaggaccuuauguguacuaggauaagcuguauucccagcacacauauuagucuuauaaguuuaggaagaaaaauaugcggugaauauggauuaucccuuuaaauucuauugcuuuuaaagugucucguucuccagcguuuacccccaaaaaggaauuauuaaguagcuauuuuaaaaauauuugucauagccuagacuuuaaaagccuuuuauaacugagguuuuggcauuuuauaacauguucuauaagacuucuacaagagcaauuaagaaacacaugcgguucuggucaauauguacggaaauaauggugucuugaggaucucucgcucgccuucauuuucuaaauaugagcuucaaaugaguuucucugggaggcauucugacacugacauaucuuucgaaaguguugaagugcaacuucaagauugguaugaggcuguuugcaaaauuugccaggagccaagacaauguuuuuauuuauuuauuuauuuauuuauuuauuuauuguuuuuccugagacaggguuucucuguguagcccuggcuguccuggaauucacuuuguagaccaggcuagccucaaacucagaaauccgccugccucuaccucccaagugcugggauuaaaggcaugcgccaccacugccuggcaacaauguuuuaauuuuaacgugucuguuuguaccagcaucaaggaaggaaguaggcaagucagagaggauaagagacauuuaaaauguuuuucagaaaauggccaaacaccaacccaacccaaaacaaaacaaaacuuccaugggcagagaaaacuugaagagcauucccaagaacuaugccugcagacucuaaagacaccauuaaccgucacguuuguuuccugcgcuauaaugaugcugaaugaaacauugcuuggugcuccccaaaugaucacuagaacacucagcacugacgccagcaguaacggcggcagaagccuggacauucuuaggaucacugggugggagaugggagcuuccugugugucagauggguuucggagaagucaccagagucaucuaaacuguaucuuauuuaacaagguugcacaucaggacggcacauggacuuggggagagggaacuugugugcuuccgcauaaggcaccuuauagugucuguugcuuguuagucagaaacacagggacccccagcagucagucccaguccagucauguaaacugguuccauucucuuuucauuauccagcuauucaauuacuggugauaggguuuguuugguuguuguuggguuuuuuuuuuuaaagcucauauuauccaauuuaauucuuagagaaaucuagugagugggcaugguuuaaaaauuguaccucuuuucauauuagguaucuuggaaauggucucugagaaauuauaaggccacacagucaguauacacacggcgcuacuugaaguguuaaagaauguguggguguggaaccaggcacgguggcacacaccuggaaucccagcacuugagagacagaggcaggaggagggggagcucagcuuuauccuuggcuacgcuguaaggugaagggcagccuagacaacuguaucaaggcaaacgcgugagagcaaaggccggauaaauguaacuuaaggugauucuuguucuugcaacuuaaggagguuuuaacugguugacagggccucaagcaucuugagugaggacccaaaggugcugugauuagaagacagcacaucauagaccacuuucccuuagaaauaaaugaagggaaauuguaucagagauuuugugccagaacauaauccagaauagaagaaacuguggggaggauguuggaugcuuggcggaggaucaagggauuuauuuuuguuccuauuuuuuuucuaguaucuuauuaggaaaaugucaagcaaauuauaaaguugaacauuaauuaucaucaucaucaucauuugugugugugugugugugugugugugugugugugcgcgcgcgcaugcgugcacaugagcaugccuguguguaugugaacacauauguagugucuguggaggccauaaaaggauguuugaacuccuggaccuggaguuccaagcuguugugagccacggauaggaaugcaugaaucaaacuaggguccccugcaagagcaacaagcucucuuaagcaccgagcagucucuccagccccggagcuucuuuugacugcgcaugcccagccacguccucaccaccuaagcucuacaugaacgaacacagguuugcacuaguguuccaucuugagagguuugugaugaugcucugaaauucuucauuccuucuucccgcaaauaaagcuuaccacacacaagcccgugugcaagugguuuguuaaaauuauaaaggggggggggguggauucuacacacaaaaagauacacagucuuguauccuacaucccuacaucgaugucugcauauugguugcaggaccgcccccuuggauaccaaaguuuacagauauucaagucucuccuggaacguggcuucguguuugccuacaaccgauacguauccucaguguaaaugcuauguggcuugcugucauuguguuaacaaugagugacaaaaaguccacacauguucugcacagacauguuccuuaaaacacaccccagcucacagauauggagagcuaguuuuauaauuauaagggauaauauaguacaauauaacucccaguuuagugggguuaggaaucaaaacguagaggcaaccaaaggaccauuaagucauggggauuaaaagacaucugguaaagggcagaggauuuugcauacaucagaaauagagcucuaaguccaucuuauuuaccuguaucuuuuaaggaacagcuaaaugucagcugauaagcaauuaccacuggagaggaggguaccauuuacuggagcuagaaguguuccauaacuauagauaguacugguagagggauggaggaggggauggaggagggggugggagagggaauggagaaguggguggagaggggguggaggaggagguggaggagaagauaaaggauggggauggaggaggggguggaggaaagguggaggaggagguagaggagggggcagagggcacagaggagaggaagaagaccuugccuugagccagaggcucaguuccugacaggaguucuccucucucuucuccaccuccuccuccaccuuuccucuauccuuugcuuccuuucuucccuccuccccaccccuaaccuucuuccuuacuucuuccuuugaauggggagaggaagagcaaaguggagauagaaugagaaaguagcaagaggaagaggagagagguaaaccaggaacugggccgaggagcugccggcuuccagugcagucuuaacucaguuucugugccgacuauucauuaacagggaggaaagagaaaggaaaugaacuggaggcaaaggaagaaguggcgcuauaagagagaagagaaaaccucuuuuucaagauguccuuccuauccacaaaaucucaaacucccucucagcaaccccgccucacaguccaggcaggcggugauucuucaguuugcguuuguagacacaaacuuuuacaguucuucugcccuaagagauaccccgcaggggucaccagacacuagauucagcagaggcuuuuuuguugacuuuuguugacucgggaaaccgauggaaccacaccaggucuccauuuucuugaaucuaaacuggaaccaacaaaaacuuucuuaacuuguuggauguauuaaaaugagcugcuuuggaguccagccucuuuugggggggggggggggaucgagacaggguuucucuguguagcccuggcuguccuggaacucacuuuuguagaccaggcugggcuugaacucagaaauccgucuggcucugccucccaagugcugggcuuaaaggcaugcgccaccacgcccggcuuggagucuagcuucuuaaacuguguguuguaacccuauuuaggggucagaaaacugaaugugguggcugugagauuuugucaacagugagagaguuuugaccaaaaguuaacucaaaaaucaaaucuauaacccuaggugcuucugucagagcucacgcauguugcagcgcgccgcucuacugcugccucguuauagacaugcaacaugugcacugcgcaugcucucacagcaugcacuaccacugaaccucggcuuaacuucaaggcuauauuauaucguaugcuaugauuugcagguucuuacugugcacacaagcuuuucuucucuuacagaaacaaugauuuaacuacaguuacuuuuaauauuuuccuaccauuauuucucauuagguaaaguaucaauuuaguauauuuuuuuggaaugaaauacauuagaaagcuugauuuuaaaauuuucugcuugaguuagugauuuguauuuuauuuuauuuuuuaaauguucugggaaucaccacacaccauaaucccagcacuugggaagcagaaggcacguagagaucugugacuuggaggguauccugcucuacauaucgaggcccaggcuagucaaagauacauagugagacacugucucaaaaaaaaaaaaaaaucaaugaauuuuggcuuggaauuacggauaauuuuucaauuauuucugaaaugggcuugaauauaccucuuucuuugaugcuacauauuuauacaaaauggugugcccugaauuagcuauauauuuuuuucuuuuugggguuacguuuauuugagagacagggacuggaauuugcuaugcagaacaagcuggcuuacaaaauacagugaucccccugccucugccuuagcuucccaaaugcuaggguuauagacauucaccaucaggccuggugacggugacgaugaugacuacuaacucaaaauauuggucaagaugucaaacauucagacaagaucuaauucuguuuccaaacauaaauaacuguauuucucuuaauacuuugcaaauuugcuuucauuuuaauuaauggcaaaaguaagcauacaaaaagugcuuuaagguaaauuucuuugaauuauuaucauuaaauauuugauuuuuuugucccuauuuuuuauuuuccauacuuauuuuaaauaccuauuguauuuauuauuuaauuuaauuguauguaauuucauaaguaucuauuguaaugauuaaucuugucaacuugauagacuuuuaaaucaccauggaaacaaucucugggcaugccugagacugcuuaguuuagguuaauuugguuaauuagcuuaguguggacucagauggauuccagacugaauaggaggaggaagcaagcugaacaccagucuucaucucuguccaaaaugggacuaccagccucaagcuucugccaccauggcaucccaccacgguggaccaagcccugagacuggcagccagauuaacucucacuuccuguggugguaccauagggagugguacuauuaggagguguggccuuguuggaagaagugugucacugggggggggguguugugggaagggggugggccuugagaucuccgguguucaagcuacaccuaguguggcacauagucuccuucuguugcuuguggaucaagauauagaacucuaggcuccuccagcacuaugucugucugcacacugcaugcuuccugcagugauaauggacuggacuucugaaauuguaagcuagcaccaauuaaauguuguccuuuguaagaguggccuugaucaugaugucccuucacagcaguaaaacccuaacuaaagaugcuuccuuaauuugucuuuugucuaguaucuuguagccaagaagguaacaacccuauguccggagagacguguagauuucuuggguggaaagcgauuguaagagagaauguugaagacuuccacaagagcauaugcaugugauaaaagcgugugauaaaagagagcacugaauaacaccaggaaggacguucuaggcuggggcaacaggugacaaauccuguacauauuaaaagaguucaucuggggaacugacagauugacaagaggaauguaggauuuauaaaaauuguccuuuauauguuugggaauggauacagcuagaauaugucaagauaugccggguggacuuaaaauuuucauucgaaaauauucauuugauaguggguaaugaagaugccacacuguguauacaguuucuuuaaaaucuugaucuucacauauuuuucauauucauaaugcugaauaugcaucaaguguguauguauguguguaugugugaaguauaugugugcaucuauaaacauauaugcauggaugugguguccuugcccauguguguggaagccagagguuguuggcagaaugucuuccuucauccuuuucaacuuuauuucuugagacagugucucacagugaauuuggagcuccugguuuggcuagaugggcuggguaaaccugggauccacccaccucugcccuguagugcuggaugucauagacacacauugaugcaucuggcuuuuaccagaacccuagagauccaaacccaggucccaauaugugcaacaagcacuauacacacugagccaucucucucacucugcuuguaaaacccuuuaagaagaaacagaguagccaagcagucucuauuaaucaaagcuauagagcuggccacacagacucuuagcuacugugauaacagcucccguuuagucaacagugauuacaucugagaacugcuccgagcuuugugugacuacucuuaaccugcuucuugugacaauucuuuacauguuugguuagcaaguggggaaacuagagucuaauaaaaaauguggagccuuuuucucaucugcacacagguagaaaacaguaauguugagcacaugacuucagcagacaccccaaaaugacuacacaaagcgccacauggaaggcaaaucaguggagccacuggucaaguucaaaugaguucccguagucugaauuuccagacaugaguguaaacuagcuaucaaaaggacccuaggcaaaaggagacaugcuaggcacaaggcuagguuaacauuagaugcagagaguacuaaggucagauagauuuuagucucugcugagaucauuaaaggcagagugcuaugugggaagcugaggcaaaaagacuugaucacggaaguuucagggcaucuuugucaacaugccaaagaccuaucucaaaaacaaaacuagacuaucccaaagcaacccgguauacauaacuuagcaaucauuuuuagauuuuagcuucauaaaaaugguuugaacagacauguuccugaaggaaaagcaaugggauucuuaauauauucaaaagucuccuaagccuggcaucauuagucauuggcaaaaugcaaaugaaaccacugggcgauaccauuucacauccacuaagauuccugggaucaaauagacaagaacaaacguugacaaggaguagaaaaaugggaaaccucagacauugcugguggggagggagguuaaacagugcagugacuuugggagacauuugaauuguuucuuuagacgugaaacaggucuacuauaugaaucagacauucuacccacuagguuugcuacaugaaguaaaaacaugcguccacacacuugucugacacacauaugaccauuacucaugcuaccaaaaaaguggagacugcucaaauguccaucaguuagugaauggguaaauaaaauguucuguaucuagccaauaggucuugccauguggucauaaaaagugagugaaauacugauauauuucaaaauggaugaacauggaggacauuaugcuaagugaaagauaccauauucaguuccuuguauucugucucccagggaugggcgaucuuaauugucaacauuaguggauuaagaaacaguugagagagaagauagaacacuccucuagaucugaggcaguuuggggaauguguuguagguugcccaagugcuguuuguauuuugaugcuaauucugcuuucucaagaaagggcuacccagaagaggaguggaucaagaaguacucagaugauuucuugugaacguucuccccauuuuaaauggucaaauaaagacuagagccugugauugggcaguggaagagaaagguggggcuggagguuuuggagagggagaagagagggaggaggagagggagaggaggagacagaggagagagaggaagacggaggaagaagagauggaaggaagauagaacagaaccauguggcccagagaagcugcaaguaacaaggaucucauagccggggaacagaguaguguaguggcaaaucugcccaaucugggcgugcaacuuauaaauauuguaacugaguuguguguuuuuugcauggauuuauugggguuggagauuuacugcaacaaaauggccccaacguaucaauuagaacccaauuaaccugagauaaaaguccacccuuggugugcauaguaucaugcaauuguaugcccacccugagugugcaugauaucauucaauuguaugcccacccuggcugugcaugauauuauccaauugucccaugaccuggagggccuaaaagagaaagaugaaggaagcccacuaccaccugcacucucucaaccauacacuuuccaagucugugaggggggagcuguucuguuccaccaugccuucuccaccacggagaaagguggagcucugaaaucaugauuccaaacaacugcuaucucccucgucccguuuccccaaguaugcuauccacgagaugaaaaacuaacccacucuguuuaugagaugcccaaaauugucaacuagagagagacaaaguagacuagugguuaucaagggcuggaaucggggggugaaggguaaucauauaugggcaugcaugaucuuacugaggcagugaagauguuuuaaaacuagguuccggugauggucacccaacucacuaaauggauuaaaccagcaaauugugcagccaaacugaugaacauauggaauaacuauagcuuaaugguuuauucauaauuaugaaaauuagauuuuuacuuaucucauauggaaucaauuuuuuuuaaagaaacuauuuugguucaacaaaauuugcuccauaauauguuagaagagguucuuauuccaaagccuuugcgcuugccaagagaucauaacuacucagguuuuacaucuuuaagaaaucuuuucacagcuagccauaguguuacguacuuauaaucucagcccuggggaggauggagcagguggauugugaguuugaggccaucuugaaucauauggugagacucuaucuaggaaaaaccagaagcuucaaaaagccaaaaagcagcacacacacuccucccucaagaaaaaaaguuguuuuuuuuuuuaaaaauaaaacaagauucuuuuuguaguaauagaauuaacauuucucuaacauuaaacugauaugagcucaguuguauauaacuuauuuaaaaggcauacugcagguuuugugugucaacguaacacaagcuaucguggucauaaaaagaggagccucaguugaggaaaugccuccuccaugagauggagcuuuagggaauuuucucaguuagugauuguagugacuauuccugguugucaacuugacucuauuuggaaugaacuacaauccagaauuggaaggcucaccagcgacccuuaucuggaggcugggagauagaaguuucugaucuggaucuugguauggagaucuugagccauaguggcuauggauuccagaagauuaaaucuccgaguuuaaggaacacaccuuuaaucugggcuacaccuuucaucugggauuaaaggugugguggaacacaccuuuaaucugggcuacaccuucugcuggagacaauauaaggacauuagaagaagggagucuugcucuugcuccuucgccugcuugcugugugagacugacuaacugcuagauccuuggacuuccauucacagcugcgacugaaccauuguugggaauugggcuaccgacuguaagucaucauuaaauucuuuuacuauauagagacuauccauaaguucugugacucuagagaacccugacuaauacagugaucaauggggaagggcccagcccaguguggaugauaccaucccuggauuggugguccuugguucuauaagaaagcuggcugaagcuggcggugguggugcacaccuuuaaucccagcacuugggaggcagagacaggcggauuucugaguuugaggccagcuuggucuacaaagugaguuccaggugagccagggcuacacagagaaacccugucucgaaaaacaaacaaacaaaaaaaaaaccaaaaccaaaaagaaaagaaaagaaaagaaaagaaagaaagaaagaaagaaagaaagaaagaaagaaagaaagcuggcugaggaagccaggagaagaaagccaguaagccaaacccuuccauggccucugcaucagcuccugccucgagguuccugcccugcuugaauucuuguacugacuuccuuuggugauauacagcaauguggagcuuacauuuuggccaugcuguuuccuugcagcaacagcaacccuaccuaagacaagaggcucauuuucauaggcuguaguguaagguaaagaaaaucagagauggucaucuucccugaauuuugugacucucuuuucuauuccaaaugcucuugcaugucuucucauucgcuuccuuaagcccauguuuuaggaugcauggugcaauucaugcuuugcagaucaggauuuacaguguagaccagugguagacugcuugccugcaugagcaauauuugggggucuggaguccccgaauaaaaagaaauaaguagaagaagugacuaaauauuauauuucagaauaauauauuucagauguuuucuccaaaagaugugugcuccuugccccaccccccaacauccucaggaaccugcauugccagaaaucuaccucccucacuguaccucauauaucucuguuuccauuggccccccucccccuccccaccuccucuccuucucguggggggaaaaccuuacaaccagcccucuuuccauuuaccaaucgcucuuuccaucuucuaacucgauacacucuugaaaugagugaucugcuuagcuugcucgcacguacacccgaagaagucaucaacacuuguuaggucaacacggcauuucuaacugaacucaguuucucacccuucucagguucucagcaucuuuacgugcucuguauuugcaaggacuuucguaaggugaaagguucguuuaugacgugaauaagcaucuguuuccccuaguuguugaugcaugugucaaagaccuggcacaucuaaguugauguuauuggugcuauagaucuuuagaggguagaucugaucagaggguguuuuuagguuacuggguggacacauguccuugaaaaaaaaaaacguggggcccccaagcuuauuuucuuuuuuucuuuugcuacuugcugaagaggugagcaucuuuuuuauuuuuucucccaucaugcucucccaggccaugagcaucugguaugcccaccagagaauuaaaucaaugaacuugccuaaucuuggacugggcccugcaaacucugcuucacaauaaauacuuucucuuuacaaauuaauugucccuguauuuuuuuaaaugguuauggaaagcugacugauagagcaggugucuggguuggauugcugcuauuauggggugccgaaaccacucagagugaaauucaggucuggaauuuguuccuuuacucuuaccaggccacacauuccuccucuagaacgaacacacuucagcuuccaagagauccaaacaaaacccacacugcugaguuacugaucugcagugagacaauccaauugcuacaugaauugaaacuuuucaaugugucucauugucauauuuggcaguaaaauauuauucauagaaaccagcccaucacucuuggaauuaagaaaagaaaagaaaaaaaaaaguaaagguugcuuggucacaguaaaaucaaguuaaggagaauuagcuaccuaauuugaauuucagaguguugggacccagagagccugacuaguucaucuuuuccgcuuauacccccacuguguuggaaugugcuaagcuaauguguuuaaaucugcuuuuacauuguuccaugacaauguuucuccuuauuuacauaguauuuuaaucaggucaugauucaggcuugcuagcucuccuuaccaugagucaguauuugcucacuauacaaauucacuuugagagcucagucuuaucuauaaaaguaauuugggguguggcucauuguucucugcauacuugcaucugguuuuuaaauauggauucccagaucccauauuucuuuauguaagacacaccuggauaagucagcauguaaauaaauucuuaaaauccuucgaggcugugaguuuguuggcuuuuccauugguuggggggggggggguguguucaaaggaacauuccccagauaagugaaaaugguuccaaacuaggcucugaauauuugaacugugacaacauucuuggaacaaugguagcagaaaaugaccuuacuauugguauggcauauaaaagucucagucaugaacaugcauuuaauuccgggggacacgauuggacuaugcuugacugaccaccuccagguucauuaacaaccuuuuacuguuugcucacuuguuucuuguuuugccagaugucauuacuugcugccagauaggcaguagccagaaucaagacccaaagguaaauuuaugggagggaaacuuaaaguugagaacauuucauucauaaauauuucccccaggagaguugaucagcaucacuuagauugagaugacagcagugcccaagcaaaauccgagagcuauuauuacaguguugggucauggaauauuuuugaggaagugaauggcaauuucauuauuucuauauuauaaguuuaaaacuugagcagcaaggcccuuuuuaaaaacaguauuugcuuucugaaauucagaugaaaggaaucucuuuguucagauuuuuaaaaccuuguaugacacucauuuccacauagaaauuuacagaaucucuaacaugccaaguaaguguauuuuuauugcaauauggaaaauauuacuuuaaaaaaaacugccuaggauaugccugggugucacuguuuguaccucgucauugcuugcugguuggggaagccacagauuccguagaaacucuaugcaagcauuucccagggguuguacuucaaaaucgccuggagggcuuugcuaaggcagaccacagagccugcucuuggggguuucugacucuguaggugugggauggggaccacguauuccuuucuaauaagaagcagauguuguaauuccaugucagaaucgcugcucuguacugacuaacuucaauucagccagccuuugaggcucucccacuccucaugguggcccagcaacccuauaucaucuuauauaagguucacuuugucaucucccauuuucuucacguagcuucuuuucuacuaggaaaaacuagggucagcuuguauggagagcuuccucuucauuucuuucuccuagucaaacuucuuuuccauuuuaggucuuagccauuucucggacucuuuacugagccuucugcuaucuuuuccagaaucaauacuauacaaacuucccagugcaauuuucauuggcuuuuuucuaucuuaaguguucgaccuuauucucuuggccaguuucuucuccaaacccccauaaacaggcucaaaugccuugaacauaaaauucuuuuuucccuugucccuugauguguuuccagccacccuguuuccucguggcaagcaggucuuggaaagaauaaggaguugcuuuaucuauuccucccuuaagucagaauaaucaaguuucucuucccaucucuauaaaacuugguuuugccagagcccaccuugaguuaaguccaguugacauuaacucuguguuaguaucauuaaugugccucuuugccaccguuuuccugacaucaggaaacuacuauguucucaauggucuuuauagacugucuaccucacucauugcguguguugaggacccagucacucauccuuacucuaggagcugucuugaccauuuuguuguuuggcuuccucuguguccacagagauucuagugagaaguuuuuuuuuuuuuuuuuuuuuuuugauugaauauaggaauggggcagagcaucauauuuuugaaugagugaaaauagugaaucugguuccuaaagcuacauguuuauuaugguggugugaauaagaauaagccccaguaggcuucaauuuuuugaauacagggucccugguuagcagugcuauuugagaagguuguaggaggcauggacuugcuggaggaaguaugucacuggagguaggcuuugagaauuuaaaaacuugauccaucucuaguucacucuuccugcuuugugccuguaguucaauaugugagcccucagcuuccugcuucugcuaccaugacuuuguuaggccaucauggacuaugacccuuuagaaccauaagcccaaauaacucucucuucucuguugucuuugccaugguauucuaucaugacacuagaaaaguaaugcaggcauuuaauccggugguucuagacuuuaggcuagguuuugcuuuuaacacugguuauuccaauugacuauugcuuauagccauuugcgauuuugugcagucaucuuaaaacuuaacauaucugaaacuggcacucuuagucuuccuugucuugaaaaacgguauugccaucuauguggcaauucaaggagccuuggaaucauuugggaguucccuguugaguuuauaguguguguguguguguguguguguguguguguguaugugugauguguaggauguucucuguguguggaagcuagaagauaaccuugaguguuugacuuugacuucuauauugauugaaauagggucacaauuauuuuuuuuuccccucuguaguuaaagacuacauauggcaggcugggaggcacagaagcuucaauggauuauccagccuucaccuuccaucuucucaugggagcaugaagauuacaggaaggcauucccauggcuggcuuuuuauaggauuucuggggauucgaacucagauccuuaaguuuguaaggcaagugcuuuucccaucaagcccuuucuccaguucugauccucacguauuaccaguugguaacugaguccucuaacauuucacguuccauuucucccagcaucuucucauguuuccuaccuauuggcucagcucugcccuauuuuaucucuuuacugaacuguuugugucuucccauuuuuccuucuaacuugcauaugacuuccaucuuucaaaacaggcuguguaaucaugauaucaccuuaaaaauaauuucaacacccccaauuucuaauuacauaaagcucacauucccaauuaugaugucuaagacuuccuuugaucugacccugacaaauuucuucccagacucugugcuccaucaugccggacuugugauucucuuuaauacaccauaacuuuccuagugcugccuccucugcuuaaaucgccuuuccccauucuguucaaagaugacucacuuuccaagacugaguucugacucauugucucagugguaagaaucacauuaaugaaaauuaaguccuaacaauguguaagacucuacauucauucccaugugauaaagcauuauuuuaagagucucuauuguuaugcucaauugaaggaugaaacuauugagaaaagagaggcugcccaccuugacacauuuucuugugugugugucaguccacauucacugcccucagugacuacucccuaacuuucuaucuucuacaauuuauacacagaauagggauuacuuaauauuagaguugacaguugcaaaggaaacgaacuccaaauuauuuaggaaaguacaagcagcuggguggucaguuagccucaaagagugggguuucuagaaucucagguuagagaaagagaugaccaaaacacucaauauuagcagugcauggguguuugagaagguagagaagguuugaguauaauguugaaaggggcaugguaccaaaacauagcaaugcaguaugagggcaaaaccccuuccauccucucgaaacuuuagucaguugcuauggccauacagaccuccaagaaaaugcacugagguaaaaucaaggaacacgguucaguucccauuugagugguuguuuguggaacagggacacacacagcaguucauccauaaacuucagugauguagcaucaaguggaguccagugccagaggggagaacaguagccccaaagaaauaugaagaacuguccgguugggcguaaggcuggaguggugguucgagauauccugaccuacacgccaaaaguugaggagaacucagcagacauuauauauuggcacugccuuuggcuuuccuaggucaauagcaacaagccuuuuggaagacaggaccuuuguuaccaaucuuuaugugucuagugccuaacuaugcuuccuguaccuacuggaaccucaauacauguuugucaaaaagaguaauuguuucauugauggaggacauggaggaguaugcucgcaaucccagauucuggggauucugaggcaggaggaucaugaguuccaggcuagcccagaguccaagucaggaggaucaugaauuugaagcuagccugaacuaacaacuauuucaaaaagaggggggaggaagagggggagggggagggaaaacaaaaaaauaacugucauguucauauagauuuauuauauuaucagaaacaaacccugguauuuuagauaaaguuucccuuuauauucccaacucaaugcacuagaagauaaaauuugcaaauagcucauuaaaagcuggaauacaauaaucgcugcauacuaaggagcuuuuucaauuggucagaacucuuccaucuaaagccuguaacaacauacagaggaggaugcuuacuuucagagaggccgaaccacagcaaguuacuguggccaaaauguggcacccaaacccaucuguuuuucacuauaccugacucaguuauugagauuguuuaaaaagauucuaggaaaaaaaaaaaagaaaacauauauauauauauauauaucucguacacacacacacauucuauagaaugcuagaaauuaggccuguuuuuacauucuuugaucauuacuuaacacuugaucugaguguuacuuagucaaaauaggcuuauugcauccagcuuuggggugugaagcaggaagggcagguugcaugagccacacugugguuuauugcacauggcaccaauuaauuuuuggcucuguuuucauauguaauagaagaggaaagcaguuauuugaauaauucaccaaaaauacauccaauuucacaucucaauguuuccgcuccaacacauugaagaacugcauguucuguauacuggucucaacuugaauucucuaucuuacuuucagguacuaaaguccccuuccugauacuuuacuucacuucucuguucucacuuuaaauacaaagagacucgacuuccucaccuuauaaacaaagugaagcauaccuuuggugugcuugacacucagcauccucugaaggcuucuguaguaaaggcuugcugucagcgcuccuuuggaccucccuuguacuccucuguccucaacccacauuauuuucuuucugaguaacucuucuuuagcucagaaccuuuuggcagaucuuccaccuuaccagaccuauccagccucagugacuugacucagccuggcccuucaaacauaguagcaaucugcuuugccuucugaauguccauauuccuggaccacuuucucaggcugucuggccccaaauugacauuuuucagugacaacucccucauccuauccauuuuuuccccuuucugguaacacccacucccuucagauauacuauagagcauagcuauuuauuuuguugcuuauuggauuucuucuacugggauggaagcuggacagugaccugaguaucugcucuguguacuguuauuucagcagcuucgagaguauggcagacacaugggaaauauuuguugcaaagugaaaguuguuugcuucuaggagaguaucagacacuggacuccaugggaguaaguucccauuugccuggagacuuccagagcacuuugaaagccagauguuuuaagauucccuuccuaauuugacucucaaaaaucaugauugcuuucucaguggccaagcaguaguuuuaaaagaugcugguuuguuaaaccuggguagaacgaaaaguccuaggaagcugauuaugauuaguuuuuguuuuuagauuaauacuauuuuaugaguguuucagaugcauggaaauauguguaccacauauauaugccuggugcccuuggaagucagaagagggugucaaauacucuggcauuggaguuauggauggaugguugugagccagcaugugagaggugggaacugcacuuggacccuuuccaaacaggagcucuuagggacugagccaucacugcagucccaugauuuuaguuuuaaaagccaccaaguauugcaauuuugaacauaucuuaucaauauguugcuuuuucugcuuugcaauauaugaaugcaauuggaaaguaggaguagccaguuugauuaugcauaaauacuaucaccuccuaucuaauguaucaacaaauuacuuuuucauauucauauuguuuuuucuuuucaaguauauaaagugaguuggauaucuucauguaucuaaaguaagagcucuuuauauucauucaccuauguuuugaaagcgaacauguuaaacuuuuucuguacaacuuuaggacccaacuuuuggggaauuccuauuuuaaaggagcauagacuuuuaggcagcuugguuuuagcucaacagauuuaacgucucaaccuauagauaugaaaacugaugcucaaugauguuaagaaacuugccaggaaguacuuagucuaaaaauuaaaauaagauugcuuuugagauuguaagacaaaaauaguuuucaacgucagaaaagcaauugacuauagcagcaaaugcauaugcaguaagagugcccacuguauuucuacagcgagacucucaugauuguccuaacaaauuaaaaucauggauuauaagagcaagauuugcagguuauuugaagugaaccacucuuaagugaagaaguggcuuccucacagaaaugguuccuauuagcuauggcuucugcuguccuuuuuagaaugaggacuuccuuugucauugaaaaugggcacauagacaauggccaagcugcugcugcuccuccuccuccuccuuuucuucuuuugguggugugaugucacuuggccuccuguuguguuuucccacccacuuuggaaaucauuucuuuuucugagagcuaauggucuccaaagcuuuaacuucacaagagcuucguuuucagcuuuguuauugaauaaaggcagggcauggcugcugcaagguauggguaaggggaagguuuuuauuguagguaugagggagaguagagccagaggcaucuggaagggcccagagcagggagagaaagcaguggacugaaccuggccagcagacuggaucuagccaugaaaggagagcuggggagagcaagagaggaagacuaagagagucugugcaaugagaccuagagagaggcaagagagagggggcaaagagugugcguagcugaaauaguaggguuacuaagacucugggugagggaagcccaugagcuggaaagguuuaggguaaaaggcaagaugagcagagcugagaagagucccagguucuugugguccugaggaagccuggaggccagcacaugcuuuaagcuaauaggaaccagauagccauuugucccaaguuuuuuuuggaccugaccauuauaauuuguuuuugagucaaaucuggucuuuaucuggaggugaaaugccugugcgaugauauuaguugagcagaauuuuaauuaaaaugaucugcauggaauuuuuuucuuuggauaaucugucuucuguuuuuacagcaguuuguuuguuuguuuguuuauuuauuuuuauuauaagacagcucagucuuaaaaaucaaggcugaccuugacuucuccaaugcugggauuacacgcccagcccaaucuccuauuucuuggcaauguacuaaaaaagucuuuucaccuuuuguauauaaucuagucuuaauuuuuaaggaaauaaugacaauuuuuggcuacuuucccauauagcucgcacucagcuuugggcagagugagccuggaucuuacacuucauguugacccuccacauccuaaaucuacucuuggaaguguauuuggcaaauauugaagugucuggcaguuacagaggacuaagcacaagacaauugcaauccagagaggagaugaucagaugaauggcuguuuuaaagacacucagcaaauaggauuauuucagaacucauacauucauaggcaagacauuaaugaaguaaguagugcuugaaaagaccugguaaaggugaaugugaugguuuguauaugcucggcgcagggaauggcacuauuagaagguauggcccuguuggaguaggugugucauuguaggugugggcuuuaagacccucauccuugcugcauggaagccaguuuucuacuaccauccuucagaugaagauguauaacucucagcuccuccugcaccauuccugccuggaugcugccaugcuccugucuugauaauggacugaaccuccgaaccuguaagcuagccacaauuaaauguucuuuuaagaguugcuuuggucaugguaucuauucacagcaguaaaacccuagcgaaaaaagugacuaauauaaauaauaauaguaaaaauaauauaauaaaaauaauauuugaaaugguaggauaguggauauuuucuuuucuaaacagccgagugaaaacaucacacacaauugucuccaguucauuaagguacuacaccugcaaccaucaaacacgggaagacaggucauacauacaauucaauauaaguggugcaaggaaaaaucaccacugcuuguuuauaaagcuuccccaauagugaaaguuauuaacuaaagcaugcuuuuuaaaguaauggaacuuuguagaaaggaacggggguggggugggguaacuuugcagaugaguuuucacaggcuuucgauuuugcgcaagggccgguagggguggguagguggguguucccagguccuagaacggacugaguccucacacagugcuucucugaggagagagucuuuccuaacucugcgccccuuugucauuggaaacaauucuggucaccugaccaaccccugaagagaagcuugcauagaccuucucccagugcagaucaccgacucucaauaauccuagcuccucgggcucacuccuacggucugcagagucaccacaggccaaauccagcuccucugccagaucgcucacucgacucaucacaacucccgcucugaggcuccgccgcguggcugcgggccgcuccguacgccgaggcgggagcgcgaagccccgcccccggaguguggcggaaguagaagaagcaggcccgcgaccgcgcgcgcuggccagccgggugcgcaugcgcucucgccgcacggcuuggcccgucccucuagucaccccaggcuccgcuacccccgccccgccccucauaguggcgcucucgccaucuuacccccacccccuccagccuagcucagucaccuuuucccuuucuacaaucucugguuccccccacuccccgccccccugcccgucgugucccggggccgccgccgccgcagacaccgcgccaucucuguccccucucauucuccacgcgggacgcgcagccgugccuccacgugucuuaagcagagguugugggggcgcgugggggcggcggggaguggggcgaggucaugggaacuugagggacgucguggcagccaaaugccuggcccggggcugcgggcccagccggaugcaggccgccgagcguggggugccccguggcuccuccccguugucggugggcgugaggcaggggagcccucggggccgggcggagaggcaccguuuaggcuugucacccaaaugggugggaaguccuccaagaaggcaagcuaggaagcuaggaagugguaguggaaggaagugcagugugcaugcaggcugagggacagaggacacagagauguugcugucagagcucgccucugggaccccuggggaaauaaaucauuuagccgguggugucgggggguauagauggggaucaucgcagccuagcucaaaacucagguuuaugggagaagaucugugugcuaaaagcuuguaucacgccagcugugauuaauuacguuugagcuccaaggaaauugucugucaucuugccuucuauauuggaagucaggcuaguugaugugacaagugauaagaguuauagggauaguggaauauauuugacggucagacaggaucccaguagcaguguuguuacugaacacccggauuaaaauuagcuuuauguccuuggaauuaguagacucaggaagaaaccaguacauauuuaucugggauaaaaccugaguucucaguauuuuugaguuaguucacuguuaaaagauuuacuuaaagaaagaaacaacugguagaauuucugcguguuccagcgaggcggaauaugacuacuaagauaauguuuugcacaaccagaccuuacuuuaaccauacuauugcaagcuucccacccuuuuccggcugcacugcccaaggggacuuuaugccaagcuggaaaugcuauacucuaugggcuaccaauaugguaaccaccgggugcagguggcucugaugagcuugauuuuuuaauugguuagcaaauuaauuacaauguaaguaaguagacacacaggcauggugcuuauugcaugggaucccacaggucugaaaaaguugagagauugagagccaguugcaguuuuuuauuugguugaguuuuaagucaggccagcuuuugaacuauuuaugcuuuuaaaaggacucguaauuagaaucucuauaaugccuuucauucaaauuguagaucugcuaguauuuauuuacagcuuggcaaacuaaagcaaaaugcucugaacucugguucuaaagcuaauggcagauuuaguuggaaagacaacagugcuaacuagaguuuucuuuaauuaucuauagcuuccauugucuuuuaccauuugauuaguucuuagagaauaguuuaaacuuuuuauuguugugguuccccccccccccuauuuaagagguggcaauuccaccuuaaguuuuuguguuauaaagcaguuuaauaaauuauaauaguaaccuuugagcaauuuuugaaaucauuuuaguauucacagucaaacuucugaagagaaaagugaaauuuggugauaaaugugucaugagaccacuuucuuugaaauauacccaacuauauuuuaucugagguuuuguaaaucuugaaaauaaaacuuuccccuccuugccugucucucccucuccuuccuucuccccuuuuuugugcuggggguugaacccaggcccucccacauacuaaguggaugcucuacuaacuaagcuaugcagucaggccuugaaaauaaaacauaugggggaaaagaagccaaaacaaaacuaucaugguggauuguauccagaguucccgccugauauuuguaaaauguuggccuuggccucaaggcugaagaaaaccauugguucuggaauggcagcuuaaagcuuaugaguugcaucauaugcagagaauaguucaugacaugcaaaugacacugagcuggacauaaguagucuggcuaucuuaauuuuucugggauagucaugucccuccauacuuacuacuagagcuccuuucauacaaucaaacguguaccagguuggacagugcuaaccuggccacacuuuuuaggcuugucaauucuuaacauaaucuuggaaugauuagcuauuuugcagucuccaaaauccacuuguugaaaacagugacgaaguccgugcugcugcccuuauuuaagugauaccugguguaagucaggcuagagaaugacuuggugacuuuagccacugucaauuucaccuuuuauguuguauagaaaucauggguagugugauuguugguucucucugggaaagaaaagaaaauccuuuggugugaggggcuacaaauaugcaaguacaggaaggccacaagauugaguauuccuguugaaauguuuuuggugaggucagaaacuugcuuuuuauguauuagaauauuacugauuuugcuuagaauucacuuacauuaugagaaagaauucagccauuccguuauugugcugagugaauucauuuuaacugaagaggaugaacuguuuuuuuuuuugcuauuuuaaaugucaucagcuuugccguugagcccuguaugucuccugugggccugcuagcuuaguuuugaaaagacggcugcacccauaagccuccuuuuuugagcucccuuaccgagaacccuaaaauguuuuuaaagagcagugucuucuuuauguucacuaucaugucucacaagaacugagcucuuucugugcaccaggucuugcuuagucauuacuucaugaagagaaguauuuuaaguuucuacuuuagaggagcugaggaagagaggagacaugagcugcccaaggucacgauacaccuuacagccucugcuugaacuccagagcucagcccuuuccugcuccauugugaguggguauaagcagauaguucccaacaaaguucacugugucaggcguuuuuuucccucauucccacccuucugcuuaguagcaaugguaguauuuuuaguuaguuuccaggacccccagcuucagagucauuuuccucuuuucacauacccacugucuauuccaccugcaaguuaucucugcauuccgaauguguucuuaucuccauuuucuauaauaaccaaaaguaucugcaucucuugucuaaucagaaccauugacauacaauuucaguagcuucugcuuuucaaaacacuaauucaaauuguuguugagugucacuccuaccugugaugcaucucucucucucucucucucucucucucucucucucucucccucucucucuccagcucucgcucucccguucuuucccucccucccauccucccucccucccacccucuuucucucucucucucugguuuuguuuagccauuauaacuuccugaggaggacauagaaauguuuggcuuuuaguaagugcccaauaauuaugaauauaaauuggacuuuaaaaaagacauugccagugccuuuaugguaagaagagggaauagaaggcauauuauauuuuauauagagagcagggaaauaagucaauugugaguuucuguuucuaugucauuuaagagauacuguggcgccugccaguuguaggaggagggauucaguauggaacagaagcuuagaaugaaaauaaaauaacucacauucacuaagguaguauuaccuauccaguugugauguuugauuuucauugccaaugggacuggauuuagaauaauuuagaagacacauucuggguacguuucuaaggguguuuacaaagaacuuuaacugaggagggacgacccaccugaaugugaguagcaccauccuauaggauaucgucccaaacuuaauacaaagcaaagaggaaaaaaccuggcacaccagcauucauuuguaccugcuuccugaccauggaucagugugacuaucuauuauuaugacaaaccugggaccugagcuuccugacaagggaucaguaugauuauuuacuauuacagccucaucaucaugacuggcuguauccccucugugagccaaaauauaucuuuccuuaaguugcuuuugcuaggcauuuugucauaguauugagaaagagaggaaauugguacuugagaaaugagguuuuugcugggcuaccugaccaugugugugacuuguaggccucugaaacugcuuuguagaaggaacuuggaaguuugaaccuuuggucuagagaaacccuugugggaaggagcauucgcucaggaaccucgcuagucgcugccacccgugcucuacucuggcaaagacacuggcuagaaaacuuguguuauucugcaugcuauagacauuuuauaaauauucuucaccuuuugaguuccugcacuuguagugauugaucacuugguaauuuucauaucaguagaaauuuagauuaugauguaacuucauuuuuuuaaacaauaaaacaaaaauggcguaugcaauaauguugacuuaacuaugauuuuuuuucugccuuuauguuuuacaaacauuauuaaucauaaaaacuuauuuauauuaugugagaugucuuagaauugagacuguagaugggacuuaacguuacucgccagugauauaguggaagaaauggucaucuccauuaugucucuuaguggcugcuuggccauuagacuuagaucucaaauuuugauauuccuucuaggauacagagacuacucagagugagguauaugauggaagauguuuuucauggcugucuucuuuggccauguugucaacaagaauaugcucuuuacugggcacccagugacauggucagcagccuuuugcuugauuuacuuucgugauguccaucuuuacccucuaccacaauggggaccuuuuguguuugguagcaauacuuuauaaugaaaggaauuuugcaugcaugaaugcguauauacguacacauacauauauguuuaaauuaaauaaacauaaauuuuuauuuucuggaaugggaguuuccagauguggcgcagcauuggcuuuugguuuagugauccaguuaauacaguagucaucagaaaugaacuuuuuccuggaguccacguauaaacuggcaugcugaaaugaucuggcuuucaaucugcacaucugaauucauuuuguaaaauauggcaagcagcugcaucuccuaggaaagccgaaacaacugcaggacauuaacccacugagaagauuacaguagguuuucaguuccauguuaacuguauuuauuagugaaaauugacuugagugcuucugcuuuuaacagacuuuuuuuuuuuuuuaaugucuagaagaaaggaaauaaagcguugggaugauaggacuuugauguguaaagaaguuaaugucuaaagaaguaauuaucuaaaucaucaaacaaaauguggguacaggaaagaauuauuuuggagagucuaaugagcuaucagcucauuaugucaagaaaaauguuauucaccuguuugucuuaaaaauuaauucacuugucugugaaaggcugaucauguuuguaauacauuuggauguagacccuuuccaauaaauaaucucaacagcaaacauuucuaauggggagacaacugaaaaagagcuggccaucaggccuaucuuaguauaaauuggcuuuaugaaauauguccucuugagagaguuaaaaacaaggcgacuggauuugaaacugaagaaagggacacacuguuucagcagagucucacuuaaaagguuggccagaguagaaggccacagaauggcccguaugucaaaugugaaaugggucaacucaaauucuguuuuggggaggcugagguuaacccuucuccaggcuuuguguuggaaccuggagaacccuggggaagguccuugaaaaaggagaacuguucuguuugcugaucucauuguaggaaucugugguuccuguuuuccccuagucaugggcugggagggugugaugguuuuuuuuguuuuguuuuguuuuuggauccaaguuucaagcuggaguuugauggcacaugccuagaaucccagcaccuaggagguggagccacucagcaccaggacggcugcuaccagauucauugccaucucagaauacaugagagucucagaaacaaaaaagaacaugggacuguaggucguuuuguuuguuauuuuguugauaaaaaaauaguaguuauuucagaagucuuugugaaaaaccagaauaaauucaggcuuaaaggaaagugauagucuuucuuacuauuaguuuuuuauguguuuggcuguagguucaguuugaaugaagcuuucucuuuuuuuccuguguuucagagcacaaaugcucugugcccuuuuuaauucuagccuggacccuagggcacucagcauaagucagaggaguauugggguauuuuagacauaaucacauauaaguaugucuaccuacuuauuaugcuauaaucaaggugcuguuugcuguagaauuuugucaucaccuuuucaaaaauggccugucucagguaguugaguagcuuuuucuguaaucuucuguccuugaggcgugaccaucaucuagauucccucggugacuuuugucauguuccacacauuugauuagauuaaaaggacacauuaugucuguguggagcaugagccaggugugaaagagaugaguucguagaagucgguagugguggagugggaggggaagaaagucaauuucuugucugcuugcacaucauggaguacagggaguguuaaagaugagauggguauauagguagagugccuagcaguuggugucuaaggacuuuauaaaauguauaauauuccaugaauucuggaggucucuuuagaacccauuuucagacuugcauuuuuaaaguacacagguauuccauauugauauaaaagcuuuugucagcucuagggguauuuuagagguuuuuauuuuaauagcuaacauuauuguauacuuacuguaucaagauuguucuaaauugccacaauaguuuuuaagaaguagggccacuguucacggguuauagacaggauaauggaagcaacgagaagugaaguaaccucucuaaagcccucacaaagaggcagagcugggacuugaaccccggccucugaguccaaauauugaaaucagaucuuuaugccagacuuuccuuuuuacuucaucucauaucuuucacagaaaucaggugaaaccuguuuucuuuuguuacugagagucuagcaguuagccagagggccucaggagacagccaccuggguagacauugugugauuugccaggaacuguguggggaaagcuaaucagugaggcggaugccggaggagguuaugagcugucuuugagaugugcagggugggagaguguuuuccauagggcgacaagaggccaugcacaggagugagccgcaugcuuccacuugggaagguagugccaggcugaggucuccugucuccuguuaaugcaggcuaugcucaacucagccucuccagcaucuucaggucaggugucaccauagaaaguucuguucucugccugugcuuugucuucugcagugguuugaacgacccaccccuuuauguagcacuaacucuagaacuuguuuaccaacuagacugugcccaaaacucugucacaugcucuaucaauguucuuaaguuugcaugcucuaacauagaauuuacaaaguauuucuaauuucuaacuuaugggaaaugaugcuauuccaaaguuugcauaagcauaggaaguaacauucauuguguauuuauuguaugguagugauacuuuacccacuucaaugaguuuuauguucuuuuggcuaguucuuuggcuaguacaguaaauaaaaaggcaugugcuaggauuggcuaguuuucucaugaaaugucagccugauuuaauaaggaaaauaccguauuuuaaauugaaugaguuauuugcucauaagauuauaaacuauaaugccuacuuccgaucuauugauugaauugcuacuguaggcuuugauucaaaagagaacuagauuugauguaguuuucucauuuuguauauuauaguuauaaaaacuucuuuuuuuuuuuuuuuuuuuuuuuuugguuuuucgagacaggguuucucuguguaucccuggcuguccuggaacucacucuguagaccaggcuggccucgaacucaaaaaucugccugccucugccucucaagggcugggauuaaaggcgugcgccaccacugccuggccauaagaacuucuuucaauggccucucaacugguauucccaaagagagagggagagagaacaugcauacucauaucuggugcaugcaugugcauggagggcagagguugauaccagguugucuuuagccacuucugcacauuauucauuuuacucagaacaguauuucuguuugaaaaauauccagaguaggugcuacgucuugucccaggugcuuacaguguucagcaaugauuacguauguagugucaugccgacuacagcaacaguucuauuaucauuuuauaguaaugcaggauagguuguccucaaagccaucucaaaugcuagcguucucuguuucagccuaacuuacuugccagaggacagccaggaucuacccuugccccucucuucuccagugcuggguuacaggaguugcugcugagccaguuuucauaggugugccgggaucugaacuuggguccuuguacuugcaaagcacugugcccacagccaacucuccagcucucuaagagacuuuuguuuucauggaucuggauggaagugggggaaagcguguuaaggggcuauuggacccucccugaagaauugcuaaugagacuuuggguggagugccauacucuggggaacgacagaacuauggaacuaugccagaauaguuuaaagaguguuccaguucucuuauuuacuguagaguaguuacuggauguguccuagucacauaguuugauaccugagcugacuaaacaguuucuccacagcacuacucauuugaauaaagacauugaguagaaggaaauugaacuuauacauagcugaaauuaaucagaaauuugaaaguuucuauacuuuuugaaguaauucaaaauugccucuauuuuguguaauuuuuaugaguguaaguuuuauuuuuuuccuuuuaauuuagaugaauaaugcugcagcuagcccgaugucuacuaccacuucaaguaguggaagaaaugcagggaagacuauaagcuuugcggccgaguugcagaguaugaugugaguacgucuuuacacaauaugacuguugcuauuuuaaacugauuaauggugaagaagaaauugaaauaaaauguauaaaccuuagcuuaauguaauuuguauuuaaacagaaguaaaauaaucuaacauuuaaauagcuccauggaagaccagcagaacuggguaaagugcuccgguggugcacuguauuugaaaauugagugcuauuggcucucuuuuuuguggauagucaaaauguuuucagagaaguuugcaguuuuucuuaauuuuccuaguucugugagccugauucaaaguaguuuuaaauuuugauaauauuugaaccauugcauuucagauuauuguaagaaaugcaacuagcaaacuuuauaugccccaguacaggggaaagccagggccaagaagugggagugaguggguaggggagcaggguguguguggggguaauaggggacuuuugggauagcauuugaaauguaaaugaagaaaauauccaauaaaaaaauaaauuaaaaaaaugcaaagcauuaaaaaaaaaucacaaguguugaaucuuugaggaauugcacauuuguuuaagacuucaugcuggugcuugucagcuugcagugagggaagcuaccuucuuaacuggcugggguggcagacagggaacccugaaggacugaguuuuuagugaguucuucaggacaaggggaucuuacaggaagaggugacaaggcaauagcacuucuuucccagugauugaucaggcgguauaaaagacuauuucugugggaaguuuaaaugucuuccccauguguguauugauagccuuuuuaccggguuaccucuauacugugugguaaugauccuucaaagcacagucuuguuacauuugauugcauguaguuucucaggggacuugcuucaaagaaacuauucacauugaaagcauuuguaaaacuaacuaauuaauuaacuuuacaucccgauuguggcugauugcgccuucuccucccaccucuccucccaucacgguguuaagaggaggacauuauuauaaccagucuggggaagcaaaggaaagcaucagcgucauaguuaacagcagacuuugcguucagcaucucuuuauagucuuauuuacugagcaucuuugagaaccuugguuguauaggucaucuauagauauugaguucuuagaguuuaaaacugagaaauaaaaauuuaggccuucauuugaaaauuaauaagcuuacauaugaaauaugaucucuuucuuaugaaaauuaugcucuaaaacuaaaaacugguaacauuuugugauugcuaagauggggaaaagcacuaauuuagaagcucaauuuugugagccugccuauauuuuaaauuauggaaaacuuuaagaguuuauauauuuauauacuuuaaguuuucauuacaguguaauggacuuuuuguuaucacuuuuaugguauauuaauuauauuuaaaauauuaagugugcacuuuaugauaaagugaugaauaucauuuuuucugugacacuaaauugauuuacuuaaucuuuuuuaauugcuaauuuggauauuuuaagauucuuaaaaucauagcauaaugaaucucauguauccuuuaucuaaauuugacaaguuauucuuucacaguuuuauuugaccuuuuuucacaauauucauuuaaaaaaaucaaguauuuuaaagcuaaucucauagaacuuaugaaaacaauauguaaguuaguaggugcaggccaggugguccacagcaugggucagcacacugugggacugucucagugaaugauguugcccuagcccucagugaugcuccuuuguuuauagccauugcucacugcugucuucaugcuacauagcagagcuagauauuuguggcaaaucccaugugacuaugaagcugaaaauguuuaccaucuagcuuaugcagaagucaaccucugagcuauaaaacuagcucuguauaaaaagaaaacagaaacuuuggaauggcugugccuacuauuuguaucuaauagaccuaagaccauuuaagaaaguugggaaaaagaaaaggaaaacuaaauucagcguuuuuuauuaaauacuuuugcacacaucuucacaagcgaucuaccuaagcuggauucagaauguaaagguuauuguuggcugugacucuggaauaaguaugcacuuuuccuucacuucagaccugagggagaggccgcuccuaauaguacauucagcaccgagaggcuaaguuuuuccccuuaugaauuucaccucagaaagggagcuagagccaaacgaggggauccuuuuagguuugcuaauacuuccuaugacuuuaaaaaccucaggcuuuacauuguauacaaaugggaucugcauaggacaugcagggcuuggcugugugcauuuuucauaugaggaagugcagacuuaaucccugccugcugggaggauuucacucccaauccuuaccccaugcuguuuccuguuuguuuugcuguuuucaguccugcaacugccauuuucuguauucacuuacuagugggaaguuucuugccuuuggauugcaggcucucuaaccagggaacacuacugagaaucuuuucaaggguugguaucacugacaaguaucugguugccaauuacaaugaaaguugcccaguucuguuacuaccaagugguugcccuaacaaacagaagcaagugcuccgucccuuaaagaaacugaacagcugccaaguuaccuaagcucaaggaggcagcaaggucacacaggcagagaaacaaagacagucugcuauaacccgugccaaggccaagggcaacuuguacaccagggcuguggcuguguggcagcuauuccuucuuauuucauguguacgguauuuuauuuaccuguaugucuguguaacauuugcuugccugaugcuggagggagccagaagggggugcuagaucaccuguaacuggaauuacagacauugugggcuaccacguaggugcugaaaaucuaaccuggguccucugaaagagcagccagugcuccuaacugcugaaccaucucucuagcuuuucuacuuuuuuucuuuuuaaugguucuuagcaauauuuaguuacuauugugcuuuuguagugucugccucccuccuaaguauauggugaacaauguguguguucuuagacuuuauuaauccccuauuguuauuuccagguuuuccaguauuauuaaaaauaugaaauaaaauauuugguaccuauuaccuuaaaguuaaagaagaauacuuuuucagucuaaugccccuuuugguacaaauuuuuaaguuuccccccaaggaagcuggacugcuuuacguuauugucucauucugagagcccccccccaaaaaaaaauugauaacaguagagauaugguguugugauguugaaagcuuggcuacugaguuucaaaauauauuggucacuuacauuguauaugugugugugcaugugugcacgcuuguauguucuuauucuuagcauagauuuuuaucaucuucuuguuuuccuguaguuuauuagggacuucuaauauuucaaaaguuuccugucuuguggauccaauuuggcauuuccuucuacccagcacuaaguuucuuuaaggauuauuuagugauuuaaaaguguguuaauuuuucuuucguaaaaacuuagcuuagucaguuucacagucuugcuucugcuuuugcccugauguccucucaaucacuacacacaaucccuaugcacuuuucuguauucagguuugauuuccccaguuuaacacuuaguccauuuugcuauuguucucuguugucagggagggcucuaagugaaagcaguuuugcuuuaaauccauuugcuaguguccccaccaccacaaauuccauaagccuuccuucccucacagcugaaacucugccuuuaucagauaauaagugacuccuuugccucucugcuuuccuccaccgaguggucucuuccuuugccagcacugcauuauuguaguuauuauagcuucuuaauguguuuuaauauuugguguuauaguucaagucuguccacauaaguuuucuuuuuaaaauauuuuuggccccuucuuauuuuuaugcuuccagaugaauuuuuaggaaucauuucaacgagcuccaaaacaaauucuaagugcaaauuuuaagggcuuucauuuuucauuucuuuuuaugcuuuuuugcuguauucucagauuucaggcaugggucuuugcaauccauuuuacuuuuaaaguugauuaaugaaguaauuuuacauuuugagaguuuauuugaaacaaccccugauagaaacaguaaaaacaaccagacuaaugagugggccgcuuaacgaguggaugauuagagaccgagcgaaaaacuucucagucuucuuuacuauuuguuuuucuugcuugaguguagaauugugcugugacugcaguaugcaaaacccagacaauuuaucaccuuaauuuuaaaucauggaagagauuuuauuuuugaauggcagaaauggucaguuuuaaacagccaguucaauuuuuaaaaauggaucuguaauacugcauucugacuaauagagaaauauauaucaguguccauucaguggaauuaagaggcugaguauauuuaauauauucauuuuuaaacauaagaaaaguaauagaacgugucuucuuuugaccaguucaguaaacgucucuacuguagguuaacagccugcagggauauggaguucacacagauagaacaccagguguaguuuacuacaguucuuugggcuuccccugcugacacucuagggugauacagaggcgucacauuaggucuguucuaugguaaauuguacuaguuuucuuuuguaaaccaugucuauuugcaguuuuaaucguuuucacccccugguggaugcugauuuauuguucucgaauucgagacauuucacugucuuagccccuagcagguguagaccagacugcuggcaaugcugggagauaggaagcuugcuuagaguuuugaaggguugucauguaguaaaggagguggcagagagagcguaagcugccugccacgcagcggaggcaggcaggugcuguucguuuccuauagccucacucugugcugggcguaagacuggauggucagggucacugggcugaugugggaaucugaagggcaaauguaauaggaaguuauuaauuugacauguuggaagauccagccuagggaugaggucuaaaacgcaauugaguuggucaacuuggacacaauaugugagaaagaauuggagacuucagcgcucuguacauuuauguagcgcuugagcagugcucggagcuuagaggguuguuggccugagcuauucuccugaggucugcucugacuuccugugcugcccgaucugugcgccugacaccagguacuauucuuaggagaggccugguaaucuucccacccgggcaaaaaucuugccccgguguaguuuccgacagugcugugcuugucuucauccagucccuuuccagggcuuuaacccuucuccugaugugcucuagcuggcaucuuguaggugcaucuuguagcuggcaucuuguaggcgucugguagguagaugugaaguugcggugauaccgacacuguguuugggaggacagccucuaggggagaggcgacaguugcaaucuuaaaaguuuccaaguagaagaggaaggaaauaggagcccggguaguucuuagaccacgauuccauauuagaaacucaaaugacugcuccauuucaguugugagguuuuuuuauuuuuuauuuuuuguccucuuacuauguugcuuuuggguuuugucuuauaugcugaaaguaguuuuaaguguggcuuucugcauuuagaguucugauuuagcuaaguccucuuuguugcuuccuuggcagaucuauauuuacagacgccauguggauggugggaggaggaggcagcguaguaaagucuggcaguguuauaauaugcaggaacaauauucaucucuaaggcggauaagccagguaaugcgcauaaaccauuugcauagauaguaaccugcucacugaacucuggguaagugacuguuaaauuauagggauagaacagaauuuuggcacuuuuuuuuucuuuuuaaaauguggacaauugauuugguauucagagacaaagaaaacuguuuuuaauagugucgguuauuuugacugacuggaaaucugagugucuuagaaauugguuagguccauccauuauugauucgcgaagauguagagaagggccgauuuguccgaggguagcuguuuaguuaguuuaggacuuaauaccuggucuuuugaauaucagcucuccacuccuuucaacugucuuugcuauuaauuaguguucauuugaccaauuuguguuuuuccuuaauuuucaaacugucagcauuuauuuaguuuuuccuucugccuuuauauuugagauggcacuacaauaucauuuaaaacgaugaagaauuuucauuaaucccaggcaugucauguuuaagucauguuaucaguuguuauagaucgcucugaaaacuucauucauuuagacauuacugguaugucuuaaauuuuauacaacugggaccugaauggagcggacagaaaccccuucacccugcaagcuuugcugcuuucaugcuccaugagcuuucuuuaacagacacggugaucuacuuagcaguuuucagaagcuagccauuauuuucauuaguaauucuuuacuuuggaguuagcucucccucccauuucuccuucucauuuaaaaccuuuaguccaccguagcaccucugggcguccagcuuuguuugcuguugcucugugaaguaagcaggguccccaugaugacaguggaauucaguggugugcacucggaucaucucaugcaggugauuuacuguucuggguaauccuuaugguggaacaaaugggucuuagaccauauuuguucuagaauauucuuguauacuaguuacuaaugcuuuuuguuuauucauucagaauugaguguuuacuguaggaugguucuguauaucuagcggugaguacagcaugcaggguaccucauccgauggcugcacuucacauuccaacucuguuggaaacacuucaugucucaguuuuuagacuuacuacugcuuuugugggaccauguucuugggaguuuacaauauuguacauuaaagucuuugaccuaauuauauacacuuuuguguuauggcuguggcauuacuuuugauugcaguuuuggcucaagacuuguuuuuccuaugacaugugaaaccuuugaaaauggaguguaucugagucaccuucuaguuuuacuuaaaauuaguuuaaagcaaggaucuuuguuuaaaaggcaaaucagaagaaauucauuuccaauaagagagaauaccagcaacgugaacugauugugaguugcauggaccuagaauauuaaucauuuuuugcuuucuuauuuacaucacuggcagagauaacccuuuuucuaauuuuagacuauuuuagagauuacacugaaaaacuaugauuuuaauguuuaaauaaagaucggcucauuaaauuaaugaaacccaauaaauaaaagaggcaugacuuuaaaaauccaauguaguuuuucaaaaauguguguaugcuaauauggagguuugaauaagaauggcccucauaggcucuuauauaugaaugcuuagucaacagggagugacacugugcugaguaggugugucacucaaggugggcuuugaguuucagaagccagggccaggcccaggcugcucuucuguucugucucucugcucaggacguagcucucaucuacuguucuaguaccaugcucccugucaugaugaugauggaccaagccucugagauuguaugagcccccaauucaauacuugcuuucauaagcguugcuuuaauuguggugucuccucacagcaauacaacagugacugagacuuaaugacagauguacagucuuaauaagucuacgucugcuuuuggaaucccuuuuuuauuuucaucuuuaagcagugccauuuuguuguguauuguuuuagcuuucaugggguauugagauuucacauuuuuuuaaugaaguuaaugaagauucuaguguaguccucauuaugaguuaagcuugaugaguucuacuuugaccuugcuuugaugguuuguucagaaaaaucaccacccuucuccauguaaggcagucacuuaugaucauguuuucuuacugaaguuuuucugccaugugcauuuuccuaggauguuaguauucuaauauacaugaaaagcauagccuguugcauuuauauuuauuaacccaguuaaaguauuaaaggucuuuaaggucuugguguucuuuacuuuuuaaaaaauuuuuauuuuauuuauuuauuuuuuguuuuguuuuuucgagacaggguuucucuguguaucgcugguuguccuggaacucacucuguagaccaggcuggccuugaacucagaaauccgccugucucugccuaccaagcacugggauuaaaggcgugugccaccacugcccggccaugguguauaaucugaguggcguuuuaguuucaggugauuguaguuauugaagugcacuguuuuuacauaugauggccauuccuuuuggguucauuuucuguccuuguguuauauguugagguauuucuuuugugcacagauuauccaaagauuguaacuaggguugugaagcuucauguuuguaaugugagaaaacauggagauauauaucuuuaaaagaaaacugagacauuucauaaguguaaauaaaucagugaaauagacuuuauuuaaaaacgcaguuguucacuguagguuaauuuaucuguauuaacccuaaacuacugaguguuaucacauuaucuaccuaauauaaugauuaauucuuuaauauuagcuucuuugaucauaaacucagauuuugugaguuuuuuuaaauugaaaauguguuuguuuguuuuuuuuaaauuguacacugugccuaccacucuucuuuguuugcaacuauaguuguccuuuuaaaaguauuuucuucuuuucuuauauaauuucuuuagcauguucuguuuuccuguaacuuaucacauuuguuuuaagucuuuuuucuuauuuaaguaauuguuauucgucuagccacccacauucaauauauuuugcugaguucccguguucugcaggcaugaggcuaggugauaucuaagaggcaggggcauggggauucuugugugcuuauguugcugauacaguacggauguguuuuaugugucuuguggucguugauuauugcaugaggcaauuuuugccuuucuuacuuuauagauauguacuuagguacagagacauuaaagauuuacacagaaaacauggguuuuaagucgccuggguagaauuugaauucacaaucucuaauuuguacaauccuggcuugguaugugggaggcaggugcacaccauuaaguauauuucugucuucauggagugugaaacauaguguacucuaagcucugccucaucacaaggcaucuguggcugcucgagagggugagguuuuuauuacauuaucaacucuuuuuccucgccagucagcuccuuuaaaaggcuuucuccgaauacaguaggagacaaguggauucugcagcuucaguucuggacucaccaacuaguaauuaaacacacguguguaaguagggucuuccccacagguggacgcagaauggccggcgauugagaacauaaguauguaaagaaagguuacugauguucucccgcgguaagacagaggaggcugagaggguuuucagcugcgaggaggaaucuuaugaaaauaauaccauuugaucuuucuuuagauagguacuguuuaaaccuucagaaaccuaggggagggugacagcacaaggaaggagcaccacaagugaaggagagcacuaggagugagcuucagguagcuugaauguagcugaaggaaaugcgcuuguagaaaauacugucagacugguggucaguauuggaauguggcaaacugaauggaugacuagggaauuuaaucuuuugucugggcauaggaaaccuuucuaagguguuugccaagugacagguuugaugugcauugaccuugacugaggagaauauguaaguagcaccauggaaguuggauuggcugggggagagacaguggcaccaggaaugaaggagaguaacaaaucagucagacauugcacagguuagcuuguuaggucuuagaggcucaugggaauagugaacuaguguugcagaguauuugauuacacugugagccccaagauuguguuauuuacugaaaaaaacuguuucuaguuaugguguggcucagccuuagcacacccaccuuuaaucucucuggcuggaauucagacaggcccuuuaguacacaccuuuaaucccaaacagcaaagguaauguuaguuuguagaaggaagcacccuucuugaaagugaugacugaguggcagacaaggucagagaaaggugugacagaauaggaagugcccaacucuccugugcuaaaaagaaggaggcaguuuuaccuggagaguuuuacagagacaguuuggagagagaacaaacuugauacagauaaagacaaaacaaacaagagaauucgaaguagcuagaagauuagaacagauggcuggagucaguucgaggucaagcugagcaauucaggauaagccagcaugagucagucagcguggagagggguuuugagccagaacagcugaguugaucagcuagccagaguucagaaagcaaaagagaaggugagcuugcauaagcugaauagcaguaagucuuagaggcugagaacauucuaggccuagaauagauuacucagagccuagaagcuucuaggacuaggccuagguuagcagagggaggcaguaagccaccuagaugacaauuaacucagcagaauaaaagauacuuuuacaaacuaguuaaaggagaaagcccaaggucuuuaucuuagagcaguguucuuaaucucccuaauguagugacccuuuaauacaguucugcaugaugcggugacucccaaacaaauuuauuuuuuguugcugccucauaacuguaauuuugcuacuguuaugaacuuuaaauaucucuguuuucuguuggucuuaggugacccccugugaaaggggucucaacccauagguugagaaccaguguucuagcccaaugagaagcuaaugguauuagauugagcaaugaguuuuaucauuuguaucuuaauuccaaaaaagauuugaggcaucugucagggcuguuuacagcaagauuauaacacaauaggauagggcagggaaggaaaucaaagugaaguccuaaaguaguagccaggccugcagcgcuggugagggacuuuaaauaugcauuucuguucuuccuuccaacagcagcaggaaagcacagcacugugcacugccucagcacaacagaccuaguccaugaacuauggguuggguguuaggauugucccauguuuuggaggugaggccugagaacauuccuuccauggaaaccuaugggacccuguuauguacucagcaaccagugucauuaacuauaugucuacaguaaauauaagauccacauauuugguugaaucaguaagaucucugacuuugaacuggggaaauagcacuauuaaguagaaacauuuauuuuuaaagguguugguggcaagucugaucauaaaauuggugcuuucaaauugugcucaguggagcuauaggaauuucaucaccaacauggagaaguccuuuccuucauucucucggcagcgagagcugcuucuccgugucuguuugagaugcuacgugcaucuuaaaauuugcuguuugaacagacucauaaggaaauguuugaaacuacugauuccuaaagugaaaaaggguuuuagacuucuaugaauguauuuuuauaauugauuauuucuaguuuuaugaguaaugucuaaaguaaaugauguuaaaucaaaaauauauaugauuggcuauguauaauguuuacuuauuuuuugugauaagggacaugacaaaauguuccacugagcuugaaaaaugaauacaguaacauucaaaugauuuuuaaugagcaaaauuucauaaaguugagccucuaaaacuguuggccucuaaccaauuuuacaguuuugugcuuugguaaaaaguuugaccauucauagccuacccugccuuuuaaagauaccaggcguguucuuuuauauauagucucaugaauguacauuuggauuuucuuguaguacuugauuauauuuacaucuaauacucuuugagaaugucugauaguuuugacagcuugugucaccuuuuuaccuuaaaauguccgugggguacagcacagguaaauggguaguuucucugucuccuguucucagaagcaucuuuauauguaauucuuuugucagacuuaucagguuuguugaguucugacucagggcuuccgggagaggugucuaagccuguaaggauaaagcuugaguagagaauaggacauggugagagcugagcuauccuguuacagccucauguguagggagguuuaagguuucagaucuucuguuuggcucacugucucccuguuggcucuccaugugggcucaugccauugcuuauuucugaagugcuccuauuuucucuuuccagguauucuuuuuugucuuaggcucaccuuacagagucaguauuuucuuuuucuuucuuucuuuuucuccuugagccuuucuagucaaaaacaaguacugguuuagauacaguuucugugcccaaaguacuaacuugcuuaauacuuaauuaauuaacucuuaauucucagugauuguuaaaugugugguaaacauccccuuccuuguagucucuuacaaggcauugaccagaacgucauaaaauuacuaaccaccugauugcuuacacagcucuaccagaugccauucaaagggaaggcucuagaucugagcucucuguugaaaguuuaggaucuagggcacaggacauauuguagucacaagacauauauggggaaaaaaaaguucauacaggugugaaugaacagcagaacauauuugcaauuaaggacagauccaaauuaaagauguaagcacagguaagguaagugcaggcugacuagaaaaugcuggggaaagcaguugaagcagcccucccuccacugcugaucauggcagcagcucuguacugcacaucacugugcaugccaggaaacagaacuugauuuccucuuuggcuugacaguauccuaccuacauuaacauuuuucuucaaucaguaaccaugcaagggaagagggggaaaacaggcaaucacggucaaacacuauuuuaccaguaagaaagugcuauaaaacaucagaagaggacuagaugcaaaagucuacccauccgcuugagaucucugcuggugaguuuggagugaggauuggaagugauuugugagcaucucaaacaugcuaggagcaacaugauuuuacccaacagcagcaguuucaccaacuuagucugggucgcaaccacuggacacugcuucagggauacuguguagaugcaaugcuaugaacuuagaggcaaugugagcagagggagggaaggggaagauuggauguaugugcucaucugcacagaguggaaagacauacaugagcaagaaugucaugauuauagucacaguugcaaaauaaaagcaaaaaccuucaaggcaucuggaaaaccuaucugaugagaaauuguugauagcaugaggacuagcuaguagcugauaucauuaugcagugucaugauuugcaggaugccucaaguaacaaggagacagaacuuuucaggagaucauugugcaagugcuuggucauuguggguaaacucagcaguaagggacauaaguugcucucugcaugugaaaguuguguuuggaaguaaaauuagguucaccuuuucuccuugggcucuugagucccugagaaugagggauuaguagaaagcuacuggaugcucugcuuaguuugagaagugggcagcuggacccuugccuuacuuaguguugucuggagcaggccuaacaaacugagacuuccugccacucuuacucaggcacaggcccuucuuuaaaggagagucucagagucuacacugaacaagcuuuccaggccugcugaugcuguugcugaugcuguugcugaugcugaugcugaugcugaucugauggugaugcugcaguacucgugugcucacuguggggaaacugugaacagucaagugugcugcaguaaaccaaaggauuagaaagcugauuauacuuacuaacucuaugaguucugucagauaggauauaaguaagcacuuuacuuuuuauuuaguugucaugggaaacuuugggguaggugcuguuuauagaugagggaaucagacacuguguccuugcuuaagguuaugugaguauaauggaaauucagauacuaauuuaaguucucgcuggucugucagggccuuguuuuuuucuucugagaauaugauuuauuuuggagagcuuugcucuauuucuuacaacuugaaugugggaaaaugaagguuuuauacugacucaggaaagugaacuugucaaauacuagagucaacugcuaacuaaauuguaauacuguaguauauguuccugucuuuuagguguaugcguagcuuuuguuacuaguuuguauuccuugaguaugcauaaaaacauacuuauaauuuaaagagcugagauuguggcauccuguaauauagcauccuguuuucucauaaacauagcuugagcaaucuguccaccucuugccaucuccucauaaucauuaguacauucaggaauuaugccuggacuauagucccauuucuccccucucuuaguccuccuguugccaaauuuuucugcuaguuuauuugggauauuuucaauuuaaccuuuugguuuuuuggaugcugggaucaguccagggccuaucuauccaugcuaggcaaacacucagucacugagguauauacaucucuagugccuagucauuuacacacacacacacacacacacacacacacacacacacacaauuagugcugagacauuuugcauuuuaaaguuuacccucuguuucuuuaacuguuuuggcuacauacagaaauuuuugucucugucauuuuuguggcuccugauaauguaagugggaauacuguggggauuaaauuaaaugcagugaauugccuuacccaaaccaaucuccuuuucuuucccaugguaucuuuuucuaacuucuuauauccauugauaggcaggacagcagaaucggaaccucaguacuagugcaacuacagaagaacuuucucuauuauuucaaaauuaguuuuauauguauacuguuguuuacccauuccguugaucucuagugccuuggguuguacacucuagggaaggcaucaugacaaaccaagcucuaacuuuuuuuccccuggauguuucuaauuaaaacuaauauguaaaauuauuuucuuuucuaaaaugguguuccuaugauuuacauuugucuacauauuuauguuagcaggugaaccuucuuuagacguuuaaaguugcuagccugguuauuauuccauggcaaguaaaaugugggugcaggaaugcuguuagacuuuugagaucucagauagcuuucucagucaguucucaugucucugaaaaugugaacuguuuaaccccuauggccaucuuggcaggguguuccccaccuccccacuguuggaaggccaaguguuugaccguuaucauuuuaggugguaaauuaagauaguugcaaauuauugguguuauaaaagcugaguuuuugauuccuaaaugauauuauuaaucauguggagaguuaccauggacauugcaaaagacuacugauuauaaugacuaagaauuaucaaguuucuugaaauucauuuucugaucaaacuuagacaaccuuuucccuugauagccuuugaccuuuucuuaguugcuucaguucccuaaugauuuuuauguaaagugauggacuagaauagauggagacacagagauuacuaggauugugcuucugagaaccaguaacuuuacagaagaaauuaaggaucaagaaaugacuucaugaaggccaguguaauacuguaaagugaauguccagaguauaaaggcuuugccuagcuugucagcuagucaguuguguggucaggcuuuaugacuucauucuuuccccuuaucugaggaauuagggaaccccucauagaagggaguugugagaauucaacagcaguguuuucaaaggauuagcacagcaccuggcccaggaaaucucaagcccagaaagcuaauagagaaacagacucaaccaaggacagguaacaaauaaaucaugcaguuucagcugacacguucaugcacuccauuagaaucacaggcagcaggagacacuugggguguuuucccaguguuaauuuaaaauaaaacuauuugggguauagauugauauguacuuaaaaacguauuggagaaauaaauaaugacuguuugguuuauucaucuuacaaaguugucucugucuuuauuuucccuuuaguauuacuuauggucacagcucuagaccaaagagaagaaaggaaguguaauguuuuauuaaaaacaaacugcaauuuuuuuggaaacagcuugccgugaauguuuugcauguuuaucuuggcuuuuguuuauuucugacauaaauucaguagccaauggcucucauugauuuaccuaggggugugcgucuguuuacaaaaggcaccuaaggcuggcccugucucacccuuccucucccauggucuaugccucaggcagagcugaggaucaaccagauauggugcuuggaccaggacagcguguggcucugggaacauuuaauggagcacauucuggaauuguuuuuuaaaagucugaugaccaaguaguaaaggcaguuuguuuacuuugcaugauucuuagaguaaauaacuugaaagcaaacuugugagcuauuugugcuuucucagaauaacaauugguuagagucuaaacugauuacauuuccuuauugcucuuuucucaagaaaaucccauuuauaaaucaaauauaaagcacacccgaagguuauacauauucuuacuuuaccuuuucacucuccuauuggucuuuuccuguguuguaccuguguuaccuggcuaagcacguguuucaggcagugaucuguaaugagaggcccuuggagugacacgaggcccugggugaagugcuccucccgaguacccagggagcaucaggaaagcccuuguuuugaggguuguagaggagugaguccuuucugaaaauuucacccuugccaccucccaugucucacagggcucccagcccuacuucagagagguaggcugcgugcaaaugauuuugauuuucauuuagcauagucucauacaugcuaggaugcuuuauguaaaaaauugaugagaagaugaaaauaauguaguugaauuccagcuauauuaccugggauucaagcuaaguuugaaaaagcgaauagcauugccuuuauucuugcuaacucaguagcugccagaauuucagaaaacccaggucggcagaaucuugccugcuaccaaaauaugcugcuguuuuaccuagugucagcuaccugcagccugugcugguagcuagcacucacgaccucauuggagacgcagcccugucagucagcucccauuucaaauacaucgauauugagguggaaaacagugucucugccuuuauuauguuguuauuuagaguucuuugaguguguuuauaugagagagagagcgagagcgagcgagcgagcgagagagagcgagagagagagagagagggagagagagaggcggucugcuacaucuggaaaugcucaaaacuuguuugcauuuugaagagaacaguaugcggugaaaguagaacuuuuugaggagugagguucaaguuaacuaaugauggagcauaaugugaggaagcauaauauugugaauuauuauuuggcaaaugcaccuaguguaggcauuagcugccgcagccguuuauaaaguaccaugugcaggaagcgagagagauagacuccacagaacuugcucuguacaugcccaaaguguaacuagaguauaacuuuuagcuauucaguggggacuaugcccuguaaguuuuaguuugauauguuugucguuuucaugguggaugcgcaucagagugucaaaagagccuuuagaauuuguuaaaaauuugucaaucauugucaaguuuggaguuguaguucuuaaaguuagaauuuacuuaaauguaccuuuucuacucugaaauaaauuuuuauuucuaauacaaucgugccaaaguaaguuuccccaaguagaauuauucuguauuuagguccacugauaauguuuaaaauaaaaauaaacuccuaacaaccaaggguggagggcugucuagauuuguuccuagcuuucuuuuucauggcuuuucagaaguguaucauauuauaaauacauucaaaauguuuugcucugaggagauguagcauuccuguaaagguuaaaucaauaaaaaugauuuggccacauuccuuagccuggcuggaacagguaacccguuguuuugggcacccuugagcuccuggagcggauggcucugguguagcuaggagcccacugaacuugccugcuuguguagaagcaucagcuuuaaagaccaggguuuccuugccuucuagaaacgggugcuuuuagagcaggccgcaauggugacucaguuaugaauucuaaauguaguuaggauuuuggagccucaagugcugaagagacacuguaaucaauaaggaagaggaauggcaggaaaaggugcaauggucaagccuuuuacaggauuuggaaaugugguagcugugugauuaaagaaauuaucacauauuaagaugaugaauuuagauguuagacacuucuuuuagucuuaccaguuuagaagaaaauucuguauucauaggguuauuguacucaaauuaaagcuugcuuuuaaaaacugcucaaguaaacgucuguuuuaaaaguguauguauauuucuuauguucagaguggcuuuauauuucuuuuuaaguaguuauauguuccaguuuguauuuuuauuguuuauuuuugauguuuugaauaugaguccucagaucacauuauuuuuauaacuacuuuuuaaaaguuaucuuuuaacuuauaauaaugaauaaggguacuauuuucccucaauguuuucuuuaaaggaagcagcauggaugguaauuaaguauuuuuuauuaaaaauuaaugaucauguaucugcauaaaaguaaauaaauagaaagauuauacuagagaaaaucucuuccuaucuuuuuuuuuuuuuuacauguaauauacuuacuuuguaaauaaauaaauacuugggacaaaauuuugugcuacguuguuuguggguauacacaauuuaauuuuauagccacaaaaauggguuggauucaucucaauaagaaauuuauuaccucugagagauuuaauaaguaauuuggcaauuuaaaacaauauuuugcucuauuugaaauuacuuaaguuuugaaagaaaaugcguauggaaauaaaaauaagacuugaaguuaguggaugcuuuaaaacuuccuagguauuugugauugauaauuaaaauacaucuccgcgugcuucuuuuccaacugcuuaagugcucggcucuucuguaaugugcauuuguaugccauaaaagacuuguauugcaucaagagucaaggucagucaagagucuucucauauauaucuacuuuagauaauaaaguuuuuaaaaugagguggauaugaguaguaaaaguuuuuaaaaauaaauuuucuuccuaaaugauagagacagacagugauauaaagcuggugugcauauguauauguaucuaguuacacuaagugugagauuguagagaauucuguuugaauccuggagaucaugagaguaugaagaaguaguuucuguuguggauuaaucaucgaaaauugaauacacggaauuuccuauuuauauugcuuuacuaaugcacugcaauacaguuucuuuuuaaaaaguauuaucugccugauuguuucuuuaaauagcauguguauguaugaaauuaauuuugaaagagcaguagcaaaacuuuaaugauuuuuuuuucaaaagccgaaucacauaaaagacuuacaaauuucaugacagugaaccauaaauuucacuagcuuaucuuuuguaaccaguugucuacuguuaaggcacaaguguucaguggaggcuucucuuagucuuuuccuaacccucugaguguucagggccuuacccauggguacuuacaucuauuuuacucucuuuuuuucuugugcuggggaaggaucccaggacuuggagcauguggccagggcucuagcccuaacccugauauacauuuauaguuugguucaagguucauagaaagcugauuuacauaauguauauuguuacccuaaaggagauuuuuuucuguguuauaggucuaguauguuagaagucuaggaaacaaaguaagaguuguuucuccaaaaacaaaucaaaacaaaacaacaccaaacaaacaaaacaacaguacccuuuaaaaacuguaccuacauaaaacaucuugcaagagagucuauaccuuuuccccuuuugauacuuuuuucuagcagcuaguuacagugguagagcagagguugaaccauuaacuguauaaugugcuuuauuauauaauaugugauauauaauauguaauuaugauauauaauguauaguaggauugaugucauaaccuguuuucugcuucaaaguacauucaggcuacuuauauuuauugaaauaauucuaaauuaugugguagaaacaauaucauuaaguauuuguuaaaaauaucacuuuuuacuugguaauucagucuuaaguugagaaguucaguacagaaauuuaaaaagaaaaauugcaguuauuauuaaaaaaacagcaaaaaugaaaaauauagugucuuccuuaccuagguuagaugggcagagaggagauguauagaagauguguauguuuagggacagcuaagguggcuauaaaucgggaucucuuagugcauugauaaaguucaaauuugcuaguguaaacuggaaugucuuguuuuacugaguggugucagugacuauuuggauuuauaauuggaaaauaaggucuuuggauuuuauaaauauaauauuuauuauuuuaguagcaugguuccucauggaugccuagucucuauuuugauuuuacagauugacauuuuacugcaauauuguaaguauagaaaaauaauucuuuuccaagagauucuaacaguuccuuauuuauauaauuuauaguuguuguucuugauuuauaaucauuauuccaaacuucauagucacuagugcauaugcauacguguguaccauguauaaaaauuuuaaaucagacugauacccaaaaaggaauuaaaguucaauauauguggcagguauuuaguuucaguauaaaaaugucaauaucuauauuaaagguuguagaauaccacaacacuauuauuguaauuuuuacaaagaaagaucauguauauauauguuuuuaaaacuuuauugguaauuguuauuugguuuuggcuaguauuuuuuucuuucuuucuuuuuugcuuuuauugagccacaaaauaaauuuagucgugagauagcugaccauaagaaauacauaaauaauguuuuggcacacucaagucucauguaguuuuaaggggaccuauaaauguguauuuaaguuuugggaguuuuaacucaaucuuuuauguagauauauguuuauaguugguuauauaaugauccaacagacauucuucauggagaaaaguuaauguuacugaaaaguaagcaugauaaaauuaauuuauuugacuuugcagucaaaauuaauuguauugacuagaauguuuaggucuaccuuauuaagaauguuacuagcguaaugucacucugauguguaguuucugaggagaaauggcaguaggaucaguagcagucacaaagucuuuagaguaguucucaaaaauuaaguacagcuugacacgaauacugacuugguaaauuuucuaacaucuaugcaauaauuuuuaacacccuuaaacauuccagaaaauuguguuuaugucuguaugucaauaaauucuuucuucuaaacaauagacuuaaaggaaaaaauuuaaacaagguacauaacauuuauuauuuucaucaguagucuucacauuuuguauguuuuuuguuccuuggauguauauuagauucaaaaauuacuaucauuuuaaauguguuuuugagggcugaacugugggcauguacacgugggggaaacacucugcuccugagcuccacuccucaccucuagaugcuggguuuuugaguauuaauaacaauuuggaaugcuuauaggaagagaaugacuaacacauuuaacacauuuuucuuucuauagaaauauuaaguacuuccauaacaagcagcgguuaaaggagucugagcucuauaguucaucucauuuggagagauuacaauacuauuucuuaaaggaagaaaacaugcuuaugaaaaaauaggcuuuagaauuaacuccuguuuuagaauagcaggagcuugaaauguuuuauaggguguuucuuacauccauucaacaguguugcaaaccuugaauccuaugaccuuaauaguacuauauggggaggaaauuccucagaauuccauguaagcugaagauguuguaaguaguauaauaaaggaacauuucauuuagguugcuauagaagucuuaaaaaguuauacggucuguuuuauuuguguuuucuguugaaugaacaaaaguuugugguuaacuguggcuaaaauuguauggaaacucccuuugaauaagguauaguguuuccucauuuuauuuggauuguaacacauuaaucagaauacauauccagugaauacuuuugucguuuugaaaugacaagagguuuuguuaagguguauauuguauagaaaaccuuauaaagauccauuuaaaaccauugaacauuuuaaacacuugagguuaucagaauauuuuacugauauuuacuuagaaaauaucaaguauuggagauuacuguuaucuuuaauauaggugcuuagugccaguuuuauuuuuaacuauguuaaaucuugaguuagaguuauacaacuuuguuucauugguguuggagaggaaaaaaaaaauaauucauuuagguaaccuguuaggaagucucugccuaaacuagcauuggguuggccaguguacauuaaaugacaggucugaccagcugugaaaaauagucaugcauuguccgaauuacgguuuuagcuucugccacacgauuucuuucaccuugaaucgauggcauuuauuuggccacaucuguaauauuuuuggaaggacgcugcagagguuuaccguuucagugaaccauuuauccaaacaugucuccaaaggcuugccugauagcgucugcagucugagugcucaggaaggacuugcacagcucuucugcccuagccuggcuacauacuagugucuaauagcacacgucccaagacucauugacggggcugggcuaugguaggggguaaguguggagacgacuuugagaugugcccuuuuucugccgucagucuccaaguggcguggggcuucauuaaucauuggaaauguagaaauaaagaagccugucccauuggaguuuugauaugaauacuuaccuuuucuuuuuuaauauauaaauacaguugagguauuuggguaaccccugaccuuuugcuuuaacaaggaagcacaguauaaaaauauuaccacaguuugcaugcaaacagcuccugagagguagggauaaagcucucuagauguuuuuuuuuuuaaaguugugauacagaaugucuuaacucugccccauauaguacuucaggaccaccaguguguaaaauugaaagcacaugaguucugaagcacuagagaaggguuguaauugauuagagcugcuugaaaguauugaaguacagugagauuugauuugugaaugguucuauucaauaaagauuaauucugcguuccugauaacaucuuaguccccuccaugagucagccccaccccacagucuucccuuaauaagcuggaacauuucuaccuuacagaauuggacuuaacacugcugacugaaacaagucugaccaucagugauuauuagcuugaaggguguaauugaauaaauuauuuuuguuuuacuaaaagaacuaaaauauacuauaauguaauuguguauauuucaugccuuucuugugccuagaaacuaucaggaagcucacucagacuuaacagaucuucuucuguaauuucauuuacauuucaaaacaucuuuaugauuuaaaagugaaaucuguauuaauuuuguaaaguagaaucauuuauuugaauggaagguagucucuuugggcaguacguggcaguuuuagcuuuuaauaaauauuagaguagccuucaaugcuugcucuuuuuaauucuuuucucuggguuauugaacuuagucucuguuaucugggaaacaaguugcaaagcuuggucacucgggaaucuugaaauuacagaaugauuguuguugauagagaccacaacuauuguuuuggaaaugacuguuuacacauucugcuucaucagagaccuccgucugcuauaaggagcugauguggaaaugugaccagucagcuuaugugauuucacaaacgaguccuuaaugcuaagauacuuguugagucaaucuucuguuucaaaaggauugauucauauuaaguaaugguuuugaguagcacagauugaaagucuugauuaaaguagcagagaucaaggacacuggaacucucuuuucaucucuccacuugcucucuugcauuccuccaucccucccuccuucccucccucccagugguugaggugagauauucaguaagcacaugcuuugucccuuaccuaaacuuucuuuaaccauuuugcaaaauuggcacauguacuuaggacauugcacuaggugguugugcugagcacuguaagaagguaaccuugaagggagguuuuagccucacaaacauuauggaacagggaaacaugcgacgugaugauaaccuggaacaauuguccacuccucaccuguaauuagucugguguagggggcucaugguaaguucucuagccacuccuaagguacuguuuggaggagggggaggcagggaaggugagacucacuuccagaagagaaagccugguuagaaugugaaaaaauacugcaugcuauagaagauggccuugauuuaucucugaaguuugagcagaucuuggaaacauuaauauucaauagucauuaagagugccauagaacuuuaagacccaccccuacuccuauauaauagaacuaggacauuucaacacguucuuugacaauucugccuccaggucugaaauguuuaacugcucacugcggccuccccaaguauuaccuccauggaacaauagccuuaauguagccuaauguucuugucucucagugacuacuaauaaauauucuccuaugugagcuguuuguauaaugugggcuauccugggauauagugcagucuaaccauaguuauuuccugcuuccugaaggcagagcuuucaaaagcaauacuuauacccacuauugaaauuaugauuuuaucuaugauuauuacauugcauauauuguaacugagaugaccuacuuuuggcuacugugggagucauuguagcaauuucacuuauuuuaaaaauaaaaaccugaaguauauuucuuuacccuuuaagagaccccccacuuccccuuuuuagguuaaauuauuucucuuugacuugagcuaagacaagcccuguuuuaggagccaguugagaugugugaaggaggaggaggaguaaugggaacuccaaucacuaguuugaaaauucugcagcuaaggauuuauuuaaaagcuaaaaagacagucuuuacaaucugcuguguagcugggacauguuggguagcauacagagaaucauguaaguggacauuuuacuacacucccgugacaguugaugaggauugaagccauuuacauaucuguauuagcacuugcugaaaauucaguauuaagggacugcauuauguuuguuuuguuuuaaaaguccagcaugauuuugucggcaugguucuuaaauccuucaggguauccuugugaaguuuauuuuucgugagacuaaaaacgguauucauuugguagguuuaagaaugugcucaaaggaaucuuagagguuucaguguuugcuguguguuuguaacaaguucuaugugggagcaauagucuacagauauaaaauuaaauuuaaaauuauuagaaaaguucaguuucauguacauucauugucccaagcacuggagaucuuuacagaacagcucugaugucuugaaaaugcuucuauucuaguugaaugucugauuuagucacagaaaauuguuuagaaacaggcuaauagagauaucugaagacauaguuucaagcgguagagagaauucuuucaguggagcggcagcugagaaugcuaacucgccuccagguuuacuccugugucauacaugguagaccacaauguuucaauaauucuguggucugcuauuuuguaaaauugcuuccuuuuggaaauuuguuucaauauugggagcugccgagucaauaacuuaacaauacuuugauuaauucagcauccagcuuuauucuagggaaguucaugggacuauuaagcucuuacuguuuuuaacauccuuguuucuguuacacuggaaaacaauuugauuaacaugagcucauuuaauuuugucgauuucaagccauuaccccgagaguuaguuacacaugccaagugcaaauauuuacagcaauuucauuuuucaauuucuagugagagaaaauagcaucaucaugaucuuuaacaugcugcgcugugaccuaggaaagcucacagccgggcuaagccuuguaccuucaugcuuaacagguucacagagaaaaagacuugaaauaagguagcacuuaccccaaaagaagcuuugcugacacggugucacugcgcugaagaggcuguuugacgccauagucccuccuuuuuuuuccagauagaacuugugcccucuguuguaaauacugcuugcagccuuaaacugaaaauacaaaccauacccagucccuguuuuaguuguacaguaugccuggaguacauagacuuuauauuuauuuuuuucugucaagaaauuauguagcugguaacaugugaaaagcaaggaaacaaaacaaaacggagugagcaaauauuugaaggaccuacuauuccugcauggacugugguuagagcacucacugacucgguuggucucgguggcugguagugaccugcagagauuaaccauuuaaacgccagagccuucuugcagucuuccuggagaaaguuugcaccgcacuugugguucugugguuguuugugaggcgaaugaagcau

SEQ ID NO: 12238 - RNA, 15385 nt, Mus musculus
uuugagaucagaauucaauucuuuaauacaaaaugcuuuuuuuuuuaagauauaucuguauuucuuuguugcuguuuaaaaauaaauauguacuacggaauaucucggaaaacugcucuagagacaaagacgugauguuaauaucuuuuucccccacaauuauuacggauaaacaguagcaccaauaaauaaaugauaacaaauauuaaaauuaaaaaaggagagagauuuaguauguagaauucucuauuuuucuuguuuuguuuuuacauauaaaaaacagaauagcaaugucuauuuuaucagaaucacauauauacauaaacauauauauauauauauauauuuauauacaaacacaaguugccaaauauauauauaguauguaaauguauauugaaaccuuauuucaaaggaaugugugguggggacaagggagggcagagcugaguguuagcaaaauuaaauaucuucucaggacaagcuagugacugucaccgaucugggagagagagauuggaaacacagauuucauacacacacacacacacacacacacacacacacacacacacacacaaguacaaauaagagagagcgagagauacaucucauaaauaguugaaauuaaauauuaaccaagaauacugaaaaaaacccuacucuuuaauuaaauuaacuguuuuaauuucuaauuaaaaagggcuauuaaauaaguaccguauauaaaacacuuucucuuuucucugccuccgugaggggcuugcggguccugccccauugcucugugccuugggaagggaagaugaggaaggguaagccacucacacacacagccaagucuccuggggacagaauuagugguuucaauggucugaucacacaagguccuccugggcuguacccaggaggugggguaaggagaggacgaaggggucccaggaggaggggccauuaccaggccucuucuuccaccaccgugucuucucuugccgggacaccugugggaggccuccuaggccccucagaaguggaggagcgagcugaaggcuggccaggcucccgauucuuccaggcagugcccagaggggcggggugcuuuuguagacuaucauggggauccacaaagcaugccauguccugaggcuccccaaacuucugguuggaaccggcaucuuuaucucuuucucugucaucaucugucucucuguccucuugacucagggccaggaauggguuugucguguuucuggaagugagccaaugugcccccgugcccuggccuugcuugcuccccggcaggcaaaaggacuucggccucucucagaccacacugaagccuuucaucccauugucucccgugucggcauccgagugaggacauccuccucccaacacaaguccacagcagucaaacauauccagugaagacaccaauaacauuagcagaguuaauuuaaaaaaaagaauauauauauauuuuauauauaaaacauauauauuuauuuauauauauaauauauauauauguguguaugugggugggugugucuacaggaaucccagaaacaacccuaaucuuccgggcuuggcgauuuagcagcagauauaagaaaauggcgaauccagucccacgagggaccgugcuuggucaccugcccgggaaugcgucugccggagucucgcccuccggacccaaagugcuccucgaagagucuccucuuccuucaugucaggcuuucuggauuaaggacuguucugucaacggugacgaugauggcgugguggugacaugguuaaucggucuuuccggugagaggucugguucccgaaacccugagggaggcuccuuccugcagccuggcucaccgccuuggcuugucacaucuaugggaaauggcaaagagaggcaggggguuagggccacgggagccuggcagugaaggcaagcagccuccccaggccugggagcccacggguccccggagguuggcaccaugggagcagaguucccaaaggugcgggugagacagagucccgguggagagagagagagaccaagcccugccuucuaaagauggcaaaccauggaagacaagacagacaugggaauaaaugcucacaaaagcaacaaaggagugguuaccaaaggacagcccccaugugacacuccacggcacgugggugacagggugagauguacuuagcugggagagaagcucugcaggaggaucuucaguccuggcucuagggcuagguuucggggcuggaaaacuaccuugagcuaagccagugacagaggacugccugcuuuggggauguguucugcccaagggaggacucgggaguuccugaaaaguaggagaacaucuaugcuaccuagaccucucucauccucagcuucuaccuugaacugcccgguggcuacaccugccuuuuaccacacgaugaugucugacuuaggcagaggacagacaacccaguggcuuuguuccuccuguugaagcagaaggaaucuccaaagauguucuccucuugcuccugacccuggcugguggcccugaggacaggcuggaaacacggguccuaaccucgucuuggguucccagacacagggcaguagcggacugagucgggucucuggaagucaggugacuucauuuagcucccagcucacuccagaaacccuacaauaccaaggucuuuaucuuccuuaaaacccuccagugaacugagccccuucacccagcccuguuguugggaagagucccuacacagcacuaacagauacauuguucucauacagccucucagaaacaacuucauaccaaggaccacagagagagagagacccgccaggccucuggugucuuuugaacccacaggacacaagaaugcaggcggggaacaaggcccaugccagagaacccuugcacugccuggaaggaaggcuggcccuuuguuggccagcccguaaaagcuuucccucccucggugauggucauccuugggacaggccacaccgguauaaaccacccugggacugccagucaacagcccugugcucuugagcuccccaguggguguggccauauacaauauuuuacucgugagauugacacuuccuagguccacauggacaaaaaacaggaguacagauaccugggcaucccaacaguuuaugacccaggcuucagguacucauggagucccgucaggaagaauggaucugacucuuuuccugaaacucauuggaagcauuuugaaaugugugggcuggucaggguugucacacuugccuugacugaugagggauaagcuauguaguguccucggauguauguagaaaaaauuuccuagcccaaaccaacagcagaucccugccucuuucaggaagcccagucuaagguggacuccagucugaggugcacauggccuguccuuacagagcuccagucugagggagacagccugucuucaagaagccauaaucuuaagggaauagacaacaggagcuaagccuucaagcccagggaaaauauacugaguggugagaggcucagcugugcugguucuccgggggggcaaaggugcagccaggaaacacuauuagacaucacuccacgccuggaaggagguuuuaacacuugcaccaaugauagaauuaacaacaucaacaccaacagccuccauaagcagcaggaccacaggauacaacacacaacuugcguccacaccgucacauuaagucacagcagccuacccacucaagcaaccagggccaucucagagcaggccugcugggccagacuggagcccgaggccccacagagccccagcaggagagaagguagcagucaccacgcaggcagcuagaagccgagcaagcaguuggccccucacaagugugcucucucugucucucucuuuuucccucucucucucucccgugucugugaugccccucucugacucuugcuugcccucuggagaccaaccugcaaguacguucguuuaacucaagcugccucgccuugcaacgcgagucuguguuuuugcaggaacauuuacacgucugcggaucuuggacaaacaaaugcuuucuccgcucugaacaaggcucacagugacugcaaaaaggcaaaaggaaagacaucuaagcuagagagucagcagagagagagagagagucccaugcaacacccccuaauguguccaccacggcuuccccacccagcucgucggccccuaggcccuuuccacauucuggaaagauccgagcacucuagcagaagacagagagaguggcaaagagacgcagcgcuggcaggacaugugccugcaggaagaggagggcacaggcaggcagagugcagggggaggguaagcuuccaugagggacagugcugugccccacgaagacaugggccuaucuggggccacagggcccccacaacugcugugcccacaacacaccuugacucuucaccugcuggggacagugauaagugacccaggagaccaccaggguaccuucucccuggaaaagggccucugcccagacccuccaccaagggagagggccagcagaagguaauccaaguccaguggcacuguccaccagccaggccuccagagcccacaacagccuauaagcagaggaagaggccaccguaggagaccucugugggugauuucuguugggcuggauagggagggcuuucccauccuggagccucaaacccaggggucaaagcauuuccaacagacgaggacgggcuaccgcacagcccgcucaagcuccaacuucagcccaccacaguccacuucccaccaacagaccccucaacucauuccacguugcccuccacaccaccccuacccuccagacaugugcaagagucuagagcaguggaaaccaguuggaugagagggcccugaugcccagugcccaugccaacaacggccccgccaccaaugcccagugggugagagaaagucggugcccagccaagccagaguccccucccugaguugaguguuccguaucuacucaccuuccacccaccccaacccaacccugggccaacaaugccaccaccaagucuacccauuggugccauuaguggggugagugagagagagagagacugaggcagggcaagagccagaggggagguagggguggggcagggguggggugggcaggguuagaggagcugcaggcgauugucuggagaccaggaaggcuccaaggaauuagacagcagcggcaccaacguacacgcuccaggauuuaaaccgggauuucuugcgcuuucguuuuugacccuuucccuuuccucgaacugauuuucuggaaaauauaaaaacagaaacagacaggaagagaacgagagggaagagaagagaggagcaaugaagaagacagaggcaggagcaggagacccaaaacuacccuagucacuuccuggagcagccucuaggucaaaccucagucacgggugagcagagacagcgugaaccuuccuccucacuuugcccacaguagggugguaaucccagcccuaggcagggcuuugagugauuagcagaaacugugaaaggcacagcuucuaggcuucauguggucccuggucucaggcagggcgcaaagccauaagggcaagccacaacgguuagacccugaaggucaggaggcaauagacugucuaaggcagacuuuaaugagaaaggguuagaagugggcugugcuucagacuaucugccuugacuuccaagugugagaguaggagucccucugggagcccugccucauagcauccuuggugggaaggggcaguugcuugagcgauggcauauaagccagggcaggagauggggcaccaguuauggagcagucaucuaggauaggcagugggaguggcugucaucagagcccagcacugaugguggggccaggggaagaggaacaguguaguaugggugugugauuagggggccagaggcucuuuuuucuagaagccaaagccugcagcuagacucucuuccgagcucgggcgagcccuaccacucuuccuaugggcaaagcagacaucuagggaacagcugggagggacaagcuacagcuugccacccuccagggaaccagcacucucuaggccugccaagucccagaaaagauauggcagccugucuaucacggggaaagcgagacaggaagaagggaccuggggagaagaaggcaggucuguccugcuugggagaaagcacugcaagcauagaaggagaaagcucuccacacagggccacucgccuggagccugcccugcucucucucacugauaaacuccaggaccauugcucuaguagauacaguagucguggaaccugggggcuuaggggaaggcaugaggacuucacauccaccaaaugguagggcagacagaaaggggcguggggugggguugggggaaaggaugggggugcucucucucagucgcuccuucacugcacguuuagaccccagcaaugucagccacccucccguccuaaacugaccuuccccggccaucaacaggaagccucagaaaaugacuaccacuccacuuuucuucccucacuaagagagcugggucugcuaccugccacagcccuacggaaaggcauacacacacaaccaagaaaucuccugggaccuaaaaaaccuggauggccacagucaccacccaacaaggcccaggcuacguccauccccugauacacagaaacugcccuguggcacccacucgcucuccugcacucugcuguggacgcuaguguucauagcacacuccaccacaacgcugagugcuggccgggagggaccugagcccugaagggcagccucuucuucaggcuggguuuacuucaucgcucuagagccauaagcuuaaagcugacuccagcccacuucggucaccauacuacccacccaaccaaugccacugaggccaacagagcacccaagagaggaagcaagaagcccugaacagagacaauuggaaagaaaugcuagcacguggccacuuacuuuucuggcuuuguucugucuuucuuuggucugcaguggguagagaaaggaggagaaaacaagacacagaggaguuagggugaugauaacaacaauuugguaauaauuuuacacgacguuucugauuuagcaaugcucucuuaaucuuuuugcauaacaacaacauggggcccuauaaugccguggaagggcacacugaauuguugugcccauauuccagagacggggaacagcagcacacugggguccaucaccaccaccacccacagaagcucacacagcuagcuggaagguggacccacacuaacacauguaacacgcucagcucugcagccaggcaucagcugugugccaccugagugugaagcucuggccucaccugcauucacaucugcugugcuguaggaagcucaucucuccuaugugcuggcuuuggugagguuugauccgcaugaucuguagagggagggagcagaucacagugguuagugacccagccagccauaccccuaugggacaccccggggcuccugccauuuagcacccagggguucuacugagcagggauaggugguggagauaggaggaccagggcucuaacagaaaagaaccucaggucacuccaacucccccaacccugcuggccucaaggggcucuugcuccucuugagagcagacagcugcaaggguuggccaggcugggaauucagguccuggauucuuaccacccccaucccuuccccuccugcaccccucccaagcuucacccugacccccuaaaugcuaccuaagagcuacccauccagccuguugcugagcuuccucccacucuccaccccgucugggcccagauccacccacuaggcaacagcaccucaagacuggcuuuuaacucugcauagaccagucccucccguccagcuuccccaauagaacccucgagugaggauugggggagcauuuggguucucccagagaaagagaagaacacuuguugcaggcagcggccccccugucgagcccagggagcaaaggucacgaaagcagauggucaaaucguggagagcuucggcagggaaguacagagcgcagagcagacaucuucuucccaaagguagcaaagaagccccagccucgucuucucacccucaaccccaauuuagcuccuccuaccaaaaguuucccaggcagaggcccagacaaccuucuaaugccccuccuuguaccacuguccuccugcccccccugcccccgccccguccccugugccgcaggugcccaccugcauggugauguugcucucugacgugggcacgcacuccagggcuucaucguuacagcagccugcacagcgcaucagcggcacacaggacggcuugaagauguacucuaucucgucgggguacuccuggaagauguccaccagggucucaaucggacggcaguagcuucgcugguagacauccaugaacuugaucacugugugggagggacaccaggcaggauggucagccucuaucgccacccagauuugugagaccacuccuuacagcuccacaccaaacaaguguuucuaaagcucaaagugaagucccucccucauuucuagguccagauccaggggagguggcccugccgcaucuaacuccauuccucauugucacagcaaguuccuaccaacuauggcuccagaugacagccugagucuggguacaccugcuuucugcuuuauggccagaccaccaaccaggccaacagccacucaucaaauacacacuggacaccggggacagcuauguauauacacucuuccccauguucccacuaagcacaaccaggaacccauuuuauaaauggagaucuagagacucagagaaacaccaccauucaucccagaggccacaauacuaguaagaacuaguuagaaggagcuauguuggcuaugccuucugacacugauaucaugcacagacacagaagcuucgagagacaccugccagucccccccuccccagacuucugcccaagacaaaucagcagguggcagugggcaggcacaccaaccaaugcagguccuggcagcacuaagaaccccgcccaagagggcaaacuguuugcaucauggaaagagcaggagcugccuccguacgacgcauuuuuagaagcugaucuagaagacgacaggagagaccauuucccugucagauucugagguacaugagacaggaagguguacuugagggccagggggcgggaacuagagaguacaggacuucuuuggaacaccaaaugguggcucagccugccaguuuuggucacaccccaccgaagccuguccaugaagugagaaaaggaccacaggcccacacaggggcccaaguucuguuagcaguuggaaugaccuugggccugucccuccagucuccaggccucuaucgguagaagcagguuagccugaccucuaaagacacuucagggagcaggaaggugguggcgcucugacucuuugcuggcccugaaaacagcucuucuuuucucauuccaggucacaaaguuuggaaugucaccaaaggcauuuuaagugcaugcuccggagacuacacacccccacccucccaaccugaggacacagccaaaccucccuuuacucuucaaaguuugguuuguuuguuuguuuguuuguuuguuuccagaaagguaaagaagauggaagccagguguaugauagguugucuggugagaaacgggggcacagaagaaaagauggagcaauggccacagaugucaaacagggaaagggguggggggaacuuaagccaccaccccuguacucugcucaagggcucucuuuucuaucuggacaaauaagcaaaggacucuugucuacccucaaaggguuaacauaaaacacagccaaaaaaaaaaaaauguccaugagaucagaucugaaaaauucuucucaaggaaagucuauauugaagacgacuaacccagaauuuuuuuuuuaacuaacccuucaucauggcugggacagagguggcccaggcuaguuagaggagcgauaugacagagcaaugaauggaggugggagcucuguguaaaaagaccuaagaugagaauccuuuccaaaaacuucuuagaguccccaagguccauaggaaguggaggaagugacuuggccaguacccacgggagccuggccccugccccaaagaacacuguccugcugcucgggcgugugcacacauacacuucagcaucgggcuuucgugguuuuccuuauuuauagcagacaagcucuucuccaucaaacaaagaccauuugucuugccucucccagaccacagagcccacuaggaagcagaaggggguggguagcacuuuggaaguaggggccugucaguggccggggccagggaguggcagagagccaggcccugggccagagaaagagcuccugggggaggaggcaaaaccggcuggacaucaccagcuuuccuuggcugcugguuccuccagccacaguggauuugggucagggaaacuagccuggagaaagaccccagggccuuccuaacucugaggaaggacacuuggggaguggcauccggcuggagcagaggccacacucagugcuggggagagccagggcguccccagagaaaugggaggaucccgguacuccaaaccacacuggaacaaaaggcaggcggacucaggguugggcaggggggcggggcggcugagagcuauagccggcccucugcugguccugcagggaaguucacagcacccaaacgcugucuauggaagcugccacacuggaaagccaggacuggggaguccuguuaggauauccuucuguccugccccagccucauaccuccaccucacacaggaagggucacagccccuucgggugggccauggguggguaggaaguggcacugaacauuuaucuuccccugagagaaggggguacaagagacaccucccagaacaucuggaaacccugaacgcugccgccuuccuuccuccacggcugugcucacagcaagcuuuccagauaaaauuucacuagaaaaccuauuagagaaagcaacaaguccuguuucuagcagaaagcagaacagaagacaucuuaagaaacacaaggguuaaguucaacaguacccaugccuccuauuccugugccccaaccccccccccaucugaaaaagaggaguggggcuuauccuugcacuccacugagacaacagggauccauuaaagagcaugagacucaccuucaugggacuucugcucuccuucugucgugggugcagccugggaccacugaggacaaagcaaagaguaaagaccguugacagggacagaggcagccacggggcguccaaggccugaccacugaaucccuugaugucuucuugucucucucucccaacccccagcucccagccuccccaccccccacccccaggcuucugagucacacagggucaggaccauguaaguggucccugcagguccagagcauacccacuacucuggacggcgucaauucugaacccauggaaguuaaagacuaaccaggcgcuagggagcucacaguguaggaggaaaauaccagaauccugcuuuacucaggcccccagucccguuccaaucuugcccucucucuuuucccacugcccccgauucccugguccaaagccauggguaaguauuaaggucaaauaggaggacaaauuuggacuggggcaggaaggaaggacugggggcgagaaaaacaacguggugaccuucuccugcugacaugacaaauaccagggagcucguguugaagagggaggggugcagaggaccgaagggcaccaacuacccucccccaucccaacucuccccaggccucgggaauauucggcauacccacagguugcucaaggggugauuagcugggaggaagccccuaagggagaguccaaguucccucccaccccaucugcccagggccugacugcagcucccaagcuuggcuagccucccccucccacaucuccaagccucucaccuggacugggcacuuggcucgaagguaaccaaggaagcuuucuccucaguauugcccagcccgcaggggguccuccaacccuccucauccccaccagcuccuuucuccccuccccagaagcugugaaggucaccaagaaggccuugugggccugacaguggaagcaagccaaggcuuccaggcaggccuuccugagggucuccuguugccaccuuccucaaccaaccuggaccuccaacugccccagaaggaccaacucccacccuuggucugucucuguccccuaagagcaguucauccagggacccucagucuugccaccagggccaaggucagaggugacccuucucaagagauagcuuccccauuccagcugccucagguuggcccuggauucugcacuguaggcccucacuacccccucaauagccccaugacauucuccuuauucuucugucuagccccccguggagaaagggaacagaaacuuugaaccccuucccagauggggagguucuaaggcagggacuggccagguguccuucucugggggccucugaaggucacacuguggccaagcacuccuauccuccuccccacauggaggcccagaaccaaggccuuugugccagggucuggggaacucuggaugguggcagggacaccugcccuucuccuuccuucugccuccuuuccaagaaggcucuacaacugaagcuucguggaaauaagcaugaaaggacccuuugguaggcaaguugggugggcaaguucgcaguuaaaccaccugcucucugggcaucgggcuuugccaggacaaagugugugagagauacugacugacaagggauccugccaaagguaugggaaagggcugguuccaggcugccccugucagagcaaauaucaagucauguuuccaaagggggggugggggugggaaauggggugaugucaguccacccuucguugauccacccccccccccgcaaaaaaaaaaaaaaaccugaagcacagcugugaggggaggagggagcacaccuucaccaacucaaaacuuaggucagcguuuccacaaagaacccgagggugggccucagcacccccacgccugacagucaccguccuuuuccuggacccuggguccaggaaagguccgaugagucuucgcaaagaaaaggaaaauauaaaagggugggaagggcuucucuuuuuacaccaggcaggaaauggggaaaagggggaaggggcgucgggaaauucuuccuagcgcgaggcacggguagaaguugggaacggaggaaagagguaugggaguuucuccgggucccggagcuggggauaccuccagaggucaccuuccucgcggagggccgguggggggaggggcgccgcucgucgcccgggucuccgggcuccggcagccgcggcuccgggaacacgaggccggccaggcccgggcugauguaaucggcucugcgccgcgcgcgcccggccaggcgggggagggcgggcaccgcgcgggacgcgagcggggacgggaggggguggcgcggugcagguggcccaacaagcuagagcggugggagaggguccccgcagcaauccauccuaaaacuuuccccaaacucacugcaagggccucagagacccaaacggcagugacagcaaagcccccucggucgcccgcgcccugcccccuccacgaucucugcccuccccggguccaagguccgagcacccccaggcaugcccgcugggcuccggacucccgcccccuuugcccggacuuccaguucuccggggacccgcgacccggagcaaacuucugccgccagccucggcacaagcccagcccccucagccuccuccucuggcucccgcccuccgcugcucggcccagaucguacgugcggugacucuggugggugggcagggcccgcgugggcggcgagacgauccuggcgcccucccaccuagcgcgcacccccucccccuccacguacgacgacagagggggacgccucgcgcccggugcccaaggacccgcguggggcacgaagccccccacgcgcgcgcucgcacgcacgcacguccccaagcgggagaggcgcucgccacggcccggcgacagcagacgggcacgaccgcuuaccuuggcaugguggagguacagcaguaaagccaggguccagugcacccaagagagcagaaaguucaugguuucggaggcccguccggggccggcgcggcucgcgcucccucuccggcucggacugcgaggcagcccgcucucuugcgcgccuuggcgggcuccucucccuucuggaaccgaggcccgggccggggccuggggcgcgcgcgcggcuggagcacugucugcgcacacggccgccucacccguccaugagcucggcuccugagagccgagcgcccacugcggcccccucuccucuuccuucucuuccuccccucucuucucgggccccggcuucuccaggcccgagcuagcacuucucccagcuccgaucgguuugucuccugcggcgcagaccacggcuacuacggagcgagaagagcccagaaguuggacgaaaaguuuccgugcaaucccgcgagccccgacccccuccaccccgccuccgggcgcgggcuucgguuccucgcggcucgccgccgcguccaccgucggcagcccgccggcgaggaggugggcgcuggggcugggggcggugucugucugucuguccgucagcgcgacugguccgaugcaagaucccaagggggagggcucacgccgcgcucuggcggucacccccaaaagcaggucagucacuuugccccugucccucucucuguucgcucgccagcgcgcucucucugaccggucucucucucucuuccuugacuucucucuggagcucuugauaccucuuucgucugcugauuuccacaauccgaagugauuugagggagugaagaaccaaccuccucaaaccguuggcacgauuuaagaggggaauaggaagcaaaaauaaauuaaagcguaaaacaauacaguuuaagaaaaaaaaauuaagagguuugaauaucaaaucccagagcacagacucccgggcuggugaguccgcugaauagucugccuugucgcugcgucucgcgacagagcuccgcugccgccgcucagcucgcccccagugccgcggccucgcugcagcucggcugccccaagccucugcgcu

SEQ ID NO: 12239 - RNA, 14028 nt, Mus musculus
cuggagggcugcgucguccagguggcacccgcuacuccgcccgcugauggcccccggcccccagcuuuccgcuaaaucaggcggaagcgagcgguggcuggagcaggcggcggagccucggagcgccuggagcaccagccaggacuaggcuccacccugcagcaggcagugcgccggcgcgccucggaggccucugcuggucacgcccucugcccgccugucuccugcagaggcacgcccccuccucugcgccuagaccccuucagggggcccaggcggggcccaaacacucgccagcgccgcagccgccaucguguuccgcgcgucccuagcucugcaaaggacaggccucgcgccaggaucccggcggacuucugagguggccagagccccaccgcagccccugccccuauucugggcuuccgaucgaccgcggagccucgcgucuccuucccaaccgugcuucgggacuauccuuuacugggccuaccuccccauccuaucccaccacgcccuuuccggaccuucucgggucuugauucccauccaccaagccucgcgccgcuuauccaucggaccccugaugcacccuucucccggccucgcgccucuggucauggaugucucccauaccuuccccuucucccagcccaucgugcuuugcugauggccauuucugugcccuuuccuuugggccucacaauccagugcuucaauuuagagaccgcaucccccuccgacacaguucugggcccccacacacccguuucccuaaauuacuuuuaucugucccaggaccuugggcuucauuuguaaauccaacacugcucuaugccacugcccuuccggguguuccgaaccaaacccacucgaggcugcgagccuuagagaccucuuagcuccaauauuuugcucuugaauaacaaacuccgcaauguucuucuguccaguccaggucucaccggccgaagcaggcccaacuuuaccccacccagaauaacagcuguugcugcuuucgcuccuccaacuccuggaugcccuuguuuucugaccucccucucacucuagcuugccuuuucucucuuccuugugugucucaggugccacgaugguaggggagcuacgauacagggaauucagggugccccuggggccuggcuugcacgcguauccggaugaauugauccgccaacggguuggccauaaugggcaccccgaguaucagauccgcuggcucauccucaggcgcggggaugauggggaccgggacucuacaguggacugcaaggcugagcauauccuguuauggaugucugacgaugagaucuaugccaacugccacaagaugcugggcgagaauggccaagucaucgcaccuucccgggaguccacugaggcaggggcccucgacaagucugugcugggggagauggaaacagaugugaaguccuugauucagagggcccuucggcagcuggaggagugcgugggcaccgugccuccugccccucuccuucacacgguccauguacucagugccuaugccagcaucgagccccucacuggcaucuucaaagaccgcaggguugugaacuugcucaugcacauguugagcaguccugauuaucagauccgcuggagcgcaggccggaugauccaagcucuguccucccacgaugcuggugagggacauuuguggugggggagggagaacaggagagggucugggucggcucagggauucagaggacacugggacaggaccuucugaccucaucaguacggaauggcucaguuguuguucacuuuuaaguuggaagaaaaaaagagggggcgggguagggagaauguuuguuguggaaggggaugggacggaggggggaaagacugcauaagcaagaacauauuaacccauuagcuuuuuaugcagaagagcuuagacuguugcagugugugugugugugugugugugugauaguaaacguuggcucuugaagcaaaucaacaaaauaugucauucccagcgagugcuggcaaaggauugguagugaguagaaagcuaggagagaucccuggaagacugcgcuuagggaacuguuucugauuggagguguggguuucagggacccggacccagauccuucugucauugagccaacaagaggccauugaaaagcaccuggauuuugauagccgcugcgcucugcuugcacuguucgcccaggcuacucucacggaacacccgaugucuuucgagggcguucagcugccacagguaucuuaugaggguccgagguagugggagcuguggacuugccacagaggguacuguggaaagagggcagaagaugagacaagaugggugagggucagagguguaucccacaggucccaggacggcugcucuucucccugguaaaacgcuaccugcacgucaccuuccuccuggaucggcugaacggcgaugcaggggaucaaggagcccagaacaacuuuauuccugaggaguugaauguagggaggggccggcuggaacuggaauucaguauggccaugggcacucugaucucugagcuggugcaggccaugcgcugggacggggccucaagcagaccagagaguucuuccuccuccaccuuccagccucggccagcacaguuccgccccuacacccagcguuucaggaggucgaggcgguuucgcccccgugccucguuugccaguuuuaauaccuaugccuuguaugugcgggacacgcugcggcccgggaugcggguacggaugcuggagaauuacgaggagaucgcugcuggggaugagggccaguuccgacagagcaaugauggcguucccccagcgcagguaugggcucuacagacugugacacugaauuuucauucugggugaggcauccaauacacacugggcauucuauacugcggcucaguuaaguuccaaaggacacggagcccuuggaauaugggagcaaaggugcgucagacccaagaagaaaccgauggauuagaauuuggaagaugggcuuucugaggccagauggaaguacugagccaugguaucuaagacagagaggauccaggccgugguaggaugcuuguaaucccagagguagagagaggcagaaagauagggaguucaaggccagccauggccacauagcaauguugaggucaguuugggacccccgucugaaagaaaggaaaaaugaaauuagacuaaagggcauaaggaaguaaagggcauugcugaggaggaaggugaggcugucuguauacuguauacauuguugcauauauagucuauauagucuauagacaguggucaccuuaugggccuuagcuggucaauagcagguccucuuccccuucccuuuccuccugccuccaacccuccagguguugugggauucaacaggccauaccuacugggugcacuggcacaugcuggagaucuugggcuuugaggaagacaucgaggaugugauugauauugaagaguuacaggagcuaggggccaauggagcacugagcaucggugagcucugggcuggagguuggcucugagcagagagagauagaccuaccugggcaggccgugacuuggcuguugccacauaccauuuacuacgcagucccgccgucccagcgcuggaagcccauaacucagcucuuugccgagccuuacgugguacccgaggaggaagacagggaagagagcgagaacuugacccaggcugaguggugggagcuccucuucuucauccggcaguugagugaggcagagcgccuucacaucguggaucuccugcaagaccaccuggaagaggagguaggcaccccucagaagugucccccgcaagucugcaucggaacauucggacgcucgggaggugaagcacggaggucggacagcuucaggggcccaccacggagggaucuggaauguucagagaugcaagggucggugggcugccagccacaagagguucagaaugguugauguguguguguagagagacccccauucccaccgaggaucugcucgcucagcugcgacaggcugacuuuucuuccccguagcgcguucuggacuacgauaugcugccugagcugaccgugcccguugacuuggcccaggaucugcuguugucucugccucagcaacuugaggacagugcucugagggaccuguucagcugcagugucuacaggaaguaugggcccgaaguccugguagggcaucuaagcuacccauuugugccaggugcccagccaaauuuauucggagccaaugaagagucugaaggugagugcccugcagacagcagcagagagaccugccuuugggaaaguguccuccaagaggugucuccucuaacagugugccaucuugucugaaagagauacccuacccacaaucccagaaacuuacgaugugcaugugugugugugucuguauguccagacccaaggauaauuacagaugucauuccucagcugucauuuaucuuucuuuuauuuaaauugauuuuauuuuggcugaguguggugauccacacagauauuugaguuugaggucagccuggucuacagagcaaauuccaggauagccagggcuacacagaaaccccuuucucaaaacuaccaagcccccucccacucuccccacccccaagaaaauuauuuuauuuuaucccuauggaugcagugcccacagaggucagaagagggcacuggcucuccuggaguugaaguucuagauccuugugagcugcgcuguggaugcugggaacugaaccuggaucccucccuucucucuuuuacucuuucucucucucucucuuucuuucuuucuuucuuucuuucuuucuuucuuucuuucucuuucuuucucuuucuuucucuuucuuucucuuucuuucuuucuuucuuucuuucuuucuuucuuucuuucuuucuuucuuucuuucuuucuuucuuucuuuuuucgagacaggguuucucuguguagcccuggcuguccuggaacucacucuguagaccaggcuggccucgaacucagaaaaacgucugccuuugcugcccaagugcugggauuaaagauguaugccaccacuuuuuggcagugcugccaauucuuaccacccucuuguuccuucagccaaagaucccccacuucagagugccagcccugcccugcagcgccugguggagagcuugggccccgaaggggagguccuuguggaacuggaacaagcccucggcuccgaggcuccccaggaaacugaggucaaguccugcuuguugcagcuccaggagcagccccagcccuuccucgcucugaugcggagccuggacacuuccgccagcaacaagacccugcaccucacugugcucagguggggggcagugaggggcaggcuugggcaccugaaggccucacgccaaccugaucuccuucuaccuuuccggcucugucucucccucuagaaucuuaaugcagcuggugaacuucccagaggcgcuguugcuacccuggcacgaggccauggaugccugcgugaccugccuucggucccccaauacugaccgagagguaacccugucccacucuggggagaagcugggggauggggaggacaccagugagguagaccccauuucccugcuccgggcgaggcuuggaggacgcaacagaaucuugguguucucgcuuuuaaaaugaaaaaaaaauuuuuuuuuaaaauagguaguacauucacaaaguucacaaguccaaauggcacaagguagucaguccuugagaauccuggcucuucaccgauuccuauugucucaguguccuugcugguaacccacuguauuaauuauuaguccaucccgugcuuccuuaugcaaacaggaacaagcucuguggacuuccuuccagccaggcccucaagaggaaggggaggggguccccugcucuugcagaggacgcagauuucauucucagcacccacagggcaguucacaacugucuguaacuccaguuccagggaaucagauaaccuccuccuagcuccaugcacacacauggugugacacguacgugcaaggcaaauacucagacacauaaaauucaaaaaaaauuuuaaaaagcuuuuaagugagggagugagggacucccaggacuuuccuuccuaucagagguccuggggacaggagguguuagaagggucaaaggucgugauguuaaugaguuucccaaagugaugccuucgguuuccaagcuguucuuacugagggucagcaaaguucaggccuucucuauccccugccagcccucuuaagugucugggcugggggcguacacaucucaacaccaacccugcaacugguucuugggggggccacagcugaaucaaagaaguaaggguuuuuuaccugcuccgcacacacucgguggcugagagcuccaggggccaggaaggcuuuucccaucgguuuggccucguuucucuaacugcgccugguuuuuauauuacuucccacacugucuugcucagcucccagcacagaguggccaugaaucaccaccgcugucuguguagcccaggcuugccccuuucuucacugaccccuugacauccccucucaggugcuccaggaacuaaucuuuuuccugcaccgccugaccaccacaagccgggacuaugcggugauacuaaaccagcuaggagcccgggacgccaucuccaaaguccuggaaaagcaccgagggaaacuggaguuggcucaggagcugcgggauaugguguccaagugugagaagcaugcccaccucuaccggaaacucaccaccaacauccugggcgguugcauccaggucaggagggaaggcaggagggagggcaggagagagagcaggagggagggagggcaguggagguucugagcuaccuaagaacguggaugcugagcaaugccaggggaucgggugccugcucgugugagccuggacacguucauccccuuacgguuugaccuuuccuccauuugugucuugccugagccuuauguccucuuuucucugauguuccggcuccagaugguccugggucagauugaagaccacagacgaacccaccggcccauccaaaucccauucuuugauguguuucucagauaucugugccaggguuagugucuguuccugaccuguuuaauuuagcaucacugguuuuccccuuuguuuguaccuggacuaugaccuuccccccuccccccuucccccaggcuccagugaggaaaugaagaaaaacagguacugggagaagguggagguguccuccaacccacagcgggccagcaggcugacggaccgcaaccccaagaccuacugggaguccaguggcagggccggcucccacuucaucaccuuacacaugcgcccaggugucaucaucagguaaggagcucccacaggcacucauggauggcccugcacuguguugguccugccagucaccugggcucuugagcgugggcgcgauggauuccaauucccauuggugcuuccuccccggcuccaggcagcugacucuacugguggcuggcgaggacucaagcuacaugccagccuggguggugguaugcgggggcaacagcaucaaguccguuaauaaagaacucaacacgguaaggagcccuaugccauggcccaccccuguaggcccucucuucccuucuaagucuaagcuccuaaccccuacauauagugaaccccacacaggcuagccuguuauccuugugccuaugugagggcaugacgcaaugggagaggcacugaagccccuuugucaggagcccugugugucccugggguggaagauggagggauuugcaagagagcuagagcugauguggcugauauuaguagcucugucuacacauaagguggugauagccaucucugccccucaccagguaaacgugaugcccucugccagccgggugacccuccuggagaaccugacccgcuucuggcccaucauccaaaucagaauaaagcgcugccagcagguggggugugaggacugcugcaggucucugagccccagccagacgucugucaccaaacuaccccauggcagcccugagccugaugaugccuuuagauuuugagccggggccugggggggggggcugguuuaaagggcaaagccuaugccaaggaggauguggggucagcuacaggucuuguguguaacaggguggcauuaacacgcgcauccggggccuagaggugcugggccccaagcccaccuucuggccaguguuccgagagcaacugugccggcacacgcgccucuucuacaugguucgggcccaggcauggagucaggacauagcagaggaccgccggagccuucugcaccugaguucuagguaugugagagcuugcauguguguuuguguggcaggucagguucauggacucugucuggguggguccugaggaggccuggagacgggucuguucuagggcuuggggaaggucaaagccuucugaggggaggggaugacggaaagagaagauagaucucuccgagugcagagggaagcauccugcuaguccagggcuccucuaaaagauugcccugggugcuggcugcgugcugagucaccuaagccuuagggcccgaacucuuccuucuccuccccaggcuaaauggggcucugcgccaugaacagaauuuugcagagcgcuuccuuccugauauggaggccgcccaagcacugagcaagaccugcugggaggcgcuggucagcccccuggugcagaacauuacaucucccgguaaccacccacacccggccccgcuccucagugugugugugugaccuccauccccgugugugugugugugugugugugugugugugugugugugugugugugugugugugugugugugugugaccuccauccccacaucgucugggccagacugcuccucucccugcgugggaguugugugguuggcuuuucgcugucccuuggugagcucaaccucucgacuuccccagagaggcaagccauccuuagguguguuauucucacccuccagaugaggacagcaccagcuccuugggcuggcugcuggaucaguacuugggaugcagggaggcugccuacaauccccagagcagggcugcugcuuucuccucccggguucgccgccuuacccaccuccugguccauguggagccccgugaggcagcaccuccggugguggccaucccucgauccaguaaguccuggggacuccaacaggagcuccaccccgcucaugaguccccacucugcuccccacacccccaugcccacaugucuggcuguccaucuucuguguguuacuccauucaugaacaccauagcaugcugggaaaggucuucagggcucauccuccggaccuugaggggccgucgguccuggccuucugacacuuuucucacuccacagagggcaggaacagaauccaugacuggagcuacuugaucacccggggccuuccaaguagcaucaugaagaaccugacccgcuguuggcggucugugguggaggagcaggugggcagccacagguguggaguugggggugggacucugugguggccccacauuggaugccuccucaugccccuuccccuuccucucagaugaacaaguuucugacugcguccuggaaagacgaugauuucguaccccgcuauugcgagcgcuauuacguccugcagaaguccagcucagagcuguuugggccacgagcugccuucuugcuggcaaugcggaauggcugugcugaugcugugcugaggcucccuuuccucagggccgcccauguaagucccuuccuggcccucucccuauaaacucuccccugccuucccaaaguggaccacccagucucucuucugugaugagcggauccuuuggaucugaccauacguugaaaacuaggggaaaaaaaucauugcaugcagcagauagagagagagagagagagagggagagagagagagacacucaacauguaucucugguuggucucucggccuugaacucagagguccaccugcauaggcuucccaagugcuggaauuaaaggugucgagcuaccaugccacuucuuucaaagccagggucucauguaucccagucuggucuuuuuuuuuuuuuuugguuuuucgagacaggguuucucuguguaucucuggcuguccuggaacucacuuuguagacgaggcuggccuugaacucagaaaucugccuaccucugccucccgagugcugggauuaaggugugcgccaccacaucugcccccccagucuggucuuaaacuuagaguguagcccaacaaugacuguguacuucugaucuugccucuauuucccuaagcaccagcauuucaggcacguaccauucauuaucccuguuuauguggugguauuagggauugaacccagggccuuagcaagcaagcacucuagcuauacucccugccccucccuaauuccuaauccuucugccuccaucucucaagggcuaggaucauagaugugugccaccaugucuaguugauuucuuugauuuugaguuauuugauuuguagacacaguuuggcagggugggggugggggcugaauuuucaguuguuaauacuacugaccugcacaacuguuaauguaagugucugucaggcugcagcggcuguagcucuguaggacugugugugcuccuuaguccugauuccuuccaguaccucuugaagagggugguggaggaagaugaccgguggaugacggagguggucauccauaccugcuuucucugcccuucuccuuucuguccccuggcucacucacccgugguuuucuuacacucuccgcucaggugagcgagcaguuugcucggcacauugaccagaggauccaaggcaguaggauggguggagcccggggaauggagaugcuggcacaguugcagcgaugccuggagucuguccugauuuucucuccccuggagauagccaccaccuuugagcauuacuaccagugaguuuagaucuuaucuuccugccucuaugggguagaacauggggaaggcaggcaggcuggcuguuuuggggcagggccagcucacauggccugagucuaauauacaggcaggccagagugagaaccugggccaugcuggcgcccacacugagaccuggccuggcuuugugcgcugcaggcacuacauggcugaccgucuccugagcguaggcuccagcuggcuggagggggccguacuggagcagaucggucccugcuuccccagccgucuuccccagcagaugcuacagagccugaacgucucagaggaguugcagcgucaguuccacguuuaccagcugcagcagcuugaucaggagcuccugaagcuggaagacacggaaaagaagauacaggugggucccagggaagggccaugcggggagcaaguagccuugaacauccugugaacuccguuccccuuccagguggcccaugaggacaguggcagagaggacaagagcaagaaggaagaagccauuggagaagccgcggcuguggcuauggcagaggaggaggaucaagggaagaaggaggagggagaggaggaaggggagggagaggaugaggaggaagagcgcuauuauaaaggaacaaugccagaaguguguguacuugucgugacgccacgcuucuggccugucgccuccgucugccaaaugcucaacccggcaacgugccugcccgcauaccugcgggggaccauaaaccacuacaccaacuuuuacagcaagaguaagugucugggaagaaggccuuggccugggcugagggacaggguaggcuccuaagaaagggaccugaaguugggguagauggugagguuagaaaccuggauggcuauaaacauggccucucagccugccuauguucaggagguacaagauacaggagauacgauucccuuuugggggacagaauggcuguguggggaaguggaggggcuguaaauuuuagcuggaguccagacuaaaggaaucucuuaggaauugggaggaauagucagacuucuucugagagaggccauaagagugagcuuagggguggguguguggccgggcaugauuccagagguagucaguuggaucuuuaagaguuuugagucuagccuggucugcauagugaacuguaaaucagccagagcuacauaaagagacccucucagaaaauagaaagagugggugugagauuccuuccugauuggucacauuuaguucccaaaguauucacugggcaucagauucuagccugggcaacaagagcaggugaagagcagagcaccacccccccuccccccaggagucaccagacaagcaggagggcaaaccuuccuggcucaauucugucugugcauaauucagagggcauggcugcagccugcuuggcacagacugacuccuuguuagccaaggcuuuuuagggaagcugagaucagaagccaucgugcccagaaguccugccugggucucuacacugcggagaccagcaaggcaaagcuugaccaacagagcaugcccuccccccuuacccuccccccuucucucaccuggcauuucuccaggucagagccgcuccagcuuagagaaagagccacagaggcggcugcaguggaccuggcagggccgggcagaagugcaguucgggggucagauucugcauguguccacaguacagauguggcugcugcugcaucucaacaaccaaaagguggccuguccugucccucugcuugcccugccuauucacuucuguucucuugccuccauccuccccagcucacccccccccccccccgaggaucuaaacucuuuguaucucuucuaaggaggugucugucgagagccugcaggcuaucucggagcucccuccagaugugcuucacagggccaucgggccucucaccucaucaagaggucccuuggaccugcaggagcagaagaacguaccaggagguaugcacucagggccaaggcagacugcucugagucaggaaucggcuuccccgggcccuccccaggcaagugaccaauguuccuuacaggggugcucaagauucgagaugacagugaggaacccaggccgaggaggggcaacguguggcugaucccaccucagacauaccuacaagcugaggccgaagagggccggaacauggagaagagaaggaaucuucugaauugccuuguuguccgaauccucaaggcucacggggaugaaggcuugcauguugaccggcucgucuaucugguaggcaguggugggcauggccaugggggagaugcccagagguaaugguaggcauggccaugggagagaugcccacaagugauggugggcucguauuugaagugucuaacucauggugcagccucucagugugugacacaugucccagaaugugugacuaacacagaagacagugguaaggacugugguuuugaccuguccuuuccuucugauccugcuaucaggugcuagaagcgugggagaaaggcccguguccugcuaggggucuggucagcagccucggcaggggagcaaccugcaggagcucugauguccucuccugcauccugcaccuccuggucaagggcacgcugagacgccaugacgaccggccgcaggugcuguacuaugcaguuccuguaacugugauggagccccacauggagucccugaacccuggcucggcaggccccaauccaccccucaccuuccacacccugcagauucgaucccggggugugccuuacgccuccugcacugauaaccacaccuucuccacuuuccgguagcccuggauaugggguuggggguaggugaggcuggggcuuucuacagaaaauaaaaugcuggaauuugaagcua

SEQ ID NO: 12240 - RNA, 28446 nt, Mus musculus
cggcuacguggcggagccggcggaagcaguuccugcgcuggagcccgaguguuuguguuuugguucgugaggagccggggcggucugaggggaggagaccgagggaggaggaggaggagaacgacgacgacgaggaagaaguccucggaacucgagcgcggcgacucuggaggaggaggagaaaggaaggcggaacggagaggcggagacgcagcccggcaggggcggcggcacggcgggcggcgcucagagucccgcgccggccagggugagaagaaggagcgagcaggcgacgccgccgcugcagccgcggcgcauccgaucuccgggccgggccgggccgugcguggccucgcugccgggagacgcggcccagguaagccgccgucggggcgggucccuguggucccgggccgggcuuggggccuccaagccgccgcgggcccucagcgcuuagugacucauucuucuagcagcuucggggccugggacguggggaauccucugagggagcggcggguggcacccucuucccuucacaagauggcgccgugggaagagccuggggcccuggcggucuccagcccggucuuuggggcucugucccggcuacugagccggaucgcauccggggugacggggguggcucaggagcgcgcccaccaggcccagcggagcuccuggccccggcaccccgguuugauuucucggcuucuuccagacaggaacccaggccuccagcagguggggauuggggagcuccgccuaccucugaccggcuuggccgggcugugcgaguagugggauccucuggucccuuccgugggaggugggaagcccgggccaaggugcgagcagguuaacauccuaacgccuccagaaguuuaaagcuuugacugucacucuuggcauauuaguuuuugccucgccgaaauggauuuaaaguucugaaucaguugccuugcacguaacuaauuaaaaaaaaaaaaacuguuacaucuuccagaauauugaggucugcccagaaucguucuuaauguaaaauuugaacccgugggguugugaacaaaguaggcagcacaacagugccuggcacaauuuaagggcucagugcaauuuuuuuaaucaaagacuuccuaacuguauaaaaaaacuauuuuaaagauuggagaugcauauuaugcaaaaguuuucuuugacggaauaaaaguacaaguuauaagugcagaaccucugugcacugagcaguagcuucacugaacacccccagcccucgcacuuaacauuaauaccauguucaaccuguguagguuuauacuugggcuuauuuccguuugaggucuuuggaaguaaaagauuuaguagcuuugcacuuuaaaagacacugacugugaaggcaccccgccugucaucccagcacucuggaagcugagguagguaggaucaggaguccaggccauccguaaccuauccugugcuugccuaggcgacaagucccugucccucaaaaaugugaucgggauguggggcaggaaacaguuuuuaaaaacuaaguacaaaauuuuguuuguauuuucugugagaaucgauguuuucccugagauuuuggaaguaccauaggaauacagaacaaguuuuguccuggauaagucauuuacuguuuuauagguaaggaacaauugagaaacauuuaagcugaagguauguuggugccuuuuucagucuguaugaagucuauugaucuacaagcauuaauuaauuaacuaauucaccaagaggccauuuuaauugccaguuucaaacacuguguacuuaguaagcacuguaucagagacuagauauguugucuuauuuaauucuuaacaguugcugugcaauguuaggguauaaugaauauagaaaauuugaaaauuaaaacuuagauugacauagcugagacuagacuucagaaucugguuuguuuuauggauuggggagaaaugggaauuuugcuuaauuacuuuugacaagcucucacaguauaguucugggugacuugaaacaugcuuugcaggccaggcuaacuuggaacacacagccauucauccaccuuuuucuggcccuggagugcuagaauuaaaaucuuggcccacugugucuguuguuuugagacaagccuugcuaaauauuucugacuggcaugcuucugucucagcuucucaaguucuaggaccacagacaagcuccaucaugccaggaugaaaugguaguuuuauuuaugugcuguugguuagaagcagcucaaacauuucaucuguaaauguguugguauuuauugguaaagauaggaacucuucaaagcuaguaacuagauuaggcuagaagaugguaucuuaaaaacggagcugggcuugguguggcauaccuuuaauuagagaacucaggaggcaaaggcagauguacugauugaucucugaguucagggacagccauggcuaaacagagagccguugucuuaaaacaacaaacagauagcacggagaucuuauggauauauucguuaaugaauuugucauuaucaaguguuccauguauuaauucaaauuuuauaggaaauauaaauuucuauaauuaaguauaaauuaaguguagcuuuuggucaaagauuuuuuuaggaagaaaauccuuaguauauuuuguuuuugauaagcuuauaacccacauuuaguauaugcgugugauguuugcauguguauguauuccugugugaaggaaugugcauuucacagcauuuucauggagaucaaagggacaaccuugguccucaccuuuucaccauaugugcuucccagaauccaaaucuaagcuuauauuucaagugcuuuacccaguggucuuucucuuccuccuuuuuuaaacaaaguuuuuugguagccugggcuagccuuagaaggacuucacagcccuccuuccuccaguucucugagugcugggauuacaggcucccccccccccccaaucuaggcuccauacauuaauaagagguuggaguaaaauauuaagguugacuugugaauaagcugaaaggguguuucaaauaguucccaguucuaccaaaacuagaugucugggaauuuugcuuaauuacuuuugacaggcucucacaauauaguucugggugacuugaaacaugcuuugcagaccaggacugaagaagccauucaauguuacuuugugacacccugucuaaacaggagggaagaggacugucacucagaccagcuuuuuccaaauacauugcaaaacagaaaauaauauauauauucuuagccucaaaacuguccccaaauuacuguaaguaaauaagucacuccuaauuauaccaaauagagaaauuauuaucagcuaggcacacggucaugggaguuaaaaauuauuuggugcuugggaauuacuauuaaaugaaaaauguaucacuuaauggaagucuucagauaguaaacccuagacuuguucuacaaucuuuccauucacuagcauaauuuccuucaaaauaacuuuuaaguauuaugacauuagaacguaauuuuucuuuucugucugucugucuuucuguuguucuuucuuucaagauuuugguuuuaguuuuaguuuauaugucuauggguaugugcuuaugaauguuuggcccaaaaaguccugaggaggaugucagaucaccugaagcugguguuaugggugguugugaaucacccuguaaauugaguccuagucaccuagaguuggaguacuccuacuaaagugccaucucuccaguaccuagaaucugaaugcuugauugacaucucagauugcuuugucacugugugaucucagugaaguuacuuaaccuuucaguaccuguuuucuuguuuauaagaauuguaauggcgcuugauacuauugacuugacuauauuaaguguguagaauacuaacucgucaaguuguuuguucguuuuggaccuagagcucgcuguuugcugggcgaacacucuucaguccccagcuccaaagucaaauuguugaagguuaguugcuguuuaguuuuggaaucaggucuuaacuuguuauccauggcuuugaguccugccucagccuucccaaguuuggcacugcuguugccaccacacccuacugaaagcuuacaucuuuccuuuuuuccuuugucuugguuuauauagagagagguggcuaaugggugacauuuucauuugugucauuaaauuuuguucuuccuugcauggcccccacugcuguucuuugucuuccucucuuacccuuucuucuguagauuaucuuaccuucugcuuucacauauuccauuacuuucucuucuuccaagcauuuuuuuuucucuucguuuagauuucucacaaucuuuuugaaguuuaacuugaggugauuuuaggcucaaauugugugccauuauuucucuugaaaauaaacuaaaugauacuggcugucuauaguuaguugguuauuacaauacagugaguaaacuuacuaaagugacuacugauuuacuuaguuuugauuuauuuacuuaguuauuauuuaugucuccacagguaauuucuccagaaagaaaacaaaauuaaugccuugcauccuggaaguucauuuaggaaucugaaauuagggacuucuuuaaaauuuggacauggcuaaucgaggagcaacaagacccaacgggccaaauacuggaaauaaaauaugccaguucaaacugguccuucuaggagagucugcuguuggcaaaucaagccugguucuucgcuuugugaaaggccaauuucaugaauuucaagagaguaccauugggggugagauucuuauuuucuuuuuaaucauuuaacugaaucauacuaauauucuaaaugugauuuugaauaacuaaauugaucaugcagggaagaaaaaaaguuuuaggagaccucaaacuuuaaaauauacauuauuuugguguuuuguuuaaacaguguaccauaaacuauucugaaauuccugugaauuucucacuggcaugccuccaccuccuaauuauucuaauuacagauguaauccagcccagcaugguuuuuuugcucaaacaauauuuaauaccaggaaaaacaaacuacaaaauugaaaccuuguuuuauuuagauaggaaaguuuuccuuuuaagacaaggucuugcccuauagcccauguuuacugugaacucuuggcauuccuuggccuaccaaguauagggguuacagauuuaguuaccauacauguuggcuuauuuuauuuuuugagucagggugucaaaccuagcagagcuuuauuucauagguuuuuuugggagaguaagauaugagugggacauuaauaagauaggauuuauacaaccuaggcuggcuuggaacugaagcuagguaguuauggaugacuugaauauuggucuucuaccuccugaauguugagauuacaggugggccacgaaaacccgugauuguggugcuagggaugaaacccaggguuuuguacaugcuaggaaagcaaaacuaagguaugucucuaggccucagcaauuuuuaacacaauuuuuuuuuuuugguuuuucgagacaggguuucucuguguagcccuggcuauccuggaacucacuuuguagaguaggcuggccucgaacucagaaauccgccugccucugccucccaagugcugguauuaaaggcguauggcaccacucccggcuaacacaauauuucuaucuuuaauccuccagugcauacuacuugcauuaaguuagggaagucacauguuaauuuuccucuuauaugaaauguaaaucucuagacacagaauaaauugucugcuaaacaaauaccaguguaauuguugcugaguaauuuuuaggauuguuaauguuauauaauaauguuuuggaugacaccugauuaguauuugauuuaaaauuuuugauuaaguaggggcuggagagaugauugcucuuccagaagaaagaacuuuaggcccauacuuuauuuagaccagugguucucaaccuaugggucaagaccucuuugguuaugagauuggauaugagauugcacauaucaaauaucuauauaucagauauguauguuaugauucauaacaggagcaaaauuauagcuauaaaauagcacuaagaucauuuuaugguuugggggucaccacagcaugaggaacuggucacagcauuagaacaacuuucuggagcugccucuccuuacacaguguuuccagagcucaaacucaggucaucaggugcuuuuuuuaacccacugagccauuugccugcccuaaaauuguuuuucauuuauagauaacacaugauaguuugauucaauugucaaacaguauauacauguaucaaacugucuuuuuugaaguauauuuaacuuuuguuccuccggcauaacuguguucugucuuugcuggcuggggcagugaggaaaugaaaaaacagauuauggacacauagaaauagcugagauugguuggagugugaacucuagagaaaaaaaucacagcacccccaaaagcucagcauauuuauuauagaguugaacaaggaaguagaguuauugcauacagcagaucaaggaguagagguuauugcauacacauuaacaaagagguuucugguauacaacuggaucaaggagacagguuuagcuaaucuucaaaacagaaauguuuguaugggaacaguucucagacuauaaaaaucccaaggggaacaaacugugaugggauuuucuacacacacugucaaagcuuauacucagcauccccaaggaaggcuuugcuguuccucucagccuaaggcuaaggcuauuggaaucuuuauaugacauugcccaugacauaccaugucaacaauacacauucacuucacugcaauaccuuaauaaaacgagcaggaaaauaaguuuauucccuccuccccccaaaaaacagaagccaacugaaaauuuuacauuuuuauuuguuuugguacaggguuucuuuuuuuguuuuuauuuuaaagauuuauuuuauuuuauguauaugaguacauguacagcuggugugagccuucauaugguuguugggaauugaauuuuuaggaucucugcuugcuccgguugcucuggucgccccacuugcucaggucaacuccacuugcucagucccugcccgcucaggccuaaagauuuauucauuaaguacacuguagcuaucuucaaacgcaucgggugguugugagccaccaugagguugcugggauuugaacucaggaccuucggaagagcagucaguguucuuaaccgcugagccaucucuccaacucccccccccccuuuuuuuuuuuuccucguacaggguuucuguagcacaagcaagccuggaacucacagcaguuuggccuuagccuccugagauguggcgccacacuuagcuuucacaaugucagugguacugcuuaguuaguuggguuuguuuagauaggaucuuauguagaacaggguggccucggacucacuguagcuaaagcuagccucaacugauuguccugccuccacuacuuucugggacuacagaugugugcuacuaccaugaccugcuuuuuguuaaaacugcuuuuucauaaaaugauagaagacccagaugugggaaaggggauuauuauuugaaacaaggaugauucagacuggcccugaacccuaggucuucuugagagcuagaccuuguauaauauauugcauucauaaaaacaaggaauacuuuuaaaauacuuaaacuguuucuagguuuguuguuauugcucuuacuguuuggcuuugaguuuuuuguuuggguuuugagaugaucuccaucuguaggucaggcaacuuauaguuagcuuccugccuaaacuucccugagugcuaaagcugaagaauuuauucuuuuacauacaucuaacuuaguaguuuuuuaauacaaaaauagaauuacuguaugguguccuugguuuuaagugaaagaauauuaucuuaaugggcaauauuauuuccucuuagaauuuauguccauggguuuguagauuguuuuggauguugguagaaauuugauuuuuuucauauuaguuugugccacucaggaccuaaggagaugauggugguggugaugaugcaguaguuauaguaucaguccucugaguuaugcauucaaaauguucucuguguaauugaaauacuacuguugaacaggauuaaugacaauccuaugcccuuuauaaacauuuuggcccuguuuacauauuuuauaaaugaaguauugaacuggauaaagauuuccaaagaacaccuuuucuugauguuucauuuuguuuauaguacuggagauugaaucuagagacucauguagacuaggcuaguacucugccacugugcugccacauucccagccacagguguucuuuuaaauugcaugugaugguguacacuuaaccccaacacuugggaagcagaaguaggcagaucugguuugcagccagcuuguucaucaaagugaauucuaggacagccaggacucacagacucugucucaaaaacaaaacaaaaaauaucgagguuauauucagugguaaaguguuugcuuagcacucauaaggucuuuguuucaauccucaccccacuccacccccaguaucacaaaagauagagucacacauauucauagguaauaugaucaauuguuuaucuuuuguaucuuuuuuaacacauuuuuuauuagauauuuucuucauuuacauuucaaauguuaucccaaaaguccccuauacccuccccgccgcccugcucccuaucuuggcccugguguuccccuguacugggccauauaaaguuugcuagaccaaggggccucucucuccaaugauggccgaguaggccaucuuuugcuccuuaugcagcuagagacuugagcucuggggguacugguuaguucauauuguuguuccaccucuaggguugcagaccccuucagcuccuugggugcuuucucuaccuccuacauugggggcccuguguucuuuuguauccucuuaaaauuaguugcaaguagucguuauuaaucaugaguauuaguauuuugucucaguguugcuaggguuaggaagcuggcacuggucaacuauuugaaaauguucagcagaauaacuugccuaaggaccucuaacccagugaacugccucuguugguucacuugaccauuuuguugaauacuggggcauaguagauugucugaaguucauucucuacuucaaacacuacuacuugaaaucauguuuuagcuguguaugaugaaugguacaugccuauaaucccagcacuuggacgauggcaagaggagaaguucaacaccagccucaaguauguaguaagcuugaagucaugucuccugaaaaaggaaacaguaauuuaagacauuuuugugguugauuuguuuuuguaucaggguuuguuacagcccaagcugaccuugaauucacuguguaguggugagcuguuccuucuacuuuuacuuccccaaugcuagaauuagaggccacuugaguauucagugcuggggacugaacccacgauacgugaugaugcaagcuaccaccaccuaaacugcauucucagcucuaguuggaaguuuuuugguuuuguuuguuuguuuuguuuaauuaguauuuuguaugagucauuguggguauuugagugcagugguauguuuguggaggucagagaacuaauucuggguguuaacuccuuacuuuugccucauacuccagguauagaacucaggcuaucagguuugugugccaagcacccauggccauuuugcuggcccagauuuuuguuuuuaucagcuaucuugauguaaagcauaaacucuagcuauuuaauugcugacccaucaaaauuuuuguugguaucauguuuuagacuuuuuucuuuuuguguuguuaacauuaaggauuaaaccuagugcuuuaccuguccuaaacaaguacucuaccucugaauuauagcagaaguaggccguucuguccaccuuauuuuccucuuuguuuuuaagacagggucuuugaacucacugugauucagagcaagacuugaacucuuuaagagcagaaucuuccucccucagcuaccagaguagcugagauuuuauuuuuagguccagucauaucauuggacuuugaagauaaucacaguacuuuacaaaucucuucacugcuuccuucuuuaaggugguuuguuuguuuguuuguguuuguuuuuguuuaagauuuauuuauuuauuuauuuauuuauuuacuuauuuauuuauuauguaugcaguauucugucugcacguaugccuagggcaucagaucccaguauagaugguugugaaccaccacuacgugguugcuggggauugaaccaaggaccucuggaagagcagcuaguacucuuaacuucugaaccaucucucuccagucccaccauucccuucuugauuucuuucucuuuuuuuucccccuccuucccuuuauuuugagacaaucuugcuguauagucuggacuggccuugaaaugcuuuuuuuuuaacuuccuacuacugaaaugacagagaugggaggaauggcacucuuuuuaucuuuguaauacaaaacaucaugaaauaacuacauuauagggcuauauugcauuugcaucuaauuuguaaauuucagaaagauguuacuuuauagaagcaauuugaccuauuaagacacauaccuacucaugggacuuagaucacacauuuucgagucucaucauuacauuagcauggcuguauaaaaacacuaaauuuuauaggugaagaaaccaaggcaguagcuuccauaaguugccugaauuuuugcaguuaauucaaagcagguucuucagugcgacuguuguauaauugcccaugugagguuuuugguguuacugguuuugguuuauuuuuuuugguggugauguuuuuguuugguuucuugguuuuguuuguuuguuuuuugcaagcaguugagacuagaaaaucaguacacauaacaagcauuauguugugcaaccaaauauuugaaaguuauugacuccucuuuuuaugugucaguuaaaauaaugugaaaguacuuucaagaaacuuugccuuagaaaagggagguaaaagggcuagaugugaugacguaugacugcauagugacauccugccuaaaagaagaaaaggggguagggagauaaauaagggaguuaagguuuccaguaggccuccaagauaccuaacuucauuguuuguccaucgagguucugauuuucugcccccucccccaauuugguuuacaacuucuguugguuuguggguuuuuuuuuucaagauuuauuuauuaauuauauguaaguacacuguagcugucuucagacacaccagaagagggcaugagaucucauuacaugauuguaagccaccaugugggugcugggauuugaauucaggaccuccggaagagcaguugguucucuuaacuguugagccaucucuccagccccaguuuacaacuuccacagcuauacauuauuuacaaauuaucuuuucaugugguucuauguauggagauuggaugacuugcacuuguucucuuccugccaccauauggauccugggaauugaacuuacuuguagcaaucuggcuuuuuauacuuacuucagccuagguuuuccuugacaacuuaauagcugaguuuaagcauaaguguuaugaaagaauuagguagaagcuagagaccuuuuuaugaccaagcucaaguuacagggucagugccagucuuguaagaaaauuguagugugacaccauauaauguagguaggucucuuagaacaugaaaucuacuguaagaucuuuuuuuuuuuucuuuuuuuuuuuuuuaaagauuuauuuauucauuauauguaaguacacuguagcugucuucagacacaccagggagucagaucucauuacggaugguugugagccaccaugugguugcugggauuugaacucuggaccuuuggaagagcagucgggugcucuuacccacugagccaucucgccagcccccuacuguaagaucuuaacagaagagcuuccucaguguucuuuaaaauaguuauaugucuauucuauuuuguuaguggucacaauucucaguguucuuuauuauucuauuuucuuuuauaccuugcagucccauuuuuuuuuguuguuuucuuauuuucuuaacacccccacacacacacacacacucucucucucucucucucacucacucacucacucacucacucacucauucccucguucccucccucccuuccugccuccaucccucccucccuggugcuggggaccaaaaccagggucuuuguaaguuauauguaaaacacccuacugcugagcuguguccccagcuccauuuaacccucucuuuucuguuugcaguuucagguuacaauucaguaguggaugucaucuucaaauguuugccccugaacuuauuuccguaaugugguuauugcauauggguauaaaaccaaaagaagcuuuaaugacugagauuuaaaggguuccugucuuuucauaaguuuucucccuuagaacacuucuaguuuuuaugggaaucuuggcuuaauuccuguaaguaccuguaacuguuaaucugauagauuugggagguuaauuucauuuguuauuuuggccugaagcucaaaauguccucacacuucagcuucccaaguacugacauuaugugggcaugugccaccacccacaucauuuaucuaugcuguucccuaucuuuacuggcucaaguaguguaauccccgcauucaggaaccagaggcagguaaaugacugucaaauuuagggucagacuggucuuuauaaguaguuaugggccagccauaguuaauuacauagcaaagcccuaguuuuauuuauuuaagauuuaaaauaugggcugggagauggcacagcaguuaagagcacugacugcucuuccagagguccuaaguucaauucccagcaaccacaugguggcugacagccaucuauaaugauaucugaugcccucuuguggugugucugaagacagcuacaguguacauaaaauaaaucuuuuuuuaaaaauuuacaauacauaugaguauuuuguuugccuacaugugucuuaaguacacuaccugcaugccuugugccugaggaagccagaauaagaccgcauuggaugccuuccaacugccauuauaagugguugugaacugcacauaggcacugaaacugaguccucuauaagaguaacagacacuccuaaacaggaucuaucaccccagcuccaaggccucauaacuuuuauuuuuugccacuuacauuuuguaaaaaaucucaacuuguaacaaaauuauuaucuacaucuaaagugucuguagacuuuuuccacauguucacauauagcuaugaccccucaaagcaagcaaguuaauuguauguacuuuuucugugaauucauaugauaguauuuacuuacuaggcuuggcuuuuuuuuuuuuuuuuuuuuaaaccacaaggaagaccuuauugccagaugaacagaucaagaaacagaauauuaugaaaugagcuauuaaugggcaacagauaaguaauuagaugacaagcaaaaucauuaauucagcauuuuaaaauaucucuacuuuauuaagauacuauuucuacucuccuuguucugcugggaauuagcaucaagauauuuacuagugcuccuuugcgcucucagcaucuuuccuugcuuauaguuuuuuuuucgauucucuucuuucuccauuccccuuucucauuuuucuuaucccccccccuucuuuuguuuucguuucuccuucucauaagaaaaaauacauauaaaauaauaaaacagucaagauaaacaaauggugauuaauucugugauuguuguuagcaccuuucugugagcccaaauggaugauggugaucuugaacuuuugauucuuuugcccucccuggcgcucacugauaggauuauaaguguguaccaguaugcccugguuuuugguaguggugguggugguggugugugugcaugugcucaaauguaugucugcacacagugccuauaggggccauaggagaauggaucccugguauuguaguuacagacauugugaacuguccagugggugggggaauugaacccaguccucuggaacaaugcuagggcucuuaagcacuaagucaucucuccagcuccauuauuucuuuucuuuguaacauguaccuuuauaaagacaagacucacauuauaauacuggcugguuuugaacuugagacaauccuucugccuguccagugccaggauugcaggaguauaauagcaaauaauaccaugccaaguacuaaguuguuuuaguauauauuuggguaaucaaguguaagguacuaaauguuaaacugaaaagacuaauuuuaaaaucauauccauguacuagcagacucuuuacacuuuuaauucuaguacauaggaagcugagcuaggaggaaauccuccugucuauacuuucaacugaagacgaucauaaacauuggggaucauaccucugucuccuuuuuuucucucuuuacaguauggaagauuggacccaagccucuacuacucuucagcuuagccaguccaucuuuauuuauugaaauaggaucucacuguguagccuugacuggucuggaacucacucacuguauauaccaaacuggucucaaacuuaucaaagauucaucuaccucugccuccugaaugcuagaauuaauggcaugugucaugcauggaacauccauuuuuugauaacuucaguugcauccauauuuuaacuauucuauacauuacuguuuuaagcauugauauacaaauauuauuugacacugcuuuuuauuaauauugaaucugugggaccuacagaggucagaagauggugucauauuccuuggaacuagaguuaugaauaauugugagcugcuaugugagugcugggaaguaaauugaaucuucuguaagagcaaugagugcuucuuuuuguuggaccaucucuccagccccaucuuuguguuguuugaaaaauguauuuuugagaaggauaaaacaccguagacaggccagcauagaggcuuuugauguacacagggucucauuguguaguugagaugggccuucaacucuuuauccucuugucucauccucccaagugcuuggauuacaggcauguggcacccaccgugcuuaguuuagaaacuacgcuaaaaauuacauuuuucugaguguauucaccugugcauuuuggaugcuucaaaaacauagggucucagguuuguuuguauaguuaaauccagucuuacagauuuuaguuguugcuaagucuaauaagguaauuuugaguuaaauuugauaccuaacuuggaagccuggauguagcuuagugguaguguguggcuaacaugugaaaccuugagugcuauccugagcagcaguacaaauaacuaucugggguagaguugaauuaguuuccauaguuuuugucuuuccucuguguuuuauuggggcaguuuuaggagagauuaacugcuuuuuuuguuauucuuuugccaucaguuuggauauuuucuccccccccccccaacaguaccgugugaacuuggguauuuguagacuaagugguuauaguuucagccaguauuuauuuaguucauuccuguaaucccuaacauuuaggaggcugagucgucugugacauaguugaaugugaugcuaucucuaaacaaaacaaguaaaauaaguagaagagaguaaggcuggucagauacagaguaguugccuagcauguuugagugccccaacaccagaagaaucaaguauaaagcaugauguaaaaagcuuugggaacguaagcagcagaucacacagaguggacaaugagcuguucuugcugugguuccuugaguccuguuacuuuccaggaaauuucaccugcuuguucaguguuccauugugcaacuacuagcucaucacaagucaagaacucauguguuaguuaagcugauaacuggagguuuaaaauaauuuccaauaacagcuuuauuauagagaaauacuaguauuaauacuaaauuauagugauguggacauuaucauucacagaaucagaauuccucagagcuuuggaauggcucuagguggucugccaguuucaugcuuacagaugggauaguugcuguguucuuuuagaacugacuccaaugcuuuuuacaaguuguauaaauaaaagccauuuuuguuuuaaacuguuauuguaaugguuuagugcuucugaaaagaacucuaauuugcugauguuauuauuguucuuuugauguauuuaauauuuaugaagaagguugguugccuuuuacauuuuuuucuucucuuuauucaugugaguauaagugugcaugugccacaguagcaaaggacaacuuuuuccuucaugaggguuccaauaaggguuggugguuguuguugcuguuguuuuguguccauugagccaucuuaaugaccgaguuaagugguuuuugguauaacuuaacugguuugaaaauuggacugggcuuucauuaaggcaguguaauugacaguuaucuccaugggcuuagaauuguuucuaguuaugcauacuuuauggggcuuuuuucuuuuguuuguuugguugguuugguuugguuugguuuuuguuugguuuuucgagacaggguuucucugugcagcccuggcuguccuggaacucacucuguagaccaggcuggccucaaauucagaaauccgccugccucugccucccaaaugcugggauuacaggcgugugccaccacuggcaggccuggugcuuuguuuuuuggauuuuuuuuuuuagagguagggguguugaacaggguauuauucuguagcccaagcugaccugaaacucccuauauagcccaggcuggccucaaguuuguaaaaauacuuuuugugaaugcugaaauagcaggugcuauucaagcuuagcuuuugacuuuuugagauagaauuuuauucugugucccaagcaaucguggaacucaguagauuuccaaagcuggccuugaauucacagcagucuuucugccccagacuauacugaaugcugauaguacaagcaugggcugccacaguagucuaaaauggaauauacuguaggauauauucuaguaccaaacuuaaagugggaauguggggaggguguaguggaaauggcuuguagagaaacugagggcucauacaugaaccagacuaaauuauccacccuuguuaaccacuuuaaaggcagagggaaaguggagccugaaaaugagauggacuaacauuucauguaauagccaacuuuauucagaauaacaggugauuuauaccuuaagggucaaaaaaaaaaucacuugaguaacguucuuauggaguucuuaugaguucagauucuccugagaucacaaggacaagaugcauauggggaaaaaaggggggaaaacuuuacaguggggcauauaaacaaauagcaauagccaguuguaauggauuaacuaaaguaaacugaauccuaucuacuacaccugggagggaaacgcuaacauaagccaaaaacaauuccuuguuuuuuaagaaacugaggucacaagacucuggaguuaucucaaaagcacaagagcauauagcuccauucauggaccauguucuuacguguuuauguugauguauggaucugagcccaggcuaggcucaaauucgugauucuucugcuuccagugaauaaaugcugggauuacagguuuguaucuccauacugaauguaaaguauucuuuaauauagguagguacuguuuguugaaauuagaaucagaauaggccaagguucucaucacacagccugaccagagaucaguguagcccacacaguggagggaagaacccauuccuguaaauuacccucagaccuguacacauauguggcacacagaagguuuuuaaagauucaacgucaucuuugguuauacagugaauuucaggucagccuggccuucaugguuuuuuuuuuuuuuuuaaguugaaaaaaaggauaaacuuacuauagauauuuucuuuuucagcugccuuucuaacccaaacugugugucuugaugacacaacaguaaaauuugaaauaugggauacagcuggucaagaacgguaucauagcuuagcaccaauguacuaccgaggagcacaagcagccauaguuguguaugauaucacaaaugaggugaguauaacaaaaucuuacuacucuaaagccaguuugaauaaucauuuuuguuacuuacaauuuggcuaaagauuuuugggaaauucauuuguagcuagucauaacauuucugccagagcuuuuuugugagugaaauauaaaaugaaagugccuuaaaugacauaguacuaaaaacuacaaucuucccacagggucacccuagaguagugguucucaaccugugggguguaaccccuuuggggaucuaaccacacuuugacagagauugccuaagaccauccugcauaucagggguuuuguuuuguuuugguggguuugguuugguuugguuuuugguuuuucgagacaggguuucucuguguagcccuggcuguccuggaacucacucuguagaccaggcuggccacaaacucagcaauucgccugccucugcuuuccaagugcuggaauuaaaggcaugcgccaccauaccuggcuguguaucagacuuuuacagcacauuucauaacuaacaaaauuaguuaugaaguagcagcaaaauaauuuugugguuggggucaccauaguaugaggaacuguauuaaaguuuuuagcauuaggaagguugaaaacaauugcacuagauucuauaagccuuaucucauagagaaugcuuucuaacucuguuuugagcuuaugccaaauagccuuuucuuccuuuuaacaggaauccuuugcgagagcaaaaaacuggguuaaagaacuucaaaggcaagcaaguccuaauauugugauagcuuugucaggaaacaaagcugacuuagcaaauaaaagagcuguugacuuccagguauguggaauuuuacuuuuaaaucaaaaucuuguuuuaaaguaauuuuaaaccuuaaaaauacagauuuugaaaaaacauguaaaaccguaacaaauaaaauauuuuuccuaguggggucagggauauagcucagaugauugauagauagauagagggagcacuugccuagaguguauggguguuuuggguucuauucugagccauuguguaaaucaggcaugcaugguagcaaacauaauaucaggggaaauagauggaagaggaugaggguggggaguagguaaagacagccuuggcuacaugaaacccugucccuucccaaaaagaauuacaugaaagauuacagaaauacugcucuguaccuuccaucccuccacuccaaccugagaaaaaguuaauguucuuccuaccuuauauacacauauacuacauauauugcuacacaaacacacaauuacguguauauaugugugcaugcacgcaaguccuuaaaaggcaauuaaaaaauagagacucagcaggucgugguggcacaugccuuuaaucccagcacucaggaggcagaggcaggaggauuucugaguuccaggacagccagggcuacacagagacacucugucucagaaaaaagcaaaaaaaaacaaaacaaaaauagacucagcuacucuuuauuugagacccagcagugugacucagcauguaaaggugcugaguucuaugccuagaacccaggugcuggaaggagagaaauguaaauuguccucugaccucccuccacaugcaugcuuacuggcauauaccuaccccaaacauauguacauacauugcauacauacauagcauacauacagauauauaaguguacuauguauguauguaaaaauaauaaugcuugagucaggcauggcaguguaucccuauagucccauuacuugggaggcagagguaggaggaguauugccacaaguuuuaggccagccugaucuuaauagaccuccagucuguauauauuuaagguaauuaauucaaaaugccuuccacuauaaaacaguaaaugcuacucauauuuacaaaauuauuuauauuaaaacuauuucuuuugcucacauagcucuagcuguggcccaauauguagaugaggcucuuuuuaugacauugcuagaguguagauagaggaagcuacuguaucaugguguauuaagcagagcauuuucaguuguaacuucguuaauucuuacgaugaccgugugaagucugcuaucugcuaugcuguccaaaacaauuacacuccucagcaaaacaucuuagagagcuucaguuuuguucagaagugggccugugcuguaauagcucaaaggggccucagguguucuaagaggaucaaaggcaacaauauagguaaacuggaaagcaugacagaaauguagggcaguuuguaauuuuaagggaaauaguucauaauguaguuuaaauuuuaaugcuguaugucauugaaaauuuaacaugaggacguaauucauuaguugccagugcuaagacauuggguuuccauauuuauuacaaaaucuguauuuuuaaaagauguaaguagauguugccauuguguuugaagaggauuuaggguaaaaugauacacugucccccaauuauugugacuaggguuaaucuuagaucugaugaguaaggguagaauguguaaaacguuaagauaaaaaaguauucguggugaauuauucuacccauuguuucuuccucugcaacagcauagucuccacuuguuaguaauagaaauccaauaagaaaaucuauaaaauaaacuguauacaguauaugcuuaaggguugguuuuuuuuuuuaaacaggaagcacaguccuaugcagaugacaacagcuuauuauuuauggagacaucagcuaagacaucaaugaauguaaaugaaauauuuauggcaauagguaagcuuaauaucuaaugaaaagcaauauauacugaauguuccucacccuucuuaaaucuuuuuuuuuccugauuauacuauuuuucuagguccuuuucacuaagcaauaucuucuuaggaauauugcaaagucugguugugaagcaggauguaguggccagccugagcuaaagacccuuccucagaguuggggaagguuaaaaaagaagagauugauuggaaguuaggagguccacgcugucuuuuuuuuucuucuuccuccugcuccgcauccuccgucuccuuccuuccuuucuccucuauucuccuccuuucucuuuccuccuuccuuucauccuucuuucuuccacuuccuccuccuuuccuuaacuuuuuuuuccucuuccaguaguaugaauuaaacuuagggccuccaauuuucuaagccgccgucuauaccuuccacugaaguaaccccauugcuagccccauuaaugucgauuuuauacucauucaugaauucagugaguguuggguuauauaauagaggugaauuaaaaguugaucuuacagauaagagguagauuuuccaaagguagauuuacugaaaaguaacaccucuuauuuguaaggaauauauuccaagacacucuggaugccugagacaguggaucauguuaagccgucuaauuugaugccuuuucuguccuaaguauacauuacacacacacucaccauaacucacacaggugaaaaagcaaaacuagcacagauuuucucucccaucugggaaaaagaucagaccccugaccuuaaaaaugguaggcaggugguguauugcugaaauuauuaaagauuguuuuccugagguuuuuauugaauuugaguucaaguuugggcuugguaugugucaaggcuggauuagaacaugggguuguugggccucagauuucagaguucugguuauaugggguuccaccaggucugaccuuuuuuuuuuuuuuuuuuuuuuuuuuuuuaguuuuuccaaacaggguuucuguguguagucuuggcuguccuggaacucacucuguagaccaggcuggccuugaacucagaaauccgccugccucugccucccaagugcugggauuaaaggcgugcgccaccaugcccaucgagacagggucucauacugaggaaggacuuguauuggugcuuaacuuaggguuguuuuguuuugcuuuguuuuuuccagagcugaggaccaaacccagggccuugugcuugcuaggcaagcgcucuaccacugagcuaaauccccaauccauuaacuuuacugcugugaagagaccccauggccaaggcaacucucacaaggacaacauuuaguuggggcuuacagguucagagguucaguccauuaucaucaagaugggagcauguuagcauccaggcaggcauggugcuggaggagcuaagaguucuacaucuucaucugaaggcugcuagcaggauacuuggcuuccaagcagcuaggaugagggucuuaaagccacacccacagugauacaccuacuccaacagggccacaacuucuaauagugccacucacugggccaagcaucacauuucacucccaggcccccauaugcuuguucaaacauaugaaucuauugagaccauaccuaaacauaacauaaugcaaaauauauuuaguccaacuucaaaagucccgauagucuauagcaggcucaacaguguuaaaagcucaaagucucuucugagauucaucuaaucacuuaacuguaauccccaaagcaagacaggaaaucagcugggcaaacucaaaacucugcaacuccaugucuguuucagggcagucuucagauuuccaacuccuuuuucaucuuuguugauugcaacaaacuuuuuucuccugggauguuuccauucccuuagcagcuuuccucaguagauagcccauaacucuggcaucucaaacaucuuggggucuccaaggcaacuucaguuuuugcuagucuccucuuaauuucauauagguuccagguauggaacugaugucaugaagcuugguggcaugcaccuuuaccuccugaauuauccugcuaucucacuuuuuuuuuuuuaaagcucagauauuucagugaaaucugagcacauuggaaaucacaagcucuuucuacuccucaugaucuaucuacccuuacugcuagaguuacguauucauguuuuuacauggguggugaggacccaaauucagaacuuaaugguuaaacaaaaaacucacuaacugaaccugguuuguuguuguuguuguuguuguuguuguuguuuuuuuuuccagacagggucucacauauagccaaggcuggccuggaacuccaaauccuccugccucagccucccaauuacuggaauuacaggauggagccaccauucuaaccugggcuacacuauaggcuuaaguuuaaaacuuuuagacuauagaaguagcucugugguacaguguuuguauuguguuccugaagccuggauucuauccucagcuucuagauuucauuucagauuaaacuauuuccuuucuauaaagaaauaccaagcuggggcuggugagauggcucagcggguaagagcacugacuacucuuccaaagguccugaguucaaaucccaguaacuacaugguggcuugcaaccacuuguaaugaaaucugccgcccucuucugguuugucugaaauaaauaaaucuuuuuuuuuuuuuaaaucauaaacuuuagaguacaaucaugagauguuacaucuauaguuguuagaaagccuauguuuccauuacaaucaucuacuuuaaaaaaaaagaaaaaagaaauaccaagcuaagcugugguggcacaugccuuuaaucccagcacuugauagguaaaagaagaugggucggggcuggugagauggcucaguggguaagagcacccgacugcucuucagaagguccagaguucaaaucccagcaaccacaugguggcucacaaccaucuguaacgagaucugacuccuucuucuggaguguuugaagacagcuacaguguacuuacauauaaauaaauacauaaauacauaaaaaaaaaaaaaaaagaagaugggucuucaagugagaccagccuggucuacagaaugaauuucagcacagccaagguuacacacaaacacaaacauauguguuugggauuggagucguucuuugauaaaguuaguuuagcaaaucucauagaaaauaugguacaguccaauuaaagaguccuuacugaaguucauuuccuuccaccuccucaucugagucaggugugauuauagaaaguccauagaggagaaauuuaugcucauuccaaaacccaacuugguguugauuauaauaugauauauagugcuguuuuauucgguuuccuuaguugugaguccugcauccacucugcaacagggcuucacagcuugaggauacagaacacagaguuugacugcacucugugccaaacugggcuuguauuguaggaaagugccaaagcacuacuuguggugggaaagagcagucugagguacaagacagccagagcuaguuggggggagggaguggggggccuggucccaggcaaagccuucgaagaggcuggggcucuagacuucccaggcacuugaauacccaggcacauuuggaagugguggaagaacugagaacaguggggucuggggaggggggcugguuuuagcccugggcuagggagugggagcaggauggggagcuccgacuggucucaugggaagagugcuuguauugacugcaggcucaggcuuuaugguggucuuggcugggaaugcagagaggccuucuaugggagaugagacagcugcucuguaggcacaggucuucucuauggcuccccacugaggauccugaugagaaaagacagucuguaguucugaaucauauauugccaugguggaaaguggauguguaaaaccauaccccacuucucagggagggccugaguuuaaauaccuuuuacagggaggaguguuugggaaggauuggcuacacccuccaggucucuauauaccucauuagcauggaagucugucuugaaccuaugugaccaaaggucacguccuuuuccucaucugcauguggaggggcuugggcuguuucggggggugggggggcuacagcuaguggcaagggccuggugcccaagagcaagugaagcuccuaccaucucuucagggucucaggggcuucuagccuuagcucaaccagggaccagguuaccuuucaccauccucuucccauaccuaguaccauuguuaauccauuuacugggcauuacauguaaaugcaucugacugaacauuuaucauuauuauacauuaccgaaccuucucuagaguaauuucuaggaugacucaguggagucuuccuucccaagcaucagugcagguccugcuuccugaagcuaagauucuaaagauaauauugaugaagggaaaguaggcaaaauaaagggcuaaaaaauggcaagauggagguauauggcuuagugauaguuaacuuguguaauguguauguaagguccaggauucaggucggcauuggacauaaaacaccacucuuggucguauugcugcuuaguccucaggauaaagccaugugucuagcaggugaacuuuaguggggagcauauuccacauaaccaguauucuagcaauauauaauauagcaauuuauaauccacaaagcuguucauguguauuaaguauugguauuuguagaucaaaucaggguuugucauagcccaagaaggaaaagauguuauaagucguguaauugauuggauuacacaauaaaggacaaguuugguuggguugauuauucugucaauagaauuuguucacauccugacuugacuuagaauuauuugugauagcccagagaauguugcuguaaugugagcuucuuuauaaauuuuguagcuggccauggucuauuggcuuggauuuuaugugugucuugcuugguuuuguuuuucaaaauggaaaucuugauaugcuacucgggcuaguuuuaauuaacuuccuggacucaaaugauuguuccaacuccuucucuguacugaaucaugguaauuacagucaugccgcaccauguccagcagcuuguauauaauagacaguuaaugauuauaaaacacgcuaauuggggcaggagagauggauggcucagcgaauaagagcacugacugcucuucugaagguccugaguuaaaaucccagcaaccacauggugguucacaaccaucgacagugagauccguugcccucuucuggugugucugaaaacugaguguacuuacaacaauaaauaaaucuuuuuuaaaaaaaaaaaaacaaaaaaaaggcuaaguguagcuaagugguacuagacuucccuagugugcacaggacccaauacgacauaagaaaacugugauuucuaagggaauugauauaagaauuaucuguaguccuaguuaaauuuaaguuuaaaugguauaucuacaauuggccucuaccuacuacuucgaaaauacuaagagauuaaacgcuuuuaauacagcaaagaguggggauuauuguuuggggaagaguauuuuuauuuuuguggguuguuuggugcuuuguuuugcuuuuuggcauuuaguaaguaauaaaccuuugaaaagagccaacagucacauaaaacuuuggaaauaacccaacagggagaguauuauaaagaagcaggucuaagugauuuuaauaugaauaauacaauuuuauuuuguuuauuucucagcuaaaaagcugccaaagaaugaaccacagaauccuggugcaaacucagccagaggacgaggaguagaccuuacugagccugcacagccagccagaagccaguguuguaguaacugagcuccagugugaacuuccugaauggcaaaaaccauggaguugggagcauuuagccggcccagugugacuuccaaaaagagacuaugguagaaucaaguuucuaauucugaauuauuuugaguguuuugaacuuaauuuuuaauaacaugcaugugcuccuccagcaguagaaaggaaaaugaggacuguguguacacuuguuccaugugaaagugcaggggaacagcucaucuccaguggguauggacccacucuuaacccacccagucuccaaacugggauaauagucaggaaugacauguucaaaauuacuaauguaugcuuuagaaaacauuuuuagaagacuuacgcuuaacaauaaaacccaagcaaaugguguaauuugauuuucuuaaaaagucuacauuucacauauuaauaaagcaaucccaacaaaacagucuugcaucuccagaaagaaggaaugaauauugaugacaucuuaauuuuauucagucccauuacuucuuaaaauuugauugaaaaaauuaagucacauguaaccccaugcuguuuuaggaauaugaaaccgauaaaugcauuuuaaugauaguggucccuucauaugagcuucuuuuaaaaaguggaaacaaaccagguaucugcuuucuaguuaaucacuguuggcuauuccauagaggugugucuggaacagggagggggcucugcuucccuuugggcauaauuagucagugcacuaacaauuauguacauucaaacuugauuauuuuaaauaugaucuucagcuguacuguaaauagaguacugcauuguagucuccauauguuuauuauuuccuauaauauuuaagaauugccuaaacauauacaaaauguacaguuacuaaaacagcuaauuauuucuuucuuccccuaugaaaggaaggggcuuugcuguucuuacauggcuagaaccauaauaaacaauguacuugcaauuguaacauaaguauuacaauguuauuaguaauaaucuugaagccuuguuuuuugaaguccauuuuauuuuaaucaguauauugcacuaauuauuuuagguauuuucauuauaugaaaucuaccaugugucagaugauuuaaucuauuuaaguguugaucugcuagcagaacuuguacauuuuacaguaacucaaaacuaguaaggagaacaguucaccgguguuuaguuuuauauugaggugcucagguuggaauaaagugauguaaaaagc

SEQ ID NO: 12241 - RNA, 11551 nt, Mus musculus
agauccaagcuggacuugguaggggagguuuccucgcuuggacgaccugaggacuuuggugagagcuggggggcaaggggcaggaucgaucuugaggcgcccuuagagaggagggagaaacgaggcuuccugggaggacuccgguaucccaaaaaucccugcacgcuaggaaacccuacuucuagagacuaacuuuuacccaaggacccaacuucugcagcgcuuccaacucuuggccuggccacccuaggaccuuagcguccucgucagugacggagucccugagcguccaaaaagguggauuccacuguccuggguccccagaauuagaguuguguucaaaugcgagucccguguguccugggcugcggcuccucccucuuccccgugauucugagucuccuguccccaagaacaaacaaccccgcaggcacagucacaaauagcuucaccugccgugcacuaacuagccccaggcccuggauccuacauaaagccaggccuguuccacaggaagcugugacccccagccgagcauggugccucccucuguuggaaucucucaaauuuaauguuuuguuucugucuuguuaauuguuuuuggaaauggcccuacgcuaaacuuagggugccuuggaauuugccuccaccaaaaaugcugggaugacagcauugucaccaaaccaggccgaaagacucccuuaaccacuucuaagccuuggcuacaugcugguuuuuugacccugggggcuuuucuggcuuucuuugcagagaaaguaaucuggugggcggagugugugggggagggucaguuucaggcagcuggagccggguguagagagauuagcugccacaagugcucaaaaagagcaaaaagcccuuguuuuucuccagcggccaccauugcuuaggaaggggagcuccaggggugucugacuccucaggcuuugccacccaccuuaccgaugacaggaaggcaugaccagcaucaccugacucccguguugggaaaucuuuaucgcaaaccuaacugcugcgguuugccagacuaguuuauugagcacccacugugguuuagcugccgauuugagcauucugcagacaacgccaagcaaucucauaaagcccaggcuggccuagaauucacacacuggguaguggaagauggcuuugauuucuaaccuuccucaagugcuggggugacaggcaugugccaucacacuugguguuuguuguucuggggcaucuggaaggcccagccccaguuuuuaacugguuuuuaaacaaaugauaucaccuaccuguccuaaaauucagacgccaggcuucuaccucugucugaacucuguccuuaguccauuaagcuuccugaucuucuaacauucuauguaaagacaagcagacuccggcugcaagugaugauucaguaguuaagagcacuuccuguucccucaaaggaccgaggcucaguucuuagcaccagcuucaggcuccuuauguaaccuaacuccagcugcaggggucugacucuccugaacucuguggccacugcaugcacauaagcaaaacuaaaauguagaucuuuauaagauguauuauauuuguuuauuuuugcuuuauguuuuguuguaacugggucucacucuguagaccagguuggccugggacucacagagacccuccugcuccaacucccaagugcugggauuaaaggcgcacaccuggcuuaucuuauuuugaguuguguguaugcccguguggauguggugccuguagagaucacguguccuugaccuugaguuacagguaguugugaaucccgugcuaugggugcugggaaucaaacucagauccucugagagagcaauacuugcuuuguaccuccuaacucccaacauacucuuuaaggagagagaaagagaaucuuggauguuucagacauuugccucugaacuucuuggcuugcaagaggucucugucuugaacacacaggggcauuuguuagacuugaacacacagggacauuuguuaguuuguuuuuguuucuaaguccccuucugcugggacuauugucauguugagacccacaaaugggcacagcugugggaacagugucaacugucuggucacauggaagaagacugugaggaaacaguacccuugagagagguauaggaccugaccuuaaugaauggcagaagugagcuuuaaagggacaugucugccggauggauguggccuaggacccugucacaaccacccagaguuagggguucuaaaggcauaauuaggaauggagccccugccuagaauccccccuaccccauuaggggcugagggguguggcuagggguggauuccuaccuagaaccccccaguaagggggcugggguguggccagaagugcagcuuuguugagugugccugaggaacuggguuggcacuucuccagcaccacagggucagucagcaguuggggcggagcuagggugagcuaggccccaccuuggaccuugcugacggggcccugagagggcugaagguucacagaucaacugugcugcuuccuguguuccuggcuuucccuggagagagggguagggcugguugucacuugacugucuucugcccacagcaacugcugcugagaccaugucuagcaaugguacagaugcgccugccgaagcucaagcugcuauggaggaaccuguugugcaggugaggggccugagcuucagggagcccugggcuccugaguucuguggcagccugcuggggucuggaaggggcuagcuaggaggggaguuagggggucucccucccuccuuucuucuuuccucucucuuuucuuuucuuuuuuuuuuuauuuuuuuauuuuuuuuuuuuugguuuuucgagacaggguuucucuguauagcccuggcuguccuggagcucauuuuguagaccaggcuggccucaaacucagaaauccgccugcaucugccucccgagugcugggguuaaaggcaugugccaccacgcccggccuuuuuuuuaaauuuugagacaaagucuugguauguagucuaggcuaguauggaacucacagagauccccuaugucugucgucugaaugcuggagauuaaacucuuagauccagcccuucauuuuuucuuugcuuucaauacagggucucauguagcccaggcuagccucagacccacuagguggcugaggauggcuuuaaaccccugauccuccagccuauaccuccugagugcuggaaugagugcucacgugcacuuucucuaucauucuuuuucucucccccucagcucucugucucucucucucucucucuccccccugucucucugagacagugucauuuagcucaggcugaauuccaauucauuguguagcccaggacaucaaagucauccuagaacccuugagggucacagccugugcuggaugacgucaugcgccauuuuccucgguuucuaggguugggaauggaaccaagggccuguuaugugguuggcuagugcuuuaacaaaaaugcaguucuucagacaagcaugauguagcugcagagguaggcaaaucucugugaguuccaggccagcauggucuacacagugagacccauucucaaaaauacaagaggaaaccaaaaaaaugggauuucucagucacugcacuuccugacaccucacuggguggucaaccccgugcuggaaccuucagcuuccugcuuugugcaauuguuggucccaggagugguguagcccagcugaucuauccccccccacacacacaaaaaugagagcauaccgguaggcacccugagcuucucaccugguccccugcccuucacagcccagcgugguggaucguguugccggccugccucuuaucaguuccacguaugggauggugagcgccgccuacaccuccaccaaggagaacuacccccacgucaggacugugugcgauguggcugagaaaggcgucaagacccucaccacggccgcugucagcacagcacagcccauccuguccaagcuggagccccagagugaguugaggaccccaagguguggagggagaaugccucucauuuggaaggaaucacccccacuucugaucuccaauuccccgaaaccaguccugggcgucucugcccaccauugagggcauuuaccgugaauguguguuuucuccccacaguugcgacggccagugaguaugcacaccgagggcuggacagacugcaggaaagccugcccauccuccagcagccgacugagaaggucagugcuaagucaguugauuccaucuugaggccgugucuggaccugccaaguccugcugcgugcacagcacagggcacaugugacaguucucaccguccucaccucuacugggcaagaaggucuuuaagguuggccacauucagucaagaaugcccucuggaucccaccgaacccagagcaaaaggcacacuggggcugucaucugggucuggccccucgacuacuaagcagaguuuagauugugguccacacccuuagacacggccuuuggaagggaaccuaaacccaagaagacggauugcagagacaacagaugcauacgugagaucugccccaugacuuuuacaugcgcuguuccagaaacucagcucuccgaucuguagaaccuccauccaccaaacccaguguauaacuggacagccaguaggguauuuucuugacagggucuuacugaaauagcccagguggcuugaaugcugaccacgccccagccucucauuuggggggcuccaccccugaucacacccccagcuccugacugaggaauucuaggcagaauuccaauucuggucauaccuagucccucacuggggacucugugcaggagcuccaccccugaccaagcccccagccucucucugagggauucuaggcaggggcuccaccuagacuccauccuaucuggucucugaaucaaaggcuggguggcuacuuugcuaugggagcacacuuucuuuucauguucuugugggcuaggccccuauccuauacuucuguauaccaugcccaggaacaguuucaaugccuggacaagaggacauucuggguuugauggcaucuggaugaccugaggccugaggcaacuggaggccucccagcagcucuuucccucuccuagcacagaccugcuuuaaagugucuucacagugguacucacauuauagaaguucagggucagguucucuagacucgugagguagcgccuauacagaggcucugggccugggaguugggaaggucucuuuacccaagccacaugggaccagggugugaccacccuggcauuugaaccugggcuauuacauagacugcagcuacauagugaguuuagguuuggagcuagccugggauacauaagccccuauguccagaauaacuggggccaagauagcucagugaguacaggcgacugcagccaagccugaggaccagagcucaauccccaggacccacaaagcaggagaaaaucgacucccacaaguuguccucugagcuucacacaugugcuguggcacauaagaaguuuaaauuauuuacuuaacuaucuaauuaaucaauuagaggcuggcgaaaugguucaguggucaaggcuguuugcucuucuuccauaggaccugaguucuguucccaucacccucuuuagguagcucacugccuguaacuccagcuggccucugagggcaccugcgcacacaacauacaccuauauaguuguauaaacuuaaacaaaaugucuuuuuaaaauuuuuuagcuaacuggguaggacacagacuuauccaggaacaccuuuaaaauaaauaccaaaaacacagacagguugagugauggcuguccuggaacuugcuauguaguccaggcugcuaugcagugcugggguuaaaggcaccauaauccuagcuaugaagucuucuuacccacacaaggcuagggugacccccauggucugucugaguuggguauccugguguggaaggaugccgauuuguccccuccugcagguuuuggcggauacuaaggaacuggugucaucuacagugucuggggcucaagaaaugguaucuagcucagugucuagugcgaaggaaacaguggccacccgggucacaggagcgguggaugugacccucggggcugugcagaacagcguggacaagaccaagucagcaaugaccagcgguguccaaucagucaugggcucacgugugggacagauggugauuagcggaguggacagagugcuugugaaaucagaggccugggcagacaaucgccugccccugacagaggcggagcuaggugaguauccuuacccugggcccucuggccuccagccuggcucaccuccugccucagugcguaugcuugguauuccccacagcugucccugagagggcucccuccucugcccacagccuuccaaguccuuugguggaaucuuuccauccaccucauagguccuagagaucaaacucagucaggcuuugcaaugaguaccuuuaaccgccuagccaccucucaagugguaugccaacuucuuuuuuuuuuuuuuuaaagauuuauuuauuuauuauauguaaguacacuguagcuguccucagauacuccagaagaggacaucagauuucguuacagaugguugugagccaccaugugguugcugggauuugaacucaggaccuucggaagagcagucggugcucuuaaccacugagccaucucaccagcccgguaugccaacuucuauagaggucucgauuccucaugguuggccgugagcaugcagcgcuacagcuucaguguggcaaaacacccacuccugcagugacucucugcagggacagagcuggcugcugcaccucugcagcucccccacagauggcaggagacgcuaccagccugggagagggugggguguacagugagaaagugggaaggugcuccaaaagcggggcgggggacaugcauaaagaggaaccaaggcucuguggggguggcucucaucugagcagccuugguuuuaaccacugcccuccuagaggcaucccuggcuguccuauaggacccagguggcuucucgauagagaauagcagagccaugugggaccuagcuuugaaacccaagcaagguggccugugccuaucaucccaggaaggaaggggcgaggcgagaagaugagaaguucuaggccaaccuaggcuacauaggaagaccuugucucacaacacaaucaagcuucaggcuggggcuaugguucaguggauaaaguggucacuuagcacacaccagguccuggguucugucccuagcacagcagccaugugugguguguaccagucaccuggcacucaggagguggaugcagggggagcggaaguuggaggcuagcccccccuccuucccauuucaguucaggccaauugagcugccugccuguuccucucgguguccugccaacucucuguccauggauugcugucuuugcuuuggcuuggagcacaaagccccuuucacuuucccagaugcggucccagcuuccaggagaacggccacacaccagcuggcccaaaaauguaccauagagaagugagaaggggauggauuuuuuucuuuuccuucaaaauacagaauuuuaccaggcaugauggcacacaccuuuaaucccaguaucaggagacagaggcaggcggaugucuaugaguuugaauccaaccuguguuacauagugagacccugucucaaaaaccaaaccaaacaaaaaguccuaggauuugauuuuuuuuuuuuugucucugaacgucucagcggccucucaacugaugguggugcagaggccacagcuccacagcuguguuucugugucccagccagucugaccccugcuuuuuuuuuuuguuuuuuugguuuuucaagacaggguuucucuguauaucccuggcugugaccuggaacucacucuguagaccaggcuggccucgaacucagaaauuugccugccucugagaccccugcuuuuugaaacagcacaucagugacuuaggaggacucugauguggcuaggcuaucugguggcucuaggaguuuauccuccagucuccaccaccugcuuuucaauauauauacauacauauauauguguguguguguguguguguguguguguauaaagaccaaauauauauacauauauguauauauauguguguguguguguguguguguaugugugugugcauauauauauauauauauauagucuuuuucaagaccggguuucucuguagcccuggcugaccuggaacucacuuuguagcccaggcuggccucaaacucagaaauccaccugccucugccucccaagugcugggguuaaaggcgugagccaccacugcccagcugcuuuucaauauuuuaaaaucuauuucauuuuaaugauaugagguauguaugcuugugcuagguacacacagagcagccagaacacaacuuuugguaguugguucucuccuaccaugggauccacggguugaacuugggucaugaagcuuggcagcaaguaccuuggucugcucagccauuuugcgggcccaucuuuguuuucuaguucuguagacccgagaaugaaccagcuuccagauagccgcucuacuacugagccauaccaucagcccucuuuuuugcauuuuuuuccgugacagggucuccaguagcuuagguugccagagacuugcaauccuccugccuugccucaacuuccuaacugccuggcgcguggcguuguguggcguggguaaugugagcaaucucucccucugucccugcagcucugauugccacacccccggaggacucggacauggccucacugcagcagcagcgacaggagcagaacuacuuuguccgguugggcucucucucugagaggcugcgcaaucacgccuaugaacacucccucggcaagcugcagaaugccaggcagaaggcacaggagacgcugcagcagcuaacaagugugcucggccuggugagccuccccguguggguguggccguggcuggggccuccuucuugcagcucagcucuuaagugagcugagaucucacccaguggcaggugggcugggcugguuccccugggcuggcuuccucuacaccuuaguguaucagucagcucaggcuguguaacaaaguuccugaguauguaaggccuuuuucucuacccggcuggauaggggugcuggucgcugcugggucacuaggccagugagagcagcuaagacacaugcauaguauuccaccuuauucaugugaagucgauguggugggcaguggagcagggucuaaccucagcacugcccaaggagaaaaauaaaagugugugucuccuugguguaugccucucauucaggcagagaccagccuggucuacauagugaauuccaggcuagccagaaaagaaaaaacaaugaaaaugaagagccccccaucccugcauugucccggcuggaacccagugucugggauauguucucccucuaauagggccccuuucucugugcuguagauggaauccgugaaacaggguguggaccagaggcugggggaggggcaggagaagcugcaccagauguggcucagcuggaaccagaagaccccacaggaugcugaaaaggacccagcuaagccagagguaccugcuggggcccccgggauccccauaugaguguccaugcccuguucagcauaacucaugcuuccuguccccagggcaaccacagaaaccaugacagaauucuauuuuguuuuggcuuugguuuuuaauuuuugcauuuuuauuaguauuacugggguaagguggugguuuuggcuuggcuuuuuuuuuuuuuuuuuuuuuuugguuuuucgagacaggguuucucuguauaucccuggcuguccuagaacucacuuuguagaccaggcuggccucgaacucagaaauccgccugccucugccucgcgaguuggcuuggcuuuaagauaacagcugugagcccgguaccauaucuggccucauagugcccauauugugguuugauuugggguuuauaauuuuuugauuuuggugggggguuuguuuuuaacuuuugcuguuuggcuuuugauuucccugcccagccccaguggcuuucaucucugauaagucuagauuccaggcaucuuccagugucucucuguaaaccuuaacuauucugaaaagguuaugggagucugucuucuaguuucaaacucagggagccaaauuccuguccuccaagcagggcucugcacccuacuggcccucaauacccugaccccaccccaaucucccccuuccagcagguggaggcccgggcacucagcauguucagggacaucacccagcagcugcagagcauguguguggcccugggggccagcauccagggcuugcccagccacgucagggagcaggcacagcaggcccgcagccaggugaacgaccuucaggccaccuucuccggcauucacuccuuccaggaccucucagccggcguucuugcccaaacucgggagcgcauagccagagcccgggaggcccuagacaacacuguggaguacguggcccagaacacuccagccauguggcuggugggccccuucgcuccuggaaucacagagaaaaccccugaagggaaguagggagaagguucagggccaacaucuaucuggcuugacugcuuuucccaacaguccaauugcacaacagguccuccccuacugagucugaaugagacauguguuuaaccuauucccaucagucuuuuaaagcaauuuuuuuucuagaauguuccagggguaaaaagauccagaacauucuagaaaaaaaaaauguuuuuuuccuaaaaaaaaaaaaaaaaaaaaaaugaggaaugaggguaaugaauagugauagcacuagucugucauccugugucagcacugugguauagaggcaagagggucacagguucaaagcccggcugccacaucacaaauucagugauagucuaagcuacauuagaccuugucuugaaguaaaaaaaggcauaaugauuuuucacuccggguuucuuuucuacaucauggcccacaauagcaagagcuuuucuuguuuguuuuuuuuuuuuuuuuccugagacaggguuucucuguauagccccuggcuguccuggaacucacuuuguagaccaggcuggccuugaacucagaaauccaccugccucugccuccugagugcugggauuaaaggccggcuagcaagagcuuuucuaacagacccugauaccuggcccaagaacccagcaacugugacaggauagacagcugggauguugcaauuguuucagaugagaaagugagggccgaguacacuguuccucaaauccuggggcucaguauugccuuaauaaauuuuauaugcaucagaggcca

SEQ ID NO: 12242 - RNA, 25160 nt, Mus musculus
ucccggcggcggcggcggcggcgguagcgcggagcggguggagggugcgcgggggcccggggcgcgcggacggcggcccgagcgcgagccguaugcgugcauggaucccagcgccgcgcugcaccggcggcccgcgggcggcagccugggcgcggucuccccggcgcugucgggcggccaggcccgccggaggaagcagccccccaggccggccgacuucaagcugcaggucaucaucaucggcucccgcggcgugggcaagaccagccugauggagcgcuucaccgacgacacguucugcgaggccugcaaguccaccguggguacgccgggccuguggcgggugggccugggggaggucggggcccggucccuguccccauggaagcucugacccucucccagggccucaacgaaucauccuacggaugcccgggcauacccgccgugggcacaucuggcauccgagccgcgcacagcccaggucuccguggaagcccgacccucucuuguggccagaccgagcuuuuccguggccuuuccgcgggugucggacccccgaagcccaaacauucccucccggagccuucaccagucaugagguccgggugaugcauccgcggaaacucccgguccguuacuccugcucacccaggaaaacggcuuugugaaccgaaaguagagcugaaggccacccaccagugcagugccccgggguuacucaccaucuuaaauggguccggaccucgcagcuuugcaggcuggagggauggaccaagguuugcuuucucauuuucugucuauuuucgugguuuacagaaaagaaguuuguugcagagacaguucgcgcuaaagcuacacucggguuucuuucuuguucugugcacaaauguagggcaaagggauuucagcuguguuuauccuugaccucaaauaaccggguggauaggcgggcaaaguaagggcgauuucccggcacccacccgaggucggugaauuaccgggaaauccauagguaacgcuccuguuaccuuccucgggaucuggguuugaaacugcaagggaauguuuuuagugacacuggauugacagggcuugacauagagguuuguugggguuaugggaaacaguugugaccauggaaaagcuaccuggaaaacucucauuugggguggcuuauagaaaaagggggugagcaggagggacuggacagagugacaaaaaaucuagcguucucccugaauccuagccccaaggagaggaagguggaucucugauuucgaggccagccuggucugucuacacagugaguuccaggacagccagggcuaugcagagagacccugucucaaaacaaacaaaaucucagcuuggagguuugaaaagcuaaacacuggugcacauauuuuccguuguaaccauugaugguucccguuuugagaugagaauucuguagagaauuucagggacucucuuuaggucguaauugguaaguugccggguaacaaaacuaccacgguucuaaguacuuagaccggaaaauuaaaccuccaguuuucacacugacuuaaauuuccuuuuugauuaugccccuucaugccuuuuuuuuuuuuuuuuuaacagaccauuuuggaaauauuuaugcuccuucuacccuguuuguuuuuuaaauguuugucuuggggauguguuauuagaacucaguaacguaauuauacccacugcaaauauccaaucuuggauccuaagaguauacagggaguuauuaaccaggaaaugaggcuuauauuguuuuguuuguuucugacauaagugcaguaggcuugaaugcaguugagaauuaccagucguuuauggccccacacuuacauaugcagaaaugaaagcuaaugguuauauuuaauauagaagggaaauaggacugcagcacucggaaggcucgaggugacggacugggguggggagagcuggccuuuaugacagcacacccacauucuaggaaguuuuccuagggcucauagaaguggauccguggagagcuggccuguccuccugagaaagaugggccuacucaguaagcuuuccccuuguugacaaaaugaaacuagcuugagacaucauggaauuacauagacuaucuggaaaugagcggaaacaggccuccuuacauacauaauuauauguacaaauauacgggugucuccccacacugagggugguugaauuuuucccuuggauguuuuuguuuacuucauauccagccuaaaguaauuaauuucaguaaguguuucuugugggaaguucggaaaaagaugguaaccauaacuuaaggaaagccugaagacacuacaugcuaacaggugccucugccucuucaacuccugccucuggguugaguuauuuucuagccagccugcgguuuguugagcaccugcuguguguuggguguugugccgccugugggguaauguggaagcccagcgugggcucagugugcaaguggugccagcaggcgccagauuacagugcucaaggggagcauggacagagaaggguacuuaacacacaagccuccuggcuggggccaagggcuuguuagaagauuccuucccacugagcccugaggagccaaguucauuccuuaaguuccuuuagaaaaugcuguuuaaauaugacccugggugugguauagccuuguagcuacugcuugagcagagcuucuaggucuuccuguggccuguuuucuaguuccuucccagccuuauacaaagagccccacaaagaagaggagugucuucccugaugcuuuuuuuacugagucaaggcugcuucuggaagagaccacaguccccagcaugaguccaccaagauaggucacauggcaccugucauucagaggcuagaacgggcaggggugggagggccugaaagacaccuuugacaaggaaucagacaccuguggaccuuguguaacaggaucuguggagguaaaugaauguaaagguugaaucagugagacauugauaucuuuauuguuaugauuaauaaucggugcauagugggcauaaaacaccuagaauucgcaaggaugugaaacgauacaguguuuagaugauuuaauggaaauuauugugauuuuuuuuucgaauagauuuguauuugcagaauugaauuaguggaauaaucagccagcgcugguuauuaauaauuaauaaaggggcagcuuuaugaagguagaaagguaggagaagaaagcuuguuugcuacagacguuggcacccagcugagcugugccagauuuuucuaguuuccucuuugccuagacugguaguucaaccucccugaugcugugacccuuuaagacaguuccucauguuguggugacccccagccauaaaauuauuuuuguugcuacuucauaacuguaauuuuacuacuguuaugaaucaaucauagugcaaauauaugagaugcaggaucucugauauucaggaugaccccugugaaagggucguuuaucccucaaggguucuugacccacagguugagaaccucuggccuagacaaugacugacauacugacccacuuuccuucccugaauaucuguguuauuguaaacauacuuuacgugcugugacucccuagguaggugaguucgcauugucacuuucugggugaaagauauagaagcugugcugaauccgucuuccuuguacuguauucccuucauuuaguauaaauaacuucuuaaaaaguguagcucagggggggcuggagagauggcucaacgguuaaaagcacugacugcuguucuagagguccugaguucaaaucccagcaaccacaugaugucuuacaaccauuuguaaugggaucuaaugcccucuucugguguaucugaagacagcuacaguguacuuauauauaauaaauaaauaaaucuuugaaaaaaaguauagcucagggcuagagacuuggcucagugauuaagagcauuuguccuugcaaaggacucggguucgauuuucgauacccacacggacgcgcaccaccuccucaggcaccaggcauucauguggugcacagacguacaugcaagcaaaaugcacauuaaaaauaauaaauaagcaagaaagaaauuuucuguuuaaauaaaaguauagguuuuaaaaagcaguuaaaaugugauuauuugggggcuggagagaugguuccaugguuaagaguauugcugcucuuguagaagaccagaggucauuuccuggcacccacaugaggccguucagaacugccuguaauuccagcucuaagcaaucagacacucucuccgaaacuccugcacuaaacgaccuuccugcaauguuuauaaggcaugugaaacauaaguguuguguuuagacuucaguccagucucuuaucaucucauuauguauaugaaaauauucuaaaacuuuuggaacacaaguaaauugauguaaaguuauguaagccagaauucuguuaugccuggacaguacaguuucccccuuaaaaaugcuagagacugccgugggaucaucagcucuuuuauuuugccaaguaaguacauuuuaaaaucccacuaucaccagcugagagagagacugagacagagacaggaugaugaugaagaaguagggacgaucagauagcaaauuuaaagcucuuugaauuucccucugaggaccucagaccucugcggaaauacuuaaagcuucccagccgcaccuuugaaaagaaagcgccucagaagaccucgucagagaagcaccucugagcugagaucugaggccuggucucagaauacagcuaaguacuuagagaagggaugcuaacuggugggccacaguccuugugugaccuuccuggauguccucuauaguucaugcagggggugggugugccucagcuacuggggcuaggccaccccugcuggaguacuugaacugacaacugaauugagggcccauaaaauaaaacuggugaaugacuaagucccugcaggcaaaccacccaugcacuuaaaauuaaauggagagggagaacuagggggaaagucccuaauucccuucuuaaacaucgaagaacaggccucccgagucaccccauucccugccagagugaugugcccugacaacucagggagacuagagagaaagaggaacugagguuugggucgcccggcacagggaguaguacauacgcugugacugaguuuauuuaaggggguuaguguaagcccacaggcuuguacaauguccgaguugugacaccugguuaucuuucuaucuaccugaaagcuaucuuucagaggaaggcuguagauuuuggagucaguuguauagggaaaaaaaaaaaaaaaaaaacccgguuagauuuggccccagagcuuucccuuuauuucugcuucucacacugaagaggaaaaguuuuaguaugacuauuuauuauggggucagaguagagauggccucuguuccagccuguagagucagccagaagcagucuguuggaagcccuggaacuggcuggagaagagagaagaggcuccuuugagaauaauaggugagagauguuuuacugcccaggcaucaaauaaguuguucccaaaaaagcauuggcuugaaccaggaaagaaaacauggcuuuguacgguagucacuaagcaggaauuuuugaggguucuaugcaucugcaucagaccauucugggagccauuuaaauagggcacagaguuaacaccuggcuuaucccuucagaggggaugugugucacagagaaagugacaauccaguguaagaaagaggugagagcuguuggguuucaucagggggaagaaacugguuauaucuaccuguuuucuuccuguuguauauagcuuggauguuggggggaaaaagcacguggaaaacaaaacuacauucagaaacgcuacccgaauugagugugguuauguuguuacuuaguccuggaaagccaggaagcaacaauacagaccuaacaggagcagccuaugugcggcugaaaggucucccugucuauucuccucagucugacucugacaggcugcugauuccagcccuucugcuguuuauuagcaggaaaacaagcaacagcggaccucuggcgggugggcguggagagucuuccuguuccuagcccuucuuaguggagaaacccccccgaacucugccgggaacccugugauaucaccaucccgggucaugcuuuuguagaauaaaaaguuaguuuucuccuguuguuaacuaaaauaaaauuggaagccgaaaucuuauuauuuauuuauuuuuuuuuaauuuugacucaaaaagagacgcucuugucauuccugcagccgccacagccuuuccgugugcuggagaauucgggagguagcgagcuaguccucaguucuggcucuucuguauguuaccaaugcuucuuaaagcagaccacgccccucgggucccucauaccugaagagaggguugaggaggcccagcaugguggugugcaccuuuaaucccucacucaggagggcggcagagacagauggauaucugugaguuagaagccagcuugguccacaaagcaaguacccugacagccagagcuacacagagaaacgcugucuugaaaaacaaaacaaaacaaaacaaaacaaaacaaaacaaaacaaaaaggaaggaugaaaggguggguugggggaaccuucuacccucccuggcucacacugugggaauaagcgugguaccaugucuuaggugccuggcccagaaagguaauucaucaugcuguuucccagagaagugcuauaaaugcagaaaccgccaggaaaucguaugcgguacaguacgaaauaccaagugucaggcacaggcauggugaaguagagccaccucacagugccugcacugggcagcaguaaagcugguugagcgccuggcuuuccccagcuguuuccuaccguaaacguuuuucuuccucucgggaguaaggugguccguggcgcaaaaaguagcagacauccacugaugucauguuuccuugacuugugcauaauaaaguucacuaaagggauacauggcaaugaaauaacacacauuagccucuuagaguagaaccuagaacacagcgaacaccagaacaauuaguucuuaguuguuuuacuuaaacgaagggagaagcaccauuuucugagauucuuccuguauacuuuggugaaaacagagcaugcuccaggaggcguggccacucagcaauccccuccccugcccuaugcugugucucuggcuauugguucuuguggcaguguguucuccuuaugugugggacugggggguggggggagucccaggguggucugcauuugucaaggccagaaugaaagggaaagcagagcugcagauggaccugugcuguccauagcccagagagcgucugugaugaagcaugguucguuuacaacuccccuccccccuuuuuaaagauuuauguguguggguguuugccuguaaguaugucucugcagcacaugugugcaauauccucagaggccagaaaaagcugacacaggucuccuugaagugaaguugccaaugguugcaaauucccacguagaugcugggaaccaaaccuagauccucuuugagagcagccugugcccuuaaaccacugagccaucugucuagcccucccucauccccguugugcucuuuaauggugucuuucucagaaaugaucacaagauuucauaauuagaauauuauuuuuaguuuuccugaauccucacaguaacacagcguagggaagaaaagucagccaaagccaugagacuucacacagaagauaguuucugggguugauacaauguuaacgugcagcucuggaggcagcuagccucauugcucuccuucauggugagcaggccuagcucacccuuacucuucauaggccacgcagcuugggcaggagacacauuuccuucaacaauaguagagcugucugucacacacucggcgccucucacccagucuugacacaucucuuacucucucacugccagugcagggaucuaauguucaaaguggcugacaucguugauauaaguacuuugccggagcuauagugucacagccauuuuacguggagaccugugucagagccugggacuccauagcuguguuaaugucggguaaaguccacugcggucugggacaagcugaggucuuggguuggcagagaagcaaggugaucuacuggaaggggaagcugggaggcugcuuguuaucaaagacuugcaccccaguguuguuucuucuucaggcaggaaaggaaugugaagaaagaggagucuguguguuucugcuguuuucauuuuguaacuucuuagggcucagaaaaagcaacaguguuuuggaaauguuuuucccuccuggccuuccuaggcaccaauuccuuaggcuaugaaagaccauccagaaggaagcaauuccagguucaggucucaugacaagauaugaugauaaugggccauuuacagaacacaacacacaccuucucagccaucugaucgcauaacaaccuugcauugugcauacaagcgcgaacuugaaucgggauucugcaguuguguaggcaugugguccgucaguuacuccuccugucucugguccaguguguccccugcgggaugacaugacagugcccaccugacuaggcugccaugagcuuugggggugaggcacuaaauaugacugucauugcuauuaaaacaaaugaagguugagccugagccacagucccucagagaccacacacuggcauuggugauggggagccuuacccuguaagcugaguccuuucuggaaacauuguuaaacuaguuucagaagauuucuaaacaaccagaagcuuaaaugugggucccuguuaccagaguaaucugcuugggggcugaccacuccaugcgaagugaugggguaaguaauuuguuaccauagugaucacugggcugagugugugcagucuaagucgagcugccugugcuuuacacaguuacacaggaaguaaaauguaucugcucacacacacacacacacacacacacacacacgagcacaggcauuccuaucugcugcugccauuucacaucugucuccuuugccucuuuaaaaacaaacaaacuggucaguccuggcuaucgcucauuuguccuguuagucagcguuucuccuugaacuccuugaauacaccgcauuuaguggaguagagaggcugacugugagccucggcaggaagccaaggaugcugggucgcugggaaaugcacagccuaugggugaggccagcaaagaaaggccagaagaguggcgggccaggaaugggguaggagcggguagguguggucagggaaacuucccugggaaaucuaggauuuaaaagguuucugggcagacaagaagguucucuaagaguacauggcaggggaaggcacuuuguugccaagugcgugguguguuaaugugggucagugugacccagcuuugggggcagggacuguccccauuaacccaaaggguagugaggaauguugcuugccugcuaaucaagacgccucugagagggcuggagagguggcucagugguuaagagcacugacugcucuuccgaaggucccaaguucaaaucccagcaaccacaugguggcucacaaccauccauaaugagaucugacgcccucuucuggugugucugaagacagcuacaguaaacuuacauauaauaaguaaaucuuugggccggagugaguguuggcccaagcgacgacgacgacaacgacgaugaugcugccucugagaaacuguuuucaacagggugacaggcucuucaccccuugaguaugcaguucuccacuccuaucucugcugacugucccuaaagcuccuguugagacuguugauggcuugcuaugauucuuuaaggaccguuagcauuucuguggcucacagcugcugcagaugugcgacaugaagucauuuuauacuugggaggugagguuucuagacagguccgaugauagacuuguauuaauacaaagauguguguccgagccguagguuggauuaagaucauuacaagcuacuuggagcuguuguuagauacagugcaggcuauuuuauuuaaaggggacagguuuauuuauuuauuuagguuccucaaggcaggauuucuuuguguuucuuuggcuauccuggaacucacucuguacaccaggcuggccucaaacucauagagaucuacacaugggguaaagaggugcuucacccagcucuuacauucauccaucuacccauccauucacuuauuuauuuauucauuuuggagaggaauaguuuuaaugagcuguucccauuuauagacuuggguuuuuuuuguuuuguuuuguuuuuguuuuuuuuuuuuuuuuagauuuacuuauucuaggccaugagugguuuugccugcagcacaugugugcaucaugcacacaguuuuugccgggaucagaagaaggcauuagaucuccuggaacuggaguuacaggaaguugugagcugccguguguguguugggaacugaaccuggguccuccucuuugagaacaagagccgcccuuagccacauuucggcccugguucauacacuuagagauuuagccacuuaccugcaccgggacucuucugcugagguuacaguguggcuguguugugauuccucugugcacacacucgguucuucucaguggcugagcagauuccuuguccuguugggguagcugaugauacccaggcccauuucuucauucugaguacuaaugccugauccuuuucuuuguucauuaagcuucgugguuagagacaugacccuuguggaggccugcuaaaacaggcagguuuuucaagcuaguugagaaggaguggagagcacauucaggcccagcaugauauagcagagaaaacucuguccuccggacacagacggcccacacuggccauguaaaggguucugucagucaacuggaagcagagcucgggagagaugaugucacuggcccauucucuucaguaaaagaacaaauuuacgaauguuaccucucccuuaacucagauucugaaaacaaauucauuugaaguuggggguaaagugaagucaaagaggcuggcagggugacugucuaagggcccgccuuggaggcugauggccugccugcccccugguauccacgcuguacagaacgugaacuccugcaaauguccucugacccccaccccuugcccacucucacaugccacaaauacaauaaauaguaaguaauuuuuuuuaaagauuuauuuacuuauguacucugucuucauggacaccagcagagggcaucaggccccauuacagaugguugugagccaccaggugguugcugggaauugaagucaggaccuuuggaagagcagucaguguucuuaaccacugagccaucacuccagcccccaacaaacugcuguccuuacaauaguaaccugaaaguaugugaugugaauuacagaucaaaugcaaggugccaugacuuuuauuucauuuuuuaaaaauuaaauuacaggcuggagagauggcucagcgguuaagaacacugcucuuccagagguccugaguucaaaucccagcaaccacaugguggcucacaaccaucuguuaugggagauaaugcccucuucuagauuugucugaaaacggcuacaguguauucauagaaaacaaauaaguaaagugguuugucaccaagaugugccuuggauuagucagagcagcagugcggucaugccuccaaaguguugcucuaaggagcugccaccucgagugagucauuuaggagucucaaggccacgaacugcucagaccugcucagaccugcuccugggaaccuguagacuuugggaagcagucagcuggagaauuaaaagugagguuaugucaaucagccuugccagucugguguaaagaauuacuaauugaaaugugccugguguggaggugcacaccuuuuaucccagcagggagggucuguaaguucaaggccagccuggugugcagagugaguuccagggaagcugugcuguaaagagagguccugauucaaacaaaacacaaagaacaagcauuuaaaaagaagaagaacugaaauucaggagaccugucuccuuuguucuacugugauguuuuauauuauuggaacuccugugucauauaucuaaggacucuuccccagcucaggcuuauaaacaugucuuguguugcuaauuuuaaagccagucacaugucugucuguucaucucagaugucaucugaccaaugcugccucagguccaaaauggaugagcagagaggacaggcagagccacugcuggcugcgccccaccugcgcauucugcugccugggaugguccgucugggcccuggcaggcagcugggaaguagacccagaaaggaaauguuuacagugcuuguagucagcgagcaucucgucucucuacuuauaaauauuauguuuuuuaaaaaguauggcuucaaauauuuuuuuucuauagcuauaaaagauaaucagauauuacacaaaugaaaauuuggauuuuuuuuuuuuggaauuuauuugaagcuuacaggucugucuuuaaaaggaaaaauauauaugugauaguuugguugcaauauuaaaaaugaauaaaaauuaaaaucgaauaugcuuaucagaugaguagguuucuuuuuugugcugaggucuuacuuuguuacccagcuugucucaaguacaccacaccucagccuccugagaggcuaggaguccaggcugcccacauaaccuggcuuacuauacacaauuuuauaacaguuuguuccucugugauguacugagucauccacauacuuaccaucacccgugagggcuaacgauguuaauauuauuaguaacuucuagauccaaacaaaggcuguugaaaacaggagucauaaauuagcuauaacaggcugcguguggagccgaaaaagccgucgagcagcaggccucugcacacugaggccagggcacccucgacccucucacuuuggaauuuuggggauaccgauucuuuccguuuucuuaggggcacacauaaggaggacuccuugauacaccgagucucacugugucucucuugguuugcuuauauucauugguuuccucuacccccaagaagggcucuuugauacaccgagucucacugugucucucuugguuugcuuauauucauugguuuccucuacccccaagaagggcucuuugauacaccgagucucacugugucucucuugguuugcuuauauucauugguuuccucuacacccaagaaggacuccuugauacaccgagucucacugugucucucuugguuugcuuauauucauugguucccucuacacccaagaagggcucuuugauacacuguaucuuuauugcuuugcuucauagccauuuguuuucucugcagguguugacuuuaaaaucaagacuguagaacuaagagggaagaaaauuagauuacagaucugguaaguagcagugugucccagucaugcccuguauguuuagcagucuacacgcuuggccacuaagaggaacccugagcccucucaccugcccacuucccuucacucccuuuaaaaucggaagaagagcacuucccaggagccacuccucccuucacacuuccuuugcaccuggggugagcugagggaggcucucucccuguuuuccaaccauaaacaugucuccaaacuccaucauugaacagggugcuucaucguuggccucacacucagcaugcagcucagugguagaccucuuugcuuggcauguacaaggcccuggcuuccacccccagcgcugcugcgggggaaagcuugucuuuguguuuguaaauuacugcaugcucuucaaaagaucccaguauguucguaaccauauugucagguggaggacacacaucaccuacacaagcagcucggggcccuuaugcugcuacaguauggacaggguguggcaggcgugcccuuucuugcucacuugugggugcuauguaacuggggccucuucuguguaccagagggggacccagaaaccccauccaaugagagaagacucucgauucagccuaggaacaaaaggccaggccagcgguguuuuaacuguaguugaugcuuaaaucuuucucuucccuauuaacaacccacagugacagcuagaaguacccaaccgauguuccuggccagcucuguggaagaaagggcagggucuggccuguaugcuuuaguaguggcccugcucagcucagugguuugaagaaugcuuugugguucucaagacacugggccagcacacucagcuuacuaacuccucuuggcaggucgcccucagcucugacugucuguccaccgucugugugugugcuuucaucugcguuaaucgcugccacaucugugcuaucaccggucaucuaacgcuugaauguuaguggcaugucuccauccuucauccauguccuugucuggggcacagcugcagccaagccagccuugcuccacuggcguccugagguaaucacuuucauuuggucaucugcaacuguguaacccacguaagggcuucucggguuuuaugguuuuguuucuaacaguuuugccuaaauacuuagauaacaaaaaauaaguauuuguuacacuaguccacaaacaagguaacaaucuuuguauaguucguugcugucugccagauuaucuuccauggccugaagagagagaaugcuuagcaguuaaguccacuggcugcucuuccaaagggucaggguuugauucccagagcccacaggauagcucacaacuaucuguaacuccagucccagggauccaacacccucuucugaccuccuuggacccuaagcauauacuuacuacacacauauacaugcaggaaaaacacccauauacauaaaauuuuaaucucugacacaaguaagcuccuucaagacagcuuuugaaggguucaggacauguccaccuuugugacuagcgucuguggcuguuguucuuuguccugagaaggguaauggagcuaauauuagaauguguggcagcugguuugagugggugaugggcagacuauguccuggggcuggagagaugucucuacaguuaagagcagcuaugcacuguugaaggaccugaguuuggguccccacaccuacacugcagggcucacucaacacugccuguaguuccagcucuagagcaugcaacacccucugaccuccgagggcacacucacagguauauauaguuagaaaaggguugccuuuuuuuuuuuuuuuuuuuaaaagcuauaucugaauguucuagucccuuuuguugguuauagccucucuuacagugucuuugggucugaucaguuccuggcuucccuuauggaagcuugguccaugaaguugguuguguguauucagccacgugggguucucagaccacuuuucucuuagaugcgaaagcaguccccagaaacugcccucugccugccuguaaaugucuaggccauggacaggacacugguggcagucaauggggaagagugguaguguggucuggguuugcugaaaagcugauggcacacuuggguuggauuaucccagggcuggguuaggaagcucuuccuucccaucgaaaguaccuaaggggagcaguguacagacggcugcucugucccggcucgugguuuaaggagguacagccuucacaguggaaaggacucaaggcagaagccaggggcugccugcuuccaucucagcagcccaggaacagaaugggaauguuggcuggcacucagcucccgccuucuccuugcuccuggcuuuauucaggcagagugcccagcccaccgucacuuguucaguaccgcgcuuacuguuagcucauccccucugcagaccaccccuuccaggaggccguguaacucaccagugcccugggugcuguucagccugacugagcaaguuaacaguccaucguaaccucuuuuuccugaagagauuuccagagugaaucuuauuucuauaauagaccagcuaucugauuaaucaugccauacucaaacgacuuucuccugaaauguuuuauuuaaaagauaaaaggugagccagaggaauagcccagugauugaaaucauuuuuuccccucauuuugcagagagcacaggugucaggcuccucuuuuauuauuucuuugauaaaaguagagaucggauacucucaucugaaauccuugaaaccacuaaugucugggauuuguaaaauauuugcuuagguacaaugaaaaugacuuggaugugggucccaagucuaaacaggaaacuuggagacagauagucuuacgcacuaucucuaguaugccuacgucuuuugaagucacguguggaauuucucaugugugacagugccaaguuggcacucagaaaggucuuagaacauuuggacuuuuagacugaggggacucagcaucugcuguuuguagugcagaguccagggcagaccccgggcuguuguugugaaucguuuguauguugucuucucugccauucugucaccagcuggagcaggacagggggugcauaggacagagcuuucccuccccgguugccacagaggaacuguaaacaauuaagauucuuuuugggcuggugagauggcucaguggguaagagcacccgacugcucuuccgaaggucggaaguucaaaucccagcaaccacaugguggcucacaaccacccguaaugagauccgaugcccucuucuggugcgucugaagacagcuacaguguacuuuacauauaauaaauaaauaaauaaaucuuuaaaaaaaaaaaaaaaaagauucuucuugauaauucauccuaaugaaaauacugaacugaagaguucuacacguuuauaauccccaagcuugagcugucugucucaguguaagaucacacauugucucugccaccuuuuuaauuccuugauuguguuuaaagcaccauuuuuuucucaguacuuaaguauuucuacucugugugucacuaaaacaaaaugugcccaggaguauguaguuucuugaauuuugugcauauauacauauaaaaacauguauguauauauguauguauauauauguguguguauauguauauguauguauguguguguguguguguguguguguguguguguguguguguguauauauaugcaugcuuguguggauauguauacaugagggcauaugccugugcaguucagcagaaggugucugguuauaggcacuugagagccaccugauaugaguauugggaacaaaccugggcccucuguaagaacaguaugcgucuucacugcugagcuaucucucucaaguuacugugaugaaauagaccugaagccuuugaaauaugucuccugcuuuugagacaacauaggauugacagguugguuggcagaccgcaucauuuuauccauuggcccagucaucacuggaggggaauuuugucucaacuggcauuaaggaugcccucacguuucccuuaguccucugcuuggaagagguggaaaaauucauaguaaaguugguucccuguccugccaauuagugccacuuacgugacuguauuagacagcaaaaagaaucuuugaaccagggcuggaaagauggcucagaaguuacacaagcacacacugcucuguuguuguuguuguuguuguuguuguuguuguuguuuugagaaaggaucucauaugcccuggaauuccccuguagaccaggcuagccuaaaacugagagauucagccuuccgaguucugggagugaagguguuugucacugugccccgcugucacugcucucccagaggacccacaaucugguuccuuucuccaaggucgaggcacacagaccuguaacucuacccccauggggucugaagccucaggcaccacauucagguucacagacagacaugcacauaauuagcuauacauuuuuuuaaauauuguauuaccaaauuggaaaaauagaauuucaggaauuuuucaccuuguaccagaagcaaagacaaaaaugagaauaagaccccaugacagcaaaacccaaauuucuagcaaugagcucuuuaucauuacaaugaaaacuccucuucccggaggcaaagagagacagagacagagagagcaggaauggauuuucucauggguccuuuguagaagauagagagacagcucugcgguuaagaucacuuguugcucuugcaaaggaaccagguuggguucccagaacccaaauggugguugucaaccaucccugacuccaguuccaagggacccaaugccuuccuuugaccuccacagguaccaggcacauacaggguccauauacacacaugcagcaaaacacucauacaaauaaaauaaacaaauacuuaacauuuuaaauaaagugucucuguacugauguacaguagguaguuaguugauaacccguugaauggaaucaacauuucucuugcccugcugcucggucaugugugguugacacggucuaguguauaguagcuuugaggaguagaaaauaacugaguauuugggaagugcagacuagucacucuaaggacuguuuuuccugccccaggcauucagagucaggcaccaaaagcaggucagaggguaagcuucgguggggagugggaacugagggcguuuguuagugcugcgucuccccguuguuuuaaagacaggcacgaccccaaauuuugauguccugacaucccuguuguggcuuucagauggagcgugguaggcuggaaagguuguucaucucgguggguaaucugucuccguuugugcaauuuagcuguuaauccauacacagauucaucgugugucuccuaaugguguagaucagcccggccuucuccugguccaccuguaaggcucagaggagaauaucccccaaucuugugcccccaccgaggugcagaagugcauaaggguuugcacuagaagauggaguuggcuaccugggugguuugagaacugauuuuuacugcuguuuccuagggacacagcagggcaggagcgauuuaacagcauuaccucagccuauuacagaagugccaaggggaucauacucguauaugacaucaccaagaaggagacguucgaugacuugccaaaguggaugaagaugauugacaagguaagcaucgccuucccuguuguggccuucagccugugcgcaucucacuguuaaagggaauagagcacucagcauccauaguggaccgaacgccaucuaagccguacuguagccucgcuacggauggggcacuggggaaauacauuauccagcaugcaacgagagcaggcuuucauuccggucccaaggacugccugacuucaaaacccauccucacuccuuuugcucugucugccgcuuccucagaguuacacuaaaacaggaaagguugcguggacacccgugggugguccaggguucuagucguccucagcaugguggaacgucuuucagguccuccuuuugagcaagacauuuccuucagcugaauguugaguucuuacucaauuuugagugaagaaaaucuaguaucuucaugguaaugugaauuguguuuugcucuaggaaaugcgugcagcaaaugcaccuuuagaagucagcagcuggaacugagaugugacucuguguauacaguugaccacaguuucagagguuuuugucuccaauuccuuuacguuacaagcacauaacaaaacaggggguguaauugacuugagaccugacugugucuguaugucuuauagcuucuggaaaaagguucucgucugguuuuacaaguuuucagugugcguaugucuucacuguauguuagggugugagaaauaggagcgccaggcauggcggcaagcgccuuuaauuucagcacucuggaagcagaggugggcagaucuccaagaauuugggacaagccuggucuaccugacaaguuccaggccagccagggcgacacagagaaucucaguaacugaaaacacuggagcagagacaggccucuccuuccaccugcucugccggcagggugggugugaacaggaagaccucagucccagcgcaccucccguggauagguuuagggauauuuaugggauaaagaugcagauggucgaggguguggggaaaugauuggagggacucaguggucugcucugcgacgcuucagcugcaguggcaaugguuaacucuugaggcacucauccgauggggacgaugacgucaaaagcccauccaucagauuuguacauaggcccaagucaagagucaggguuuuuaaaaaagaagaaaaaaaaacccuucacaucucugggaaaaaaaaaaaaaaaaguggccagguaaccaucauccuggggcuggugagagggcgugguugguaaagauguuuacugcuaagcugcugguuguccucugaccuccacaucauauaugccguacagcacacaugcacacacaacacaaauguaacaaaaagaaaauccucccugguuaccccucaacugagaguucugccugccuccgccucugccuccgccuccgccuccgccuccgccuccgccuccgccuccgccucccccccugccuccgccucugccuccgccucugccucccccuccuaagugcugggaucaaagguguacacaaccaaggccauuaagaccuaucauuucuggacuguucgcccugggccaggcugucccaucugccagccagucaggccggcgcuccugcucccucccacccccucaccuagccuccagaguacuucggcuguggucccuagauuccucccauguagucacuucaaaugauguuuuagaaguacacagaagggaauuauucaagagauacuaacauuguuuaaagagagaaaucuguuguaccuacuuuuuuuacguucuugcagauaucgcuuaaucuuucugaguguagcgauuacccuaacuucauuauagcccggauacaucaccaguuuuucuccaggagggccuuccugugucgcuugguguuccagggcagaagggaggggccuugcuuguuuguaugugcugugcuucacucuacccaauuuuugauuuuuugauuuuuuuuuucaguucuugacaucguugugccugucauuuuuaaucauuuccuuaacagucuuaagaguggccaacaccaaggccauggucauucuugaugccccucagaagguacuuucuaaaccacugugagcccuguccacccccaggagacagugggagagaaggaacaagaaguaacgggugacaagcccugaguuugcguuuugucugucagugcauaacgucuuuaaaaacaucccacaguaugcuucagaagacgccgagcuccuccugguuggaaauaagcuggacugugagacagacagagaaaucucaaggcagcaaggagaaaaggugcgugagugggggcucucccaagcagcacccgcaaucugcagcguguccacucacugucccucgcgugcugccagaggaccgugggugccacacagcagugcccagucacacccuucccauuauucauucuuuguguucauuuugaagcagaaggcaaaagcacauuaauauauauacuguaucauuauguaaguugguguuuuauacggaacaaguguuugggguuguaaaauuugcuuucaugauauuuuucucuccugccuuagcuuuugcuaagaauacaaucauggcgacacaugguauauuuuaagugucagauacauuguacguuuagacucuuacacacauaaugggauuuaaaggucucaagagaucuguuauauacauugcuguuuacuuaaggaauuugcugucccugugaacgugauauuugagcauaaauggggcuuuucagauccuaagcaccuuccccccacggggucuguggucuugucagagguccagccugacacacccacaccggcgugggcggcaccuuacaguuaaagcaagcacaugucuucuuaguuugcacagcagauaaccgggaugcgcuucugcgaagccagugccaaggacaauuucaauguggacgagaucuuucugaaacuuguugaugauauucugaaaaagguaaaaaagaaaaaaaugggugggugggucgguggguggguggauggauggauggauggaugcaccugcucagcuagcuccgugcuagcuguugcuaguacaugggcuuguggaguccucaggguugauaggcauucuguuggcuuugccuugugauagaacguucuauggugacuuagacaaggacuagugacuguaagaagaugaguguggcucagugguagagcuuuugccuagcauccuugaggcccuggauucugggcaguacuguguacauagauagacuggggcugagaguguagugccgugaagagucacaaggcccuggguuccgucuccggcacuagagguggauaaaguuccauguuuauucaacacuuccuuuucuuuucuuugucucuuccuucccauaagaguuaaguuuaacauggaagccuagaacagcacgcagccuugcuggcuuagagaaaagccgccaccacuugcuucccucaugcccucucuucagaggaugcugggcagccugacugaacagcaaccgucucuauagagacgguuccagccacuaguuaauguucaccagaaaggugacucuaggcacccugaaaccgauggcuuacaguguaaaacagccacagugcacuuaaugacagcuguggauguucguuacagacaguuauuuuuuuccaggcauuuuuccucagcguuucauuaaaucgggcaguguagaaucuucaguacagagugcggcuaagcacuaacugaacaugucacuaaggccccgggaggaccagcccauagagccucacgggugugacgugauucagaaguuucuaaugaaccuggggguuuuuuuuuuguuuuguuuuuugauuuuuuguuuuguuuuguuuuuuuuccgagauaggguuucucuguguagcccuggcugcccuggaacucgaacucacucuguagaccaggcuggccucgaacucagaaauccgccugccucugccuccccaguguugggauuaaaggcaugugccaccacgcccggccaugaaccugguuuuuauguaccugguggagguugcuucuuccuuuagacaauggaccaguuuuccacuaguaacauguuaaauuuucauuauaguagacucugugcaagaaaauggugguuuuuaucgaauugcuaggaaccaagccuuggggcuuuucgcacauacugggcaaacacuccucaccaggcugcuucccagccucuuccaaagagccuuauaaacaauacuuccaagacugaagagauggcucagugguuaauaacacuggcuguucuuccagaggacccagguucgauucccagcacccacccagcauuucacaaccgucuguaacuucagcucccagagauccaacacccuauccuggcuuccuuggguaacgggccuguggcacaaaggcaacacacccgugcacacggaaugaaagguuuacaguuuaauacaauccugccguuugcaggacugaagugugucugugcucucuucuuguccuccagaugccucuugauguuuugagaaacgaguuauccaauagcauccuuucucuacaaccagagccugagaucccaccagagcugccuccucccagaccacacguccgaugcuguugauuugauacuuuggagauggugcaagcgauuccuagaagggggaaacguucuguucugcacuacaaucacgugacaauuuccuuucgcacuuuguaacccaagucagcuauacacuaacuuguaaauaugcaaauaugcaauccuggguaaggucggguuauauaaguuacacacuucccuucaaauuauauuuccucauuaccccagugucuaguguacgcacacugggaggcguaguacuucuaauacgaagacugggagagaagaaagauguaauauuuccugaguacuauaaauguccuuguuaauuacacuacaaggcagacgcuccgaugagaagagaggaccuggugcuucgcuugcuguuucaacgaaaaucuacaaaacugaaguuuuuugaaaaggaagacaugacagccaccuuuucuuuauuuaugggcuuuccccacacggcaccucaagguuuggagugucucugcaccaaagcagagcucccucacggccacagugagagcacacaugggccauguagugagaggguuccuggauaggggacuggacuuagucccgaggcugcagaacccuggguguuucccguuggcugugaccugcuuuuaagaaugaaaagguucaauagagaaagaacggaagggcugggauugcagcucagcauuugagcaucuguccagcguacgugaggcucuggcuucaauccccgucaucgcaaggaaagaaagaaaaagaagcguuuuugaaacuauagaaaagauuuuaaaaucacacugcuguccuacacaaauccuguuuaaagggauuuuaagaguuaccuuuuaguauaucaaagaauacacaugcauuugccuaaacauccuguaucuuuguaaugacaaacuucuccccuugauggugaggcuuauuccuauuaagccuagacuguguucuuuaaguuuucuugguccccacccccccuugaggguuuuuuuuuuuccuggucugauaaggaauuugugaacucuaucuuugguauaucuuuuauuaagcugcacuguuuuguuuagucaagguaaauaaguauguauuugaauaacuuggcguguccugaguguugugcuaugagaagcaucauggucuuucuacacuaaugaagugcaaauaaaauuuuguauuuaugaaugacag

SEQ ID NO: 12243 - RNA, 30010 nt, Mus musculus
gaaggcggaguccgccgggaaaacgaaacagaagagaaccggccaggcccggacuuccaugggcagcagcagcggcagggaacggagggcgaauagauuucagagccugcaccugaaguacaauucgaauccugcuccagggagcgagccacuguccggauccagaaacuuugguaagaccugagggcuauuuucccacuccuggauagcgguugcaggaaaagggacccagaaggaaaaugacaagcccaaugacuuaaaacucuggagggaacucuagaagccugaaugacccagagacugaauucugcgccaagacuuugugcugcacagucauggcauuccaauuagcuguccuuugugacaagcggguccugcuccauccuccaccagccgcuauggucaggcaacccccccccccgcgccucccccuccccuucccccuucuucucccaacucccccgcccagugcccaccacuuucagacuuacuuggugguucugggccacagccaaauacccuccaacuccugccuucaugcugccuguuucuacuuccuggaaagcccuuuccaccucaccccacccccaagugacuuccugggcagaucugucuauccaguccuuuucacagagccaaugauaugaauuaccuucccuaagcuagaaacuccacucugcccucauagccagcgccccccguccccugccccauauuuuucucaaucuuccaacuaguacuuaguacuagaauuagucuuuuuccuucuaccaguaagaucccaagagcaguuuucauuggcuuguauaagccuagcaccugaucccugacaggugcucguuccauguauguuaaguggaugguaauucauaaauaaccuugaauucuagagaaacgggauucccuguugcaccuuuaguacuaaccgugccuugcccccuggaguuaaagacacucucagggcagagugugugcuuguuuuucagcuugcccugcggcccuggagggacccaaacacugugugcagcuugcuccuuuauauaucauauacuagcugaaugcauguuguaugggaagcagcgacuggaggggcucagccuucugggguccuacagucuucaggaaggagaaagaucagggucuucaggauauaggugagacaagcagguggcauuuguuggugcaugugaugggcugcucuuugggugagcgacugagagcugagagcagcuuccugguaagcauccugauuccuuuauaggaaucccaccugucaauacaguggugagguggagugauucuaguugccccugcagcaucacagaaggccagcccauccugagaggugaauaaaauugcucccuagacaaaggguuccaacuccugggagcauggauuggaccguaccuagccauucauuccccaguggacuuauucauucauuuguaccaagcccuuauuauaguucugguaccuucauuccuuuuucaguuacaacuguuauauugauuuuuaaaaagaauuuauugggggcugaagagauggcucagcgguuaagagcgcugaccacucuuccagaagaucugaguccaguucccagcaaccacauggugggucccaaccaucuguaaugggacggaugcccucuuguggugugucugaagagaguaacagacacuguacucacauucauaaaaaguaaauaaaucuuucuaaaaaauaauuuauuuacuuuuuauuuuuaauuauguaucuguguaugagugugugcauaggaaugcaauucccuuggaggccagggaaggugccggauccccagaagcuagaauuacaaagagguuugagcugccugccaugcugagaaccacacuuggauucucuggaagcgcagcggugccguuaacugcugggucaucuuuccagcuguacauuuacuuauuuaguuuuauguuuuucuauuauuuguaugugagcguguguguauguauguguguucacaugugcuucagggagcccgucuaggucacaggacaacuacguaggucccagggauugaacucagauggucagucuuugcagcaggcugcuucaccugcugauccaucuugccaacccuggugaaaaccaucacucuguagguagaauguaaggucacagccuggaggugaucaucaggagagacgcuaaguacagagcaggaagagacuugaggacugggucucuggaugaaaagaagaugaggaggagccagggaaggaggcagagaaggcccagcuugugagaacagaggagacccacagaaaccuaagcuaauggggguggggaguugaggcgggaacaagugaccgaaauuggacuauuggauuugacaaugaaugagccccugggacucucgcaacagcagucuuggugacuuguagaggcuccagaugcuuuuaaagcagugguccucaaccuuccccuuaacacccgcacguugugcugaccucaaccauauuauuuugaugcuacuccuuaacugcaauuuuguuguucugaauuacacuguaaauaucugauaugugaccucugugaaaggggucacagcccacaggugaagaaucgugcuuaaaauuuaaaaaguaaaauuacauuucauaaggcggugaggaucaaauguggggcuuuguguaggcuacacaagcccucuaccaaugaagcugucuccaaacccacugagccuaaugucuuaaauguaccaauucauuuuuaaacagauauguagaaacaaaaauguccagauuaggcguaggugauauuuugauaauaaguacacacuguauaauauuacaucaggucuaauguaaccauacccagaaacaguucgcuuccuuucuccuggggacauuucaccucuuuggcuauuucucuguguucauuggagaaauaguacucagauucuuugccuauuuccuaaauagggguguguguguguguguguguguguguguguguguguguguguguguguguguguguugcauguauauauucauagucauguguacauuuaaauuuuaaaaaccuauuuuuaaugaugguucuuaaauguuuuaacuuuccuuuuagcccaccacccaccagagguagugggaaagaaaggguacaggggaaguggaccuguuuagaaaaguucuuuggaguaacuuuugucuguuuuaucugggaaucaucaguucaguucacaaaccuacagcuugauccucucucagacacuucacggauauaccgguaguccaguucgguagagucaggauagcaaauacgaaucagcaaugguggcacugccuaguaaagacagccaggccgaagccucagcacaggucagcaggagggaucagaagggaccccaggagaaguucucagcugugccucucuuggggaagcaaagaucagggaagacacaacaccuacaggcauuguacagcuagagcaagccaagcccagccuccgucacuguccaacgaggccuauuauaccccuccaaacaucacguguccuccaccgcucucgccuuagcccguguaucugacaucccucugccuaacaaccugagucuguggaagugacaagaaacuguagcacaccaucagaaauuuuuuggugcguuucucucuauggaguccugacaaauguagcucaacuacacauguaagguggaccaacacauguguguuguuagcagagaaucuuaucaugugucuuuucacguuuguuuuaauaggacaucuuuuuaccuguguccacuucagcuaaacuuuccuucauguguuugccccaacaaagcaccauccaaccaauuuuccaaagcccuuaaauuuucacuucaaucauguguauacagaguuguguguguacauguguguacguguguacauguguauguguacucaugugugcauauguguguguauguaauauauagaaauauauguauauauagccuuguuuugaccauaaaugccguaauucuacuccuguacuuuuuauacuuccucaggcaggggaacagacuggaacaucucacuucuuggaagccaaguguuaaagaaggggcagggccaguaguuuuuuaaagcagaugguccaggaggagaggaagaaagauuuugacaugaaguuuuuuucuaaauucauuuggagcugagacgagucauguagagaagcggcccugucuccuguucuccugugguggguuggaaacaccagaucugaugucgucugucagugucacauguguaggccccucuuccuuugcaggccacugggaggaaaaauggccagugauaccccagguuucuacauggacaaacuuaauaaauaccgccagaugcacggaguagccauuacguauaaagaacuuaguacuucgggaccuccacaugacagaagguaggcugccaucaggaaagauguaguuagggccagggaggugacucagucagcaagaguucuuacuguauaagcaugaagaccugcguuugaauccccagcacccacauaaaaggcugagugugccucaguacaucccugaaaauccaguguuggguagaacagaggcaggaggauggcuagggcuuucuggcuaccagccaagcucuaaguucagugagggacccugucuuaagggaaaaaggcagagcgauagcauuaucuggaauccuucucugaccucuggguaugcacacgcaauccacucccccagcaugugcauauaccacauacaaucuacggaacacaaaugucaaaggauggaggaccaugauccaggaaauggagcuauaacucaguaguagugcaggggcuuagaauacacagguccugaguucaguuccagguccuuaaaacaaacagacaacaaacaguccgucccugcaaguguaaaguagaagacacagcucuuacuauccuagccggccuaggauaguaagacauuguaucuaaauaagcaaagaaauaauaaauaacaagacggguaaagaaaaggaaaaaggaaggaaaaaaaguacauacuaaucccagcucuaagaagauauuguuacugaggguaggugcuuaaaguaggugcaauucagacauugguacuucagcuccauagugaagcugucagaggccugugacagaguccuugagacagacccuggucaccccagaagccuggagacaaaagauggaggccggaguaaugacuuaaugaguaaacacauuggaagccaagccugaugaccugagguuuuuuccuggaccccacaugguagaaggagaggcuagauuuccaaaagcuguccucugacuuccaacaaacauguccuuucaugaguaugcaagcagcccaugcaacauauacucuaacccacccccacaucaaauaaauguauacacauacauauguauauacauacacccauacauacauacacauacauaauacauacacauacauacguauauacauacacacacauacauguacacacauaauacacauacauacacaugcauacauauacauacauauauacauacacccauacauacauauacacacaauacauacacauacauacauacacauacauaauacauacacauacauacguauauacauacacacacauacauauacacacauaauacacauacauacacaugcauacauauacauacauauauauauacauacacccauacauacauauacacacacaauacauacacaugcauacauacacauacauaauacauauacauacauauacauacauauauauacacacacccauacauacauacacauacauaauacauacacauacauacacauacauacauauacauacauacauacauacauacauacauacauacauacauagaaaaagcuaagcacggcaguucauacuuauaauccuagcacugaggcagcugaggcaggaagaauguugugcguuugaggccggccuagguuauauaguaagacauuguaucuaaauaagcaaagaaauaauaaauaacaagaaggauaaagaaaaggaaaaaggaagaaaaaaaaguacauacuuauaccagcucuaagaagauauuguuacugaggguaggugcuuaaagucugucagugagcccggguucgaaucccgaaagguacuuguguggugauggcaacuggcgcgcuuuuccuuagcuaaauuaccagcugaguaauguguugcaaauacugucuuuuuaaaccagguuuacauuucaaguuuuaauagaugagaaggaauuuccagaagccaaagguagaucaaagcaggaggcaagaaacgcugcagccaaauuagcuguugauauacuugauaacgaaaacaaggugagugacugccuuuaccccuagucaaagggcaucuguguguguguguguguguguucucucauggagaccguuuguucaaagcuuuacuuuuuuuuuuccuaucugcauuucuucugagugagaaauacaccaggagacuuguugacaaagcuguguacuucugagcgccaacuuacaugcucugaagccgaggcuguucagugggagauggguagggcuggcaagggcuaaggaggggagcuuuccaccucaggaggugaacaaaauagagaagacuugguagggggaaacgagucuccuugagggagauuacagagagccagcauaugagacaucgcaucccugaagaugcaaacuggguaaauggcguauucaccaccaacagcaaaacagauuccuugucucuggggagcugggaggggugugugguucugugugcuuagcaugugcaagacccuggguacaguucucuaacaucacauaaaacugucugaagauauuugagcagaaaaaaauuuuuaugaaauaaagacaugauauuagauaagauaaaccucgucgauagaggaaaauacagaaggaccagaaacaauacugaagacggcaggggcgggaggggagcgauuuuaaaaacgugguggcagaugauuagaaaguuuauguuuuguacgacaaugucaaaaccaggcagccguggcaggggcugcaaaaugagacauaaagugauucgugugugagacgagaaguuuuaccuuccaacauacucuuauaaucaauucaaaagcagcuaagcgaaaccacuaauucucuuaugaguaagcagaaaaacauuagucaaaagguuagauaaacaggguuccucuccucucucaaagucgaagaaagacaauaacaacaacgacggaaacuugugcaaaauagcacaaaggauaaacaucagugaagcaaaugaccgaaccaagcucuuuggauaaugacggagaaacuuuggaccaacccugauccgauggaaacagugaagguugagaccauaaugaagcugcuucuucgugcauccuuuccaucaagcugugaagcggcacagagcaucccucccgggcucagcacgcuugaaagccuuaagauacuccuuuucauggaagaggaagggggaugcguagccagaaagggcucagaugccagagcguauauugcucuuaccgaggaccagaguuagguugccagcaugucgggggcucucagccaaccaccugugacuagcuccaaggggucucagcacucucccggcucuuugggcaggcacgcacacgcacgcacacacacacacacacacacacacacacacacacacacacacacacauuuuaaaguaaauaaagguaauaaaauaaaacuuuagcaccauuuguucuguuuugguaaggcagucuggccucaagcuuuguguguagcucaggcuggcuucagguuguguagcucaggauggcccaaggcuuucuguguagcuuggacuggccuggccucagguucgcuguguggcucaaacuggccuugaucauuuugccugacucccaauggcuagcauaacagaugugcaccuggcuuuucuuaaugaaauuaugaaaggaaacugagugacuuaacaaauugcauauuuauaaauggcuugggaguauauuuuaaguguccuugccauuccaaaaaauacaaaaggggaggaggaagaggaggaggaggaagaggaggaagaggaagaggaggaggaagaagaggaagagaagggcauguaagguguuauauaugguauauaugguauauauggcaauuaucugaauucagcuauugugcagcauaugcauauuucaaaacaucauguuauauaccaaaaauauauguauuuuuaaugugcuauuuaggauuuuuuuaauuaaaagaauuuauuuuugcagauuuuuuuuuuacuaauagacauauaguucgcuuuuaauaagaaccuauaacuaggaaaucauaacauguuuuuuugucuuucacguuacuuagucauuucauaugcuaauucgugguuuguauuaagcacaucucuuuuuucuuuguagguggauugucacacgagugcaucugagcaaggcuuguucguugguaacuacauaggccuugucaauagcuuugcccagaagaaaaagcugucuguaaauuaugaacagugugagcccaacucugaguugccucaaaggugagagacuucuacuguuucacugugugugagcugagaaacugaggcacuucguauguaguuuuccagaaauauuugccccuuuuuauacauucacuauggaggguuuuaaaugauuuauaagcaucucuuuaaguaaaauacccaauuccuggggcaagagaaugugguuccucuuuccaucucgcugcuggggugugugaacacugcuuaggcagaggaaacaggagagcucuguguugcaggauucuucccuguccaaucacauuagggcagugggagguuugugauuggacaggagaagggaggcagagcgaggaguugaggaguaagagaaccagaauggaggccgacguggugguaucaaaagguuagaauaauuggguuaaagccuuaucauuaucauuuggcucugaaauuauuguauuggcaucauguaaauuguauuauuguugauacauaaaucugauuggcuaauuaagcguuaagagucuugauucugccaggcagugguggcgcacgccuuuaaucccagcacuugggaggcagaggcagguggaucucugaguucgaggccagccuggucuacagagugaguuccaggacaacuagggcuacacagagaaacccugucuugaaaaaacaaacaaacaaacaaacaaaaaagacuugguacuaccagguaauuagguguugugaaagcgagauggccuagcaggguuggcgaguuggugggcugagcgagugagaucaccuggcacaggaucuagcucucgauauuucccgaaacagcgcuaggcuacacuccucuucucagcugucaugaugcugggguggcagaacacagccgaagaugggggccccagcccaggugagauacagcacaggcugaggcugaggaagaaggcguucccaaacuccugggcguccguccguccgguggcugcuuagcucacggggagugucugucuggagggcagagcagccuucugcgggagacuuaggcuaccccgcucuguaugaggacuucuuucccucgcaauucuugaugagagagacaauccuugcuugucucaacuguuuaugcauuguucauuguggaaaaugggugcauacaacuuauccaggguggaccagagauuaaauaccuuuugcaggaaguaauaauaucuggaaagggaaguuuauuggcuaaacccuuggggcccggcccaucuagauacuucauuagcauggagaacgcuguguucuguguuaugugaguaguaaucucaaucuucauguggggugucguggucacauguucaacgacauuucccgcaacagcgcuaggcuacacuccucuucucagccgucaugaugcugggguggcagaaacgggauugggaguacauaaaaugccuacuauucuacugguguuucucaaccauccacugacugcucuuccagaggacccagguucaauucccagcacccacagggcagcucacaacuguauguaacuguaagaucugacguucccacacagacauacaugcaggcaaaaaccaaugcacacaaaauaaaaaauaaauuugaaaauuaaaaaaauaaaaaguuugaggcugcggagucuaucacaauccaauuuggcugguuuacuuugaaauuucaguuaucuuuggucaaccagauggaggaagaccauuucaaaaaccuagaaguagggcauacugcacuaauaguucuauuuuauuauuggcuguuagucuuuuucuaucuaggcuaugagaugaacuuuaucauaggaauguuuaaggagaacaaugaguucaauguaauccaugguuucagucauccgccagcccccugccaauaagaggggacugcugguuuuuggaggugcaucugggcaauuaguccacuaaacuuuuuuaaaaaguucaggaugcccauggaucagggacgaagagcucuucccuucccugaggccacagcagcugcaacuguguaagaaccauucugucuguacauggaaacgacucuauaucaguuucgguuagagagcugcuugucuugagucucugcuccucacauuuggauaaacggauagcauggaucagcaggaccggucuuaguccuacugugugaagagcgcaguugugagggauaugcugugugaacaaggguuagaaccuggagguccugagcacauugucagugugcugucuuccccaaaggccacaguacuguacccucagagcuuagccccugugagccccauccuaccaacuguuuuucucuccuauuugaacagcucuggaaaaggugcuagaccuuucccucuucucuucccucuacuugggauuggaaagauuccauuugguuuuuuguuuuuguuuuuguuuuaaaucaucacuugguguuuugcugucaggucuuucaaugaggcaagaaagacuuagauguugccugggaaauguagacaaggauauaagcuacuccugguuauuuacauuagauugauggccauuuuguggggauuaaauuaugugagguaggaaauauaaaucuaaauaaaaaaaauucuuagucugauuuucaggccuuuauuugucuguaggggccuuuucaaagugugcauuagauggacgauauuuuugauaugugaaugaauacucuaauuuuuccuagauuuauuuguaaaugcaaaauugggcagacaauguaugguacugguucaggugucaccaaacaggaggcaaagcaguuggcugcgaaagaagccuaucagaagcuguuaaagagcccgccgguauguguugccaguuagauuuaauuuguacaaucaugauucccuuugaaauugacuucagauugcuuugucuuuauacugcgggcauaugccuauugaguaaagaauggucccuccauccuguguaccaacaaugauccacgaaccauggggccacgagggucugagacauaaaaguucuauagcaacucgggguugcuuuuuaaaacuuagcccaaacguccaugaaaaaauguguuaauuuugugauugcaauuguggaguugguggccacggggagaguaugugcaguaguguguacccagugacagaccuccucagagaggccaguuagcucccugugaacagugauggacugccucagggagaccaguuagcacccugugaacaugcuaagggcugucccuucuuucagaaaacugccggaacauccucuagcguugucacaucuacauucaguggcuuuuccagcagcucgucuaugacaaguaaugggugagcuuggguggcaacagugcugggcaggcugaggguguggcaugucugaggcuguggguccugaucccccccuccccaccagacugaauucaucaagguuccccuuuucuuguaguguuucccagucagcaccuggaaguuuuuccucagagaacguguuuacgguaggauaccagccuugaaguuucccauuucccuuucucuccucacuuagaugugaucuuuccauaugauuaugaucauuucauaaguuuuacauuucaguuucauguccuuacuagaucaugauauuaacagucauugccucuuuucuguucucuuuauuaacuuucauucauauuaacuucucuucuucaaggacaaaauucuuccccacucucccccauccuuucccacccacuuuguaacccucccucccucccucccucccucccucccucccuuccuuccuuccuuuuucuuuucccuucuucccuuuccucucucccuuccuccuuuccucuuuccccccucccuccuucccucucuccuucucucccuuccucccucuccucuuuccuucacacucuccauccccuaccccuacuccucccuccuugcauccuucccugugcugggauucaaauucuagcuauaaauagguauucuagccaaguucugcuacugaacucucuccuggcccuuaccuuuguucuuuuuaacguuucuacuuucuuuuuccuuguccauucaacugaauaauauuugguguaguuccaccccuacuuagaaucagaacuaaacuuaaaaaucaggcaauuuguuguaaaaauccaucuauuuacuaagaacuacaagucuguaagaaaaagacaguugauccaguagaacagauauggucugaagggaugugcuacaccuaagugggcagcgagugggaaaagaugcuucauuccccuagcgaugaggaaagugcaccuccaaauggccauuugauggcaugccacagcugcuuggcaauccugcaguaagcguugguagcgacucagagaaauggccgaccuaggaagcugauguaaggaaccuggucacggggccagcucccaaacuaagacgauggcucuccucaucugaaacagcuuccuuuuccuuuuguugcagaacggucucggagaaaauaaaaggaaaucaggagugugaguaucauugugcacggaacauauuucagacuaggaaucucuuucagacuccgucuaucagacucaccuguugacuguggcacugacagaacauuguacguguguguuugggugguagucucagaagcaguggagagcuggaaaccaauuuagcaggagagaaacacagaaacacaccacacacuuacacacucacaucuuuguaucuguagauacaaaagcccugugaugauguagcaggcgccaguggugggcuugaggguggggagacagggugguggcauggcuuuguggggcuaauucuggugaccuuugaacaucucacugcagauggcucacuaucagagaggcaugagggccagagggaggggggacccaggagaccuuuguccuaaggauguucugagucugaagaaaaaggaggugauagcaugccaguggcacgcauguucagguaaaagugagaugcaggagugagaugcaggaaagaauggaagagaaucaaaaggaaguguuuauucugaagaaggugaacagucucuuccuaucccucugaugacugaugcaaaauagaaauuggccggugcguggggcggagccugcucuaaaguucuauagguuguuguuuugucuuaguuuucuauuuuuuuuugucucaauuuuagaaaaguauccccugaugaugugcaaagaaauaaauauaccuuggacgccagguaagcggaguuugucuaaugguaagcucacucucgaaaccguugcuuagggucagguuaugaguuguauuuccacccaaguaauuaaugugggcuguggcauaggcaggcccauggaggguuauggucucucagagaagugagguuuagggauccaaguggaacgugucggaugcagaccucggugauguuaucaggcuuucugauauccauggaugccguugaaacugaaaagcaaguaggacuuucagcgauuuggaagaaaaauaaauagagaagagaaaggauagggaggaagauagguguggagggaagagaggaaugccuguggggauggacacaagucagcgugggccuguucucuagcuuguucacacaagacuucacuaggaaaaaaaaggaaagggggcucaccuucuguagaugaugguucaguuaaaaaugaaacaccuaagaugcaagaagccggugugcggcagcggaacauugugaacaaauucugaaugcuuauuaagcaccuagcccuuaccuguaacuguugugggcugguggcuuaggguaggaacaaauaaaauagaacucuuucucugaaaaaauuuggagguggccacuggcauuaaggaaauacuuauaauuaaacacguguauauucagaggcuggggagauggcucagcugugcaaacaugaggggccuacguuugaauuccaagugccccuauaaauagacaggugcaguagcgcacacaccuagaacucucaaugguggccgaauggagaugagcgauccacagccagcauaaccagucagugagcuccaaccucaacaaaagagacagccucaaaaaguaaagugugucacagccaaacaucggcuugagcacagggaccccaguggaggaguuaggggaaggacugaaggagcugaaggggccuuauugggcaucagugggaggcaauugguccuaugaagacucgaugcccccguguagaggaaugcuacggcagugaggcuggaguggguaggugggugggagagcacccucagagaagcagggggagggggaauaggauggggaucuguaggagggaaaccauuggaaaaggagauaacauuugaaauguaaauaaauaaaauauccaauuuuuaaaaaguauaaaaaaauccaacuuauaacagaaaaaaaagaggaaagugcaaggugggugugguggcacacaucuucaauuccaccacucaggaagcagaggcaggcagaucucugaguucaaggccagccugagcuacagaaagaguuucaggaagccaggacuacacagugaaacccugucacaaaaaccaaaccaaaacaauaaaaaagguggagaguaacuaaggaagaccucugucaccaaucucuggcauguggcacgcacaugcaugcacacacauaccauacagacauauacacaagcacgcacacauacaugcacacacauacaugugcacaaccauacccacgugaucaguauucacauauuuauaugacacacauacgcuguaauuacaaaauauggccagaguuaaagaagaacaguaguaugguaagaaauggaaagauagcccuagggucaccuuuuuguagagaaaaauugcauugaagugcaaugcaaagaauaagguguagugggaugaaauuggagaaagaacuggggacaugcuauguugcauuuuauugggcauuuaaggguuuccuggguuuugcugaaugcaaagguaagguuuguagaagguuuaggggagagggagacacuaucagacuaaguuuucacagcuaaauuaggguaggaggagcugggugucagucagcaagccaccauuguaggggccugauggcugagcuggaguaaggaugccagaaaugacgaaacaucagcagaugggagugcugcagguuggaagaauuagcaggccuuaaggaugggagauggggaaauggagggaaagaaacaggucgcuauaggcaaccuugggcuugugcuuuuucugugguccuuguggcguacaacugagugauucguuuuaauacuuguugaggugggguucauuucuucuuuguagcugcuagagaggaugcuucaucauguacagccagagggggugaucuguuauacugaauucucuguuuaauaugggaggucaagagaaaaaggaagagggagauguuuuuuugugacucaggaguucuggcagacauuauuaaaaacaauaagggaagaaucauuuucaucauacaugaaacacugaaccucaggguaacagcaauaucaaucuuaucuagguuuaacagcgauuuugaagacauagaagaaauuggcuuagguggauuuggucaaguuuucaaagcgaaacacagaauugauggaaagagauacgcuauuaagcgcguuaaauauaacacggagugaguaccugucuugcucuuugaacaguguguugaacucccagcucucgccuuuaugugccuauccuucuuugccugcuaauuucuuucugguccuccuugauuuuuuuuuccugacuacaagaguuugacuuauccugaaaugaccuuaccuuacuaacauugguuauuuauuucaguuuaaaauaugacuguaucauuuugagauagugcugaaaccucaagcuguugacuuaacuuggucuaaggagguuuccucaauuuucuccauuuugaggcucccuccucucugauguuucaaacuuguaucacauugaccuaaaaagagccacaggcuaauuucaggaaaaccgcacggugucuuagcucuugagcccuguugcuguaaagcuuucauuguacagagucuuggcuucuuugcauaaacuaagccccucgauuuauguuugucacacagugaaguuucuaaguuaggcucugcuugcugcuuggguugacuacccuugcugcccaaaugggacuuguuugugaacuucaaagauuuuaacacaucuucucaacagaguaucaaccaugauguagcuauugaaaacuguuacagacagucaaaaggagaugcaaacgaugcauaccuuuggauagcuaccauuuaagccucugucuucuucuuauacauugagaaugagaacagcugugguuugggauauggcuuuacuauucauucaguuuucuucccuuuugaguucuggcuccaagcuaaaaaaaaacuuggcaugggaaccacaaggacuacagagagaggagccugcgugcuugcaucccauuacguaagguguucuguggcuaucagggguauguaaugucaccuuuguuuucuggguccuuuuaaauaggaaggcggagcacgaaguacaagcgcuggcagaacucaaucacgucaacauuguccaauaccauaguuguugggagggaguugacuaugauccugagcacagcaugagugauacaagucgguaagaagaaauucucaaggcugugauggauggaaagcacuugguauuuauugugugggggccacuagaggaggcuguugcucaucacagccuucaaaagacacuguggucuccugaucuacagacaagaagacaauucauaaucuuucagggauccucucaaucuuccaaacuuucuguuaguuuguuuguuuuuuuuuuuuuuagacucacuauauaccucagacuggcuucaggacaggccuccugccucagcuucccaagugcugugaucacaggcacauauccaguaugucucacacaaacuugccuuaaaggcauuuuguuuguuuguuuguuuguuuguuuguuuguuuguuuucaagacaggguuucucuguauugcccuggcuguccuggaacucacuuuguagaccaggcuggccuugaacucagaaauccuccugccucugccucccaagggcugggauuaaaggcgugcgccaccggcuaaauggagagauggaucaguagucaagagccuggauugcuuuugcaaguaugucagguagcucacaacgacauguaauuccaacuccaggguauccucuggcuacugugggugccagcacucguguacagacucacacagagacaaagacauaucagaagacaaaaggauuuauuaacuuuaagugaauuaucgacuacaucauauuugcuaccguauguguuuggaaaauauaaauucaauaugggaggcaacuuaguucauaagauauguagaaacugugguuagcaaaaagucuuccagcuuuauauagcaaccaauuuaucggcacaucuguaggaguuucuaaaugggcugucaucucaggcuugguuuuuguuuuuguuuuuucuucuaucucuugugagacucuaaucccuaugaugauaaagaaaguaccuaacucauuuuuuuaaguguucugugcccuuuguaaagcagguguuuaguuaagugaugacaaauuaaaaugcuucaaacuuacuuuauaauagcgaaaaaaacuagauuucugcaauuaauaugacuuauaucuauuaucaaaagugaucaaagaucuucagcauuaaagaacauauaggcuccuccuuuauagauaaacaaucgaagcucuggaugcuugggaaauuaugacuuauauaaagugguuuguuuuauuucagguuuauuauauucagauuuuuauucugagacaugcuuuggguuucauaaaauaugguagaacauuuaauguacugugaauuuuguauccagauacaaaacccggugccucuuuauucaaauggaauucugugauaaaggaacuuuggagcaauggaugagaaacagaaaucagaguaaaguggacaaagcuuugauuuuggacuuauaugaacaaaucgugaccggaguggaguauauacacucgaaaggguuaauucacagagaucuuaagguaaguaggaaauccaccuuguugguugauaaacacacaguuuaauaacuuuaaaaauguaucuucuuuaguuuuagauuugugauuggcaguuagucacgauaaaauuacaucucucuaaucugcuggaccuaaagugggucuggaauuuacccaaaugcugucccauguaacugccuggcauuucuccgaggcccaugaacuuauugugaccaugauccuauuagaagucucgguccugucaggccauguuuaguuugauggucauuaccucauuaaaagcaaaaacacucuucauagucugagaaauuauugugguugccagguccagcuggcugcccugacccagccgcugcucugcucuacugugguucagcggcugcacccgagggcaggcacagaagagugcauggcuuaguguuggcaugauugggauuuucugggccgccauuaggaaaaccauccaagcuuucaaauaugcauagcguguuugcuuuucaggaaccacuagguuccucaguuuccuuuucacuagcaacaaagaagaggcaccaaacagcucugugauuuccuucuuuaucacaaaccuacagucuuagucaggguuuguauuccugcacaaaacaucaugaccaagaagcaaguuggggaggaaaggguuuauucggcuuacacguuuacauugcuguucaucaccaaaggaaaucaggauaggaacuuggaggcagaagcugaugcggagaccauagaggggugcugcauacuggcuuguuugcuugcuugcuuauagaacccaggaccaccagcacacggauggcaccacccacuaugggcugggcccucccuccuugaucacuaauugagaaaaugccuuacgguugggucucauggaggcauuuccuccucaagggaggcuccuuucucugugauaacuccagcuugugucaaguuuacacacaaaacuagccaguacaacugaccccuugucaacuugacacacaaagacaucacuauuaaaacucaacccuuggaaucccaagggaucccuugggaucuugaucccgagaucuaaauaacuuuaaaaguccuacagucuuuauauauuaaaauuucaaucccuuuaaaauaaccaguaucuuuuaaaauucagucuuuuuacaacucacagucuuuuaacugugggcuccacuaaaauacuuucuuacuucaagaggggaaaauaucagggcacagucacaaucaaaaucaaaaucaaacuccaacuguccaaugucugguauccacucauaaucuucugggcuccucuaagggcuuggaucacuucuccagcucugcucuuuguagcacacggcuugucuucuaggcuccagaugccuguacucugugcugcugcuguucuugguggucaucucaugguacuggcaucuccaaaacacugcugacuuccacuguaacuaggcuucaccaacagccucucauaggcucucuucauggugccaagccucaacuccuuuacaugaccccuucaguccugggccaucaauugcagcugaggcugcaccuucaccaauggccuuccauggccucucacagugccaaaccucagcugcucuccgugaccccuucaugccuucauaaccaguaguaccaccugggugacucuuauacauuaccaaguccugcugcagcaagagguacaaccuuggcuaucacuggaacacagccucuuugugcuuucagaaaacacuuuccagaagauuucaccuuaguauugcuggccucuuccuuuuuuuuuuuuuuuuuuccuugagacaggguuucucuguguagcccuggcuguccuggaacucacucuguaaaccagacuggccucgaacucagaaaucugccugcuucuaccucccaagugcagggauuaaagauaugugccaccacugcccagcugcuggccucuucuuaaucacugcuaauuuuuuaguuccagcuaaccagcaucaaaguuaauauaaagguuuugcuauaguaguucugguaucuuguuaaccacagcuaauucuucaaccccaacuaaccaaaaccacagaaucuucacaaucaaaauagcaauggcccugauaaaagucuuaaucuugccucugaaauuucacaagccaggcuuccaucauuugaacuguucucaacauuaucuuccaaguuccuacagaacaccccacagagcucuuaacacccaagggcucuucuagcccaaaguuccaaaguccuuccacagaccuccccaaaacauggucagguugucacaggaauaccccacuauucugguaccaauuuuucuuagccauaccaaguccugccugauggcuuugcucagguccuucccuggaagagcuucugaugucccccuuugguccugauuccuuuacuuagccuuuucgaaucacucugccacugcccuuuccugcucgaggcagaagagccuugacuaggcggaacuugacuggcuguguauuccacccgucucauacauccugagugaggaaugcuuccaaacagccuagcugcuugcugagucuaguuaaaauuaaguggacuucaaaacauaggaguucuucuguuugccuugcauucgugagcuuaauaauuugauauucaagcccacucguuucuaauauuucucuguagcaauauaugaaaguguucuugaaaguuagaacauuuuuaggaauguuauguuccaaaagauaaauuauguccaggauggaugacacauacuugaaaucccgacauuugagaaccugagggaggaagauuaugagcuugaggccagccugauccaaacagcuagaucacaucucaaaaacauucuaauuuuuguuuucauccaguauuccuucacuucaguguuaguuguacauagaaaugaacaagcaauuaacuucuuacacauaacucacuuaaaaccuaucacaacaggcugggugaaaaacagagucaagaaugcauuugccuuuuucuguaaaagcagauauggaaggaauuuguaaaauguauaagaaaguguuaccaaaccuuccugcuuaggauaugcuaacguuuauuaaaaucuguuaugcauguuagcauauucugaaguagucaaccugggaaagagaauaagccaugaagcacuuacuccacaugcuaaauauaauuaauuauauauaauguauaauaaauuagauauaauauggcuauuauauauuuaauauaguuauccuacuaaguuacaaugccaguaaaugagaaguucggguauuccucccaggcccuccucaaagggcguuacgaguucuggaauguacuucccaacucgucugccagcuuuccugcaucugcucuggcuggguugugugucaugaaguggucuuuucuugaggucuuuuccauauacggagaaggucuuucucuggguguaguucauccugaucugagauccuuucaugaacauuuuuuuuuuaaaacugauaaugcugcucccucucaucucagaaaagaguagaaagauguguuugcaggugucucccaaaggacaauguuuacacgacagagccauucuuacaugaauccuccaggaguucaauucuuaccauguuagaaucuuaagcccuaggccucaucagucagggcauagugguuuuuagagagagggcuuccucuggucucuguaucuuaccuugguaccagagggaucagcccuggccggaaccucagagcuguccucugcucccuggaugaaggugccacgucuucccuaucuuuuaaccucaacacuguaucugacuaaacaaggagagcgucacgcauuguauuuucuuuuuaauaaaaagcaaugugauauuauucuuugucucguccagcucagcuguuuacacagauucaaccuccuguuucucagagguggguugcagcugcuguucugagguagcaagagcuacgccauucaucugugaauguggacauguggacuucaguuuagcuacggaauguugucucuccaccucaaucacaaacaaaucugcuucuuccaugacugacuuuagggucaaaucaacugacugaacuuggaucucauugcuaauuuuugcacagggcuccucagaaagcuccuuuuggccuuuccugggcuucccaccuuaucccucuuuccuuaccuaggcccucucauaggcguguguaauuuuuggaagaauggcaaaauauuaauuuugucaccaacaaucuuccuguuuucagucagugcuguguaguuauuuagcacauauagccacccuuauuuguuauguguguguguguguguccauguuugggcucaguggguaaagauguuuguuauacaagacuagugauuuaaguucaacuucuggagcccacauauagguggaaagaaaaaaacugauguuuugguuuuaguucccaucggauccugagccacaucugcagaugucccuaagguggaggcccagcccuguuuugggauggggagcucuaaccccuuuuccuguaccucuuacugggcuagggugugugagagcaaggagccauacucacacccacccuccagucuggaacccucuccugggacccugcaaacugaaacuuucucuugauagcugaucugauguuuggaagcagguauaacccaaaccaccuuugcugucauuuaaaagucuuuucuuuccuucugucugucugucugucugucugucuuucucuuucugucugucugucugucuuucugucuuucuuucaaagccuacagcaccugguauucccagguggucucccauccaacuacuaaccaggccugacccugcuuagcuuccaagaucagacaagaucaggcgcguuuucauucuucacuugguaguuuuaaagacucaagguuuuaaauucccugguuuggaaagccuguggaaggauaaaugcaauccauacaaaccaacacaacaaauaguuggggcugggugguggugguugcgcacaacguuaaucccugcacucuggaggcagaggcaggcaggucucugaguucuaggccaguguggucuacaaagugaguuccgggacagccgaggcuacacaaagaaacccugucucauccccaaauguaguugggaccugugguaauaguugguccaacuggcauaugguaauuaauuuuuuucuauagccagguaauauauuuuuaguagaugaaagacacauuaagaucggagacuuuggccuugcaacagcccuggaaaaugauggaaaaucccgaacaaggagaacaggaacucuucaauacaugaguccagaacagguaaagcccuuucauuucuauuuaauuccucuuuaacuucucugucucucucucugucugucucucugucucugucucucguauguacaaguuuauguagguguguguacacgugugugguguguacuugcuugugcaugagcauauagaggccagagguugugucaggaugccaggaaucuugucugauuguucuccaucacacacacacauacacacacaguaggggggggauaucuuauuuuccaggaccauuguugaagaugcuaucuuuucuacaaaguaugcauuuggcaucuuugucaaaaugagggagauguguggguuuauugugggucucuuauucuauuccauugauccacaugcuuccuccguguuccuuucaugcauguuuguuacuaagucucuguaauauaaguuaaaauccauuacagugaugucucagguaauguucuuuuuauuuaggauuuuuuuggcucucuggggucuuuuauucuuccauaugaauuuuaagauuuuuuuucuuuuuguuaaguauguuauuggaauuuugauggggauuacaaugaauuuguagaucaccuuuaguacuauagucauuuuuaauauguugguucugcugauucauaagcauaggaagucuagguuucucuguguagcccgggcugcccuggaacucuguagaccaaggugaucucaacuuacacauccaccugccucugccucugccucccaagugcugggaucaaagguauguaccacaauacacaguauaauuuuuugaagcuaucaucaauaagauugauugauucuuuuaacacauucauuacugaaacauagaaaaccuacucauuuaaaaaauuauuucaugugagcuugccuggauguauguauuugcaacauuuguaugccugguaccuguagaugccagaagagaaugucagaucccuggaauaggagauagagauagaugaaccaccauagagaugcugggaauugaacucagguucuuuguaaaaguagagaccuggacgaucucuccaguccaaaacuacugauuuuuggauguggacuuuguagccaguuaggaauuuuuguuagaaaauuuagagucucuuauauacaguauuguauuauuuaaaaauauggcuuuggccucuuuuccugucugaauuucuuuccuagcuuucucuugucuggcuaagaguucaagaacuagguugaaugcagguggcgaaaguccauccuguugucugacucuuaguguugauggaaaugguucugauuucgcaauuugguaaaaaguuagcuguagcuuuguuuuauauagccucuauuguguuccuucuguuucuaugugaugguuaacgcuagugcccaacuucaugagauccagauaaacaggcauuuuuuuguuucguuuuuucccccaauuauuuauuuuuauucacuuuagaucccaagcacagccugcaccucccccaguccagcucuuacaaaucccuacucccaauauccccucuccuucaccucagggaaaggaaagccccccuuggguaccacccccacccugggacaucuagucccugaaggcacauccucucccucugaggcucaacuaagcaguccagggaagggaagggagccaaugcaaggcaauggaguuagagauccaauuguuaggggacccacaugaagaccaagcugcacauuggcuacaaauguucaaaagccauuuucaucuaauauaucaccuauagcuauuguuuucucaaaaggcauggacacuucuauuaggugaguaacaaagacauauguauuucgccuuucaguuauuuuuaaagcacuauggaaaagaaguggacaucuuugcuuugggccuuauucuagcugaacuucuucacacgugcuucacggagucagagaaaauaaagguaaagacgccaggagugaauccagggacuaaaguguuggccauccucaagcacuauggucuugccauucggugaggcugggugggaccacauuggcuucugguuguaagugaaaccuaugcuuccucuuucaaguguugccagccauuccgcuauagauuaaaaacguuggcuuucuuuagaauacguguguagcccguaagauucccauucauguuugcuagcagcaucuggcagaucggagggaaguuucugcucuaagugcuaccuggauauaaagaggaacaagccaguuucucaagggauucguuuuguaagaggaaaggaagauaacauuggagaaugaguaauuuuuuuuuuuuuuagaagacagaaagucugugggaacagguaaaaaucuuuccagaagucuggauuuagguuucauggaagcacguaaguuagguacugaagggucagguuguuuguugguuggguuuuuuuuucuggguuuuuuuuggggggggauuauuuaagggcauacauacacauacaaauacacacacacauacccauacacacgugcacgcacgcacacacacgugcauguauacaugugcucugguaugcucauggcagucagaagacaacuaacccgagcuagcucacucuaaugguuugaaauaaaaagcaugcaaccuugcauagagauaagaaugugcagugagugcuggggcugacagguuggguaugguuuuaucugaagcuggugacugguggggcuggaaagggugugggcuuugucgugugggugguggggaaucacuggagacagcaggcuauugggcauccuaguuggaagcucaggaaaaaaaggcuugccuggagugcagagccuuaucuucccuaaaauaggcgugauggcgggauguacugccuagcauuccaaacagagggaaaugaugagucuugugcaccaaucuaucucgucaaagcauugaauguuaaggauggucauacgauugggguaggcuuggggagggcguuuugcuugcuucuuagacuagagaguccacccuacauuuuagaaaucuucuagauuuagugugucuccagguauuauuguguuuaguuuuucuucccaugucaaucacugccuaguaaauacaucuauuugugguauuucaguuuuucgaaagucuaagaaaaggcgacuucucuaaugauauauucgacaacaaagaaguaaguccuugaaagcuaucagguugauuuuuuuuuccacuauuuucuuucccaauacugacucuuaccuaucauuaacagaaaagccuucuaaaaaaacuacucucagagaaacccaaggaccgaccugagacaucugaaauccugaagaccuuggcugaauggaggaacaucucagagaaaaagaaaagaaacacauguuagggccuuucugagaaaacauuccucugccgugguuuuccuuuaacgaucugcagucugaggggaguaucagugaauauuauccuucuuuucuuaauaccacucucccagacagguuuugguuagggugacccacagacauuguauuuauuaggcuaugaaaaaguaugcccauuuccucaauuguuaauugcugggccuguggcuggcuagcuagccaaauauguaaaugcuuguuucucgucugcccaaagagaaaggcaggcuccugugugggaagucacagagcccccaaagccaacuggaugaggaaggacucuggcuuuuggcauaaaaaagagcugguagucagagcuggggcagaagguccugcagacagacagacagacagacagacagacagacagacagacagagacacaaagacauggacuagaauggaggagggagggaggaagggagggagggagagagagagagagaaagaaagagagagagaccacauggagagacaaaauggcuuaaguuagcugggcuaccugagagacugucccagaaaacaggccaacaaccuuccuuaugcuauauagaugucucagugucuuuaucauuaaacaccaagcaggacugcuaaaaacucugcaauaggguuuuuuuuuuccuguuacuucaaaagcaaucuuacaaaguuauuuuuuugacaauuccauacaugcauuguguucugaucccacucugaacccucugccauucaugccuugucugucaugugaacuguugccucugaauguggggguccaaauuaacccucugcccuugaguggcuucucucagguagugauugugaugagaaaaguaaugagaugcuggcaaagaugugcagaaagaagaacacuucuccacugcugguaggauugcaagcugguacaaccacccuggaaaucagacuggagguuccucagaaacacaguacuaccugaggacccaacaauaccacuacuggucauauacccagaagaugguccaacauguaauauggacacaugcgccacuauguucauaguagccuuauuuauaauagccaggagcuggaaagaacccagaugucccucagcagaggaauggauacagaaaauguggcacauuuacacaauggaguacuacucagcuauuaaaaaugaauucaugaaauucuuagacaaauggauggaucuggaggauaucaucuugagugagguaacccaaucgcaaaagaacacacaugauaugcacucacugauaaguggauauuagcccaaaagcuccaaauaaccaagauacaauucacagacuacaugaagcucaagaagaaggaagaccaaagugugggugcuuuggucccucuuagaaggggaacaaaguacucacaggagcaaauauggagauagaguguagagcagagacugaaggaaaggccauccagagacugucccauauacagagacugggaauucaucccauacacaguuaccaaacccagacacuauuguggaugccaagacauucaugcugacaggagccugauauggcugucuccugagagguccugccagagccuuacaauacagagacugaugcucacagccaaccacuggacugagugugggguccccaauagaggaguuagagaaaggacugaaggaguugaagggguuugcaaccccauaagaacaacaauaucaaccaagcagaccccccagagcucccagugacuaagccaucaaccaaggaguacacauggcuccagcugcauauguagcagaggauggccuugucauguaucaaaaggaggagagguccuugguccuaugaaggugcgauagaugccccaguauaggggaaucaagggcagauagguggguuggaggaacacccucauagaagcagggggaguaaggaaggauauggggauuucugggagggguggaaacuaggaaaggggguaacauuugaaauguaaauaaagaaaauauccaauuaaaaaaaaaagaaaaagaaaaaagaaaagaauaguaauaaaaugguacaggaaguagaguuauauugcaauaaaccuacuguugggcuuucaggacugguuugugggaggaaugugaaaaaguuugaagccccagguuagagaaguccucaaaugguauacgucaaacuuacugugguagcucaaaagucuccugagaggcccugcuuggaguuagccuuguagagguccagucuuuccuuguuguucuuucagacuugcuuuguagaauauugguaguuacuuugugccuuuguaugcuguaauaguuguuuuauagggccucacagcuaagaguuucucgcugcuucucaaagcacuuuggaccuuugcauggaguugaguauuaagauuaugggaauuucugaggugggacugaaagcauuuugcauuaugagauggccaugagccaacagagacuuggacacacuccuccacugucaaccgaggcuucugccaaaucuucccugucaugaaggauuguaucaucugaaauugagucuaaauagauaaauaaauaagu

SEQ ID NO: 12244 - RNA, 86703 nt, Mus musculus
aguuugcuaguaggaagcuccggcgcuacaccggcggcggcagcggcagcgguagcagcagcggcggcgacggccaagcggccggauuccccggcagcgaccucgggcccuccccguuccccaccgaccccugcucccgcuucgucccguucugggccucucgcuugaguuccccgcuggcgagcgggcgccaccggccggagcguccauccacgcgccgucucucggcgggccaggccgugccggggagcgcagccccggcggagggcggcccggggcggagcggggggccugccccggggcgguggugcgggaugccgccgccgccgccgccggguugcguuggcucucggcgagcggcgcgcgugucggguggguguccggccgcgggccucgccccccagacuccucgccagcgcuagccgggccgcgcggcgccccgagggggccgggccgugcacgggcuguggcccuucuccgcgccgcgagccgccgccccuccgcccgccccgaggcgccccgcgggcaccaugcaggcgcagcagcugccuuacgaguuuuucagcgaggagaacgcgcccaaguggcgggggcugcuggugccugcgcugaaaaagguaggggcgcggaacccgcuucccggccgcaguccgcgcggggcugggcgaggguggggaggcggggcgccacugucgucuuucuucccggucucggaucucggggaggucugcucgggcugcgagguuccccgcguccgcugcuccagcuguugacacucgcccggggugcgugggaaggccgcacacagucggggaggguuggucuggaucauccaagcgcggaggcggggguuggaggagccucgguuuuccguggaggucaacgaaggccauugccuaccuucucgaucuuccgaacugcggucaaccucucguuuuaggaguccgguacucucacuggcucgaaagugccuuggccacagugcuugccuaaguaauugcgagguugccugccagcaagaacauggccugcucggcugugcucguccucagucauaacuccccguuuucuugacccccucccccauuacagcggugaugcacaugccacuguauucagauugguucuuuugaagugucugagaaucuuugaacgucauuugguuugguguuuugcaucuuuuuauuuggaaauguugcuacauuuuaaaagcuucuaaagcaacugucuguccuuugguuaggcauuuuggauuuuuguuugccagugguuaaaguuauucgugaauguugcuacauuuuaacagcuucuacagcaacacuuagugacauaguaaauacuguacuaagacaucugaaacaggugugcuugaauggauuuuaaaacaaccagauugguuuuuguuuucauuugccuuaccuguagaaauuguuuuacaauuuaaucucccauuucuuguugcucagaugauuuucgugcuaucuuugcuaaaaugcaguuuuguuacuacugaguaccuggcguuuacugugccauuaugcagagccuuucuauuuuaccagaaagucuugaaagguauuucauacucccagaggccaguaccuuucaguuucucgucugcccuguucuccccuuccccucuugguauguuauguggaaacuguuggcuuuguuggaagacuuugcuuuuaucuuucagacuuagguuccugcgcuuuauccucaagugucucccuacuuacaaaccucuguauguuuucuaagaaaaucaaagagaccaccuuguugugcauccuuaaugacuccaugagacuucaguccauuucuacauuggcuuuaccugcacaauugccugcuuagcuuggagaauuggagaagaaugccucaugaugcuagaaguuugguauuuugacaggacaggaugaagacaaaaaauugauuuauauguacaaaagcucucauagaaccaguuugagguauauggcuuaaaagcaauagcuccuauucuaaggaaaccuccaaaauaacacucgaggcuccuuuagaaugguagacagagcauuguagaaguuggcagacuacucuaacuugccacuugggugguccuugcugaaaucuauuuuguguggcuggcauuguggauuuuguuuuguuuuucaauguauguaauuagucaccaguuucuuuuuuucgagacaggguuucucugcauagcccuggcuguccuggaacucacucuguaggccaggcuggccucgaacucugaaauacgccugccucugccucccaagugcugggauuaaaggcgugcgccaccaaccucccggcagucaccaguuucuuaaaaugagaacuaucacauaaacucugagguuuguuuguuuugaauuauagauggacuggccauacauuuucaccaucaacugcuagaguuuugagugacugcuuucuuuggaaaggguuuugucuccaguucaucaguguugcuuguguucuaucgcuucaugguugguugguuuuccauuugaagcagagaccucccuguagaagugauaugaagagggaguuuacagagucucccuaaugugugagguucuuucccucauuuacauuuccaccugcaaugcucuuaagacacccaagacaagguuggauauauuucucauauucugaauaugcucuuuuguuuuuuuuuuuuuuucccgagacaggguuucucuguauagcucuggcuguccuggaacucacuuuguacaccaggcuggccuccaacucagaaauccaccugccucugccucccgagugcugggauuaaaggcgugcgccaccacacccggccugaauaugcucuuguagcugaaaacuugaauuaugguauguguguagauguguccuuggacauuuuguguccuuggacauucugugugggugucuccuuaucuugagcucuucagacuuuaaacuacuugcguagugcccgacuguguguuuucauaccugaggcuuuuuggauagccugugcauuuucucuggucuaauacuauucaaccccagagauuuuucucaaccuaguggcccauccuaacucaacagugaauuuuaaguccuaauuuacuuguccauauucacauuagcuacccuauuggacuuguuguacacaggugcuaggccuuacaccuguuagcacucauuuugguuguuuuguuuguuuguuuguuuguuuguuuuuguucuuuugguuuugguuuuucgagacaggguuucucuuuauagccuuggcuguccuggaguucacuuuguagaccaggcuggccucgaacucauaaaucugccugccucugccucccaagugcugggauuaaaggcgaugaacaagugucuuuguagguuaccuugaguuugucagacuuuaaaguaaauuauuuagaaaucuugcuacauuuuuuuaaagcuucuaaagcaacauuguaacuuaguaaaucuucacaucucccuccuuuugguuuggcguuuugaauuucuacccuuuguaugcuucauuuaguuugccaguaguuaaaguuauuuggaaauguugccaauucuguaaggggauacucaaaacugacccccaccaccaguuuuuaacuucuugauuaacggcuuuaaacuuuuauuuaauuggcucaaaacugaagccuaggacuccuuuccguacugcugccugccuucaggccaaaccuucugcuuaucaaccucuaacaugcucuuggacucugcucugcuaacugcuuggaguuuccgagguuacugugguaaccucucaguugaguuccuuacccccaacccaccugccuuuacauauuucagaaguuauaaaguacuuucgaacauguuauacauuuguucaaaauuguugauguccuuuaaguuaaaguuaggguuuguuuguuuguuuuuuuaagauuuuuauuuauuuuauguauaugacaaguacacuguagcugaucuaggaaacaccagaagagggcaucggaucccauuacagaugguugugagccaccaugugguugcugggaauugaacucaggaccuuuggaagagcaguuagugcucuuacccgcugagccaucucagcagcccuaaaguuaaguuuuuuaagcauggaauuuauaagacggcuuuaccuuggccuuccuguuugauuuccuaccuagaucuuucuggagagcacugcuccuuuuccugaauguauuuauuaggccccacagugucuuuccuacugcaucuaucacaucccacaaauacuugauucuuguuucagaacagguauggccuuuggcacuaaggauaaaugacauauauuaagaagacuaagucgagggaaggugguaguggauaugucuggagagaggacuuguuuuuaagccagggauuuuguuuuuguuuuuuuuguuuuuuuuuuuuuuauuagauauuuucuuuauauucauuucaaaugcuaucccgaaaguucccuauacccucccucugcccugcuccccuacccacccacucccgcuucuuggcccuggcuuuccccuguacuggggcauauaaaguuugcaauaccaaggggccucucuucccagugauggcugaauaggccaucuucugcuacauaugcagcuagagacacgagcuccagggguacugguuaguucauauuguuguuccuccuauaggguugcagaccccuucagcuccuugggugcuuucucuagcuucuccauuggggagggcucuuuguuuuuagacagucucauucuacagcucagacuaaucuugaacuuguagcuuagcuguccuggcucaucuacccuagugcuaggguuauaaguaugggcuagcuagcacaccuggccagugagguguuuuaaguagggaguaacaccuggcuugagguuuagaagccucacuuuggccaacgaagaggaagaauaaggccuaagguaagggagagaagcaagaaggcugucuaagaggaaauacacauuuggauuaagauggaugcugugugagugguguugaaaaggcagacccguugggaccuagcauuucacuaugugacuguaggaauguuaaggaagucaaguuugcuugcagcuagucacugaacuuugggauggagagacagguaacauaaugaaaugauuuggaacauguugaucuuuuuuuuuuuuuuuugguuuuucgauacaggguuucucuguguagcccuggcuguccuggaacucacuuuguagaccaggcuggccucgaacucagaaguccaccugccucugccucccaagugcuaggauuaaaggugugcgccaucaugcccggcggaacauguugaucuuaaaggccuuuuggaucgucuaggccuuguucuccaguuggcagcccagcuuugauacccaaugcagcagauuuugaaguaugaaguagaguagaugaaguguaucuauagaaaaacuuauguaugagucagguuugaugguacaggcaguaguagauuagagcacacaccuaguguguauaagauccuggguuuaguucccauuauugacaaaagaaccauauguaugaauaccguggcaggucuauucagcuccacacagcaaucgaaauguauacuauccguaaucgacaaggaaaugagugaaugaacuguggugcagccguauaguggaauacaugggaauguagguuacugaugcccaugcaguguggccaacccgcuaaauaaccaacaaaccaaacuaaaaccagcauguucuauaggcuucacucucauaaaccuguaggaaaugcaaacugauacagaugauugguuauuauaaaaacagacgucuagaugguuaugcugacacaggccugcaaucacacagaugagaaggaagcgcaagaagaccaggagcgaaggucuuucuuagcuacacagcgaaagaacagcaaaccaaaaggagacgucuaugucuacuuaucuugaguaugcuauagugcuagguggugucaaaucauacaacuuagauauaugcggcuuaguguugacuaguuguucucagugaagaccaauguagccaucagcuuagaaucugcuacugucucacuguguuugcuuuaucacaccuauccacuuucccucccguuaaucuguuguuguguuuugagacagucucucccaguguagccugaaaacacugugaagcccaggcuggucucagacuuguggcaaugguccugucucugccccucccccuccagugaugagcuaacagguaugagcugcucuguccagcuuaucuaauuuuuuuuuuuaaagacaggguaucuauccauucauucacccauccacccaccuguaacucuaagccagcucuggcuguccuuugcccaccucugccuuccaagugcugggacuuagggguccacuaccacaccuggcacuuaugugauauccugaugaauuuuguaguugcagguauaagcacacuuuauuccuaaauccuucaccccacaucaguaacuagaaaucaauagcuuuuuaaaaacaguuccuuuuguuuuaguaggaaguuccuaugcaguggaacauacagacguuacuuggagugcuuaaugaauguuuacugucaaagccucuauuaaaggauggaccacucccauggcucuugagguucccuucgugccccucuucccagagguagccgccacugcugcaacauuucagcaccucacaucgguuacucuugucuguucuggaauaucauguaaaugaaucaaguaguguauauauauuuuuuuauuguuuucuuuuuuucaauuuuuuauuagauauuuucuucauuuacauuucaaaugcuaucccgaaaguccccuauacccuccccccacucugcuccccacccacccacucccacuucuuggcccugguguuccccuguauuggggcauauaaaguuugcaagaccaaggggccucucuucccagugauggccaacuaggccaucuucugcuguaguguauauuuuuagugaggcauuugagaguaugcuuuaagaauuccguccuuuuuuucccaccaugugaacuaugucacaguuuaucuaguggauggauagcugaugcuuucaauucggagcuauuauuaaagcugccauaaauguucuuuaaaaauugcaucuauguguuugugcauguaugcacaugcaugcacagacguggaggucagaagacaacuuacaggaaucuguucuuuccuucugccauguggaucucucaaaucaaacuggcgugguggcaggugagccacaggcucaaauggucuuguugagauggugucucauguaaccaggcuugccuugaccuccuggugcuccuguguuugucuccuggauguuggguuacaggugugcacacucagcccccaugguucuuacaggagucugcuuagagacagcuuuuauugcuuguacacuaguaccgagacauugcuugcaggauagagaucuguuuaugagaaacugcuagaccuuuccccaagauggccaaaccauuuaaaagucucucacagugauagaugguggcuccuugccagugugugauguuacuagucuuuaacuuuagugguuugaagugcuaucuuauuuuaacugugucuuguaucccaugguagauaauuacauugaucacuuuuuuauauucuuuuuugcacugugugugugugugugugugugugugugugagugagagagagagagagagagagagagaaugaaugagagggggcagacagacagacagacagagaacagcuuacaggcauugauacucuccuuucacuguaugggucuucaggauccauuugaggugaugagguuuggcagcggcagcagauacauucugccccccuagucaccuuguugguaccuucugcuuuuauguucuuauuagucauucuuguuuauuccuuuggacagugucugcucaacucuucuuucccauaaaacauugaauuauuuuuuucuuuuuaguauugaauuguaagaugccuuacauauucuggauaacuguccuuuugauaagguauuuuuaugauauuuaucuaucuaucuaucuauuuauuuauuuauuuauuuauuuaaggccucauguaacucagggucauaaugguucaacuuccuugagugucugcaucuuaaguguguacuaccgugcuggguacacaucauuucuucuagucuuugauuugcagauuuacuuucuaguaguaguguuuuaugacaaguaaaguuuuaaauauccacacaucuauccauggugucaagcagcccacauugggcucggccuuacuguguggcugaggcugacuuugaacuccugauccuccuaccuucauguccccaguucugggauuaugggccuaugucaccgugucugcuuuguuuuugugaggucuaauucuguagcccaacuuagcuugaaauucacuggcugaccuugagcucauaauccuugugcucuaccuuccaagggagccaccuaguccagccagauagaaauucugaaggaucacuggcauccacauggcagcucacaacuguuuguaacuucagugccaugggcucuggugcccuuacagaacaacaggcaaagcaaaaacaaaaaaauuuaucuuugauuuuacagugcuaaggaaaauuugccaggguguagggagucuuugagugaaaguugacugucacaggaaugcugcaucucugagaaacggagucugccuucgucugcuugccaugcucagugaucgacuaggaggggcugguuacaggcauggccccugcacaaacacagcgguggauuucagagugcagcagcuggggcccuuagucaguuauccugccuccagccagaucugagagggccauuguuguggccaaccaggcucuucucuggcuaugaauugccugauugggauaaaucauauacaguuuuccccguguaaaguaggugauuuggccccuucaacacuuuaaauguuacaaaaaaaaaagguaucuuagaguaaauaaaaauaaaaacuuaauuuucauuagaauuuaauaguauguaauuugcuuccgcugaucaaauaaacuguuuccuagugugaggcugguuugugcaguuaaauauguaguuagcaaaaccacagauaggacgguaacucugaagaaaacagcucagggaugccuagauaaucacugccuuaacuaaccaagugcagccuuggacccugcuuacugagguagacagaaacaauggccggugaaguuccucaugaaauuaaucuuguuaaauuuccagugggauuggagguacccaggggagaaaguaauaaaagugggaaaauguuuucuucccaguuuuugaggcauuguccugaugcauagcuaagacuagccaugaacucauucuucuagcuucacugaaaagugauuuaaaauuuuagaauuauggacacuuaauuacuaugauguuauuauuuugaaacauuauuuuauauaauacuuauuuaugcuuuaugauaguaugugugcuuugaugucaguuuuggagagugucaccaaauaguuuucagggacuugaacacagguugucugucuuggcauuggaccuuuucuuguucagucaucucccugggcccucauauguuauucuaagauagggauuuuuaaacuguaaaaugauuuugagacucucuuuaaaaaguacacugugugugugcauuacacgggcuuguguuuguggguaugcaguuacgugugagcauacaugcaugcauucaugauaugugcuugagugcacgggugcaugcaggcguuugccacacuuuguagagcucagagaagcaagcuuggugaucuaaguucaaguucaacuccugcacguuguccucugaccuucaugugcauuccuggguauguaugcacauacauacacacaacacauaccagauaauaaagggaaagaaggaauguggguaaaaaucuauucugaaauuuguugaaucuuaugucuuaaaacacagucaguuuaaaauuucuuucuuuuuccuuuuaaaguguaguuaagggcuagagauggcucugugguuaagagcauuuguugcucuuguagaggacgcagauuugguucucaguauccaaaugauagcucacaaucacucaacuccaguugcagggaucugaugccccugucugaccuccacagacaccaagcaugcacgugaugcacagacauaugcaagcagagcacucauagacaugauauaaaauaaauaagucuaugaaaauaaauaaaccuaugaaauuaauuuuuuaaagcuaucaaaaaugucagaaguuucaauaucuggaaaaacuuuuuugucuuuugcuuuuucuggucagaguaucacucagauacaguuuauauguguccacagaauuuaaaaugacauuaucagagaagucagagaucuuucaguagaaauucacacauggguuuauaggaauaauuacacaaaauaagugaucccucacuacauuucuuuuaaagcauuuuuauuuuuuuccagacaaggucucucuguauucuugguucucaguguaguugauguguagcuuacaguuaucacuuaaauagcaaguuugcauucauuaugaaauuuauaacuuguuuguuucuugggcaagcucucauauagcccacauugaccucaaauugaauaaguaguggaggauggccuugaacucuugauccuucuccaccuuuguaguccugggcuacaggcaucugccacccugcccuguguuaccauuuuaauguagguauugucccuauuuuauagaguagggaguaaguaugucugucaucuuucaaauuaaagaaguggacuuagaaucauaucuuaaauuacucacauguguaaaagugcccugcauagaguccucauuuauuuguacaauaggggaaagucagggccgucuuguaugcguguuuaaaaauaugccuccuggucuucuaagauuuaacaaagucuuuauuuaguuaaauuaugguuuuggguuuuguuuguuuguuuguuuguuuggucuuuugagacagaguuucucuguauagcccuggcuguccuggaacucacuuuguagaccaggcuggccuugaacucagaaauccgccugccucugccucccaagugcugggaucaaaggcgugagccaccaccgcccggcauaauguacuuuuacaaauguauuacuucacaauuaagauuuaauuuguauuuacuuauuauugugugugcauuaccgggggggggggcgggggaggaccacagcuuuaugucuaggaugacuuaguaaagucacuuuuguuguuucaccguuacguggguucuggguccuuacacgucuguccaguaccucccacugaacuguuugccuguggauaugcaugugccucucaacgugugcacacaaaauaagucaaaugcaaaugcuuuucuugaacucaugugugacucuaaaaaguaauaauguagcugggugugguaauacacacccacaugcaaaaacaauacucagagccaguugcaguaggauuuggagcugaaggccagucccagcuagggcgagacccgucuuuaaagagaagcugaugugagagguguggucugagagccgaugugagagguguggucugagagcugaugugagagguguggucugaggcuggagagguguggucugaggcuggagagguguggucugagagcugaugugagagguguggucugaggcuggagagguguggucugaggcuggagagguguggucugagagcugaugugagagguguggucugaggcuugagagguguggucugaggcuggagagguguggucugaggcuggagagguguggucugaggcuggagugaagccuuccuggugcuuugaucaucacuuuucagauuaacuuucuagaccuagggaaagcuugcagccagcagugugugaaugagaaucauccuagcucuagguggguguagguggaucucugagaucaaggccagccuggucuacaaauagugagccccugucucaaacagaagagucagggguaagauguuguuuucuguucuguucacccccuuucaugaaagccucaggagcagauuuacaauaaaauaauauauauagugcugaauauuugcuuacauuucaaaaauuuagaauucccuguuaccaucagagagauuuuauaaaguuauagaaccuuuauuuaguguacauguguguguguguauuauugaacauacacagugucuauaucuaaagagaguaugauuucccacuguguuuaacagaucuuggccauuucaggaguuaagugugauuauaugguaaagcccaaucaaagugaaaggauggauuuucuuucagaauuugaacugauugcuuccauaaaaguuaaagacagacaauuggcuaauuaaauucuaacuaaaaagcauaguuugauuucacuuaaaugaaacuaaaagagagaaacuguauuaaaccacuauccaugccuuugugugaauuaacuuuaccuaccuuucuuucuuucuuucuuucuuucuuucuuucuuucuuucuuuucuuccuuccuuccuuccuuccuuccuuccuuccuuccuuucuuaaauuuguuuauuuuauguauaugaguacacuguaguuguacagaugguugugagccaucaugugguugcugggaaucgaacucaggaccucugcuugcucuggccccacucccucuggcccaaagauuuauuuauuuauuauauguaaguacaccguagcugucuucagacacaccagaagagggcaucagaucccauuacagaugguugugagccaccaugugguugcugggauuugaacucaggaccuucggaagagcagucggugcucugaacagcugagccaucucucuagccccaugagccuuuuauuuuuuuucuccuuauucugaaguuugucuugguuucucaucgcuuaagauugaaauuaaaaacagaauuugcguuuuaaaaacuuaugaccaaacucauuggaaugacuucauuaguguuaaagguugaggauuaagcacauuccgugaauucuaauuggauuaauauucuuucucagaagcacugucuugcugggcggugguggcgcacgccuuuaaucccagcacucgggaggcagaggcaggcagauuucugaguucgaggccagccuggucuacaaagugaguuccaggacagccagggcuacacagagaaacccugucuugaaaaaccaaaaaaaaaaaaaaaaaaaaaaaagaagcagcagcacugucuuauauaauagcugcauagaauuuaguuuauauuucaguuagucuaucauaguuuuucuaagcauuuauuuauuuuauuauguuugguguaugggacagagaauaaaacugagggccaugugugugugcuagcuaaacauuacuguaccucuaguccaccuuguagguuuuuaaauaguuaauuaacuuuacugccaauuaaguacuccuauucauagacaguacauucuaauuugcuuauuucuaggcugucagugcaaaauguuuaccuuuuccuuauguauaaguacaaaggccagguuuguagcuguauccuuuaaauuauacaacuuuccuucagugucaugugaguuccccagcuccaccugccggguacccuugcuugcugaggcauccuacaggccucugauuuuggaaguuuguuuauuaagacagaauguagccgggguuuacccugaacaucugauccuucagccucuaccucccaaauuuuuggauuauacacaugugcuaccacaucaggcugguauucugaauuuuuaaaaaagguuuuuuguuuugguuuucuuuuuuauguauuuugccugcauagucaagaagauggcaccaggucuccuggaagcagaguuccaguucugggaacugaacuuggauccuuuugaagggaaauaagagcuccuaacugaggagccaucucuucagcccucccuuaauuucuuaaagguuugaagucuaucacaaacagugacuacaacuuaggaguuuguuuaaagaauaaugaaauacaaagucauuuauuuuuuuguuuuugaaacaaggucucauuauauaacucaggcuggccuugaacuuucuauguaguccagaguggccuggaacucuugaaaauccuccugccuuagcuuccugaguguugggauuacacgcaugagcuaucauuuucaacugaaauaacauuuagaaauuauuaucaucaucauuacugcuuuacacgugugggugucuugccugcacauauguucauacaccuucuacaugucuguuguucacugaugucagaagaggaugccagaucaccuugacugagagucaucgucaucgugugggugcuaggaauugagcuuggauccucugcaagagcaguaugugcuuuuaauugcugagccauuucuccagacucuuuaagcugucccuaacuacauuauauagcacaugccucuugccuucauccacugagugggggaauuacaggaacgaauaaccagucucauguuuaacaauuuuuaguuuuugaauuuguuuguuuauauguuagcuucccaguuuugucucuuuuaaaguagauuauacuucaguugcuucacugaccauuuucuuguuguauguacacaguguguucugugguugguucccaguacuguucauugacuugacagucauuugauuuuguauguucaaauuugcucagcuguuauugcuguucuuauuuucagaaugauuucauauaaaacuuuauuuuaaauuucuucuugaauucuuugauuuauauguuaacaauaucauucuuuauuguuuuuuauauaaaucuuuucaugaauuugauuucuuuuuuuuuuucuuuuuuuuuuuuuaagacaguguuuucucuauguagcccugcuaucuuagaacuguguauagaccaggcuggccuugaacucauagagauccaccucugcuucccaagugcuaguaggauuaaagguaugaaucacugccugacaaacauuucaagaaguuauuuuuagauacuguauuaguuacguuuccauugcugaugccaugaccaaagcuuaugguuccagagguuuaggucagugaugauggagugaaggcaugguggcaggcagcuggaacagcaccugagagaucacgguauugauccacaagcaagaggcagagagcacacuaggaguggcacaagucuuuuggaaccucaaagcccaccucuagugacaacaccuguucuaacaaggauacaccucuuaauccuugacacacuuccucuaacaaggcuacauuucccaguccuucccagauaguuguaauaauugggaauuaaguauucaagcaugggagucuguggggccguucucauuuaaacuaacacauacagguuuuuguuuguuugucuguuugucauuuguaguucaaagcugcuuguauaggguauauagguucccagguuucuaacuuguaacuugcuuauagccagauauguaauaaguaccuuguggggagguauaaugguccguuuuuauuacugcuauguguaccagaagauugguagaaccaggaagauaggaaauguucuuuuuucauuacauccacguguaagccaggcaugguggccuaugccuguaauccuagcacucuggacauuaucagggaggauuaugaguucaaguacaaccuggguaagauacugucucaaacugaagaugggauacaagaagagaaaggucaguauaggcucagugugucuggggagggacuuguucuugggcuaccugcuuuaccuuaacaguugcaaggggccucuuguauuuuccauaacagaacgggcacaggauaaaacauggaugaccccaguaacacauaacaccacuucuguguaauguuacuaccuuggccucugcuauugaaaccuagaugaagggaagggccaguggauggcugugucaaagcuuuacugggcucuugguucaaccugcuaugaacccuaaauggaggaaaggguggcaguagaucuuauccugcccccccccccccaagguacaggcugaacagagagggaguuaaugauuggcacuggagaaauagccuagaauggagaugagagucucaucugaggucugugguugggaguucauggugagaugcuagaauuggcuagucaggguucaaggauggggaccugggagugaggguacagggagcuaugaggacuagcuaggaggaccucagacgggaguguugguuaaggaucuaggacccuacaaacacagauugucaggguacagacauccuagcccccccccuccccccccacacacgcuggcugcugacaccuccccccaacacccuagcaaugucagcaucucugcuagcagcuacaaaagagcccagagcuuuagucaggccuuugucauacaugauggugguaaaggacucagucuagagcuuugaagggagccagccugaaaauagaugucucccccaaaaguguaugugaccaccaaaagcgaaggcaugggaguggucagcagugaaaaggagcagcguguccugcucauagguaagcuguccugccuucuuaauggcaguaaagcaugaugguuuagucagccgcucgguaagcuaugccuucaucgugauuuugguugaugcaacguagacguuucagguucuccugcacagcagguccauggucaccucugucauuuccauuaggggugaguguucagccuuuuagaggccuauaagguggucugucacaggucuaggcaugccugaaugaacuuuguacuguuguguuaguuggguauucagcaucuguauaucuuugggaaacauuaauuuaugggacagaguaucaugucacugucuuugugggaagcgagcuauauggagugaccuugcagucagcugugcuccaggaccgaggcaggccuuucugaaucuaagcacaguugcaguguaaggugcaaguuaggaaggcuugugcaccgagguggugggugauugcuuucacagacuucuccugguuucucagugugauacauuacagacgaaucucauugccgcacugauguaugugugcaaaucagugaccuugacauuggcucuuaacuccucagaggcaggcuauggaugugccugucuuuggggaucugccugucuauguuguaauugcucugcguccauuaggacuuggguucagaucccuaggacccacauuagaauaacaaaacccaggcacgacugaguaccuguaacgugcauuggugagagacaggcagaucccuagagcucacagccagccugccugccuauccaaaaaggcaagcuuccaggucaagaagagacauugucugaaggcaauaaaguaagacaccuguguccugcucugccuucuccauuauaugcaauugaacacucaugugcauacaggccggugcgcucucucgcacacacacacaaacacacacaaauaaaggaaauagaagaucuaggcuuucuaaagccuuuuuagcuuuuuauagagagacauuagcuagaaagggcuauuaaagauucaucagaauucaucacuguuuucuggcaguuuacccaaggguuccugaguaucucuggauagcucauauaucagauagacagaaauucauacaaaaucuuguaauaauagcaaauaaaauguuguauaaugugcuagaguuuacugcagauaaagugaaccauugccaguuuaaaauuuguaaggugcuaucuuuuauugaacauggugauugugucuuacaaauggaauugcugucacuuucaguaaaauuccuguucaugucuguuauugaacucaaggcauaugccuugauaacuggcucugccuuguuuuuaaagacagggucucucgcuaaaguuggaguccacuaauuggcuagauaggugaccgacccccugucuuaucucaccaggacagguguuauugguacauaccacacuuggcaggugaaggauuguuuuuuuguuuuguuuuguuuuuuugcaguuuuugauuuuuaagugggcucuagucauucaaacauggucuuacguuugcaugacaaacaugagacugaaccucccucacuaauaacuaauaauuagaaaggaacuugguugauagcuacuuagaagcauugcuccaagugacuuuaggauucacugcuaguaaauuagccaugaggauauagaaagucaguuugaaccauaaaggcacauaauucagugugcagaaguaaaguguguucccagaguguuuaaaaggguaaucgcaucaugcuaaguguaugcgggagugaauuuaucacaaugccuauauacacuagucagaguauguuggugaaugaaagacuggauuuaaaacccugaacccucaguucuccauuauuuuaacugugcauagccauugucuuuugucaggguucauugcuguaaagagacaccaugacuaagacaacucauacuaaggaaaacauuucacuggagcuggccuccagguucagagguuuagucuauuaucauggcggggagcauggcagcaugcaggcagacauggugcuggagaaggcgcugagaguucuacaucuugauccaaggcagccaggaggggacuguguguuucacauuguguauguguguguagcuugagcauauaagaucucaagcugcugcccccacagugacacacuuguucucuaacaagaccacacccacuccaacaaggccacaccuccuaauagugccacuccuauggccaagcauucaaacacacgagucuaugggagccguuccuauucacaccacccuagucaucuaguaaaguagaagaacugguaaaccaguuaucauuaggcuggcaggcaggucauauauugacuaugguuaaaaacguguggguaaaugguugcagcuuccagggcugcugcuucacugguaaaaucacucaaguuuuaaauauucucuuacgcaguucugaguuguuagaauuauuuuccuucaaauauuuaccuuuaaaauuauauaaaguggauaugaauguacuuggcauauacauuuuuuaaagaagaaucaccauuaguauacuaauaauguuuucccccagcccuaggcugucacccuccccauccugagugcuuucugucaguaggugcaugucuuaaaacgcaucacucucaucaggagagguuuuucuugccauuccuagcuuguuguugaguaauaguucugacccacaguaagcgauaaagggauacaaaacuguuuugcugguuauuaaaaugcaagcuuuuaguagccaacagccuuaagugauuaugaaaaaaagucagggaaaaauaaagaucauuaaaugauuguucauuuuuucacaguauagcagacuaagucacaaauuguaaaagcacucauugcccacccggugagagugugugugugagaaaguguguguguguguguguguguguguguguguacauagaaaaguuagaggacaacauguuuugggugugagcucuuccuuuccacuuuguugaggccggcacucagggucucucuauuuuuccuuuugugcugacucuucccugcugucuggccugccaggcucuuggcaguucuaaugucuuaggcucccaucuggcuguagagugcugugcuuacaaauguguaauuuguauguggaucaaacucuguggucaccaggcuugugcgucuaucgucugagccaccuccuuggccccacuuugguguaaggugacuuuguguucacugucuguacugggagugcuuugcacaguagguacuagaugcuggagacucauuagugaaccucauagacggacccccgcggucucaacauuguguaaggaagguggaguuaaaaggggucagagacccaucagaggucaguuucauccaagaagaaugcugacugacuguccugacugguucugggcagggguccuacauaaacaauguuuuaucaccaucuuagccucucccucauguuucccauuucuacaaggcacugcaaaccauaguauaugcaaaaaauacugaaauuacaguuagguaacuagauuuaaaaaaaagaauagcaugcaugguguaugaggcugggaacaaagauugugaagcccugauuuuuuggauaacauucaaucuguauuuguaggcuaguucauauuuuaauuacuugccuuuuuguuuacagguucaggggcaaguucacccuacucuugagucuaaugaugaugcucuucaguauguugaagaauuaauuuugcaauuacuaaauaugcuaugccaagcucagccccggagugcuucagauguggagguauggcaaaugaccgcuuuuguuuucuuuuaacugcauguaucucgccguacguuggcuguaauggcagugaaggagaaaaggacucuccaguucauucuuccaucucuguaaacuuugaacuggguaugugguagcuucuaugugucuuagcugugaaacguucagauuguacuuuucagcuuaaauaaacagcuucauguuacuacuagaauggucugaggcaaacccucucuauguaaaccaggauggccuugaacucagagaucccuguucauacauacauacaaacauacaaacauacauacauacaaacauacauacauacaaacagagugcacgcaaagguuuuagucccaaaacauuuccuuuaaauuucagagagucaaaaggcugauaauaaaauaucucaaaguaucugagggagaauuauagaaacauuggggucacaggaugaacauacaaguucccugguaaaaguuacaaagcaaauguggacauguggugacacacuagagcugaagguucccaagguauggacggcauuuaaagaguuaagaugccaaucaccaguauugugguacaaaccuuuaauaauagcacuuaggaggcaggggcaagaggauuagguuuccagaucaauuuaaacuacacagggaguucaaggcuagccugggcuaugugagacccuaucugaaaaagcaaaacaaaagaguucaaagaguacuuuauuuuuaccuuuagcuccuucaagucccaggacuucaguugggugggaaggcgugggaccugacaugugaguguggagcauugauguaaggggucuguauagcuuauugacuacauuucacgaagccuuaccccauccucaggguuacagagggggugauggacggaaggaggggaagaagaagaggaagaggaggagggaggagggaaagagagaaaacaaacaccaaguaacacguuuagucagguuuagaaaauacuguauccuggguaauucucaucucucaacucauuuacaguagauucuuuguggugguuugguuuuguuguuguuuuugagacaggaugacauauagcccaaucuggccuugaauucaacuugcugcuguauagucaagagugacacuugcucugccugccuccaucucccaauugcugggauuucacgaguuuccuaccaggccugauugguuucuucuguaaagucagacuuuuaauucauaauuucuuuuaaauauguguuuauguuguuguuucacagagaucuugaauaguauggcuugcaugacucuaucacauuagcaauuucacuuggguuuucuuugauccuagcuauaaucuuccaugguuuggcagaauccagacuuacaagaaaggcucacaaaucucaccuuguuuauuauauugauguugguacauuuuagaaauuugcuaaucuacugacauugcaaacauaaaucagauauuccuauauauauauuuacauaacuaugcuuguuuaauuucaucuuuaauaaaaacaaggaacagaaaaccauaugaaauucucauguggagguuuuggugcuggggauaguuuuggugagaacauguaagaauaugacuaauagaaguaccagucacguauguaaucagcuuuauuauuucuuuuuaacauaucuauuggcauugcauacaguuuuaucaucuguacacaucuguguguaaguauuuacaugagcgcaggcacccacagaggccaaaggaguuggaugccugucuugguuaggauuucuacugcugcagugaaacaccaugaccaaaaagcaaguuggggagaaaaggguuuauuuggcuuacccuacauaauagcauugacgugcaucauggaaggaagugaggacaggaacccagauaggggaggaaucuggaggcaggggcugaugcaacaaaggcuguggacgggugcugcuuuuuggcuuguuccccauggcggcuucuaccugcuugcuuauagaacccagaaccaccagcccagggguggcaccacccaaaaugaccugggcccucccccaucaauuaauuacuaauuaagaaaaugccuugcaggcuugccuacagcccagucuuauggaggcauuuucucaaucgaaguuuccucauaucugaugagucuaguuugucaaauugacaaaaaccuagccaugaaaaucugaaguuauaggcaguugugagccaccugacaucaguucugggaaucuaacuuaggucuuuuggaagaacauuacuugguuuuaaccacugaaauuuaauaauuucaaagugcuguuuuauaaaauucuguaucuuacaacaguucuauggggguaugggaauaucuuucucuuugcuugcauauuugaaaauugacccucagaacaguauugacauaaaugaagauccaagaaaaaaaaucaauuuuccagggcuggagagauggcucucugggccauaaaaucacuuuagugcauugaucauacaaaaagaaguagacuagaaaauacuagugugcuucauaaaauaagggcgagguuuauuuaggaagcccucuuacagcucaguuucuuuauaaguguauaauauaaacuauugaaaaguuauuaucuaacuacuguauguauuuguaugugaaugcacaaagggaucggcguguggguucugggcaucaagcuuggucgucaggcagggcugccagugcccuaacuugcugggcugucugcaccagaauggaaauguaguauuuuuuacugcauucucucccucucucccucucucccucucucccucucucccucucucccucucucccucucccucuccccuccccuccccuccucuccuuaauuuauuuuuuuacguucacauacaaaguaguguguguuuuuuuuaauauugugugugugugugugugugagacagacagacagacagacagacagacagagagacagagagacagagagacagguagggagggagggaugugaguguaagcgugcgugcagugugcguagaagucggaggacaucuucuggagucuguucuucccggccuguggauuucugagauaagugacggacacaaguccucaggguugugcagcaagcgcaugcuccgagcugagcuaugucacggccaggcaggaugggcagcucccagacacaggugaaugucauuuauaccuaguucuuacgcauucuaucccucauuucuccuuuuugcuggcuuuucuucccucagauaauccucccgucuacuaucauguacugugucuacuuucguguacugugaguugagguuucagaguguuaggacucacaggcuggagaaagcugcaacuccaggauagagcucuuaccugggaugcagagggcccugggugcaacccaaagccagaccgugggaagcggaggggaggggaggggaggggaggggaggggaggggaggggaggggaggggaggggaggggaggggaggggagggcacaagggcuuguguucuggauguucuuuuguaucuuccccuaccuucccaacuguuugcgcugccaccauuuuagacccuuuuaucacccuuaucauacaggauaaagauuugcuacuuuauucuauguuuguuuguuucuuuguuguuguuuuguucuuuaagacaggguuucucuguagccccagcuguccuggaacucacucuguagacgaagcuggccuugaacucaagagaacugccugcuucugccuccccagugcugggauuaaaggcgccccacugccgugcaccaccacugcccagcugcugcuguaauuuuuaacuacaagaauucuuuugacuucuaauuaauuaaaacaugacauuuuaaauauugguaucuggacagccuugaacauaaaaugaagagaggauuagauaagugccuauagaucugcuccuaggaugugcuaaaugcaccuaugccucccucacacccagcucuagaguacccaaggcaguguauuuacugauugaacuuucauucagguuugcauucaaggggcaauguucacuucauuuuauccuacauacaaguugaauacugaaaauuuguucaagguuuuguaauagcgaccucuacuggcucuagcugagguaugugcaaguggauuuuaaacaccugaagggagcuaauagugaauuacauuaaaguagggaauuuagcuauuauaauggcucguucuuuaacugaauaacuucuagauguuagaauugaaauagucugcuaaagaugggccuguucguucaugguagguccaccauguuaaagcacggguuagcagugcaggccacugaggcucgugaccuggaugauacggacucucacaugaaugcuacuuguauuuauaacugggguuaaaguaaggaugaaauaaauaagaauuuauuggaguugauauuugcaagucuccuuccaugaaacugugaaugauguuuaaggugacuuaccagucuugccauuaguguuaaugaaggugggugcaggauaugauuuaccuguuaauaaaaacuguccuuagucccuuagugaccuaacuaagaaacuaacacagugacaaucacagacuuuuguuugcaguguaaauuacgugaaaagcucgcgcauacucuuuauuucacaguaagcuuuaagugcugagcuguauuugcuuguugcuuaguuauuauucccucuuuucuaaggaacguguucaaaagaguuuuccucauccaauugauaagugggcaauagcugaugcccaaucagccauugaaaagaggaagagacgaaauccuuuaucgcugccagcagaaagaauucaucauuuauuaaggguaagcugaaauaagccacaugaccuaugaaaagcaaaauaacugaaugguaaaauccuuuuacauuuuccagggauucauguugagguaagggggugcugugguagugaguaaagguuggacaacgugguuucaugucacuucaaaccaguaguaguaaaucaaagacaccuggaaaaguuauauuauagauuuuauuuacuccaggguugcuagaaaauauaauuguagauauuucucucuuucuggucagagcuaaauaucccauaaagcuuuaaagucuguuagcauuuuguguagggcuaucugugagacugcagugagggucuguguuuuugugggacaaacaagcugguccugcuuaaauaaguuaaccacuuuaguguacccagaacuagaaaaaugccaagaauccuaagagugcuaguuugguuuauuuaccaugacaaacaaaauaacucucuuccucacacacacacaaauaccuuauuguaauauuuaaaaccuuaguacaaguuucuguuuuuucccuuugagacaaggucuuacauuauugcccaggcuggccuuggccugagugcuggcauuaaaggcuggcauugcuacgcccgacggacugaccugugcuuucuccucuccuguaagacuucaucuuccuugggaacuuguggcuccacagacgcacauacucucugugaagucuaauaauaggaucauuuaaaugcuuaguagcacauagcauggaggguguuuguuuuguuuuuaauuuuguuuuucauggaaagccaagagugugucaucagguaauauaccauaugcuccccacaccaagcucagacuuugugguuaaaccacuuacuuacacacuacuguguacugcuccaguacuguacacaaccagagacgauucugcuucccucuguguguacgcacguguguccuacacauaauaguguguguguguguguguguguuucucaugaaugaacuagugaaaauuaaauuauuaaauauugguagugaugggcuucagugaaaguuaagcuggguugauacuguuuaauuuuguaguugauugauuagauuuuacuguguaugacguuuaaaugugcuuuccuuuuaauuuuucaggagguccucgguuauaaaauugaccaccagguuucuguuuacauaguagcaguauuagaauacauuucugcagauauuuuaaagcucguggggaauuauguaagaaauauacggcauuaugaaauuacaaaacaagacauuaaaguggcaaugugugcugauaagguaggagaaucagcuucuuuguguuguauucauaaauuauuacuuaugauuuauuggaugcuaauauacucuucagaaagaauagaauugugcacugcauuauguuuuggggagagauuuccaguaaccucauagcauacauccagguuguuacuguauggaaauaagauagagguggcugguacuuaaguggcuuuuuaggaaagaagauauuuucugaugggauucuauuccacuuucuucacacucuggccauucugguuauagauucuacuuauguauguauuaguguuuauucuaacagaauaaagugaaagagauuaucuggccugaagaauuaaaaguguugugauauuuuuaaauggagauaaaguacuugauauuuaugauuacaacugaaaaugaauacaaaguguuugcuacuuuguuuuaaauguguguguguguguguguguacagcgcagggauucagagaagucggaacaaguauucgaucuccuagaaaugggcgcacagaggguuuauggugcuggaaacugagcccaggugcucugggcaagcugugagugcuuuuaacagccaagccaccucucuagcccaucugcuaaaagauuuauuuuuauuacuguggcacaugggaggggcauucugugcacaugagcacaguuguuugugaagaccagaagagguaccagaccccugaaguuauaagcaguugugaauugccugacauggcuucugggaacugauacacuuguguguucuuaaccacucgccugucugucuaacccucuugcuugcuacuuuuuaaaaugaaucauauaaguaaaauauuuuuuaguaucuauuaugugcucauacagaaaugagguacagaaaaauguguuuaaaagggggcugggaucuuucuaacugguagaguguggccuaggaugcauaaagccuuggauuugguuucugguccuggguaaacagaaugagaugcgcgugugcaagcagaaggaucagaaauucaaggccagucuuggcuacauagugacccuauggcuagcuucaguuauaugagaccauaucccuauaguuuaaaaaauuuuuaaaaaacaaugcuucaaaguuguugaaaggugacuuacguuguagcauaagguaaacuauacugcagugacacuguacagggccacaagagugggaagggugaguuucagcaagaguaaccguggaaaacuuuuugaagaaacuuuuuguauguauagguguuuaaccugcauacaugccugucgccauguugaugccugguugccaugguuaacugauucucuagaacuggaguuaagauugugagccaccuuguaggugcuaggaaugaagcucagguucucugaagaacauuaauuguuccuaaccucugagccaucucuucucuaaagccaucucuuccucccccccccucccccacagggcauguuuguccucuugugggggugggggggaugccuagggcauuaaccuucaagggagacuacacuauuauuacugacacuuucauuuuaccucugacuacauagguauugauggauauguuucaucaagauguagaagauauaaauaucuuaucuuuaacugaugaagagccuuccaccucaggagaacaaacuuauuaugauuugguaaaagcauucauggcagaaauucgacaguauauaagagaauuaaaucuaauuauaaaaguuuuucgagagcccuuugucucuaauuccaaauuguuuucaucuaauguaaguauauuuuguuauuuuugcauguguuguuaacuuucaguucaaauuugaaguuauauaauucaugauuucuaauuuguccugaucacaaauaaagugcugccacaguuucaagagauuaaacaucagaaauugaaagacagaaaucuaaaauagacuaauuauguaagugaaaaugaaaucacauaauaaucaauuuaucucaggggauagagcgucuuguguaggugggagauauuuuugauucagugacuuauuugagucauuuaagugauacuuaucaacagcagccguauugugggacaccacauucagaggagucagcaacaguccugucucgucagggcggagcuggaaauguaggacgaagagucguaaugcaagaguaacagcggaauuauugggaacacaagagaugagccgcagggcagugcccgugcuaaccgugcuagaccuaaagaacguucagugaugagaacagugccagcucuggagcuccaggcaucgcaguuccugggcauuaaauaaaacggagagcagcugagagcacagcccaguggcagagcacuugucuaaucugccugugaaacccuggguucaauuuccaccacuuaguuuguaaauaugccaaacacuacuuauugaguuaguuuagauguaugaaaugcaugguauuuaaauugcuucauuaaauuugcuuuaaaaaauagcaaaggagggauaaagauaucugacacaaaaaucagcaaucaaauuugcuaaaugguauucaguaucagagaauuacaaaucgaaacccuagcgagaugcuugcguacacgucuuagagaaaguuaaaaaaagacagugucagacauggagaagaaugcagugauugacugcucauggguuugcaaaauuucaacauuacuuguaaguuauaaauuaaauuaguaaaauuggcugguuuuguaacacauuucuacauuuucugacaauucuguucuguuaguuuuuugcuuagaagaaacaacaaggccacacaaaauagcaguuuuauuuuauagcucagugccuaccaguugugaagggagacugugcuuugcucacacaauggucagcuuuucaccaggaguaaagaaugcagggcugacgcaugcaucugcauagcugaaccuccaggacucgagcagagauucguagauuugucucucuacuuccuggacaauaacugucuagucacagggagugagcacucauuuucuggcugggaggauggugggagcugauacagaggagacauaagggaacuuaaaaauuuuuuuucaauuuuuuuuuuuuuuuuuuuuuuuuuuuuuaguuuuaugugugauuguuuuccugugaaggucagaagagggcacuagcucuccuuggacuggaguuaauagaugauuggagcugccauguggguucuaggaccuuaacuuagguccucugggagagcaucuauuaacugcugagccaucucuccaguucucauaaggaaguuuuuuaagacaagaaaacauugugaauagugacuguuaggagguuacagagaggaauaacuguauacagucucaccaaaaaguacauuuaaaguagguauaucucauugcauacaaaccauacuucaaaauuaacagaauaaaaauaguaaucaacagauuuuaauagaacaguauaaaauuuauauggucuccaagaaauguaggaaaugaccaacuuauuagcagcaguauaaugacauuugaccuguuugcauagaauguucccaguaguagaugcgcacagcagggcucuggacuauaaauagaacaaugggaagucacuuuugcuaaugaguuuaaguugucuuuugcagagaugaccuuaguuuaaguguacugaaagccagucagugguaaauacauuuuacaguuuauucacgugauccacacacaggaagauaaaauugcuuuaaaugagcuuuuuggugagaucguauggacucauuuauccuuauuauuuaaccaugccauuguagagauacacaauacuuucuugccuuagacaauuucuuuauaucccauccacauuaaccuucgccauccuuauucccagaaagccaguuauuuuaugauauguuaauuaaagguugauagaaaaauuacaugaauguuagacagaaaacaagaauaucacaguugaauagacaauuaaaauauuccuucauuuucccauuacaugucugguaaacuuauguaucuagauaaagcuguacuuuauccuguucuccagccacaacagacugaaugcagagacaaauagaaaaguccuguucucuguuaaacuguauugaagauuaguaaagagaguaugaagauguucuaaaacaaaaugauugguagagagacauauuucuuaauuguauaucuaucacuaaagaauaaauuuugaaguauuuucuuauuguaagucauuaaaauuccucaauaucuacauuauaccuugauuauaaaauaauuuuuuuacugaaaagauaucuuguuauacaauacaauaugauugaauuaauuuuucuuucuccuccgcaggauguagaaaacauauucagucguauaguagauauacaugaacuuaguguaaaguuacugggccauauagaagauacuguagaaaugacagaugaaggcaguccccacccauuaguaggaagcuguuuugaagacuuagcagaaguaaguauaucaauuauauugucaauuauauagcaagagaagucugucuguaaguacauuggcauuaaaaugggguucauaauuccuauuuccagcucaagucacauaccguugcuucuuuuccaucauaggucaacauuuauuacuguuaccagguacagaaauaguuaucaagcacuacgcccagucucggugucacucugaaacuuugauagaaagaucaaggcaaggccacccgugagugagaaaagcuuggguguaggguccuaguccucacagcucacugcucagaucacugcuguguauuacauguguggcuccaggcgaguuaccgauauuuugcuucucuauacacauuuguaaagcaagaagaauaacaauaagaagucucaaauuuuuuuuuuguaaguuaagauaaucucccuuaaauauuuggcuaauucccuuuacauaguaaaauaaccaguacgugauagccacauuuguuuuuagaauugaacaaugaggugcuaggaaacucagcccauggcauagacaguucagaucccaugggagucugguaacccugaguaucuccaaugcuaacugugaguuaauuguagugagucaucacugguagucacucugggguuucuugcucuuguccugcucuaaagcccauuuagucuuuuaguauaauggugcugagcccaugggaaagaagagaggaaccagggaucuaccucuuuagguaaacucuccccagcaaacaugaggcccuugguuuaguucccagggccauaugaacugggugugguggugcacgccucguaacccucaguaaugggaaaguagaugcggggguuugagaagaugggugccauucucagcuacagagcacgcugggcgucaggcuagauccaugugaagcucuuagagcucuguggaaagcaccaagaccaagagcugcuugggguuuacagguuacaaccugucauggcaaaccagagugggaaccuugaggcgggaacugcagaagacuggaggauagcagcucuggcuugcucagcuugcuuucauaucuaacucagaacuuacacccggggauggcaucacccacaacccacagagggcuuagaacuucaugucagucaccaauccaggcaaucaguuggggguguuuuucucaauaucgguucucucaaucuuuugucaaguugacaaaugacuacccagcacagagguucuaucucagaaagcaugggacaaagccagugcccuggguaggaaccuccaggagaguuaaggagagaacacugcucaaggggcugcacagcacagggucagggaugggacagagcaagaggaguugucuuguuuauagucuauaguuggcaaauacaagaaaacacuaaaauauuaggugaguucacaguaucggcuuagagaaaggacgagcauuccuaugcugucacacaugccagaacauagaacuuuacaggcagaaggcacccugucucagaggcacaguaagcauguggggcaagcgcgauggccccgcccauaaagcacugugcaggccuaacacuugguaccuagggugucccagccuuaagaguuuaaucccuagaacgugugguagaaagagaacugacccccaaauguuguccucugaccugugcacacuaguacacacauacacauacgugauucuacuauuacuacuacuauuacuauuacuacuaaugauaauaaaacucaaaaaccuaacuaaaaguauauaagaccuauuaagaaaaauuguaaaauauuuagguugauauggaauguacaaguacaugguaauacauucuauguuguguuuauggauggaaaaacucagcauugcauucauguuagucauucacaaguagccagagcacagcaagcugaucuuuaauagguacaaaugaggugugguccaugcucauaaucccagcacugaagccaggcuuucguugcaaguucuagcuauccaaugagauccuauuuagguugucucagccacugccuaccacccacucagaagaaugagggaagcacauggaggagauuugcuucaucacagauuucaguuuauuaaauaggaauaucagaguugcuaccaguauaggcagacaacgaaugaaacagaauggaauuacaguuuugacauauggcacagauugcauugaucaguagggacagaacaaguugauaauuaaauuacgaguugacccaaaauguaaggaagcaggaaggccuggagcgucaccugcuacgugacacuguaugguguccagagcccuaguccagaguguucagauaugguauucuggcuaguaacucuuucuuaaguacuuuaaaaacaguacuagagguaauuaauacauaauuuguauuuuaucuugaaucgcuugucuuauuucuuaccuacuacauucauccacugaucuucuagaaccagccacugcagaggugaggcgcucuggaccugaagcugggugugugugugugugugccauauaguagaggucggaggacaguuuguuaagucacuucuauccuuccacucugugggucagggauugaacuaaggucaucaggcuugucaccagaugugucaccagaugugucaacaggugucuuugcucaccggccugugucugucccuccugacaguuuuauaacuggaauaggccacaggaucaaagaugggaagggcccuacucucugugcuaaaaucaauagaccuacucuguguuucaucagcaaucaucguacucuuuuagaccuugcuaugagugauaucucaauggugauugguauauuaaugaugauggauuuuuuuuuucacuuuggauuaaguuaguuuuaugaaaacagaauuuuaggugauagaaacaguuacuucuuauuuacaaaauagggaaguaaaugucuaacaccaaaaauauuuuuuagauuuauucuauguauuuugcuucuauguauuuguaccauauaugucucugguacccccagaagcccgaagaggacaucggauauccuggaacuggaguugugaugguuguaagccacugugugagugcugggaaccaagccuggguucucugcaggagcaauaguaacugcugagccauuucuccagcccuccccccacacccggaagacucagucccuaccaucagcacucuaaggcucgagucuuacauaccgucuguuguccagguucagcugugcucgucucuagggccgggucaggccacucucagaacaacuccugguucacagaagcggaagcuguggccgagaagcagcacagcacacagugacucugcugcucagaagaaagaacucguggauucuuucacuugaggauauuagauuuauucuguuaaaauuauaauggccauucgguuuuuauuuggagccuuuaggaggaauagguuucuguagauaaguuuauaauuuaaucuuuuguauuuugugugguggaccauuucuuauuuaugacuauuuuuacuuuacugucucccuuuuuucaggaacuggcauuugacccguaugagucauaugcucgggauauuuuacgacccggauuccauggccauuuucuuagucaguuaucaaagccuggggcagcacuuuauuugcagguauagugauuguuaaauugcacaauguuagaaaaguaaacucuaaaaaauauuaaauccuuucccuuuuuaguccauaggcgaaggcuucaaagaagcuguccaguacguccugccccggcugcugcuugccccuguguaccacugucugcauuacuuugaacuucugaagguaaaaaaacucagauuguuauuuauaaagcauucaagugucaucguuugccacuucacuugcaaacaugugagcauccacacacauuagucuauguucuuuuucuuuguuuagcugagaagcaauuuuaagcacguuauccaaaagacuaacgugcuuucugacuacuuaacuguaaagcaguugcccagguuuauuuauuuuacuuuuaucugcauuuauuuuaugcugacuuuauucgugugccaugaaguuuuguuucuucaguuucuucugggguaucuuuuucugugcagccuccucuucuggcuuuggaacggucagugaggaucaugucaauguggcaggggggccauguauggguuaacccggccaugagcucuggaggugcgucuguuugucugucugucugccuuucugucggcgucucaggggccguguucaccuggauuugcucagugacuagaaaucugucuaaacccuuaaguucagcauuacucucucauuuuuaagugugugaagcaaaaauucagcacucuuuuggcuacuguccguguguccagccccacuguuuggccugggcacaccuaccgccggaacggcacacauugcuucuuuaaagugacauccuucagauccuugguggcuuuguggauaugcauacccuugauggccugggcagucucccggguguucuuaaagugaacucgaagguuugagccucuugauuuguaugauuuugugggguuuucugggucaagccaguguugaaccaucuucacaggucaccucuggccacuuagaggaagagcccaguuuuauuuuuaaucauguggucuguuugcuuauauggugauucuuugaaagcaacuuuguauauaugcauccacaucuccaucugaggaccucaauagcuacagggacucuccucagggacccaauaugaaaauaaggcuaaaguaauaaaaacuguuaguucaauagauuuucauuguucagcacugcagcaaugucuguuaaacucaguguuguuauuauuuuagaagcagugaauuuguauaccaguaaaaguucuccaacugaucauaguucaaaauauuaaguaaaaaaauucuaaaggauuaguagccacauaaaacuugaaaauuaguuuauaaauaaaagcaagaagcuuuaaugagaauuugaaagguuauaaaauccaagcaguuuaauaaggaaaauuaaggauugcaagauggcacugugacuggcacucgucacagaagccugacagcuugauguugaccccugaagcucacaugggaagagagaaccagugucccagaguugugccugaccuucauguccauacucucacacacaggcgcgcacgcgcacacaugcgcgugcauacacacacaagagaacuuauaggauggaaagagagauggcuuagcacuugcugcucuucuagaggaccugaguucaguuucuaacaccacacugggcaacuaacaaaugaccuguaacucuacauucagagagcuccagugucuuugucuggccucuuuaggcgccugugcacacacagcguacaaacagacacauaauucaaaauggcuuuuaaagaaaaaguuaguuagguaccaaguucaaccuugucucaaaacaaucagaaaggccagcaaggaugugcuacuacugugugagugacuccugggacccaugugguagaagggagagacuucugcaaguugcccuucuuaucugucuccauacauggacacauaaaagcaagcgugugcacacucuaaauaaauaacuuacuuuuuaaaaaggaaugcuuuuuaaaauuaucugguaugguggaucaaaccuauaguaccagcacuugagagagacuaaggcagguagauuacuaugaauuugagaccaggcaaagcuacauagagaauucuaagccaauccgggcuacaguaugggaaaccuugccuuggggaggugugggagaugauuuucauauagauaauuaagacuucucaggacuuuaggauguaauguuguucuacuguguguguguguuccugguucauaguaugacuugccuuacauugcaaagcguauaugauaugguaguacauggaacagggcacggaucuguccauacacacacucaucuuuuuuccauucuggauucuuucagaaugaaugcaugacuugaauuuuuauuuauuuccauguguacacacaagcaaaugcacacacaagugcaccaaguguacaugaggccagaggacagcugacaaaguugguucccuccugccaccauuguggguccuggggauuaaccuugaacccuuguuccugucaagcugucugccagucuuacuggcgcuucagcugugucuguugguuuaccgcucagcucauuuuuguaggggaggauuuucaagguguaauacuguguaugucuguaggcagguggugcauaaguaugcgugacaggaguccacaccggggagcugaagaagucuucaguuauucaucaccuuaguuuuguguguaucugacagggucuuuuauugaauguagaaccugccaauucagcuagaauugcuggccagccauuuuaagggucugcuugugucugucuugccaaugcugagauuauagcugccuaauuguggucuuuuuguauuuuuaaaggcagggccucuguaucccuggauguccuggaacucaauauguacacuagacuggucauaaacucacagaaauccaccugccucugccuccugaguugugggauuaaaggcggguguguagugucuaacuuuuuaaguggcauuugaacuuggguccucauacuuaggcaagcauuuuaccaacuaagcuauuuucccagcugccucagguucuguuuugagaugcugguaucaugacauacucuaaauaaauggagaacuggucaauauacacuauuagaagguuugaaaaguuguaugauacaccaauguauuuguagguuacuuagggaaacuauugaagagguuccaauguucagugaaccaaaagaugccccccacugcacccucugauucuugguguucuauuuucuuuucuuuggagaauuguuaugaauccuaaaugcccaucuauguacucaguaauucuggagacagcugauugcaugagauugggcagguggaaccgaaucauaauuuaucuguauguggaauggguucagaauuuggugacacugacgucuuucuaccuguugugcagcuagagaaaagucacuuuauuuuuuugaucccugguuuucuuguuuauaaccugcuuauuucacaagguaaggcauucaaacagugcauuuguaaagguuacuucaugaaugacaaugacaucggcacuugcauguuuucagcacuggagauguuucuuacugucuguaaugcuggccacuaaccacacccacauuuuccugcccaccagagcucugcuuuucucuauagucucugucuuuguuggcuagugugggccccacccaucacaccaccuuugauucuucucucuuccuuacuggcagcacucaugauuuaacaucagaaaugaccauguauucagccucaaguguccauuuguagugacaucaccuucauaucacuguuuagacacaauaacaacuucuuuauaucaucuuuguaauuccuugaacucugagauggaaagguacaguugguucccuggcaccugcaacaggaagucuagauucuugaguuccacugcugcugucuguaguuuuaucucagucgucaguucugcccaugagcuugagcagcccuggguaugccagcuccgugcauggugccauuuuuguucuuuuuccuccccccuggccugguggaaucccucuuuuucuaagcccccuuuuauuugagaguuuguuggguugcagggucagauaccccuuuguucccaagcugcugcugcugcuuucacaccuccuuacagaucugucauauugguauugucugccucgucuucagacacuauguucccugaggaaacagaacaaagccuguaugcuucugaauucugccuagcacaguaccuggcauuuaaauuguuuauuaaaugcucauuaaauaaugaggagcaaaaauagguauuuucucaauuccuaucuguuguagcuuuaaaaaguuuaacuguaaauuuauguauauguguuuauuugggaaacuuagaaugccuuaaacuuuacaaauucauaggauagaauucugcuguuauuugccuaacagugucagacaaagaaauagaguaauguaauguuuccuguggguuggggacauuaggaagagauuugucaacggauacaaaacuugaguuaggacugaagaaggaaagaaguauuaaacuuuauaguguuaaucgaaauaugauuaaaaugaauuuaauaagcuuacucagaaaauauuaaaucacauggaaguauaggauuaaucuaaggggcuuugccuaacuuugaguuagcuuccuaacauauguuaccuagguaauguaggaagauaaaggaaauaggcucugacuucauuagaauauaaguguucugcaguuuuccuuuuuuuuuuuuuuuuuuuuuuuuuguaaauuugcuuuuucaaacccuuuucgcuuaucagaagaagugagcauuugccacaagccuugaaauacaaccucggcuccaucugcuuaggucuuguuuguggugacugagacucugacucugugaauucagaaaauguggcuuggggauggggaccuaaaggccacuccuagaugaauacauauaagauuacaacaucacagcccacucuaaaggcucagggagauuguagcuggggauggaccacuuaagcauuagcuagggucugucccacacuaaccaagagcucuccugucugagugcuugggugaauuccuuacuggauugggucuuuuucucaugacagaaggaauaauaaauucaagagaauuucagccuaguguagaacaugcuuacagcauccagggccuggaacaaagauucaagacuagccuucaaaauggaaaaacaaaacaaaaacaaacccauauacacauacauuuaugcauacauacauacauaacguguguguguguguacacauacauauagugccuauagcaauaauaauaauauuguauaguuuugaaaacugcugagcagauucuaagaauuuacaucugagaaaaauauuugacaguauauauuuuuaaauauuuugucaagcaccauauuguauaccauaaacauauauaauuuuuacuugucaauuuuuuuugagacaggguuucauuacuugucaauuaaaaaguaaaauuucucaaauaaaaaauuuuauuaagauuuuauuuuuaaucauauguaugccuguuugugcguucaugcgugugcacccuuucugugugaaggugccuuuagaagcuagaguuguuagacacccugggacugcacuuucaggcaacugugagcaacuggguaggugcugggagacaaguucuggaagaacacuauguccuccucuuagucagggccaucucuuugaucuaaauuuugacugauuuuaguacuacuugaauuuuuaaaauuauuuccucaaaauuagacaguccuuaggcccuuuuauuaguuagaaacauuaaaguuaauauuuuaugaaguggaaaaaaaacuuccuuuguuguuguuucuuggagacaggguuucucuguguagcucuggcugucuuggaaucucuuuguagaccaggcuggccucaaacucacagaucuaccugccucugacuccugacggcuuggaucaaaggcgugugccaccauaccugaaucaaugugagcuuuugaaaaaucauaugcuccuauaaggugacuuuuuuauaugaaauuuugcuggcuuuauuaagcaaauguagauucuuacaacuaacuguagugaccaaaacucugauuacuaggaguugguucacccaaacuuaagcagcuucaguuauacccucaagaauuaccccguucucuuugcaguaugcugacuccaucuuacugaaggaaaagugaguuuucuuucauuuuaaaaaucagguuaaagggggaguggguggguaggggauuggggggguggguaugggggaccuuugggauaguauugaaaauguaaacgaggaaaauacuuaauuaaaaaaaaauaaaacaaucaaaaaaaaaaaaaucagguuaccugaugcgccagaaaauaaaccucuugcuuuugcaucggggaaaaaaaucagguuaaagucuguuacguauguaguauguacuguuauguaguauguacugcugauauuuucuaaggcuauaccaaacuauaaacuuaguggcugaaaacauuagucuucaguaguuuauucuuucugcucuagaggcagagagcaggaguugagagggccugcaucuucgagggucuaaggaacagccucacuugcucugaggaggcagcagccaucaggguuccccugagcuucauggagagccucgcucuggacgcucuggacgcucuggacgcuguggauguggccucugccugcaucagaucaggcacaucacuucccacucugugucaggcagcgucucgcugcccuuuccuuucucacagucgagcuuuaggguucggccauaaucuagcaugguuucauuugauuacuuaaaccugcaaaaaccuauuucuaaaaagguuuuauuuauuucaguuaauuguagacauuaguggaaaggucuuuggacuaacagucaugacccuuaaguucuggucuuuccugccuauucaucuaaguaaauguuacucauuuuauauuauguuggagaagaguagcuucuagaaauacaaucauuaauucauauguuccuuccuucuuaaauuagggaagccauucuagcuauucuguguucugauuaacgugaacuuuaaucaguuacacacuguggagggggaaaggaauguaaguaacucaguaguagaaugccugcuuacuaugaacaaaguccuggcuucaguccccaguaucacaaaaaccaucuacaguuuguuuuguguuaaaauugcugagucuuauucuugaaaauacuucuguaaauuguguuuucucccccccccccuuuuuuuuuuugguuuuuugagacaggguuucucugugcagcccuggcuguccuggaacucacucuguagaccaggcuggccucgaacucagaaauccgccugccucugccucccgagugcugggacuaaaggcgugcaccaccacgcccauccggcuguguuuucuuuagaagcuccuucacagcaucugugccgugguuuccugggagccgcucuguccgugcuguccgcucuguccgugcuguccgugcuguacauggacuauaccaucaguacugcuuugccuuuguuuccuucugauagucaggggccaggagcagauaugaaaaagcccagcucuguagcccagcuagccuuaaaguugaggggaucuuucugccucagacucccaagcgcuggacuaguuaugggccaccacaucuuaugcaggggccucccuacugcuuauaucuaaggaacccaaaagucaucaaggguaugagugacuccuuuucuaugaaaagguaaauuugggggcuggagagauggcuuagugagcacuggcugcucuuccauagguucugaguucaauucccagcacccacaugguggcucacaaccaucuguaaugggaucugaugcccucucuggugucugaagacagcuacaguguacucauacauagaauaaauacaucuuuacaaaaacgguaaacuuuaucaucuggauaggccauacacauugucauuaucuucugcacagggcguacacacucuuacuaugcuuuagaaugccuucuuaggugaggcugugcacacacaauaccaucuuaguagaguuuugguguugguaacggucgcuguggaaagcaaugagaacgcuucuuugcugucauuuacaugacugcagcugcuuuguuucuguggcaagaauaagccgccucuuuaaggauaauuagcuuuguuuuacaugauuuccuaauuuaaaucaauuaaaaaaaaaaagaauggacagacagaaagguuuuuauuaguugugugugaugaccacgagccuugaaccccaacacuugggagauauucagucgcuccucugaguuugaggccacccuagucuacaucgugagacuaucucaaaacagucuuucauuacacugaaaugcggaacacuugccuguuaacugugaggcaaaaagaacauuuaaaaguauuucaucagagagcuucaugaguucaaaaacuuaggggcuggaguaagcugugcugacccagugcuuuucuagcacccguauaaacaguggcacagaccuguaacacuagcacuagaggggagccaggccucaggauugggaguucaaggccagacaaaggcacacaaaacugugucucagaaaaaagaaaagaagaaaauggaagaaaaaaaaaacacacaaaacuuuggguuugugaauuuuaaaacacuaacagagaggcugacgggguggcuuagugguuaaagagcacuggcugcucucacagaggacgcagguucagucccagcaccaacaugccagcuagaaacugucugagucucuauuugaagggguaugacagccucuucuggccuucaaggcacauugugcacagacauacaugcagccaaaauacccauacacagaaaauaaaacacaagcaguauuguccauaugccaauauauucauauacaaaaugcaaguuaaaugauacaugaaggacucugaaacagauuuugaauugaaaaccaguguaucccuaaacauguuuuggguauaugcucuauauuagaauucuguacauugggaauucuguauauuugcugaguuguaacaaaaacaggagccagagaggcggcucccuagggaagagcacuugcugcucuuccagaggacaagaguuuaguuccuaauguccauguagggugguuugggaacaucugucaccucagcacugucaucugaccuaugagggcacugcacucacauguauaauccauauccacacacacacacacugcacucacauguauaaguccauauccacacccacacacacugcacucacauguauaaguccauauccacacccacacacacuuaaaacaucuuuaaucagaacaaaauacagaggggacaauacucucccuauuggcacaucuugcucuguauguuaaugacuugaaugcuucuggacuuuacauuuuaaagacuuuuuaaaaaauaaucauuuauuuaugucgggagggguaagcagaggauggaguagcacguguuuuuggagaucagagaacugcuuaagggagucauuuuucuccacccaccauguggguccuuaaggagaacugaggcugucaagcuuggcagcagcugccuugcugagcaguccugccagcccuggacuuuauuuuugauucuauccuuaagaguauccuugugccuagagccaugcuuaaacuccuaugggagucggaaacaguucuguguugccucuucucaggaacaugaccaaugaguacauacgugacacugcuuuuuucaaggcuuaacaguucuuucuaaagugguuccucgugguuuucacauggaaaacuuggugauguguuacuacacaguacuacacagaaaaguaaaguucucagagacagagccuucugcuuacagagcucaggcugaccuuagacucccgcuacagugacacgcaugugcugccaaaccuugcagaaacgauaauaagaacugcuguuuuucuuuggagacagcuucucguguauccgaggcugccacuucuuccuguguccugugauuaucugcaaccaugucuggacuacaugguaucagagaauagaacucaaggcuuuaugcaaacuaaacacuaccaggcuacaucagccuagaaaaaugcuucaaacaacugaaaggcuggagagguggcucaguuguuaagacacuuguugcuucugcacuggacccuaguucagcucccagcauccacacaauggguuacagccacuugcaacuccaguaccaggggaucugaaauucucuucugacuuuuuugggcaugaagcacucauagggugcacuuucagacauucaggcaaacacugacacaugugaaauaaauugaaaaaauauaucuauagaacauuuaaaauuacugaaguagggaaagcugaaugagcaucauuuauccuuaaauaaagugagguccuccuucugcccuuuccacagcaguuagaagaaaagagugaagaucaagaagacaaggaguguaugaagcaagcaauaacagcccugcuuaauguccaaaguggcauggaaaaaauuugcuccaaaagucuugcaaaacgaagacuaagguaaauauucucacuuuaaagucucuuccuuucuauccugaaaguugugguacaaguucaggagccuuagcccccccccccccccccccuugaguaaacaaugaagaaaacaguauuagugacaagcuuggucuuucagaggaagugacaucaaagccaggagaguuuguuauuguuugaaaaaccuuucauauuugugcauuuucccugcuuacucccagacaggaccuccugaggagcagcugguaagcuggaggggacggagcacaguguaccgggcagagcugccagcgucauuguuguagcagagugaaauuagcaguguugcuuaguuugggaauuguauaacucagacauugauucaguuagcaggucuacuuucccauuauaacaugugcuguaugcuuuuaucuuugagucuugugcauuuaaaaauacuuaauucauaucucaauuuuuuuuuacuguguugggcuacuuuuuaauaguuaucuuucuaaauguuuacuauucaagacagagauaauuguuuuguaccugaguuuauauaguugaacaucacuguuauuuuuauaaaucugaaaaaaaaaucugugcuuaguucuuauaguuaugauuauuuguggaguuaguaaauaucacgugagugauguuguaaauuauauuuugcccugucaccuuaucugcaugaacucucagaucugucuuccgugugcuaacagugucuuucccuuuaccccagugagucugcaugucgguuuuacagccagcagaugaaggggaaacagcuagccaucaagaagaugaacgagauccagaagaacauugauggcugggaggggaaggacauuggacaguguugcaaugaguucauaauggaaggaacucuuacacguguaggagccaaacacgagagacacauauuucucuucgauggcuuaaugauuugcuguaaaucaaaccaugggcagccaagacucccuggugcuagcagugcagaauaccggcuuaaagaaaaguuuuuuaugcgaaagguacagauuaaugauaaagaugacaccagugaguacaagcaugcuuuugaaaucauucugaaagauggcaauaguguuauauuuucugccaagucagcugaagagaaaaacaacuggauggcagcacugaucucuuugcaguaccgcagcacccuggagaggaugcuggacguaacggugcugcaggaggagaaggaggagcagaugaggcugcccagugcugaaguguacagguuugcagaaccugacuccgaggagaauauucuauucgaagagaaugugcagcccaaagcugggauccccauuaucaaggcagggacagugcuuaagcucauugagaggcuuaccuaccacauguacgcagguaagaaacacgcgguggcuagaacgguuuccugcuuaaacgaauugauuugauggguggguuacugucccugaaauagaaaacuaacaacaagcaaauccuucucuaggagaggagcauuggcuaaaaccgucacucuguauuucuuugaaguuuuuaucuuuucuaucauauuuacaaagagaaacggucacuugucuuuaacguuacccaguaaaaagcaguagaaauaagaccaagccucaacaugauugucuaaaagguagaauuacucaguauaauuauuuuuuucuuauucuauaacuggguuacaaacuaagugaugcauuagguauucacccaccaucaaaauugugcugguggcaaaaaugcguauuuucuuaaucuccauuccuacaucuauuuaggaaaucuggaagccauuuccauuucaguauuuuguucuuaaaguuacuuaugcaaacaguuuuaccuuaacagguuuuaaagaaaaccuagagagaugcuagguagaauucaguacagugguuaagggguaaagggcauacugagccgucuuguguggucugacacacaguggggcguuugauagcugccauuucagaauugccguggagcagauagcgcuccgcuuagacuuugccccuucaccagaucagggucccuuuaugucccagaaccauaguuuucaucucaaaaaugaacaucagaucuacaccauaguguguugucagaaaacauacacgaaauacugacuaugaaagcuauuucuaaguuuagauggaaauuuuuaaugucuuuucuuuaagagaaaugugugauuuaaaauuauauaacucaucauaugguauucuuaaauaccugacuaugaaaauuaaccucucccuauacuccucauucaaggauauuccuauuuuuaggaaaugcaaguuucuggggaagaauauuuauuuuccuguuuuuuaaaauguccucuaagugaguucuguuuccuuuggaagcuauucuggugcuaguaagauuaacucucaaaaauauccuuuaguuuucccacuuuguaaaacugaagaucauuuaacaaggacuuccuucccuucaauuuauuaaauacaaguagcgcuucgugugguugggaacuaccaaagggagagaagguaauuugagugcuguuuuuuauuagugaucucaaaccgcuuuaaaaugugugguugccuuuaucuguauaguucugguauacaagcuggaguuuaguucugcuuuagguaucuggacucuuugcaggccuuucauaguacaucgauaguguuuuccaaaguccaguucuuacaaugacucagcuccucugaacacgcauuuccaguggcagugcccaggcgcugaggcacgcugaacaugucauguauguucauguguaugagucacgucaucccgggcuccacuuuacuguaaacuucaccagggacucuauagucaguguguuuacuauucaaaaauuuaaaaaagaaaauuuaagcugccuagaaguuacauaaaaaauagauuaccuuucuuguuauauauaaagcuauuuuaaagagcuacaguuuuuaguaauuauuauaaacuauucacauaaucuucaucaaccuucuguauacuguuuaaaauuauaaaauaacaaaaauacuuuguuaacccaaaauugugguuuucaaauacucuaaauaacuuuucaacaauaaaaguucaaguugucuaucuugcuacauugucuuuguuuuuaaaucuugugaauuuaaaaccuguucacuguauccucaauacagcuuggcuuguuuuuuauggaaaggacaaaggaaaagccauauaaacucaauuaaaaaaaaucagcauguggauugaugguggcacugcagugucacagggccuggcuuugugcccuggguaaucuuuugaaggcgucauucuuagaguauuuagguugucuauuuuaccucugcuugugaaggacacaguuuucucuacagcauggucagcaaugaucacuggagacuaaauagggcaagcugcucuuuuuuuuuuuuuuuaauuaaauguauuaauuauuucuauauucuaaaauuuacauucuguuucuaaaacauuucuguaauuuucuuugcuguuguauuugacaaaaauaauuuauaauuagcauuuacaagcuacaacugauuuauuuauugauuugcucuuuucgagugcgucuacacuugaacacaccccgucaguagaucggugucauguggcccaguagucuuuaccccucgugugugcaaagcuaccuuugucaugaugucaccaugcacaccuaaggacuguacugcugucaacuuacgcaaaauaaaguaacauuuuuauggucuuaaaauaacacugaaauuucuaacuuuauaccguuuugaugaagucuaguuuacugagauugaaugagauuacuuuaccuuuuuuuuaagauuucuuuuugucucucugugugucuaugcaccauguguguaaagugcuaguggaguccagaagagggcgucagguuuccugggacuugcuuuacacucagguccucuggaagagcagcuggugaucuuaaccucugagccuucuguccgaucccgcuuugcuuuuuuuauuuaaacguauauguguaugugaguacacuguugcuguuuucauacaggcucgaagagggcaucaaucccguuauagaugguugugagccaccaugugggugcugggaaucaaacucaggaccucugggagagcagucaguacucacuuagccaucucuccaguccccuguuuuacuuuuuaaaauuaaaagaaaaaaaauuaaauccuccaguauuaaagaaaaauaaaaccaagagugucuguguuauaacuaaguuuuuuuacauuguucugaaguuuaauuaaauauuuuauuucauaaauauguuacugauauaacugguguccaccagcaacuuuauaaguugugagcuugaaguaagugaaauuacugcuauuaauuuacucacuguucuuugaugucuuuaaccugcaguauacgauuauuuuuuuaaccuagacuaacuaucccgucaagcccauucuugccuuacuauggcaguauagagugugcuuuugauagacacccauggaucuguaagauauaaaaugaguauuguaaggucuccuccagcuacaaugacaacauauguagcuaucacuuguuagaugauuuuacgagcuuuuaaaaaaagauuuuaagaacuuucaugugcaugucucuggaguguguauaugcagugccagcuuaacugauguaaacaaacauuagucuguguuuuucuuuuauucagucuccccaaauaaaaaggggguuuuuugaucugguuaauugguuauuaggguguuuuuguuaacaugcaguagagguuguggcuuacacugaaacaaaagcuaaaauuaauaaugcuuuuuuauuauauaguaaaagacauuguauauaauacaugaggaagucugauaacuaguggugaauauagcacuucgacaucauguagaguauuguaaguuacuuagacaauaaaaauugaagagaaauugacucacauuugauuaguucacguucagcuuggcuucggcuaacuugauuucucaaguguuacaacaauaacuuagacagagcuacacaccuguaugccaggagcugucuacaccugaguuuauaacagaagccaagaccccuguggauuguuugaguugcuagaaaucuuaccaguuaauuacagaaugaaaucuagaaaucaauuucuuuuuaaaaaauauuuauuuauuguuuauuuauuuaauguauaugaaugcucugucuucuuaaugaaagccagaggagggaaucagaucucauuacagaugguugugagcuaccaugugguugcugggaauugaacucaggacaucuggaaaagcagccaauguucuuaaccgcugagcgaugucuccagucccuagaaauuaauuucuauucagcagaauauauuuucuacccaugucccacugacacuuucaaacugaauuuuuaaaaacuauuuuaauauguuauauuuuuaaaagguauacaugaugaauaauaaaaaugacguuuuaauuacucucaugguggcuauucauguggugcaaaugcagguauacugugaggagauagaguuuuguuuuguuuuguuuuguuuuguuuuguuuuuaauugaaauagguaguaaguucugagcauugugaugagcaguucuguaugcaguuggauucuauuugucucuuuuaauucagucccuggccgguacucagccuuguuguacuuuacuuuguuagcuauugagagaggacaggcagccagcccggcauguuaacuucaucagccaccugagugcugggauuacagguguuugccacuagguuuuucccugacagagccuaguuaauacuaucagaauaguaugcucuauaaauaaugcuuucuggaagaauguguuuauauaacaugaauuaaaagauggauaaugugcauaaaugauuacagugugacagucuaacugauaacuugucuaucauccccaguauuacuggacccugacuagaucagacuugggggaauucaccuugaacacuggcaggaaaauuacucaguuggauuauuuuaaauuuggcagugauacgaagacagucuccuuaccuagaguaacaaucacaaagccgugcgacaagggaaaggggagcaggaaguuccuucacagaguucuguggacacugcccuguagcuaaccugagcugcagcaacucugggagaaaaaggcuugguggucuggccaugagugguagagaaugggcugcugacccugaggcaggagggcaguuaaguuagcugugagcugugccacaccguuuccucgauacuuuuguagaagauggaauuaagaacacuuaagacacuuuccugauguauuuacugcuguuuuuguucucaaauauaaaauguucaaaaaaucuacauuuagauuugagucuguaucuugcaugaguuagguuugggcguuuaacuuuuaaagucucugaacaauuuuugaucuauagggcagugcucuucuauuuuuaaccuugcauuuuuuuaaguguuugugcgucagcauagcgucuguuuccuuuuuuuaaggaauucaaaagugauuguuuguaaguccuggcugaggaguucauuguuucuuaggguugaaauggcuguauuaaagggaguauugucacaugaacagacauccugauuaacaguguucuaccauggcaggugggggaggggugcucugcauaaauagcuuuuuaguguaauaaauguuucacaagucuuaagaccuugccauauuaaaugccaaauguaaauucaaaguagggccagaaaaaggaagauugauaucucaaauuuaauaugcuguauucugaauacuagauauaauauggauagaguugaaguucagaagauuuuugaauuauugugcaccaaauaacaaagaauuguucagggguugaauuagcuauaaggccagcgaaauaaccguggucugggguauggcucagguggaugaaugcuugccuaacaugcaugaggcuuuggguucaaucccuggcaccucaugaacugggcauaguggcacaugccugucaucucugaauguaauguucaggagacagaggcaggaggauuagaaguucaaagccauccucaguuauauaguaaguuuugggucagucugagauacaugagggccuguaccaagaacuugagacuagcuucaguaguuguuuguauaaagaguguaugaaaacgaagcagaagcagagaaacucugaguguggugggguaggucaggaggaggucaucucugguggauuagcuccucugcuuggguugaaauuguagggucgugucugaguaguccauguccagacugacuuuugguuauauaucagaagagacagucaaaucaagcuaccaucuuauuaguggccauuuguucauguuuguaccuuaaagccaaauucugccugacuuaaauacaggaaaggucuuuuaaaauaaguuuguuacucaguaugaauuguucauugcuuuagauuagaaacaaaacacucucucucuuucucucucucucucucucucucucucucucucucucucucucucuguguguguguguguguguguguguguuuaaaccagcaugggaauauagguagcuuuuaauuuuuucuuaaguacguaagcuucugccaguuuucuuggaguauuuuagucguuccucacacaccccacccucccuuuuuggcaaggcugcuuuuagcuuccagccaaaauaagaacaaaugaaguuucagucagguuaggccacacuacaguaguggccacugcggagcauuuauuucguucgccagcaccagaagcuccucuugugagcagugugacaggaaggacagcugugcauucugacagggcaccaguuauaaggucaucauuagacugugcauuucuagugacuucuggugccucuaaccagcuuagcaguuacagcugcauucuggauuagucauguauguaaauuuguauagugacacugaaauagguugauaacuuguauauguuuagaauucagagcuagguggggcugauggggauccucugaucccgucugccuugauggaagagcaccagggcaggaacaaguggccgugcucuccugugcuccccacucugcugucugaccugcgcugcucaccuccccagagcucacacagcagcacggggaacugguguggucccgugugacuguguggcauggaggugcagggugccuuucccggcacugccaucagcuaguagccuaaauugaagagccccacuuuaaaaaauagccauauuuuucuuaaaacauacgcagcacuucucuucugucugaaacccacagcuuuuagccugauguuggguagcauuugaaaagaaauaguucugggugugauguuagauugucagccugaaauaaaccuggguuuggaggagcggugggcacacacuugcaauguggagcccagcccagagacacucagaggccucaucuagaauacacagcucucuagcaagggcgggcagccagccgagcagcccacuguggccccgcuguugcuuccuagacacacgcuacuuugagaagccucaccuuacaaauagauuugcagaacaggaagaagaaucuugaaagggaggguggugaugguaccgauaaauaccuguguuuuaaaaucuuguacagccuucuguuuuaaaaucuuuucuucuggaugagacuuuagucuguaacugaggaucucuguaacugaagacagacaauaaaauaccaacaagaaggaaauuguuaaaagauuuuauguaucuaagauacuuuuacuaguaacccacucuagccuuaggagguauaaacuaaaggaaccuuaaauaaaaccaaagaaguuuuuagcuggaagccuggucaaauaugccugcaaucccagcacuuugggcacuuugggcacugagacuaaaagcuagaggacugugaauucagggccggccuggauagcuagcuaggcccugucucaaaagcaaaaaccucccacaauaauauccuuuguucuguaauuuuuuucuucaaaguaaaaaaguauuaaguacuuuaaauucagggauguuugauaguuaaaucaguucacuaucuugaugauaauauauaccaguagauuagaucaauccaugaauuuuaguuuaagguuaaaaacuuacugugugaucuuuuaaggucaaauuuagguuucucagaaucaacuuaaaauuuuucuaaauauacucuaauuucacuaaacuuuguccuaguaaaagacuucuuauaaaauuaugauugauaauguauagguuuuuacugcgaucaguggauuucccgucacuuuauccauguuaauaauguaaacagagaaauguucuuacaagagacucaaguuaacagauguucucccuucuuuuaaagacuuuggacuaaucguggguggacccuagagagaucugaguuguagaacgagugguuuuuuuucagacagucuuacugugugucucugacuggccuugagucccggagacaugccuacuucugcaucugcugagacugaaggcccaugccaccauacgcaaggaaaugguuuuuggguuuuuuguuguuauuguugcuuccuccaguacaagaaaauguccuuuccuuccuuaugcagaagaaaauagccuaggcuccuuugugcccaucccagcucccuaacccuaacuuagaagcgugcucuaaaaaaagauccaaggaggcaagacuagagggucaucugacucaggaacuacuucaaauaaaagcaagggcuuuuuacaaccauguucucucucucucucucucucucucucucucucucucucucucucucucuguguguguguguguguguguguguguguguguguguguguguguguggugugcggcgcgaguguggagggcauagaggcgggagaacaaccgccuggauugaccgcagggccaucaagcuuguguggcaaaagacuuucucacugaguuugagacuuuuuuuuuuuuuuuuuuuuuuuuuuuuuagcaguuauaaauaaggcuuuuggcaauuaagcgauuuuaaaaacuauuuaacuuaccuuacuacuuuguaagauuuguuuucuaguuguaugcuuuguuaacaugaucuaaaggaaauuaggaaauguaguuaauuaaacuggaugucagacagaugggcugccgcugcugcuaucucuacaagguaaaugaacaggcaggagaacuuuugggauccugguagcgauggcaaccugguucaguucccuguccuugcuuuucuucacugaauguuccuugccaaugaggaguuaagacagggcaagaagucaguugauuauauuuuacaauuaguguuuuguuuugguuuuuugaggguuuuuguuuuguuuuauuuauuuguuuguuuuuugcuaccaauuuaugaagcaagugaagcuagcaguccauuauauaauccaaagccgucucucugguaaaacauuuaggggcuuuguaagccugaguauuugaucucuuuuaaaacuaaaaauaauaguuuuaaucauuguuuauacaagacuuuaauauuuuuccuuuuuguuccuagauccaaauuuuguucggacguuucuuacaacauacagguccuuuugcagaccucaagaacuacugagucuucugauagaaaggucugucgguuuuaaauguuuacguucuuuguuuuuaaaaggacuaagauauguuccccauaauuguguuaauaagcuuaacuguugaacucuugaaaauaaaagcuaacuuugauuuuuuuuaaauaaucaaaauuuuauauugcuuuaguacuuaaaacucccaacuucucagggucucagcagcacuggggauugaaacgugaaccuuuguuuuaaucuaagcaguauucccagccugaauuaaucaaguuaaagaacucugucaguauggaugacuuagaaccucagcugggcacaugccuauaaucagaacuugggagacagaggcaggaggaucagagcucaaggucgucuuugacugucauaggaauuuacgguuccccugaacuauauggaacuaugucuuuaacauaaugagacacuagaaauucagauuuuaaugguucauaaguucuaaacaaguuuucaaguuacuacauauugaguaaaaugaaucuugucaaugagcaaaugcuuuuaucaaggaaaauauuuuuaaucuacccaaagaacaaucaaguuucaagcauuaaucauccuuaaaauuaugucuccugauuuaaaguuaucuacagacuaaaaauggacauuggccucauuuguuuuaaauuuuacauauauuuuuauuuugcuucuaguuuuagcuguugacaaaacuaaccuuuuaaaaauauuaacuuaaaaauauuaucauuagauuagccuuuacauuauaaaaguggauuuuuacuuaugugucuguauaucuauaguaauuuuuauauuaucucuugauuguacugauaaauauaaauagaacaugaauuuggauuugauauaauauuuucauuauuuuuuguuucauguuagauuugaaauuccagagccugagccaacagaagcugaucgcauagcuauagagaauggagaucagccccugagugcagagcugaagagguuuagaaaggaauauauucagccugugcaguugagguaagcaguggagacacgucugcagccucaaaccuggguuucaaaguggggauguucaaagcggggcagugguggugccaucccagcacuugggaggcagaggcaggccagucugaguuccaggccagccagggcuacacagagaaacccugucucagaaacugaagccaggaaaacaaaaguggaaauguucgagaaacugucccuaagcaugguggagggaagcggugugaaugagagucucguuugaauugcuacagcuuuaugagaccguugccuuguuucaugugugcacucaauguuagauucuguguugugucgaugccacaggguguuaaaugugugucggcacuggguggagcaccauuucuaugacuuugaaagagaugcagaccuuuuacagagaauggaggaauuuauuggaacaguaagagguauguuuuucuuaaguuccuacuuuuacaugugauaaaauuaccaauaugguuacugccaguugauaccauuagaguucauuugaaaauauugaacuuucuuaucauacagcauuuagacuggauguguggugcguaccuuuauucccagcacacaaaaggcagaaggaguaugauuucuaugaguuuuaguacagccaggacuacaguaguaagacccugucucagaaacaaaacaacaaaacccagcauugacaacuguaaaucacucagcagccacccugcugaccccacauacuugcaucuguucuagaacauccugcugacuccacacacuugcaucuguucuagaauauccugcugaccccacacacuugcaucuguucuagaacauccugcugaccccacacacuuccaucuguucuagaacauccugcugaccccacacacuugcaucuguucuagaacauccugcugaccccacacacuugcaucuguucuagaacauccugcugacuccacacacuuccaucuguucuagaacauccugcugacuccacacacuuguaucuguucuagaacauccugcugaccccacacacuuccaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuugcaucuguucuagaacauccugcugaccccacacacuuccaucuguucuagaacauccugcugaccccacacacuugcaucuguucuagaacauccugcugaccccacacacuugcaucuguucuagaacauccugcugaccccacacacuugcaucuguucuagaacauccugcugacuccacacacuuccaucuguucuagaacauccugcugacuccacacacuugcaucuguuuuagaacauccugcugaccccacacacguccaucuguucuagaacauccugcugacuccacacacuugcaucuguuuuagaacugguucuuuuagucucagguuaagccagagccuuaacugaaacugugguuacccuugauacaggcuggaauucuuuuaccacuguaacaccauugauaaaagugcaugguuagauaaguagagcagaucaggaagaaauaguguauuacacugagagauugcuuuuuaaacaucagcacuaaucagaaacauaauuuugagucuuuagacucauucaauuuacuuaugaaaaacuaauguugcuuaucuccaagguuuccuuuacuuucaaaaauucugugauuauaugacuccaaguuugccuagacaaacuuuguuuuugcaucuauuguucagucuaaaugaaaaucagaaaauaaaggguuaaguagauuacuuuccuauacaguacaaaagacaggcauaucaaaaaauagacuaauaugaucaaucaguccucauaauuggguuauaaaauacaauauuaauuagauuugugaauaugaaacuuauucuuguuaaucuuucauuucguauggaauauggauugugaaaauaguauuuugaacuaagcuucaaaauguuggaggugaaaaaaaaucaaguuacuuuaaaauauguuuaggaaagguauagauacaugccaaacuauugacaaugauuaccugugaggaacaaggaugagagggagaugggggaggggaacuuuuaguauuuacuuugcucauuugaacuuuauagcaaugguuuauucauguaucacuuguauuacuuuaaacauuuuuuuaaaaacaaaguguuaaagaguauuuaaauguuuguuaaaauguauuucagguaaagcaaugaaaaaaugggucgaauccaucacuaagauaauccaaaggaaaaaaauugcaagagacaauggcccaggucauaacauuacauuucagagcucaccucccacaguugaguggcacauaagcagaccugggcacauagagacuuuugacuugcucaccuuacacccaauagaaauugcucggcaacucacuuuacuugaaucagaucuauaccgguauguuauucaacauucaaacucagaagcuaucucaagaguucauuuuaaaaauggaauacauuaucugccuuuuagggcugucguaagauguaaaugagacagcauaugauguguauacagcauuaaggcauugcagucaguucugguuguuuugcccccuuagucaucuugaucugcuuaaauuaacuuugugcucuuucaguuaccccugcuugggaagcucgguucaaauccuggcagucccaguggcuuggccaaagccuguacugucuuguagguuugaagagucuggugugugccugaugcauccaaggcugagcacaaagcagaacauagaaacuacugcagcaguuacuccacaguacacgauagagcgacugcuguguuacagcuaagccucagccaguuagaacccuuuauaguuuaaauugauuaaacuaucugaaaaauaugauucugguuugaaauuuuacuuaaaaucucaaaauuauuauuaaucaccaaaugagaaaaagagcuaaauuuauaaauucucccaucuccauuuaucauggucccugagugaccauguuagauaaugucuaaaguuuauucucagaggcauuugcaggauggcuuucucuucuguccacuguaagagcaagaacaagccaagaaugcguuaguaauugcccuguccuaguuggcuacuuacuagauaccauuuaaguaacuaccucaccaucuuaacuuaguaaauaauaccuacaagugcuaggaaagacauuaugcaaaaguaugcaguaaaugggaaaacgaccaugcugcucugcgcagucgugcuagcgcucaggacacugaagcagaggacugccauguguuccaggccagcugugccagacagcaagaaccuagccagggcuacauagaagacacugucuuuaaaaauaaacaaaugagcaguaaauguauuaugcaagaguaucuacuaaaauaguucuaaucugaaaacauaaaaaaguuauaaauauuguuuucaccaacuuucuguugaugaaagagaacuuaaaaaugucguuuaguuuuucuucuguaguaagcuauauacgugaggagaaaugugacauugccauuuuauguugaugauuuuagggcugugcagccaucagaauuaguuggaaguguguggacaaaagaagauaaagaaauuaauucucccaaccuucugaagaugauucggcacaccacuaaccucacuuugugguuugagaaguaagugugggcguuuccuccuggggcagaggcagguuuugaauccagcggggcuguuuugcuucuuuagugcucucauuccccuuucuuguaaacucaguaucuuucuaaugugcauuuuaauuucacugguacuuugguuuuuaaugguugccuggcacuaaccacaugcgucuuacuuuaucagucuaggcuagagauggcugcagcuucuucccagcagguagaugcuccucccauacgcggcucucauugcucccuuucuacauuugaacagaccuaaucaauggugcaaauccaacaaugcuucaugacaaugauuacucugccgucugcugucaccauuuuaucuuacagagcuuuuuuccauucacucguguccucuguugacaguguguuacauuuuuauacuacaaacccaaaaguacauucagauaccuuaaauuaguugcuuuuuaaacaaggugagaggaaaaaaugggcauuuauaguguuuguauaauucuauaauuaccuuuacugauguucuuuguguagacugacauugcugucuggggucccugguuuuaagccugaagagaaccuccugugguccagugggucaacucacaacaagugugcagauuuauugcuguuuugaacagcagcucucucuugagauuaguucuguuuuauucugucuguucauaucuauuauugagcccccuugccuuucaguccauuuguuuuccauuuggugcuguuuaaaauuuuaacucuuuccucaucucuuucuagaugcugcuauuacacuucugugcgccuuaaccaggcuguccuuuagcucugugaccauacucucugauggcgacuuugaaauacuucaguuaauuuucaucuagucacucaaacaggcaguuucugcucccugcuuuuauuccacuguuuaggucauaccuuuuauuucuuuauaugcuuuauaauggauacagcaacuuuucaauacugcccucugccuuccacagcuuucucuuugcuacuuaaaugugaugcggacuaagcagguuagauguggggauggaugcccauaguuaggacuuugggaagacugguuccaguaugguucacauucucucucccaggcugcaccccgagcugcuaaauguugcacuacuaauucccgucuucauuccuuugucgugaacaguucccugguagcacagguugcugugaagaauaagccaaugaaauucuggcuucuuggaaguaaaguuuuuaagcuccuuaauaacugauauuuguucugaccugcaacuaucuuccugguucacaccguuccuagcuaacacacauuuggggcuacauaucuuccuuuuaucuccagauuucuuuccaguugccuuucauaacaacuuccacuguuccugaacacaccuuugcucuagaugugacacaauucuggagaggacaugacuacaagcugucuuuacauucuaagagcuuagagucaaagugccaagaaugaugcuguggccucagggucuagcauggaacccugucaggagccaagcaaagagcuauuuucccagcguucuaauuacccuacagccucagcccauaagugggcaaggggagggcuccguacaucuuaaauauuaaggaaauaaauauuauagauaaauaaauaugaagacugcacucagugaagcccuaacucagcaggguaggaacccauccagaugugcaccccaaccccucaaaaucccgggcugggauuaggugcuccugccccagggcucaaacaaaugcuccggagggaggaagaggaggggacaggagcuuaguugaaauacuccagagucucccuuuuaaagagauuauuuuguagauuuucuugaacaauuuuucguuuguagcuuguucuuagggucaccuccaaagacucauccgcauuaugaguuauggugagugggugugguuugcuuuaagaucacuggaguccaucagccgagcugcaccgucugauaaagccgagacgucugugcgcuuucauaacuggggagcggacaccuuagcuuuguauacuggauauuguuuucucagugaagaagccagaguccacagauuguacugggcucauaagaacaagcaguugguaacacacaaaacaagucuggaugaaggccugaggcgguucaagucacacaaagacagcuagaguugucugugagaucagagauaauauaccucuaaaaaguaaaaacuagaaucuucucccaaaauguugcuucccgguuucauuuuaaaguugauguauuuaaauacagaagcccuuucuuaccuccccacaguuacugcagcuaucauucuggggaacagacacacaaugaaugaaacagagagcaguguccuucgggucuuuaguaggcgauuuaaggggaagcguccccugcguuuucagugugugacagauucuuguucacucaucucagugguucugagcuacaaguccaguagaauuggacccaagagcacugaucuuaacuucuauacuuaguaaccaaaauaguuaagguauaaagcauacuugcauuacguuuuuaauuauucaccugauaagguaaauagagcauacauaauucuuuaaauauguuaacauguuuaauuuuauaagccauuucuuuugaugguuuuuaguauagagguuuuauucuuaguauuauauuagccucaucaagaauaauaucuguugcuagcuuuacauuuuaaaaauuuaauguauauuuacuuuugaacuuaauuuuucuuagauuauaaacuauuaacgucacugagaacuagguuuaaaauguuuuucuuacugacaaauuguuaauauguaaaaaguucucucaaauagaaagauuaagcguggacuaagcaguuuuuuuaugugugugugugugugugugugugugugugugugugagugugugugugugugugagagcagguguguguguguauguauguauguauguauacauaucacacuauauaauaaacuaauauauaaauuguugguauguaaaaaaaaaguacuuuuuuguuuguuuguuuguuucuagguaguauguuuuguuugcuucuuguucugggacuugaacccagagccugugcaugguaaccacaucaugagcugccccaccugccguuauuuacuuaguuuuuaaggaaaauauuucaacugacuuugcagcauacuaaugguuaucuuuuuuuuuuuuuuuuuuucgagacaguguuuuucuguuguagcccuggcuguccuggaacucacucuguagaccagguggccucggacucagaaaucugccugccucugccuccuaagugcugggauuaaaggugugcgccaccacugccuggcuuacuaaugguuaucuuaaaagcuauuucuauaaacauaacuaauuauuucuauauaucaaaaaacaaaaugaagcuggauaugguaguauacacucacucagaaggcugaggcaggaauauuacaagguuuaggccuucuucagcuacauagcaagacuuuccucaggcaaacagagaaaucccuauaauaggauuguguauaugcacacacaaaggaagcaaagguucuagaauaaacaggccuagcacauaccuaaugacagagauucacacauccaguaagauuugaaagcugacauuagaggauucacuugcuagauuaggaaaaugguugucugguauuacaguguaggugucagaagagagcaaugcgcuugaccagagccuuucucugcaguuuccuguccaacccuucagugugcauaugucuucuuuauagucauacugaacacuuuuugaaucagaguuuugggaaaauaaaaauuuuaauuucugguuuguuucaauuuccagauguauuguagaaacagaaaacuuagaagaaagaguagcuguaguaagucggauaauugagauucuacaagucuuucaagagcugaacaacuucaaugguguccuggaaguugucagugcuaugaacucgucaccuguuuacagacuagaccacacauuugagguaaguuuguacguguguuuaaaaggaacuuaggaauuugcaugacauggccacuacaaucccagcagcugugauuaucagcaugaugucauggaagcuggguggagauuguaaggacucaccucuuccagagcaugucacugugguuagugguugcugagagagggagagacauuuuauucaguaacuacagguaagguccuggguucauaaauaaccccucacccaagcuucuguaagcagcugccauuuacucacuggaucaccaagagagagggggcgaggucgaggagagggagagggaacgagaguaaaggccaggcaggacaagggaggacuggcugggaagcagaagggcuccagcaggacaaggacuggccagaaaucgcuguggggugaaugaucaaagugcauugcagauauguaugaaaacguuguaaugaagccugccauuguguauaauuaacaccugcuaauauaaaugggaaaucacuuaacaguuuuuaaguaauagguuaaauauuagacuuaccuaaauuucauaaugaauuguuuucucuuuuaaaauuaaguguucucauuaaaauucauucauagguuucaauuuguuaggagaaaaaacagcauuugauuuucuuaauuugugugugugcguacucaggugccuccauaggcacaugggaggcccaaggaaaguuguggaguagguucccuccuaccguccugacgggaucuccggguuugugcugagccagcuugcuaaccuacacucggcauuuuguaaugcucaguuaaacauucacauaaauuguaugagggaugacaagauagauuauaucaugcaugcuuuaaagcuuguucucaaguauaugagaaagguuuuuuaaaaaaguauuaaaccaggugugaucacucaacccugggagacagaggcagguggaucuacauguuugaggccagccugucuacaaaaugaacuccaaccuggaccuugucucaaaaauauauaaguuaaaaaguaaaaacaguauuaacauucuuggagucaaagcugauuaugaaugggcuauaauaguuaguuguucuuuugggauuuuauuuguuuuguuuuaagguuuuuuguuuguuugguuuuguuuuguuuuguuuuguuuuguuuuguuuuuggcaagauuugcaguucuuguagaacugaggccuccuaauuuuuauuuuuauuauuacagcaaauaccaagcagacaaaagaaaauuuuagaagaagcucaugaauugagugaagaucacuauaagaaauauuuggcaaaacucaggucuauuaauccaccgugugugccuuucuuugguaaguauuuauuccuaauugugcucuggauaaaacaaaacauuuuauuaaaugaguguagaagguagcaccguaauccuuucagguuguucuugcugggacuuuuaaaaaaaaucagaccuaguauagauugagcauccuaaugugaaaauccacaguguucaaaaccuugaaacuugcugaggugacacaagugucugucugaugucuguguggccucguuucaggagucauagacaaaaugucacuucacuccaagcacgguaagauagguaacucaggugauagaugugguagcacacgaaugugaggccagccuggcaugcauugcaggguccuaucugagaacaaaacaaaguaggugcauugaacagucaagcugcagauguaaggaauaugugguauguaaauaaauuuccucuuuagaccuggaacccacgcccaggauauccauaaacacuccaagugcucgaagcccucugaccucguucagcgaggacucaguuuguacacgcuuugcuuucuagucuaaucucugacagccaucacguauccuaucacucgugccuuuguggucuuauuauuuuuguuacugcuguaguccuccugcacaaguccacugccuugacugaccuguaguuuaguucaauaaaggaaagcagcagcauggugauggcauccauacuuguaugagacccucuagccacgcgucuaaacaacgucacugaugugcaggaggagacaggcuuccuucugcacaguagaccuuuauuguuaccauccuucuuugcacuggaggaugaaugccuuucauccuuucaagacugacuguccugucugaaccuguuguuuuucuugcauagagagugaagaugguaccugucuguugccuucuuguagguuccuccuuauauuuuacacauucaguauucuuuacacugcgccuucacacacaccuuuucccccagucagugcuagggcuggaacccagagcuuaugcgugccagguaaaugcucugccugggcuauacccagcucuugaaucagccucucuccucugccugugugcaugcuuuggugaccguucugcugaagguuuguagaaauugaucuauguuauguuugacuuucuuaguaauugguacauuuucuccuaguuuuaucuucaucuguguuguuuucuguguagucuaaguuguaguacacagaacaaugcuaaccuugaucuuuuccucaguguaucuauuuucucauauuucauuguugcacuuuaugacuaaacacuuuuacauuugcucguggguuuuugguuuuuucuuuuuuuuucucucuauauagcacuggcugcccuagaacucacuauuugaccaagcugaccucaaacuuagagagaccuuccuccucugccuccugagugcugggauuaaaggugugugccaccaugccuggccugcuuuuggacuuuuugaugugcacauuguaugugauuacaugccauauauguugcuuuuuugccauauguacauuuuauauuuuaguggccuuaaaugauuguguacaguagccauaugauagccauaaaguuagugugacucuuucaucauuaccccacgauucaguguauuacuucuuggcgucaauagauccauuuauacacucuuaaguuguguggggauagggaaggcagaacaguacgccauaaauaacacagaagggcgggcuuaaugucugucacugcuuuucccaacuuuccuagcaguaaaaggcaacucgggguucucgguccucuagcaguuggcucauacucugaugcacauacugcuuauagcacaguagcuuaggcucuuggucuuucaaaggagcaaaacucugggacaaugucuugucuauucuuagcaccuaggauacauggaggcaucacaaauguuuuuuaacuaaugaaagaaacuguauuauuuuagaacggaagagaauuuggccacuuagacuaguauuugauaggcacagugacaacuagaucuacauguauauauacauauccccacacacaugccuaccuaccuuccuaccuuuucccucccuucaucccucccuccccaccuccucuaucucuuucucaaaucagaguuugguaggccuagagagauggcucagcauuuaagagcacugaccguuauuccuagugccacauggugguuucaacugacuauaacucccucuucuggacaccauggguacuaggcaugcaugugguacauaggcauacaugcagggaaaaugcacauaaauaauuuaaaaauaauuaagcuugcuaguauauaguauugaggucccuauuaaauguguccauauacaaauauucuuugcaaaucacaugugcuuaaauauuuauaugaauguacuguuugaucaaaaaagcuuggacagcacuaccaugauuuuauucuuuugacuagucagucauuaaucaggcauacgauacuucuccaaauuuuaucuugauauuucccaaagugcuucuuguauuuuuacaacuuuauccaaguguuuuguuuauaacauguguggacauccuguucacuguaccagucauucagucauccuaaguacagagcuuaaagccuuccugcuauguccugcccaugugugugcgugugcgugugcgugugcgugugugugugugugugugugcgcgcgugcgugugugugcgcgcgugugugugcgcgcgcgccacaccauuguuggagggaagguacucuuagaggccaagagaggguguuagauucccugaaacuguacuuaaagggacaucugauauggauacugggaaucugacuugagcccugugauagagaaagcaagaacacauguaaacacugagccaucucuucaguccagugacuaauuucuuaaggcccaccucuuaaauuugugugcccucuauucucuccaggcacagaguaugauagccugcacacugcuauucuuuggcagucaguguagcuagcaauucuaaaaugcaaagauaugucuaaccuguuaucgccuauauaacagcuuuuuaaaagcuuuuucuuuuuucucuuaagauacucauugugcacuguaagauggccugauauuccuguaccacuaugccuagcaugaaaauuaaacguaccaaaaaauauuucacaagcugaguaccagaugcuaccauccacaaacacgucaauuuuugacuaauuuguaaaguugauuuuggcugccauugaauuuguacacucuuaaggacauguuuguuagaaagcacaagagccuaugcuuacuacaacacacagucauuauuuuaugaauguaccuagaagaguggccuuggugcugagaaacagacgaauaaaucaugugcccaaaccaaacaaguauuggugucaaugucaccuuaugcacacgcacgcgcgcacacacacacacacacacacacacaccauuauuuagaaguacugugcugcuaaacauuuacaacuacugaucuugcuuuuguccaacaucuugccagucuuauuucacuccacauaauaaauaaagcccuagggucuuaccaucacaaacagccugccugcucggagaaugcguccaugccucauggcgugggaaugucacacucguguccgcucucuuauucuacugauugaacucuuaauucacuuuuuugagauuuaaucuaaugauccuuuuuuaaucuuaacaacucaaaauaggaaagguaccucauuaugcugucauagcaucuuaaacauuacuacuacuguggcaucuccucauagugcaaucucaaaauagucacacacacacacacacacacacacagaguguaccuucauuugcuguaccuaaauguagcagaaaggcaguacauuuguauucaguaaacagucucagguauacacaugccuguuuuccaccccuucacgggaaaaaaagcaauguguaauuugggaggaaaaacaaagagaaguaauauuaagauaccaacaucagcaguugcaacuauuacuaauggacacuuucuguuuugucaggcccuaucucaaucuguauacaaauuuauuucccacagaugaauaacugaggcacagagagacuaagcaauuuaucucagacagcacagguagagaacaacauagcuggcucuagaaccuucgugccaggaaggaaccagagggcuggauaaagagcagaaguggacugaaguagcucaguuagaagggugccuguuuagcgugaaccaggcauggguguacacuguaaccccagugcucaggagcugaagccagaaggaugguccccagcuacaggacaagcuggagucuagcccauaucaccagguguacuaagucuaaaauaugcaaaaauuaugucacccucugcuugauagacuugaagccucgccucuguuuucacaaauaagccuguucaaauaugauccucuccaaaccgagagacuaaggacuggaaaggcuggagcugucaucuucugaguuugaguccuaucccgucccccccucgcuguucugccacuaugcuucaccaaugacagugugguuaaguuucuucaacccaggucauguaacagggaagagucuggaaggaagccuuuauucuuuaaaaauaaucuauuucugaaauuugaucuccuuuuccuugaauguuuauaaaacuuaaauauuuuauauagaagaaggauuuaauagacauauaucuggucauugguucuuugcuuauuaugacuaucuaugccuacaguuaaugagaaagggaaaaaaaccuuuuccuuuuccuucuuuagcaauuaaguaauucccuggucuuuucuaggaauuuaucucacaaauauccugaagacagaagagggcaacccugagguccugaggagacacgggaaagagcuuauuaacuucagcaagaggaggagaguggccgagaucacaggcgagauccagcaguaccagaaccagcccuacugcuuacggguggagccggacaucaaggugagugcagugugggagcgugcaaacuccuccucagccuuagacacugagugccucagaaaggcuguucauuucguagaggagaaaaggaaaaaggaaauuuaaagucaggaacucaaauuuucuuauauugaguguauccuaaacuaucuucaugaauuuaaaauauuuaauacuaauaaaaauuuuuuggcuuuuauuucagagguucuuugaaaacuugaauccaaugggaaacagcauggagaaagaauuuacagacuaucuguucaacaaaucccuagaaauagaaccccggcacccuaagccucuuccgagauucguaaguguccugugcucacacuugugcaucgcucacacuugugcaucgcugcagucucucccacuaugggucacacagacuuaaggacgggauguaaauguggugauugcaagugcuuaauaaguaaauagaaugagggccaucccaccugguuucaaaucagugaacacuaauauugauuuuaauaaauucugauaugauguaauuauaaaagugaccaauuuauauuguuuauuuuuaguuguaacaaaaguuaaaauuuauuucaaggacauggaauuuaagaaguuuauacuaauucauuuacaaucaguauauuuccuucauuuguuuguuuguuuuguuuuucaagacguuuucucuucauagcccuggcuguccuggaacuuguucugcagaccaggcuggccucaaacucauagagauccugcugccucugcuuuccuaguacugggauuaaagugugcaccaccaccacucccagcauacuugggaguaaugauuuauuagaaauguuagccaugagcaaugcaaaguuugcauaaaaauauuuuuaauaguucuuuuauuuuguaguaauuucuuagugccuagccaaguuuaugcucaguaucacuccucacucaucugaauaugcucccucacucaauaaagagucaaaaugaauacaaaugguuucuaagcggucacaguaaacugcuaaugucugugacucacagccagauuuuuuuuuuucaaacucuaaauuagcuuuuaaacaugaaccuaaaauaauucauuagagauauguaugucgacuccagugaggcacucugacaucacugugaaguggucauucugcagggaaagggcccuaaaauuaacacacacacaaaucaaaacgcaagcaacucagccuaucaguaaguaguccauaugguccgaaugcccuaauucccacaguuccugacgacuauccuggcuuuuccaacaaaguuuaauugccucaaauagcguuuuaaaaacuugaauuacaggauguauuucagaaaaauuuccaacccccgagaugcuuaacaagcauucugcuauuuauaucuauauuaaagcucaaucacgcacauuuguuucuagcaccuucuauaagaaauccucacagaggagugacagugcugcaccuggggcuccggucugaaccaucaugaaacuuucauauuggucauuuacagaaaaaaaggaaaaaaaaaacuuccuguuaaccaugauauuuuaaguauugugguuuguuuuuguuuuugaugucuauagccaaaaaaauacagcuauccccuaaaaucuccugguguucguccaucaaauccaagaccaggaaccaugagacaucccacaccucugcagcaggagccaagaaaaauuagcuacagucggauuccugaaagugagacggaaagcacagcaucugcaccaaacuccccucggaccccacugacgccgcccccugcaucuggcaccuccagcaacacagauguuugcagcguguucgauucugaccacucggcaagcccuuuucauucaaguaagugcugaaacuugacgugcuccugagaaguuguuaaguagugcccaugccagaggugagaguaaccucuguaauuguguguauauucauccgcguaaccugaguuucuaaagauacuagaauucuuuacaucuaaacccuacaacuugggagguuuuuuuaaaaaaguugcugaacacucucugaaugcauccaaguguacagcucgugucagaagaaacaaaggccauccuuaaaagucuucaauuuuguuuuuaaauuuuauuuuuugugaauguauguguuuugccuauguaaaugucuauacaccaugugugugccuggugccugcagagaccagaagagggcaguagacccugggaugggagugagcuuccaugugggugcuggauccucuagaggagcaacaguugaacaucagccuacacauuuauuuuauuugaauauaagguauaccauccccuccucaccacauucugcaguggcuucugauucuaccguacauaaaauuccaacucuuagaugacccuuccucagacucacuguaguauccuaauaauauguaguucuuggugaaacuaggaauagcacaugggcauucaaaccacaguuacugcuuuaucagcagaaauaugagagcaauauguuuggcuguaaaugucuaauagccacauuuuaaaaagcaaauauaacuuaaagaauccuuuguuaaaccuaguauuuaaaaaaugacuucagugugaaaucauauaaaacuuauuucaagacauacauucgaauuuaaguauugaaaaugcagugugcauuuccuauuaugccacaucucgagucaaacaaacccaagggugcuuggcagucacaggguuaucagccugacuuucuacgaaguuccauucacucuuagggaauccaugaggagcucugcaugcagcuccuaacaacacaucgccuuuuuacauucguuuauuguuagaucaaacuuucaaucaacuuuaauccucugugaauauuuccacauauucuucccauuggcauuccuagcuuaucaaacuccacccaacggccugacacagugccagcaucaggggcagcauagccucacuguugagguaaaggcugagaggcuccaaccuucgcauuaggaguccugcuuuaucauccaaggcuacucaugacuuuccugguucuugguaaaacacuuucugugugccuuguggaacuuuaggcugcuucuaaccuaaagaaaccaacuaaaaauguugcagauguauuuugagauuugucccagaacccuguguaguuauuucugugacgugcaugcaugcguuuaucucaauguacgucuugucuuugcacuacagaaaauuuguacugagcauuuacuuggcuuuacuugugacuaaggaacauggaguucacaguguauacuuaguguauaugaacuauugcacauauuuuugauaaguucagauauucacuaaguaaaaauauguauuuuucucuaauuuggcaauccucuuaaguacuaaaacacaaaacauacagauuuccagcuuguaugacuaaaauucauuauuguuggauucacuuagcugcaagguuucucccccuggaacagauauguguaacuccauauuauaaggacucccaaauaaaugaauuauugaaggcacauggaaacuaucaguugugaauucuuuucuuauuaguuuaggucacuaaaacuagaagaggugggaaaauaaacccacuuucucuccuuauguugaaucuaaaugaccagccaagggagagggcaucucuggaugcacuuuccgcucugguaugugcccgugggaaggcauuaacuaaaguuucuagacaaagagggaaaacucuuccaggagugaugaagcuuugaaauccuaaacuuuucggguuuucuuaacuacuuauuauaaagaaacuauuaauacucccuuuucucuuagugaaacugcaaagaacucauuuugaaauaaaguaacucaaguuaauauaaaacuauucucauguucgacuaaccacuacuucaucuguauuucacuauuucaucuguagccuauuuauuuuaaagguaccuaccagaacaaucagaucuauaguugugaggcugcucgagcuuucagucgcucugcacggguugucucuaaucugcaugccaucugaagcccuguuucccagucagaaagggcugcuguaacugcagccugcagccaucugagcagauuccauauuauuuauguuccaaaaggcugaagcugacuagaacuaauauauugguuguaauguucuugaggcuucguuuuauggaaguauacuguuuucuuuuuaaggaaauugaggggcgggaaagcuggcgcucggguuaaacaucauuuacuguuucugcaagcagaccugaauuugguucccagcacccagaaggcagcucacaaucccugaaacucuagucccaggagaccaggugcccuuuuuuggccucuguaggcuccagcaugcacaugacuuguacacacaauuaaaauaaauauuuaaaaacuaaaagugagaaauagguaaguaggucagugcuaagccacacacacacacacacacacacacacacacacacacacacacacacacacucacacacacauacacacacacacacacacacacucacacacacacacacacacacauacacacacacucacacacacacacacacauacacacacacacacacacacacucacacacacacacacacacacacacacucacacacacacacacacacacacacacacucacacacacacacacacacucacacacacacacucacacacacacacacacacacacacucacacacacacacacacacacacucacacacacacacacacacacacucacacacacacacacacacacacacacacucacacacucacacaccacacacacacacacaccacacacacacacacacacacucucucucucucuugaucuccacugagcuucucagaaggacugacaagaaaucagaacaccagcuucaugucauucagaauuuaaaagugaguuuuaaucuuacuaguguugcuaaauugcuacuuacacauaugaaaggaaacacugugugcgauacuggcuuaugaaggcagucaaguuaacauaagagucgccauaaggcugaauggauggaauguccguuuacucuccccuugaccacauaaacugaaaaacugucccaaauuaacugaguuauuguauauuguauacaaacagguaaaaguuggaaaucuuauuuuuaaauaguuggcucagugcccuauuguaggaaguauuuuagccacuuggguaguuguguuccauguguuuaguagugaagaaguguaacgacgauuuaaugacgauuuagagcagcccaggugucuaguguucucucucaauuuuccuucauuuuagugcaguggcugucaaccuguguguugcagccucauuggcaaacaucuccaaaaauaauuauauuacaauuuauaacaguaggaaauauuuuuaaaauuuuucuaggaauuuccucaaaaauucuaagaaccaaauauccugaaaucuuugaagguuuuggauacagaagcuuguuuuaaauauucaaaguucugaauguuuuaugacaauaaauguucugaaaacauauuuucaaaggugucugauaauaucuguaugacuuccccuuuaaucuuuugcaaaaugauuugagucuagcuaaguucuucacugcacugggcuuuacaguguacauugccuuccagggcagggagcuggcucagcagucuaaagugcuugcaccaagccugacagccuaaauucaaacccuggaauccucacgguagaaggagaaaacugacucuugcaaguuauguccuguccucugacuuuuuuuuuuuuuaagauuuauuuauuauuauacauaaguacacuguagcugucuucagacacaccaaaagagggcaucagaucucauuaggggugguugugagccaccaugugguugcugggauuugaacucaggaccuuugaaaaagcagucagugcucuuaaccacugagccaucucaccagcccccccccccacccccgacuuaaucacacauacuguggcacauggacacacugaacacacauacagauaaauguaaaaaagccuuccaauaauauagcaauauauuguuuucuaauaaauguucucauuuauauuaucacauuaaguaguaagaagaacuucaaaaaucccaauauuaacuccuuuagugagcuuuuucuaaacaugauuaugacaucuuuaaaacuaguaugucaucauauauacauuuuuauggguuaguugagaauaucaaugggagaaaacaacuuuuuccuguuuccuuuccagagguggcgaugccggucuuuacccagguuacacugccccauggcccaagucaguuuaccugauuuaaaccuaauuccugcuuuggcuugagaccagcuugaggccaccucccugcugaccuuccucccccaucuuauaagugagccuccccugcugcugucucuugagcauaaacaguugccuuaaauguguauucuucucaugcuuucuacagagcuuuuccucuuaaaagaccuuacuacauaaguagcuuccacaugcaccacuucucuuccgaccgcacaauucuaaguaugcuuuauccucaccguuaaaggagaagcagggcaugcaugcgcauaugaggcugcugugcacaucugagucacacaguacuuagccugcugacaacagagcgccagugguaaccgcauuaacuucauaaggacuaccuuauccuuacaacuaguuacaaugcauuaacuucauaaggacuaccuuaccauuacaacuagucacaaugcauuaacuucauaaggacuaccuuauccuuacaacuaguuacaaguuccaaacaguuagaaaaaccaggugcuggugcaguuacuugcucuagcuuuagacuaacaauucacuauaaauucuacuauuuuuaauguuuuaaacaaaucaauggcuuugcucuuuguacaaaugauuucaaaauauauacacuaaaaaauaucaguuacaagcuaaauuaauuguauauauuuucuuaaaacguaggagaccaaaauguugcugguggucuguggagaagcucggugggcagcgucugcuaugagagcgugaggcucugccugagcaucucccagacccacguggaaccucacgggaugucacaugcuugugaucauagcacuaaaucccagccagccuagaccagaaauguggguugcuugcccccccccucucucucucacacacacacacacacaauguugaccauuuggauauaagugcacaaaauacucuuagguucucuacuauuguaacauacuaauggugggggcaaaaugcuuaaaggaauuuaaaaaaacaccugccaaguacaucauuuuuuauuguuuucauaguuuauaaacuaauaguagcauaaauugucuuucagagcauaaguauugaggccuggauuacgccuucaucacuaagugucucuaagauggguuuugguuuuacauaacucuucuauacucucaucacuuuggucucacaucagguuuacuacauuuuagaacaguuccuguuuucacgaucagagcgccucugccuggugacauucuaaauaguuucaucaugguuaaagcuuuuggcugggcggugguggcucacgccuuuaaucccagcacuugggaggcagaggcaggcagauuucugaguuugaggccagccuggucuacagagugaguucuaggacagccagggcuacacagagaaucccugucuugaaaaacaaaacaacaacaaaaaaaaaaccuuuuggauuagaugugaugauucugauuuuguuuauauacuaagggggucuggacccaagcaaaaugugcacaagccucagggagcugcagauucucuccugugugucauguaagagauguaacacggcaagaucacagacuguuccuagaaacuaucuaaucuggguacagcauccugagagcaacagaacuagagaaaaaaaugaaccuaccacaguuugaaaaacaaaaacaaaaaaaagaccauuucaacgauuuuuuucaauuuacuuuuccaacagaaaucugaaaaauagacccaacuaaaaauuccaauuauagauuaacgaugguaacacuauuuuguucaaaaaguuuaaaaaacaaaacaaaacaaaaaccauuauuuuaggcagcuuuuucuuucugcauguuuuuuuuaaaaaagauuuauuuauuauuauacauauguacacuguagcugucuucagaugcaccagaauaaggcgucagaucucauuaugggugguugugaaccaccaugugguugcugggauuugaacucaggaccucuggaagagcagucagugcucuuacccgcugagccaucucgccagccccucugcaugguuuuauagcaguuuauuuuaaugaauagaauagaacugggugcugguuuauugaacugcuuuuaauaguuaaacacauuucuuuuagccaauagcauuuccaucuaagucuuuucaagaggaauaaaugaaucuaauagggguuacaggauaagguuucaguugugguacccagagauuaagugaccauuguuucugaggaaaaaaaaaauaaaauaaaugaagucaaaguuccauaaucuuuuuuuuuuucuuaaauuaacacucuacaggaucugcuucagucucaucuauaaguuuauccaagggcacugaugaagugccuguccccccuccuguacccccucgaagacguccagagucugccccagcugaauccuccccauccaagguaaaggagaacacugguuaucuagaaacuguaaucucuagcugugucagcgguuaacggcaaguccauuucuugcuggcaggcuuauauuucaaaguacuuagguuuaauaguucaaagauuaaguauaaauuuaucaugcaagauguuuauauuuuuuccuauaaagguaguuauaggaaugcaugcaaaccccuaaguuuaaagcuaugagcauuacuaacggaagaaaccaacucuuaucuacaaggugguaaauaguaacuuggccuugugugguucuuuuauauuuugcuugugagccuugucuucaauggcugagccauugcuucagccuucugcaguucuuuuaaaauguaugaugugugugugugugugugugugugugugugugagugagagagagagagagagagagagagagagagagagagagagagagagagagaaugggguaggguuugugugaagguauaugauaaugaaaccguacugaguaucugcugaaaguuauucucugagccagacaggaagagacuuaaauucuagguuacagagauccuaaagacucauaguaacuaagcuuucugccuguuuaaauuuacccuguuuauugauuauuuugcaaguuacucaauaauucuuuuugauuuggagcaacccagagaacagaagcagcagaauaagucaagaccauauagaguucaugaaacaauucaguacauuuaaaacguaaccauuacuguuaggguaguuuguuugccuaauauguacacugccuuuaacacuuuagcccugcgggggggaggggguaguuuaugcuaaauuagaauuuaguguauugugugaugggcagucaguagucaacaacaaacuuuugacuaaucuugacaaaauuaguuuuucccuaagaauggacagaacaucuugauuaacacauaggguaaaacuccacguucuauacccaguguucugucaguagcaugucugaaaaccccaaguuaacuuaguaaauuuauggugcucuucaaaugaaauuaacauguuguauucuuuuucauuuguuagauuaugucuaagcacuuggacagccccccagcuauuccuccuaggcaacccacauccaaagccuauucaccacgcuauucaauaucagaucggaccucuauaucagauccuccugaaagcccucccuuguuaccaccacgggaaccugugaggacaccugauguuuucucaagcucaccauuacaucuccaaccuccuccuuugggcaaaaagagugaucauggcaacgccuucuucccaaacagcccauccccuuuuacaccgccacccccccaaacccccucuccucauggcacgagaaggcaucugccaucaccaccacugacacaggagauggaccuccauuccauugcugggccuccuguuccuccacgacaaagcacuucucaacuuauccccaaacucccuccaaaaacuuacaaaagggagcacacacacccauccaugcauagagauggaccaccacugcuggagaaugcccauucuuccugaguuccucuaagcugggauaguuuccuagcccccagauccauugcuggcaauggaugcacugaacaugccagcacuggggaguucaaaugagaacuccaaacacuaacgacucuacuucacgauguaguauaagacaaugaguuuuaaccuacauggaauuauggaauaaaaugguauuccagcuuagaauguggaaacugauugcaccuggaaaucacgugaagggacuuuucuggccauugggcaggaguccucauauugugaagugaucuuuaucauuaaagggauggaaaacagucuaauguccaacaagcccauauguugacaguuuuuguaauucaaaauauuaugcacuuuuaaaaaaucuuaaacagggaucuccuccuuuguuuuccuuugcuuuacucuucuacuuuagaauauuuucguaaaaguuauucagaggacugugagaaaaggcugugguaccugaccuuguugaaaucaaggcccagcacuguacuacaguccuguuuacagauuauuacagugaucugaauggguaccgaggcuucaccaaagagguacuuuuuguuauuguuauuguuuuaagaauaauuaugccaauuuuaagaacauccccuacccacccccacucacaaacaaaauguggugguguugccuuuaaacaaaaaaugucaaugucauuaacaugauggaagaagaacauuuuaaaacguaacugucaaguauacgauuuacgcuuaggagacuguucaucuaugcuagacugucaucccccagccccuuugucucacagaaguuuacugguaauguauguccuggcucguggcugucccucuaaccguacacagaaacacaggcacccaaugugaacgagagcacucucugggccucccugacaccuuucauguuuuacuaauaguugaguaguuagcauaccuagaauuaccuugcauugccuaaaucauguguauauagugaauguuauauaauauaccuugcaggucuguuauuauuuaauugaauaaagauaaacuacuuuguuuggcuggcauauauuaaauuauuauauggagaaaaugguugauucuuauuucuuuggguugaaaacauacaaacacuaagcauaaaagcacauguggugguaccuggguaucuaguucuuacggaauaaucucaaguuggaguuuggcgugaagggaaauacuggcuuaaagugggauagguaucuuuuaagcagaaccuugcaucuuuuuaaaauuucuugagcaaccauacauauuugugaagauuuauauugaacauucuacucugcuuaagaucuuugguuccuucagagcuucuccuuagaguaucuaccugcauccuuaauaccacgugaugauucauggagccuuguacugcucuucugagucuaacaaauacugugacugaaaugcaugcaacuugaagagaaaacguuuucuuauucuccacugugucugugaacuguguaguauuccauucuuugacagccaucaguaugugcauguguccucaguaaugacgcagccuuucaguaacccugugacugccgcaucauaguggcaacuuuguauuuauuagcgaguuaaaugugcaccuugguagugcaguauauagucuucuaagaacagaagaacauuaauuguaucaucaugaggcagucuaguuuguuagaguugguucauuuucacucagcuauguuagccauuuuuuucuuuguaauaaaaagucuccuuuuuaaaaagaguccucaaguuaauuucaaaucccuucuuggaugcaaagugugcauuaggccauucauugaacaaaugacuauucguugaacaaaauuagcuaagcaugcuuacuaaugcugcuccguaugacuguaaugcacaugcccaaaucucccaggacuuuuuagaccagccuaacugucccuaaaacuucccauggcuuauugaucgcuguuugaucaucccguccuuauuucaaaugagaaucuaagaaaagcaacauuagaaacccauucaguaucuguggcaagugcugccuucaacaaggugauggccccuuucagucugccugagccaacaagggaaggagagcucagaucugaagugaauuauauuucucccacagggagccauugucuaucccacuguucuaagagaccacauaacccugcagucauuuuauaugcaucauggauagaggauauuuuuauucuccaauacaacaucuuggcaaaaauauuuucugcagcaguaacauuucaaaaauucuaauuggaugcucugagaagaugagaaagcuguauccuugugugagccauuaucuggcuggcagguuuauccuuagucauaaauguccuccuucugggauaagaaguggcagaagacaaaugcaccauuaagaacugcaucugaauucgaaauuacaaggcagccagugcagcaaaacuugcuuagcuaugcucccagauauggggcauuucuuccagaaauccaagugucagcuaauguuuucuuaugcuuggcucacaaagggaguuccucuugguggcucauuaccaauauaauagaaaugcuuuuucacagcuaagcucuuugaaaaacagggacagaaaaguaguguuucuuaauuuauuaagacaagauauuuacucuuuuacuccuucaaauguguuugaagacuacaaaugacaaauauugaaaaucugccuaauuuauuuuauuuuuuuuuuuuugcuuaaauaaagcuguugggcaucaaauugugaguuuaguaugccacuauucucuaacucgauguuuuaguggaucugaguugaaccaagaauaccaaauaaacacaaccagcagaacagucuacuaaaggacuacuaaggcugaaggcaaugcuacgauuucaaauucuuccuuaaugcaaaccaaaagugguauuuaucauaaugauaauuuaaguuuugcucacauuauuucacugucuuaauggcuuaaauuagggauauuugauaguucuggaaaauaaauggggauguugucccaguuagaguacauacagaagaaaacccuuccuauccucucugccuuuucaaaccaaggcaaccauuuauuccugguugucugcugcugggugguuuugcaugcucuucccaucucugcuguaugccucuuguacaggugcagguucuguguauuccguguuaaucuuuaccaguaaauacaccucacaagguuacuuucaguuuggcugaaggagaacugugcaguaaaaugcgaaggaaagcaaugacuuuauucaaugguuuuuuuuuucauuugaaacacuauuaacuuuuaaaauaauuucauagucccuuauacauaagccaaugaaauauucugaguucuaguuagaaaaaaaaaagcaugaauucuacaugauaaaucuaaacaacaaaaacacuuguaaguucuuuuauauguuucaugccuuauuuuccauuuuugacaccauaaagugcauuuucugucaacugugagcaaauuucccuuugccuuuaauaaacauagugcauuaaguagccaguugcugaaaaguuacaaagcaaguuagcuaaaggugggucauacuggacuacauucaaagaaccaagauacacaaaagaugcaaguuguauguguguggcuuagagugcaccugugcagaugcaugccgccuucaguagcugccaaaugugccuuuaauuaaaaacaucucuaauuuuuuuuuucuucaaaucaagucagcauuuggggacgugauuagggcaagggacuuggggguacaaauaucuggugaaaucaccagagaauuuguuugucaaagugacauguguaauuuuaguugagauaugucuguguauauaugcguauuugccuuuguuuaggagcacgguuauuugcugaaauaauuguuaaaaaaugcugucagucuuacuuugauguaaagaacaaaguguggucuguacaucuaauaaugaccuuuguaccuaaccauguuuguuggugaucuuuguauucugugugcagcaauauuugguuuguguuaaagugaaaauaauggcuguuauuuuucuggcauuacuaagauaaauugaaaaauaauaaagaaaaauaccuuauauagccuauaaguguguuauuuugcaagcauuauuuucgagggcaguacuuggaaguuguuagugauucuaguuuagcuuauauuugaccagguagguugaucuuuggguauacacaggaugacguuucagaggcagucacauuuccaaaacaaugagcuuaggcggugcacccagcuggggucguuugacaugaaagagcuuaagguuguaucuaaagaauuuuguaaauacagucacucaaaauguaucauaaaauaaauauauuaaauga

SEQ ID NO: 12245 - RNA, 57287 nt, Mus musculus
ccuugcugggagcugcggcucagcguuaaggccaagccggccagcgagggacgcggcccgggagcauccuccccccaccgcgcgcccuaagguggaacugcccggaggcgggcgucgggcccccagcuccgcgggcccuggagcgcucgggacucgcugaucgcgggcucggcggcaacaugucuguggcguucgcagccccgaggcagcggggcaagggcgaaaucacgcccgccgccauccagaaggugagccgggagaggcgccgggacgcgggccgaggcgggguggcgugggggcgggcugacgccggcuuuccgacggagcccuuuggcgccugcucugcccgcacaaaagcgcuggcaaccgccgcccgauuuccccgcgggccggguggccucgcgccgcggggccgugaaggaagcggccccgagacuccggcgucgccccgccgggaccccacgcgcggaagcccgacccgagagugcugcgccgcaaacuccucggaguugaggcccucuucggagaacuugagaaccuuccgcaaugucucggggcaggcgagaaaggagccggggggccuccggggcuccccggggucgcucccgggaucgcaccccggaucuguuccggucugcagcagauagaugcgccugagcgcgcagggcgggcgcugggguuccggagggcgagccugcucucgcuggccuagcgcuguuggccguccacagcgacaggcgggcgguuugcaugaagucacgaucgaagcgcugggagcuggguccucagagagugccacccagucgccgcuccggggcugccaacuggagacacaaagguucuuuauuauccucuaagccagugucuaaaagcaaggcacuauuuagcucucagcaugguagacuuuugaaagucgccuccuguuaaguuuagcaguuugccuugcccugaguauuucgaucuuguucccugccccggaguaagguuaaggggagcaagucaaccuguaguaccaaucggggcacccuugaagaccuguggguuacggccaucgguuucuguuuacugucagggucuuuguaguguggcauuugacauuugcccaacuguugcuuuauuuuucuuugaagaaacccgccuggcagugucuggaaacgcaguugguuucuuuagagugccagguugagccaguagucuggugaacagcuuucuuuaagcacacacgugcagaaagaauguuucuaagaggauucuuuuugaacucuagaaaaagucuggcgcuuuccuuuuucucaguagaguuuuuuuuucuuucuuucuuucuuuuuuuuuucuuucuauuaguugcuuaucgugagugauugaucuaggugcuaacugguuauauuucauucucagaugaaaagugaaaauggauuaaaauucuuuuguuauuuuauacgucuguguaugucaugugcaugcagugcuuggggaggucagaagaaacaucaguucccugaaauggaguuaauagccuccugugggggcuggaaaccacagccagguccuuagcaagagcauuaagugcucuuguccucugaaccaucucuccagccccccaaaagcauuacaauucaaguucuguuugcagugucagauguugguuuagacaggaggcagaugguugggguuguuucaugugucguggauuccuugguugaguauugaauugauggcacugccuucaggggcaggcagauuucugugagauugaggccagccugguccacagaguuaguuccagggcagccgacgcuacacccuaucuugauaacaacaacaaaaauaguaacaacaauaaaaaacaaaagaauuuuuuuguauauagugauuauauuuaagaggcacacuuuagaaaaguguuugcucuuagcaaucgaagauaaugauaaaugugccggaaauaccaauucaugguaauuggauuuuguuuuuaauugaaaaucacguuaaaugauuuuugguuuugucaugaaauuuugaaagguggggcaugcuuaggaugccccccuaaaucuuaagcuccuacaaacuuggauagugugcuagggacuccauguagguuuucuucuguagugccauuggcauagaugaauuacuuaauccucaaaaccaagguugcuuagauuguuauaagaugcuaaaaugauaaucuuaugguuuuuggacuuucugagauaucucaguuuauuuuacaaacuucuauuaauaauuacaugcauagagaugauugcuauguguccuuuuggagaaucaugaaucugcacaguuagaaaagaagcugagccauuaccucagggcccuugggcagcacugcuccuguguuuguuuccuucuggagaagagauuuccuccuucacacuagagcaugagaaugcuccaguagcaacugcgaguccacuuucaacuagcagaaacuacuguuacagauuggagagguaaugaaauguuucuguauuuaaaacaagacaccccaaaacaauggccuagaagaugguucagcuggguucagggagagagccagugcuacagaauugcccucugaccucacaccacagcacugagugugugugugugugugugugugugugugugugugugugagugagaugauuaauacacacugaugauaaauaagucaaaagaaacacccuuuuuccauucugaguuucaaagagaauaauugagauagguauuaaacagaauugauuaaaugugauaucauuccacauacacaaaguaagauuuuuuuucuuuuuugagauaguuucucugugaaguacugacuguccuugaacucacucuuguagaucaggcuggccuugaacucacggagaucugccugccucugccucccaagugcuaggauuaaaggugugugcuaccuuucaaccagcuuguaggauuuuuuuguguguguguugcaaguuaugagcaguauuuuaacagaagaccacagaagguucacuuucuauguagauacauuucuagaaagauucaaaauaugaaaaaucaguugucucagaauuaucuaugcaagucauauauagcauauuucauaagugauuauacauuuuaacagcaaaggaaaauuuuaaccaaguuaauucaaucucauguuucuuacaaugaauuuuaaaauauuuugucagagcaaguagaaacacuaucacaaaauaauucuaagugggugguguuuuccauguucaacuagaugguuuuauaaucugaaguggcuuugaggaaacaauguuucgcuucuuugcagugucguguucauggauaccuucucuuggcuucuugguuuugaauuuuacuggauauacagguuuauaaugaacucucuggcuuaguuuugaguuuuacucgauguacagguuuauaaugaacucucugguuuuaauuucagaugcuggaugaaaacaaccaucuuauucaguguauaauggacuaucagaacaaagggaaggccucggagugcucgcaguaagacagacaagcucuuggucuugggucuugugguuguuacuuguuacuuugucuuugaguuauuuauuucaaaaugugcauuucagucuuuuaaaauguacuuguagagucaugguacugucaccucaguugguuugagaacauuuuaaucaccccagagagaagcauauguuuauuggccaucauuggaagucuuucccaccgaccucuuacccuauaaccuacuuucuagugguauagguuugacuauugaaaaccuucuggauaaguggauuccccccuguuuuugaaauagggucuccugaagccaggcuggugucaggcuugugauccugccucugccucugccucucaggggugucugcacaucacauaaagggauguaugugccagacacccagcuccaguuggcuuuuccacacagcugacuggugcugacacgugcacuacugcuuccuuagaaagccaagugcucucccuguccuccugucauuugccauucauggcacuuugcugaacaugagacugaucuugacuuuuuuuacaaaugaaaauuccuuccugaugggagcuaucauguauacccaaauaaugaccgacagacacacacacacacacacacacagagagagagagagagagagagagagagagagagagaaagguauaaucuuagucuagugguguugugaccccacacaccuuuaaucucagcucuuggaagguacagacaggcagagcucuaagucugaggcuagccaggucugggacuucacugagaaacccugucuugaaaaaaaacaggcgggggggagggggggaagaaagaaaaggaaaucuucauguauguagugacuucagaaaauacugcuauucuagaaacccaguuaccauuaggaccaaacuucugaagugaucucucugaagugagugauaaacccuaguagaaucagaugggcaugaccggaaucccagcaucuuuaaggcaggagaauuauaaauucaaggccagccugagccacaucucaagauccugucuuuuuuuuuuuuuuuuuuuuuuuuuugagacaggguuucucuguguagcccuggcuguccuggaacucacuuuguagacuaggcuggccucaaacaagacccugucuuaaacaaacuaaaaauccacagaaacagaucaccagaagaaucugacucugaggcaucuugggcagcagugucuggcagauacagguaaagacgagacacguuuucuagcagaugccauagggaagaagugacaugcuuuacaaaauacugucacgucugugugaaaccaccaucacuuugagagaguugacgccccucucgguccugagcuguguguaguguuuugguuuuacugaguccagccacugacugcugcccggagagcacugcuuuacagccucucacucagccguggugugcccuuuccuagggcuccuguuggcucucgggagagagcgccagcaaccacuuggucagcuuuccaccuuuauuggucucuugcccuccagugauucacucuacaucugaauuucaggucucucuuuuaccucuaccuaaaguaaguuuugaaauaaaaaucuauguuuaauauuauaaaaauuuuauggcuaccucuuauuuuccauuaucuuauuuccuucuguauaaauuuaugucaauacacauauagauuaugauguucuaauguuuagagaaguaauuuuuuucuuuuuuucuuguuggccaaggaucaaauuuaggacgguguuucuguuuggcaagugccguccccauugagugauugccagaccuaggcugcaguucuuaaguaaucacuagggcagagaccaugcuaaauugccgaaccacucugccaaaaguuuccuugcuuuacuucaucccugucacggcauucacccaccacggccagcccuagauacagugacacaccuaguccaacaaggccacaccuccuaauugugccacucccugggccaagcauauacaaaccaucacgauauuaucccuuacugaaauucuuuagauguuaacagaucggcccaaucacuuuauuucauagacauuugagaaugauugcagguauggguuauguuuaguaacccagguuuucccuaaaguccggggugcacucuuacguugccugaguuuagacuauugaagugaugagugcaggacuguuggcugcacagcuuucaggguuucccaguuaguguguccucuccgcaucccagugugggucauauuugcauuuggugggugugcuuuaaccauaggccgcuccucagacuuaacguuucaccguguugacguuguugcagaaugcagcaauucugugguggacgccucaguuaaguccuaauuuauguuucugcauaaugaagugcccuauggccuuaguguaacuguccccacccuaguugaacaguagcagcuuguucuaguaucugugguagcuuugaugaauuaguuaagcugcugccugcuguuuucuucaccagauuuaccggcuaauguguaauucagaugcauaucacugggaaggcaccuugaagcacaccuuccucauuaugcuucaguguauucauuuuaguagccacuagugauucccccaccaugguuauuaccauuacaguugucaaaugaugccuagguccaucgcucguaaacccauuuggaguucuguugugaggucaucucucuccucucgcuuggcauuucaugccuuugcauuugaauggaguuguacauuccuucuguguucuuaaccuuaggugugacucugucaaauaccuuggguuuuuuuuuccccccuuggguuguucuagaucuggcuacuagaagcauuucugucugacuucuugauaucucucuuaaauuuuugaauauuuuauuuuccuguaccaugaaauguuuuauuuccucuuguacaaaucuggauucaucucuuucucuuaagaccagauugauggugguuuuauuugucuaaauauaugguugaaauauagaaaccaaaacauugauauuagauuaucuuguuuucuaaucacacacuuggcauuuuguaugaccacuuccauuuauauauuuuguuucuucacuacauuuuguugauauauauuugaaauuuuauuuuuauuuuuuauuuuuuuuuuuuuuuaaagauuuauuuauuuauuauauguaaguacacuguagcugucuucagacacuccagaagagggcgucagaucuuguuacggaugguugugagccaccaugugguugcugggauuugaacuccggaccuucggaagagcagucgggugcucuuacccacugagccaucucaccagcccagaaauuuuauuuuuaaaaaguaguggucuaauucugugguuuugucacggaugucaggggugaggucacucccugaagcacacaugcaugcacugccacagugauucuuuacuguguguguggcauuuaagaaccuggaguagaauagguuucacuucugugucugacccaguguuaauggcagcgaggugcucccacuguggcggauccuguaugguuuguauuggaagcuuugucaccugugugugugucaucugcccacucugccucuacacauggccuagacgucccagacgguccuccccugugcuugcugcugccggggcauagacugaccucagguggaggcuuacgguuugccuuuucucaugaguuuuugacucuguucuacauugacucaagcaaguuuugcugugucauuuaggacugcccuuaauucuugggagcuggaguuuuauguuuuucagguucuuguauucuuucacaauuucacacuuaucuguaaugugcucugaugggauucuccuccauuauacuguuaccccuccuaccaagcccuccuuccuacccagaccaugaggcuuucaucucucucucucucucucucucucucucucucucucucucucucucucucucucucucugucucucugucccugugugugugugucccuguguguguguguguguguguccgugucccuguguuucccugugugugugugucccuguguguguguccaugucccugugugugugugugugugugugugugucagugucccugugugucccucccguccgccucagagaagccugaucagcagucugagcugcaguuccugcuuugauggguuaccuuuguuuggacuguuaguuuguuuguuuuuguuuguuuguuuguuuuuguuuuguuuuguuuuguuuuguugguauucgcuguuuuccaaguuguugcugcagcuugugaauaaagaaaaaagcacucccugcucuccacacugaccggugcucuaugcuccugcuggggcugaaggggaaggaaagugcauagaagccuuggagaaggauguuucuacuggcucuugcugcaacccuaauuaaugcaguggaucccccaccccauugugaaagaaaacaugaacuugaaaaaaaauauucaccuccccuacacgcacacaaaagacgaauuuuagcuacaugucccacaucuguaaucccgucacacagaaggcugaggcaggaggauugccaugacuuccaggugagccuagagccuaugagagccugucuuaagaauagcaaaccuaacaaguccuuacuguuuuaaaacuguugauaguauuugcauuguaaaacaguuaggaagcaaauacauugaaaacaagacagugagcacccccuucccacagggcuucccaggagugaggcuuuguucuguaagucagggguugugcauaggcaauguucuuccugguuugcauacuugagccgguuacugcuuccuucuuuguaguuuggauguuuuucuaagucaauccagauuuugcuuuaaucagaagccccccaccccuuccccuuuuggguauuuuaggauggcuacaacuauuucagaguguuuuauaaauuuuaaugccaaaagauuguauuggucauuauuuaauggauucuuaguuuaaaccacugcucaccaaacuaacuuauccuacaaacugcaguuugaccauugaauaaaugugcuguauaaaaguuauuuuuaaaauuaagcuuucagauuaauuuuuuuaauuaauaaauuuaggacuguuuauucugccuuaugguagguaauucaucuucucuuuaguggugucuuuagggacugaugucucuuuuaguagugagcauagacauuuggaaguaucuguuagaacuuguuaggaccagacagucaucaaacauaagauuuuaauggaucucguagguggcuggcuuccagcuguucccauuaucaaauauaagaugugaugugauuggucaucuccuguuaguuauacauccauauuucuuguguuaacgcaguagugagaacagguacagugauguuuaaagaaaagaaaccauaaaggcaccaucagccaguuuugucaucguguggacauugcagagcacaccacacagacugagaaggcagccggacauugugggaacacuggggauacccacuccguccuugacuaaaacguagaggaccacacaccuguaaggacugcaguaacaaguguaaugauauuuauauuagaacaugaaaauuugcgggaaaauguuuuuauuuucuugcccauagucugaguucagauucuucaaguuuuuguuguuauuguuguugauuuauaaauuauaucuuaggugacuuacauguaaacucagaagagaaugagaaaaaaauaaaaguaaccagguuuuuguuaaucauuuuugagauuuguuuugucuuagcuuuuugaugaauauuacuuauuuuucuuacugcagucguacuccaaagagcaccugcuagccuaguuuauugauaucugccuauagucucaacacucuggaguuugaggcaagaggauuacuaauccagacaaaaaucugucuaaaauaaagugagauaaaauugcugcguuaaaggccaguuucuggcuuauguaguuaguucuggggccaaccugaaguaaauuaaggugucgcuucaacaaauaaacaaaacaauagaaaacuagaaaccacaaaucagcuugcauuugugaaccuucuuauguuaggaaaagaacuuagaggacuguguucucuguguuggauggguguuaauguucucguggggugguacucaggggugggccgauguacauugggauugaaguauguuuuugacaaaccagaugggugccuagacagaauagaaggacagaugcuauaaaauacugcucagaaaucuggagaaagguguaaagguuucuccuuaucuuuuccugaaacuucugaaaauuuaaaaucacuucaaaaguuagauuugauguugagaacauuuggguaaauagcuugaaaauuuaaccgaguuauggugugaguuaaagcuucaagagacuuuugaggccugcuuuaaccccuguuaggcagucagcuagcauguaccaugcaguaauuuucuaagggcuggucagccuaaguaagagguuuuguuauauugcacauagacagagucuucagguugggcaucuucaccugccaugguaguuggucauguuguuagacguguuaaucugccaugggguaguuagucucaagcucucacuugagaaucauacuaacguaagaaaacucagagaagaaagacuugaaaauguaggcuuugaaguuaguguguguguccuacuuaaaagugacugcgugguccugccagugggcucagcagguaaaagagcuuuuaccugcuagcuuuuacaucacuagacauggcuuuaguuugauccccaggacccaccuaguggagggagagaaguugugguccccauuacugcuccuaugaccauggauacaauuguuaaacauggguguuugagggcuggacaugguggcacauccuaacucccagcacucaggaggcagaggcuagaacuuaggcaaccuggccuccagacuacaaggugaguuccaggagagccagggcuauacagagaaacccugacucaaaaaagggguugggggaggcaguuugguuauuuuugucuucagugcaagagaguguuaaguuccaagaaagacaaguauggaguugugagacagucccaacugcugcuugcugucaguagucugcagaauugcaaagacagucauaagagcuccgcuugguccuuguuuacccaagagccuuauaaaaaggucuccuuucagauuugguguaugugaggagcgggacuacaagucuaaguuucuuagugaggaaccugugaucaguaaagaaccaagcuuuucuccucuuagaaacccugcgguuaguuguuuauaauagagaauuauuucaguuuggaucugaauuugaaugcuucauuuauuugaauacaauucuuuugacauacucauuuuaaauuuauagcuaguaucuauaauuaaugagucucagcuucugagacauggucuugcuauauucccaggcuaaccguguuuccgugccagcuucucaagugcuggggccacaggccuuugccaccaugccuggccugaggaaaaugaagucuuuaaacaguggaacguuuuuguguagacuuuaaauuuguauuuauguacugaaaccaaacaguaauuagaucacugccaauuuuugguuuuauaugaguuaacuuuaaaaaauuacaaagugacuuuaauuauuaagcaauguuacuaaaagccauuguucuagcuguauuuaaccauacagcccuagucuuaagaauuccaguuauaguuuuaaagugaauuguuaaugauuuuaaucuucugccauuuuauucaugucugcuguagcaguuuuuacguugauugauucccguuguguuggcaaagaugcccuuauagaagaaggguguaacguuggcuaaaaucagcugagacaacccagagagggagugugugaucauaccuuggcuucaaguuuuugguaaaaugcaaauggcacaggaguacuugggaggcagguggaucucugaguuugagcuugccuggucuauagagugaguuccaggccagucagggcuauauaaugagaccccaacaacacaaagaaagcaggagaaagugugggggcagugagcauaucucauugaauuccuguguucuaacucuuguaaaacccacugugcugugugucugccucuggaugugggauauugaucccuugaccagcuguggagucuugugcaacucagcacuguaaaccaugauuucucagugguagguaagcggagagacucauugccucagucaggguuuccauugcuucaaugaaacaccaugaccaaaaagcaacuuggagaggaaaggguuuauucagcuuacacuucuacauugcuguucaccaucaaaggaagucaggccgggaacucaagcgggcaggaaccuggagauaggaguugaugcaguggccaugggugggguggggugaggugggggugaggggguggggggaugcuguuuacuggcuugcuucccauggcuugcucagccuucgaucuuauaaaguccaggaccaccagaccauggauagcaccagccacaagagcucacuaauugagaaaaugccuuacagcugaaucucacggaggccuuuucucaacugagguuucuuccuugcugacucuagcuugugucagguugauacaaccagccagugcacauagaacaugcgugccuagcacauggugagauugcuccgcgcuccauuaccuuaaauguguugugugucaauuggaauuauuuugcagaggaaauaagaaaaguugaagugcuauugauacacagguaacaucuuucauuaagcucuaaaaauaauuauagugcuguuugcauuuaagcagguuggaagauuuuuuuuuaauauugguauuuguuuuauuuuaauagguaucagcagauauugcauacaaaccugguauaccuugcuacaauagcagacucuaaucaaaauaugcagucucucuuaccagcaguaaguaccuaugcaaccaugugggugaaugucucugcccccgugugaugucaccggguuuuguuucuugaaugcuguguuguguuacucgucugauuugcaugaauucuccccaaaugcucccuguugguuuauuuuaaauuacugaguaaguugcuaaugugccugggauauuucauuucaguguuaaccacuuccacccgaaucucuagcuaucaggacuguugaccuuacaacaauguaaaccagauugccagggucugaacagaaguuucucaacaaacuucugugugauugccucaaggccagacaagauccuggaguggcacuggcugcuuuaucugccaguuuaugcuuuuguagcuccaucuguuuguuggacaaacugagucacuugcugugcagccucuaucacacucuggauucugucuuguagaaucuguagcuauaacauguccuuccgucucaguggcacaaacuggugcguagguggagacucagcugggcuugagguuguucuagguuuccucuguugggucaagucaggaagauguguuuucaggauccgagauaccaaacuagucagcuauuacacucaagacucggccgggagcagcggcuuucaaggcguuuucuuuccuucuuguuuguuuggggacuaagacucagggaucaguuugaaugcuuggacauuguuacuacaagauuuuuauguuuacuaggcccuuuuaguugacagaacuagauuuuuuuuuuuuuuuuaaauacugagaucuaagaugguuuuaguuaucuuauugagaugagguccuccuggccgaggcuggcccggcauuugcuguguuuacuuuccuuugguugcuaaaggcaugcaccaacacgcucacuugagaaacuauuuuaccuggcuuugauuuugugguuaguaucuccugccuucauccacaagcuugaaguggaucaugugauaaagugugcacagaacuugugagccaugagagcaggacccuugaccuugacccagucugugggauacuuuugaauaugaaauaguuuguauggguauugcuguguacuucauugcccuugaguugauuuuugcaggcagugggugcauuuggcuugcuuccuccuguguggcugauucucucucaguaugcuuggaaauggccuuuuuuucaucuaguuucucaaguauugguguauguguggaccugugucuggccuuuguucuguuggucuuuguaaggaaauuccgugacgucaucaccccugaccacgcaguucuuccuucuuccccuccucaagggugauguuucuagauuucucacucugcuucauggacuuagugcuagguacuucauucagguguguguguguguguguguguguguguguacaugcaugugcaccacagcacucauggagaucagaggacagcccaguucuuucugccuuuuuagaguucuagacuugugcugcugagcaagcgccucugagcugagccgagucucuggucugucuuuguuuuucugugccuagcaucugcaugaugugcgugcaguaggguuugaaucuucgcuuccaggacauugucuuuagcuccuggcguuuugcucucuguauucccaguugugucauuuguuuguuccccgccaguccugacuccucuguucuuagaagagguagcacaggacaucgcugucugcucugaccucagagggagagauucaucugaccaguaugugugauguugacuguaguauucuguagaaaacuauaucgaaguaaaagucugcuuugguuucuggugugcuaacuaaagcguguauuucggaugaguugcacuuaacccagugaucagugcuuucuucuucaggcugucagugugguacuuuacagugguaaacugaccaauaacuccuaccuaagaaaggacuucacuuuccugagucugucucacuuggucacggccuuugucuuuuuguuuuuguuuuuugaggugggacaucuuauuguagcugagguugguguggaacuugcuguguagcccaggcuggccuugacuuccugcuuuugcuucugaggcgcugggauuacagguggaugugugagaacgcccagcuuggucacuguacacaauaccuguuguauuuggcuuuaucaggguuuuugcaucuuuguaagugaucucucuuuuuuuaauugauuguuacagacuucauaaaaugaaauggaauuuucuugcuuugucuuaugugaaagagugcugaaaugugacuuuaaaugguuggugugccucuguagaauaguaucuuccuuuaguuuccuuagcauuuuaaauuuauuuguauaaagcugaugaaauaauuuuuuaaauaauaacaauaggacuauuuguguguuugauuguuugagacaggguuucuguguguaucccugguuguccuggaacuugcauuuuagaguacacuggccuugaacucagccaucugcugcuucugccuccugaguacugggauuccagacaucacuccccagcuggaaucuuguuuaccauaauugacuuguauauuuucuugugacuuuucugucagucgugacagauauaggugaccuauuuuuaaaauauuuuaauuagucaauauuuggcuuugauuuuuuuuuuuuucuguauugaaggauuuuuuaaaagcuuuuuggacuagaaccccaucacacaugccaccaucaucgugauguuacuauugcaaauagguucucauguagucugggcuggccucaagcucacagugcacuuggguacaaggcaugcauaugguacacuguuguaggacaaacauuuuccagaggaggcacaauacucacccagauaggagacuaugacagcaaaguuuuaaguaccaccaaaggcuggcuugguaagccagugaguuuuauugagguuucuuacaggagcagaacugacuggaagacaguugcaucaccaaagcccaccccagcaugggcgacagcucacagagcuggggaccuggagcucacugcacagcuggcaggcagcuugcguaguccauugucgagaguguuguuuccaugugacccgguagacagucauuugcuagccacaugaaagcacaugcugaucuuaaaagaaggcugcuggcagucaccugucuugcuuuucacuuuuuucaaguuuuaaauaguacaacuucaccacuuagauagaguccuuaaauuucccuuuauuaaggguagcuguugaaaugacuuguaugcaaagacugaaaggcuggucucugaguaaaauugauuucgaguacauaguccuguauuuuagacaaaacuuucacuuucuggcuucugguuuuuaggugauguuacauuuaagauccugaaaagcccuugggugauaacgaauggcuuuucuuuuuuucuaaaagcuuuaguaaaguugaguuuuaguuuguaaguucacugagugcucuaacagagcaucauuuaaggcccuucaugucagaaauuuaauauagcuauuuuuuucuuuuuuauuggauauuuucuuuauuuacauuucaaauguuauccuuuuucccgguuuccccgucuccuggaaacccccaucccuuucuucucccccugcuucugugaggguguuccuccacccacucacccacucccaccucccaccuccccgcucuugauuccccuaacaggggcagcuauugaaccuucauaggaccaagaacuuuuccucccauugaugccugacaaggccauccucuccuacauaagcagcuggagccauguguacuccuugguugguggcuuaguccugggaguucugggguucuggggggguacugguugguugauauuguuguucuuccuaugagguugcaaaccucuucaacuccuucaguccuuucucuaacuccuguauuggggaccccgugcucaguccacugguuggcugugagcauccaccucuguauuuguaaaacacuggcagagcuucucaggagaaagcuauaucaggcuccugucaucaugcacuucuuggcauccacaauagugucuggguuuggugacuguuuaugggauggauccucagguggagcagucucuggauggccuuuccuucagucucugcucuacacuuugucuccauauuugcucuugugaguauuuuguucuccuucuaagaaggacugaagcauucacacuuuugucuuccuucuucucgagcaucauguggucuaugaauuguaucuuggguauuccaagcuuuugggcucauuuccacuuaucaaugagugcauacccuguguauucuuauacgagugaguugccucacucaggaugauauuuucuagauccauccauuugccugcaaauuucaugaauucaucccuuuuaauaccugaguaguacuccauuguguaaauaccacauuuucuguauccauuccucuguugagggacaucuggauucuuuccagcuucuggcuauuauaaauaaggcugcuaugaacauaguggagcaugugcccuuauuaccgguuggaacaucuucuggguauaugcccaggagauguauuacaggauccuccaguaguacuauguccaauuuccugaggaacugcuaaacugauuuccagagugguugugccagcuugcaauuaauguagcuauuuuuauaaguacaauaaguaaaguaaaagaacgugcaguaucguagcgcauucugaacauuucaguguguguguugccaugucacaugaagauugcaguguguguguguugccaugucacaugaagauugcaguguguguguuaccguguuacaugaagauugcaguguugugugucuguuggcaugucacaugaagauugcaguguguguguugccauguuacaugaagauugcaguguugugugucuguuggcaugucacaugacgauugcagugugugaguugcuuugucacaccuauugaucuucucauucccucugcuguugugaagugaauccagggucaauacucugauguuucaccugcgcuugcuuuugugucugucuguguguguuugugugcacguguguaugugccagggugugugugagacggucaggacaaccuuggguguaaguucucuaggcugucuagccugugaguuucugggguucucccaucucugccucacagcuccccaugggauggaccgaugcuuaugcuauguauccggcucucaugugaguucucuucuagcauggcagucuuuauuuggccuugccuuuccacaccaucucuaccuuguuuaauuuggcauuuaaaugaaaggcuuaaacacauucuugucugaaguuauggaacagagcccuaaguaugaauauuaagucaugucaucugucgacaaaauacuauuuuuccugacauacuuauucuuugacuuccuaauuucucuauuuaaauuauguguguuaucgguguaugcauguguaagaacuggugcccauggaguccacagggggaguuggauugccuaacacgaguguggaagcugaacgugggcucucuucaggaacaguagccuuaaccacugagccaucucuucugcucacuccuguuaguuuuuaaucuuaccuucuucgagugcucagcucauggcaugaccguacauccguucucuuguuucuucucagugcacacaguucuucagggaggguuccuuuaugcuucuacuuaacugugcucuuuaauuucucucuagaaauagacggauuccaaauaaggaguuucuugccugagugugagacagcacucuagcuuccauuagacacgaccauuugcauauucaacaggccuuucagcaguaugacaaaaacaaacaagaaccuugugacuguugugugacagacuuccuggggagacauggcgcacacaucccuucaccccuagaaagguagcccauggcagaccaaaguauggcugugguaaacuaguguuuuauugggguuacuuaugggaauauggguggaugggguuccuugcgggagcagaaacgacucagaauaccuggaucacuaaagcccaccccagcgugggugacagcucacaaagcuggggaaccuggggcucacucucgccggcagacagccccacaggucggagagcuuccuuuccaggugcucaguuguucugaguucuugugagcagcucaccugguuuuuguuuuguuuuguucuuuaauggagcuggcuguguucugcucuguucaggccgcugcuuuauccuuccaguucugugugcugucucagucuuccguacagcuguuuugggacggacucuuccuagucuucacugcgcauaaauucuuggggagggcuguguauuagauucaguacagauuaaaacaucaguaugugccugaucuucugggcgaggguuuuuguuuuguuuguuagcauaaaaaagaaacacuagaaagauugauuuuauucuuucaaaaauguaaaacaaagaauuuuacaugccuuaaauguuuauagccaaauggcuuaaauguguauuugauauagaacaauauguacuauuuuagaaauacugcguguauuaaaaauacauuuuaagcagcagaugagauuacuagcuuugcucaauuagggacagcucugcaaggaaguuguucugugucugugggcacugaucucucuguucacgugcucgaaaugcuaaugucacaggcagcauucuaccaacaggcugcugauuugucacaucuauuuaagaucuauaugaugccgccuggacuuuuaucuauuaaauucagaagccuguacaauugaaccuagauauucuuugcauauuggcuguacauuucugugaauaguguguguguguguguguguguguugucagcauagguauaaaauauagucaaaguaccucuaauggaaccuaaagauuauccuuuugacuuuaauuggaaauacuauuucaguauuccaguaguaagaaauuaauaaccuucuguuuuguuuuuuaauugaaugcaugugugcuguguguguucacauguaugugcuuguuguguguggaggccagagguugacgucuggcauuuuccccaguugcucuaggugguacuuuuuguggcgggugucuuacauagccugguccucccugguuuccuuaggcuccucggcagccagccccagggaccuugugggucugccaccacucacuuucuccucccaagguuugcaugcgugcugagaucaggagucagguguucauguucgugugacacgcacauuacgcacugaaucggcuccagccccagccccucuuaacauuuggacaaguacacaaaagucuucguagaaagcugucuacugaagcauugcuuauauaaauaaaaccaacaaacagaagcaagggucaguauugaggaugacuucaacaaauacauacaacuguuuaguagaguuuuacucuugaauaaaguuaauuuguauaauaauaaagaauaauguguauagaauuuuuaaaacuacagaaugguucuacccugcuuucaaauauucaacaaauauuuauuuaagucuguuuuguuucaauaaauguauaugcuaagcuuuuagauuuccuaauuguauuuguauaucacgcuuauaaaugcaucacuuuuguaauauaaacaaauugauagauguaaaaauaauauaaagaaugaauauaguugugcuaguuauuuuuguugcuauggacagaauacccaaacaaacaccuuacggauuaaagauuugcucuggccacaagcuuucagaaagcggcguguaauggccaccuagccccacugcuuuccagcagucuagaaugaacaugguggaggauggcccuggaaagaagugcuucaccuccuggcaaucgggaaaccaagagaauuaacagggaggaaacugggccaagguagacccuucacaggccuggaccaagugaccagcuccuuccagcuccuucccauggucccuugcuucagugcuuccaacaguccacucaaaauguaaaccuguggacgaaucaguggauuaaaguugguaggucagaaacuccgugaugugauaguuucaggaaggaauuccagagacacccaaagggugguuugcauuuuccugggcuccccucgagcagucagguugaccuucggggcuaacugccucacaugcucucuuucauuuccuuaacgugugguauaccuguagcuugcuggugagcauuugauggucucauauuuacaaggccacgaguuagauucuagcauuugcauauaaaaccauauacauccuuaaguacuugggccuggagaggugaagcaguaguaagaaagcuugcuguguaagcauggggccuuagugacuuuucuauugcugugauaagacaccaugaccaaggcaacucauaaaagaguuuauugggcuagaguccauggucgggagcauggcggcuggcaggcaggcacuggaacaguagcugagaacucacagcagagaaaacuaguugggguggcauggacuugggaugccuaaagcucgccccagugacacaccuccuccaggaagguccuaccuaauuauucuccaacugcucaccaacuggaacaaagauucaauguauagguuugcuuucuuacuuaaaauuaagugauggugguaccuguuacuccaauacuugcgaggcucacuuaggagaagccuagguucugugacaaccuggccuacaauaguagacccaauuucaguuuaacggacugagaauggcuguucaguaaugaguauguuggaguuggauaaacucagguugucaauuuguuauguaggaaauacuugcucucaugaaugagaaagugugaguugauugagaaccugguacuaaaucuggcgaguauccagguaguggacuaagcccgaagcaccccugcccccacugagacuugagccccagggagucuggagaaugcccccuaacaaauagaagugggagcauuagcuauggauauggaaggucacccagucaggucuugugguuagcacugagguuuuuugaacuagcuuucuagcccagggguuaagaugaaucaguuuugagaauuaauuggggacaccuaacuccugcagaaauucaauacgggucaugucaugauggcaugcauccugagauuucuuuuuuuuuuuuuuaauuagguauuuuccucguuuacauuuccaaugcuaucccaaaagucccccauacccaccuccccaauccccuacccacccacucccccgcauccugagauuucugugagaaugaauuaccaggagaggagaccuuccuaagcuguuugaggucgauguguguggguauaugauauauaaugaauaugugugcgcacaugugcauauucaucacgugugugcugugugugcauuuaccuuugagagacugaauuagggcuggaagguaaggugagcaaacaugcccccguaaggcugcgggccccggugaggcugcgggccccggugaggcugcgggccccggugaggcugcgggcccccguaaggcugcgggccccggugaggcugcgggccuccgugcaugaccagcuaaggcucuuguuuguguagcuuuuaccagcuuuaggcauguuaaguguacaugucuccuuuuuuugguuuugauucuuagguuucucugucauuuuagugccuccuugugggagcuuuauuaaugccaguuauacuacaacugaggaagcuaaggauuuuguuuguaguucuguguuuguagucuaaaagagauauugaaaguaauuugauauaaugauguauagcuuuauggaaaacuaugaaauuuuugagcucauuaguuaauugaaaauauauuguuuauaauaugucuggcuguagcaaguagugcuuuugaagugucagugaacaaaacagccagaaauucccacucucuagggucugucuuccaucaggcaaggcaggcgcaguaaaagauccuugcggguguugaaaaguggugggcuguggcaaggaaaggcagagagcaggagagguguacuuggguacuggggguugcaggaugguauaugcauagucaaagagcugcacaucuuugagaaggggaccugggaacagaguaaggaggcacgucuacagaggauugcuucgaggacuauucuuaggaccuggguuucucuucugaaaguugagaaguuguucuaacgggacccugugcagacucaggaggcagcuguuaaaccagagauguggcaguagccauacccggauagaaguccaggagguguagacguggguacaucccagguuagaauagaggccagcggggaugagagaggcguugggguggccucgccauuuucaggguagaacuggcuucaugagacuugagcaugggaguugaugaggccuuugcaucuguggcauuuccaggagaggugaagggacggugcagguaggaggagggcugguguaagugugcugugagcaugcucagagcccuagcagggcucugcucagugaaaggccuagaaucuaggcuucauaaucauuucucaaauauuuaucaaguugauacuggaugacuggaagccccgacaguuagcgaguaauacagugguggcucucaccccuauuuaagcuacugccgaguagaauugacagacagugagcacugacaugggaauuagaagggagcuaagcaguggaacggagagguuccugggaguagacaguguggccaguuauucucaugccgggaaagggagcagguaaaguguccuuuuacaugucauucauacacaguaacgccaucccuugaaggguauaggugacuuuacuacucgucagaacaaugcucucauccccagaguuucuagugucccauucuuggcuaguuucuaauucuuugaccuuuuuguaauugacuguaggaguuuuaaaaauaagaacugaaccaaugcugggcuucaaacccaggacccuauaagucuuuguuaucuguguuucucuuacaugcacuuauuacacuuugaaauuugccauggucugcuugaaacaucauugcaugaauaguucugauguaaauguuucucuuccuguaucaagguuaugaagguaugccugcauuuccuucauuuauucaacaggugggggauguggcuuaguggcagcugaccagcacgcaugagguccuaggucgaguuucugguagggacaaaaaggaagguuuauccacagaucacauccaucagcaccacuuacuggaaaguguuaacugcccacugacugucaccugcgggucucuuccuguacgcgugaguucuccauuacagccaacaucuaggcucuuguucugguuugcuugucugucuuugcaccaagcacaugcuuuuauuauuguaguuagccuuccuguuugcuaguaauuguucuuaagauugcccuggauacuccaaaucuuucacguguccauauagauguuagacuuucugggacaaguguuucaugucaccuguagguugaaacccauuauccuuaagcauugagcgaagguggcacauccuuccgugacaggcuucuuucccaacaguguucccuucagauagcgcacaucucuucucgagauaagugccgccgucagguggcagauuagccggugacggauucacgcacucuguaugugugcucugucugcauccaugaggaagcagugaugcgcgucccuuccccaguuuguuguuguuuuuuuuuuucuauuuugcuucugacauuaauuugcuaguugguuuauuuuacuaucaguguuagguaaauauuuuugucuaucucuuaaacugugggggcaagagugcuuucaccaauaugauaguguuguaaaguuuuguuaaguuuuauuugguugugaaugguuauuuuauauguaagugggagcuguggggccguggugugcugugggaucggaggacacuggggguggcucucuccuucuaacuuaaauggcuucuuggggucacucucuggucgucagacuuguauuuuggggcucaagcccccuuagcugccgagccaccuggccaggucaacuccuguucuuaauugcuguuauguagacguauuaaguuuaucagagccuucucuucaugagagcucuguagacuucacucugauucgcugcacugugucauuuucacaggucaugcccugacccucaucccuggagugacauugcuuauguuacucuggacuugauuugccucuguuuuugugcagugguuuuagugucugaaaacauguccuguagccuuucuuccugaaguaucuuugucaaggaguaaugggcucauaaagaauugguaccugcucuccuuauuuucgauuucugaaagguuacauaugaauuucuauuuuuuucuuuuuauuuauuccuaagugacuuagacauaaaacuacaauaaaagcucaugaggagauuucuucaggaaagguuuaaaucguggauggugguuuuugcuuugcuuugguuugcuuuguuuuguuuugguuuugguuuugguuuugguuuuucaagacagaguuucacugugcagcccuggcuaugcuacagcuagcucuguagaccaggcgggcugaacucagagaucuggaucaagagugccuggaaaaaaagaaaaaaguucuuuucuuuuuuuaacagagaaauuuuuacauuugccucccuccuuucuuccuuucuuggugcugggacagcccagggcuugccuuguguuaguugcccuagugcacacguguaaaacuggagccaugucauggccucuucugugcagccuuucuccuuugcugaccuucaggcaucccuaugacuguguuucuguguggccaaauaguaccccacuuuaugaucguccauuguuuguuuaucacuuggggguucuucugagggacucccugagugagugcuuuaucuacacauugugccaagacuguguguguucagcccuggaauauguacaggaguuggaguuaccagauuuaguguuaccuccguguuaagcuuguugaguggugacgacauuugccauggcgccuguauccucagcaggacguguggguuucuguccgucuaguuuuuacugugauaguguuacagccauccugcugcuguuggacauuacuuccuguuuuuccuagugcccugugguuuuaaccgaacgucagacguuguggcuaagcaaaagcaguacacaucgguguuguuuucuuccaaagggagccauuugccuuugguguugaaauacccagagauuaccuuaaguugagugaggcucagguuagacuugcuaaggcugaucuauuaaguaugacgcuagucucagaggagauugugaccucuccagcgagcucgagcuucaugagaaccccugugacuuugggccugccccagcagucagucaccuuccagccaucugcgucacugucaccuccuggcuacuguuucccugcuucacguggaucuucugaacuuuuauucuuaaauuuucuuuuuuucugguugucagagauuccaaagaacucuagcuuucuacugggcucaaccucugagcucaacacagucaaagaaaaguccaaggucuagcguauggucuugcauuuauuugaccccucuuucugaaaggguagcuuucaauucauucucccaaacuugcuuuguagagccuucagauugugucuuguuuuguuugcucauuuguguuucccagcacuuauuagcucucauuagcaggagaguuuguuuguuauaccuuguaaugaugauagugauucgagaugaauuggagauugaauuacaaucagauuggaauugagguauguaauuaaaagugagauguaugauuuggugguuuuuuucuuuuuaaaucagaacuaaauuguugucuauaaagguagacaaagaccugaagaugagauuuaaaaauucuaaagguuagugauuuacuggauuugcuaauaaagagguuaaagguuguaauuuuuuuucuacgugcuguuggcugaagaacagugugucugucuucugugugcugcuguauucacaucuggaaagcuacauaguaacuauaggugguaaaugugaggaacugcuggacuggacauuaccauaaggucuggaaggaaagggcagggcagauagauguguggauuauaacugaguacauacgugugugcgcgcguguguguauuuauuuauauauaugcauauaugugccuucaggcugaaaugaggauuuagagagaaacuaaccagcuauuuuccuuuucccccauaagaagggagacagguguugaagguguguuugugugcaggcacaugcaugcgcauguguguauguguauguaugugugugcgugcacucucaugugcauguccuuucacucuuuugugaacucucagguuucgugaguauuuucauuaggauugucaaaguuuagaggccccuguuuagaggcuaccuguaacauucccacccuguaguagugacuagcacagagcuauugagccaagcugccagcuccuauuuaaagcauucucccagucccggaacuuacccucuugacagaguucucugagacuucuuguuccuuugauguauuuugcugcuuuuaucuccuuugcagguaaaaaucuacuauuaguaaacaucuagauaucuucauaaggaaaggacacuuuguuuuuuaaauguaacuuaaauaacaacaauagacacauuagagaucauaaauaaaguuuguauagccuguuagaaaauuucuuucccugugagauuuuauaaguuaaaacacacuuuaacuguagucugcuuuccaaggcacugaaguuaugagggauauuaaauaugauauuaauaaaugcaucauugaaaugcaucggaagacacugaaauggauuuauuguuuuguuuauauccaguuuaguaauauagacagcagugauucuauaugaaucuuucauacauuauucugccguuccucuuguuugacuaagcugucuucuuucagccgcccacacagacuaugccaauggguccuggagggaugagucagaguggcccuccacccccuccccgcucucacaacaugccuucagauggaauggugggugggggcccuccugcaccacacaugcagaaccagaugaacggccagaugccugguaaguuuuucuccucuaagacauuaacaccagaguugcuuagcaacuggaacgacaugggggcuccggggauacuagauuguugaugacaaaacugcuuugaaugcccccgaguacaggcucgcuucgaguuuguuagcuacagagcgacgugaccuguauucaguguuuaucaggcugcccuugggcuuugauguagcugacacacggcauuccucugaugaacagaacuggcuaaauuuagucugucugaaacuaugcaauacagucggcuuuagaagcuuuuggggggaaagggauugugccauugcuuaagaauuaaaaccuguucaugaaaaguaccauaauguuuauuuaccugaaaauacauugaucucagaaguagggacacugcaaaaccacauggggacaggaacagaauugccccugaagugccuaggguauuuaguauuuccuugcagauauuccugaagccaaaucaagauuguuauuaguacauauguuuauagguuauggcuaaucugaaguugaauuagaagcaguauuaaaagcagaaggcuaauguaagcuuucuuaacaccgaguccuucccuuuaccugccuggcgguaacagcagaacacugaccugcucaggccauuggguguuuaucugguuaccuuuaaaacuauuguuuuuuauaauagauaguccauagcauagguuuugauaaaguguacucuuccuuuaauaugaucauauuuuuacguucuggggccaaagauuauuuucauuagccagaaagcaaagagcacuguucaauuaccaauagaguaaauuaacauagcagaaccauuuuauuauuagccugauaauugaaauguccagcauagucucuuacuuggcuggcugugccuuugguugcauugguguccaaggaggacggacauacuaaaagaauccaagggagagcacugagccacgagauaagguaggcugcuuuagaagaucggugugcagcugcuaaugcuggcgguaaaugguguuucugucacucaucuguuuccugcuaagguucgcacaggauggagggaugagucagaguggccccacacagcauggagagagggguauacacagacuacguuuuagguuccgguuaggcuguaguagagggaaaguugcuugccaaguucaugucuggcucuuaggacagcagcuuuagaacugggacacugugagguugugugguuuagaacauuagccugcucuccagauuacagugaggccuaagaccaacgagaccucugagaaucaaauaaguacuuuuaacuugacauacugguucaccuauaaagcauuauguaauagagauauguucuuuuuauuaaaaguguuaaaugcugcuucuuauguauguggcuguguccggaagucagggagguuucggggucucuguccgucuuguuccuacuguagcugugugcucaggccugcuggaaaacugcuuuuuccugcuaagccaccucucacacccuaagauuaaagagcgaagauuaucaacuaaugaggagauugucugcacuacugcagagcuucuaaagcaaucucuaaauacccauuacugucuuaaaaguacagaguuuacucuuugguguaagagaauuuggaaggccaauagcauauauuuccuuccaugaguuuaauuuccuagcauaguuuuuguaguucauuuauaucaccuugauuuuagugucacuuacaucauuugaucuuggcuaaaaaaaucaaucacagcuuuuuuuucccuuugaauuaaauuuaucaaaaagaaauuuaucauuacugguuuguuuuuuguuaagccuagaagguaaaucuccgugcccguggaaccaaaaucaaagacauagaaguccgucccucaaccccuugccucuccaaaugcuugggucugggucuggggagaaagaaaaggggcucguguagauuuugguuuccucccucccucccucccucccucccucccucccucccucccucccuccuucccucccuccgucccucccuccuucccucccuccgucccuccuucccucccuccgucccuccuucccucccucccucccucugucccuuuuuuccuuccucccuaaaggaaacacccuuuacauaagcucuuccuucagugucuggagaacugucucauucucuugguggccaugcugcauccuuuuuuuuuuuaaauaaaaauguuuucccuguguuugucugucugucugucuggacuguguguguguggugcccggggaagccaggaaaggguguaggaucccuugggacuuuaguuaccaacagucaugagucgugguggguucugggaaucaaacccaguguuccgggaggagccgccucuccagucucacauccuucuugguggaugucucuagucuauaugccauuuccuggugacagaaaugaagcuuaaagucuuuugguaugccuaugcacaugcauauauuuuugcauccauacaucuguguaccccaaaacuuuguaccuguauguuccuagaaguuaaaguguuggauccuaacuacauuuuaagcuagguguaguggugcgugccuguacucccaacaccugagguggaggcucaggaguccauacucacccuuuacugcauugugacuuugaggccagucugcuacagaauauuugugucaucaaaccaaaccaaaaccaggacauuuuaaaauuugccugucauugcaaauuguuucauaugaaacaguacuugcuuagauuugcauuccuucagcuguguaugaaagugauucuucauaaugugcugggucagagguuugaggcagggucccccugaaccuaggccucacugacugggcuagacuagcugaccagcaagcccagggacuacaggagugugcugucucccccugcauuuuacauacaucccagugagccaaacccagccccucaugccucaugguuagcacuuuaccaauugagccagguccucaacuucuacuuuagguuuuucuguuauguucaaacuugcuuuuauggaguuaagugcauccaucuaacauggcucugagcuuccaagcguacucaaggccuucccuuuccagcauuguuuccaaaguccucaugcuugaaguuaguuuuuaugcuuuguuuuucuuuuaauauuuaauucuucacuaauuaauuaguuaauuaauuuguucacuuuaucccaauauccaguccccuucuucucccagucucccccucucuccuucccuucucuggggaggggaguuuuuuauacauaugaaauuaguuguagggaaggaaugagguagggaccuuacuggaugcuuuuuccagcuguccccgcccucuccgagaacucucugucuguggcccauagauauaaaugcuaccguuauuguuuacuucuaacuauuuuauguauuuggcauauuuuuacacucugugcuucagugaccuguugauucaguugcuugugucugcuacuacuucacaguacugcucugugagucuucgcuguccuagcaagcuugggucccuuccuguuccaccaucaguuuccucaucacuaaccugggaaacugacaacauguaccugaucagaguuaguucccauuuaagcuguuugcuuauuuccuguugauuaauuacucaguuuguugcuuagacuguuaguuccguaaugaaaaacagacuuguaccaugcaccuccguaacucuguccauucugaccauuucucuuugaagggccuaaccauaugccaaugcagggaccuggacccagucagcucagcaugacaaacagcuccaugaauaugccuucaaguagccauggcuccaugggagguuacaaccauucugugccgucaucccagagcaugcccgugcagaaccagaugacaaugagucaggggcagccaaugggaaacuauggucccagaccaaacaugaauaugcaaccaaaucaagguaacuguccacagcacuccugucccucucuuccccagcuccagcuccuucacaccccugcucccgacucaggaucgcuuucuucuuauuauugggggguagcccacggguagcucaucacucagguguagggauuccuugugggaucuucucugugcauauugccauuucaccuggcauugucaugcugcuccuguuuaggcaacuguuuuuuguuucuguuuuuguuuuaaagauuuauuuauuguuauauguaaguacacuguagcugucuucagacgcacccaaagagggccucggaucucauugcggaugguugugagccaccaugugguugcugggauuugaacaggcucuuaccggcugagccaucucaccagccccuuaggcaacuguuuuacugagguuucauagguacguuuucccugugugucuaguagacacuguccgucaccagcuacccuaggugucuggcucuuacagccaagcugguaugaagggggggcuucuuaagacacguuucuacucuguagcugaggcuggcccacacuuggggaaguucugccucagcgucuccauugcugcgauagcaaggggaagcccagaacugaacguuuauguuuuccuugagucgaaugucuauuuguuuuggucauuugaggcagccucugucuuaagugucaacugagucacagcugugcacaugagagacaacguugaguugaagcugccccgagucuuuuuguguuuguaaauuaaauugcacuugguuugccuuuugcaccuuuuauuugggguucuguguuggauuguuucuuaaugcuggccacuggguaaguuaccuaagcaagcgggcacaccaucugcccucacaagcaagcucgccagccuuguucucuuucacuugcuggggaacuucugguaacuccagauggcuuuucugguguuugaggcagggaaggguuugccuuccaguguuuagugggggugccucugcaccccuagcuagcuacuuagcauggagugcacuacaguuuauuaguagcauagugaaguuguuaccaugguucucuuuuaaguaaauaauaucuaaaagccgguaaguggcgcucuguucugcuaauugcuuuguuuaagcauuuggcacguuaccaccguaaaacuaucucacuauaaaauguagugagccucaaauuugauugauacaaaaaaaaaaaaucagaucacucagaggaaguuggcuuguguuaaaauuauuuaugaucaaauauuauaauuucaaaauacaaguacaguuauguaauuuggauuagaggugcucaccuuaccugggacccauugaaucagaagcugauuugacaaaugaaagucacauuaaaaaauuguuuuguuuguucaucauaaaaccuuuuuuagauaguuuuuauaacaguaagccauauuuaaauauuuucccuguguagacggcagagaucauagcacacggcauugcagguggccccuuuuuaggaagcuuaaaaaguucuaaagaugaaagggaacuguuuuugcauuuucaccucuuaaaaauuucuuucaggaccaaaaguucaguccuugguacugccccgccccaagucucagauuuaauaaagguuucuuuaaugcuuuuguuugcauuguaaauggcaaaaauccuuggacgggccucauauuuuaacauuuaucucuguauuaagaaacacugaaaaaaauacuuaaaaguaguuguauuguuuucuacugggggcuguuuuuuguuguuguuguuaauguuuuccugcauggaugccugugcacauguguaugucugcuaccuuuggaggucagaagggggcauccccaggaauagaguuaguggacgauugugggucaccauguugaugcugggagccaaacccaguuccucuguaagaacaagugcucguaaccacugagccaccuuuccagccccuaguuguucauuucgagauacaguuugguuguguaaccuaguuggccuuccucagccugguuaauucugggaugacagucaugugccaccauuuuuuuuauuaacagggcuuuugagucauggaaacuaaauauucuaggaaugugaaauucuaagaugcagcuuaugguuaguagucaggagcguagcucacugguaggaugagcucucagugcguucaacaccguggguuugagaaaagggacgaaggaaggguuugucaagugacccaucacaauugaaaaaaauaacagcuucgaguucuguggcaauuaacuagugcauuguaucauuugcuaauguguuuguauuccugcauaaugguacuuuuauaaacugacuguuuauguuauaguuuucucuucuugcuggggauguacccacaaguacacaccuaccacacaagugcacaccuaccacacaaguauucuaccagcgagcuacaccucucaccuacccgcaaccccagaacggcaguagguuccuaacaggaacacugcagggagagucuaaaugcauucauucugguaguguuuaaacucauuucccuccacucacuuguaaauugaaagaauucugccgccccuucucaucuuucuacuuugaaugugauauuaaagggaaaaaauacucuccaauuucuuuuauuguaauuuuacuuauucauaugaaauaaaucuaacguguagaaauuuuacucacuuuuaucuuuuagguuguuuaagaaguagagagugaguuuguuagcuuacaccacuggggcugauguagucaggccaugcaguagagugaggcagaguggucggauguggaauccuuggacuuuaaggugcuggguuccauuacgcuauuuccauguauguguuuccuuacgccuuuucuagcuuguccaccugccugccugugcccagaucgccccuuuagcuccugcucaacacguacucuaguccucucccuuacagcagcuccagcucccucgcaugcuccccuugcuagugggccucaccaguaaaaacuggcuuuagcuuuugaguaguuugugagaaaguuugaaaguuagaaagauaguaacacauuguugauacuuaccuggcaggggagauaccaugaucacgaaggugguuuucccagggcgaggcuuauccauugcacuccggaugugcugaccccugcgauuuccccaaaugcgggaaacucgacugcauaauuugugguagugggggacugcguucgugcucuccccuguuaaaaaaaaaaaaaaagaaagaaagaaaagaaaagaaacuuguuaaaauacaccacagcaucugccucaguguuagcugcagaggcugagcagcucacuacagccugggaguaugaaccagccugagcaagacucuguaaaacaaauugaccccguuauauuuacuaguuauacuuuuguauauuuguguuauugaaaugcauauuagcagcaguuggcuuuuaaacagguuauaugugguaguauccauauauaugugauaguaucuaagugccucuauauaugugauaguauccauccauggacaugggauaguauccauuggauaugugauggcacugugauugguaucuacucucaguuuguugaguauugcucaucuagaaguugagaaaguagauuuuuuuucaacucaguuauuaaacuauaauuuuagcaaaauacucuccucugugcugucuucgagcaaauuuuaguauugaacuuguggcacaccacagucuaaguauaagacaucucaguaucugccuccccgucuuaauucagucuuguccaggugagggucuuccgucgucccuuggagccuuuacgguuagagccgugugcccguguauacaccugcauggagcgaggugcgguagaacugaaagccaaagaggccggaagaggggcuucucuguucacagccugaucccugaugcacagcagacugcuuggggucaugcacgucuguuuccuuaaugacuaggaauuggaacuaaaugucaugucauaaucuggaaagauguuuaaucaagcaaaaacccacaaaugagaacagaaaagccucuggaaauggcccacaguuguauuugcuagaagcaguguauuauucauucacaaacauuaaguguagcucgcuuuacuuaacagaaaugaaacgucagcuguaaagaguuccacaauuguuuugcguuaagaaugugcuucaagagcucuaugaacguaagucuuaggacuuagauuuaagcuucgagcuuggggcuuuugauaaauugauucaaauucuuaaagauuaagugaaguaggccagugugacugcgugguggcuacacaccccggagagccugagcuugacucuaaugugcuugugguaaaaggggaaaacuaacuccuggaagucguccuuugaaggcuggagagaugguccaguggguaaggcuggagagaugguccaguggguaagaggaccuggguucaauucccagcacccacgugauggcuuacaaccauccagaauucuaguuccaaggagacugaugcauacauacuuaggugcagacaaaacacaaauauguaauuauguuacaauuuuaaaaaguaacagcugacagauuacaauaccacagagaaggacacugguuuccuaauguguuacagcagaaggaucuucugacccgcccaccccacacuauuacucccaucgcuaacgguggugauaaccaagcuuuuucuuuuuacauagacauaaacauugacguugauuuuuuuucaauugucauagcgcagcagcaucgucuuaacuuauuucuauucucgagggcuugccucacuugugaguggagagcaagugugagugguuuccaacugccuuuagguuuugugacuuuugggagaacucguagagcacagcugagugccauucuacauguaauguguuagguuauugucccagggcacagaccacaugaggaagcggaagaggugcggaggcagcauccagaaagggcagugggaugaugcuucuguucucuccuccagcaccaggggacaucgcucaccuagcgcgguuaugggaagacgcacacauaguuuaccugugcuggggacucuauuggguggguagauuugaucaguagauuagccccaugauaagucuacauguaguuauuaguccaaacuccaccuaaguuuaggaacuguaggacauccaauauagaaacuauagacaacuauaguauaugggacuauaggggaguguuucccguacuggccucacuacuaugaaauuaagggagcaaucgcaagucaugauucacucacuaaauuucaagaauagaaaguuagaaaacaaaagaguuacuugaaguauuccaugggaaugucuuguucggugaccaguguuuuagacgacuggaucguguuaucuuuguucuuccuuaccaucaagacugacaagaauauugccgaucccacgauugcugugaauccaggguuugagguguauugcagccuuucuguuguucuguucuguagaccagauauuuuguuuuaauacgccaguuucuacuuagaaaaguuaaccucugauuaaugugaaaacucuagaagauguaagaagccuagaacauggacuaggagacacugccagacuugauauguuuuaaaugauuccauacacauagucuauaggcacaguaacauacaguuagccuguucauagaaaucucuguacuuuucauuauguaauuguuuauuuuucuuuccucuauacucuuuguucaugacagucagaugcucuguuugcuucggucacucugcaucaugagugauaauugacuggcuagguguauguccuucugcuguaacacauuaggaaaccagugagugcccuucccugugguauuguaauuugucagcuguuacuuuuuaaaauuguaacauaauuacauauuuccccuucccuccaucccuccaagcccccccaccccccaccccuugcuuugcaguccagguggagcuccagcuugguagguugcugaaggugaccuucaauuccugagccuugugccuacacugccugagugcuggggcuauaggcgugcgcgcaucaucaagccaggugccuguaaugcugggauccacacuggugcguugugaauacuaggcaaacaguguagcagcugcgcuggacuccugaccccaagcgaggcauucugaugucgcccauccccaagacugucuacuuagacaggguucuucacaacauauugucacuguaccacccaauccagagguuuuggaauucaguucagucaccaacagauguuuaccaacaaauuucuuuaugagucacuuuggagucuaguucaaacuguaaguaauuuucugagggucugcuaacuaaaauaugcccuagcuuugucuguugcuacauuuauuaauccauaacauacucaguugguuuuuuuaaaauuuuuuaaucacuacgaagcagaauccauaauguaguucucagacuaguuugugaaaaugccugcgaugaccauaagaaaaccagaguagagugucuuaccucacugcuagugauggucuugagguuguagccgauuccucguuguggggacucugcgucuguccucuacucucagguggcaacacccucuuggggaccaccagaaaugcggugaaugucaguaggacugagaaucacagccauuaaaacaguuacuguaaauaaaugucugggaaggucguuugugugugaagauagaaguggaugugccuauguaugugcguguaugaaaaauggucuuaaaauaacaccauuuaagauucuucucaaauuaaugaacuguuaacauuuguaaguucuuuuggucuuaguguaagccccugagaugguuacaauacugucacaucugucugucacccuggcuccuugccuugggccuaguaagaagcacucaaauuugcuucuugacaaaauuuucuuggagcucaugauaucaguaacauaaaguauaccaauuuugcgcuauuuuuuguguuuaauauagaauuguuauuguagacuguguaauacauuguaaaauucaaaauggauuaguguggaaaugguaaauauuugguuuauguccuuugcaaaauacaugaaaaauuuuaucuuagauuaaugagguauuauacaccuuuguauguauuaucuacuucguaguguaucugauaucaacauuauauagaaacaagggauaucugugaagugacaccguaugcugcuguuauuugaagcaaugauuauguaauauucauuuugaaaugcuucuuuauucuaggguacacauuuguagaguugguagccuuuguccuuuaacuuguuuccguuaguguguuaaggaaaaccaugugugcccuagauaaucagaauugagguuuuaaacucuuuucacggauacaccuucaaggggguggugcagaaugcgugcucuacggugccauccugccccauugucucuggauuuacauugauccugagugaugugaggguccccuggggaagugacagagaauacaggagggugguaacuggauuggagccacuggcagucccaagagauccggcuuggguggcaugguccugcccggcugggccuugugcugggauuuccuuuccuggaaggacuuucaagugagaccaaauuuuguugugauagauuuuugauauucccucauccccucgcuaugacuuucauuuuggcuccaguauacagauauggucuaacugcaccguuacuucuaagucaggaguucuuugggcauuuuuuugauaauaaaaauaaggcaaaccuuucauuucuugaaaaugaaauuuaaaaaggugcagucagguugacacaacaaauuaugaguaauagcauuaaaacuuuuaucauauuaugucaaacgaucaugaauagagcaauaacccagcgguuaggaacacaguucuuucggaggacccgcguucgacucccaguuacccacaaagcauuucaugacugccuguaacuccaggucuaggggaucuaaagggcuccucggacuccagccaugugcauggcucacaccauccuugcaggcacagaggugcauuuagaacucgggccugaugcgugcaguguugccggguacuguuagcgggucuuguucuguggguuccucgcuuguguggguacugcagugagccauguccaugcauaacggcuccaguaagcuuugaagaacuucuguuuacaauaauaaaaauuggagagaagagaaaagaauucggaaaaaagcagaaagcacaaagguaguuaggaaggcaggcgcucuggaaaagcauuucuuuccaggaaacagauggucacaugccauggagguaaagcuuuguacccgcacggucccuggagacuuucagagugggcugcuucguuuuuagauauuuguuaaaauuaauaaugagccuaugacucaccugugucauuguggucugcagaacuuucccuuuuguaguuggauacuauuuaagcgggauacugcaagaugacacacacacucuugagacagccgggugagagugguaggcaggccgagggacucuguucucuaaugacccagcaggucucuaggagcaccuuccccugccauguggcagcaugggaugagauggccucugcuugucacgugacagucuucgcugugugugcugcagcaaugggacuggauucucacucgguagacuggguagcccaugccuuauuacaggccuuuuccugguaguuuuaggauagggagacggggguuggggcaggugagagcaugggcaaggugagaggauuuuaguuaguuauuaaggaacaccgagguccuggaggcaggagagaugguacaguguucuuggaaaggaccuuggucaguucucaguacgcaugugacagcucucgggucuguaacuccacuucuaggggaucccucugggcauacauacaaaugguacacagauacacacaugcuggcaaaacacccauacacacacaauuaaaaaaaaucuuuaaaaagcaaaaacaaaaacuagaccauugauuucaaguuuauaaagcuuguaaaaaaauugggaaagggaaauuuuuuuuuuugaaauuuugcaugaaauugaaguuuauaaaauucaguugaucuguuuaugaagcgcuucuauagguuuccguuuaccacuauagaauaaaugucuacuaaaaggaaugaaaguguagggccagagagauggcucagugguuagaagugcuugcuguucuuccagaggaccuguguucagucccaagccuucacagcgggcagcucacagcaccugugacucuguucucuggaugccuucccuugucugggcuccugcaugcaugcggugugcauacaucaugcaggcucacaugcauacagagaagucaucuuucuccuccccucuacuuagagaaggaaguagaagccuggaaguugguuucuucuguugguuuugucuccagccuuuuccucuugcugcaggaggaugcuuugucagagagauggugagaugaugcagauaggaaauguauaugccagaaagagcuugucuccauuuuuguuuuuuaaagauaacgggagcacucugguggaccugagggccaccaccaggucuugguuguuuuccuuauuugcagauaaauucuggccugugagcuuugugcagagacucauuuauauuugaagucaguguuccuuguuugaucacacacucgcguauuauguuguaagaaguucuuguaucuaucaugaaauggugaacuguugugccgggauacuguaugaugauguuuugcguguccuuagggccgaugaugcaccagcagccuccuucucagcaguacaauaugccaccuggaggggcacagcauuaccaaggacagcaggcgcccauggggcugaugggccaaguuaaccaaggcagucacaugaugggccagcgacagaugccucccuacagaccuccgcaacagggugagacgccauuugggaaauuccgugcuuaauguaaauaacaguaauugaagggcuugaaguuuuaaugaacuuuugaucuagguaaauccagggcuuuugcuggacuccccugacacccacgaagggagcaggguuuaggguacagaggguccuaggcacauaggagcgucccagcacccagcuuccuguugccugguguucuccagggaaagaugacaucaggaaauauaaauaucagaaaaugcccccucccuuuuuuagaagcuacuaaauauaugacagaacaaagccaauuuuacuucaaagugcuuuagcguuaaugucaaaguaaaaagaagucagguucccaccagcuucagccccuguuucagagguuguuuuuccgaguugauauuguuugauauuauguguaucuuauauuaauuuuauaaaugacguguggaccugcuuguguguguaccugggaauagugccaaagcaugguggggucuccagcucagaaguagucucucguaacagcagauuagaacgaucgccuuugaugccauagagaacaaaugauuuaugucuugacugguugugguuuuucaggcccaccacagcaguacucaggccaggaagacuauuauggggaccaauacagucaugguggacaagguccuccagaaggcaugaaccagcaauauuacccugaugguaaucucuccuaauguuacccuucccguuucuauccuugcccaguaucaaugcagacagcauuucacaacucuuuaaugaagggcgaagaaacuaccaacuuguuucuucauuuagaagaaagcauuuggguauuguauaguaccaccaggaaggacauugguuuguaauuaauucaaaguauauuugugcggucacuguugguccauccggagcuacauucuaucucuauauugucucucgugugaaagaggagcuuuuuauauuuaggauuguucauuugaacccaagacaaauuucuucuucuacuucuuuuuuuuuuuuuuguauuuuuauagauuuaauucaugugcuauaaaguucacucauuguuuugcucuuaugcauucuauauaaggaauauagcucuauaagacuguagagaauauucuuggguaauuuucauuuuauuuauguuccauucuugggaaagaauuaugccuuauaugcuugcucuugagaaaagaugugucugcaaucuagccguagauaaggugcacugaauagacugaguguacgcaaggcauuuggguuuauaauuuagcgacuucccccugccuccuuuaaaaggggacgugacuuguaagaaguugacuccgcuaagaaagugcaggcacugauaauccagguguacaagggcauuucuacugggcaguuuaaaacucuuuuuguuugaaaauuuuguauccuaauuugaagaaacauucaacauagaaucgguaaaauaauagauaauguuaauagguaaaaaguaauauuacauaguaauucauaguguuuugccaaaauauuucauccauaaaguaaauucuuuuguuauuuuuuuuaacgcaauuauauggcaaagaaacuucagacuaacguuuaggaccccuuggcuagaaccuaacgcaaaccaccaagaagauggaguuugcauucaaauggcauuucaucugcugcuuuucgucagcauacaaggcauaaaggcaugucugugcuaagcacugucaccagggcuacacacagaagcguuggucagugauggugcauaacuccgcuuagagcugugugcuuuuaaucucaggucuucuugccauugguauucagaguauuggggcuuuuuccucuccuuaauucuuuguggauagaugaagcuuuuuuuuuucugaaauuuagacuuuauuaauaguacauuuauagaagauuucaaagguggcaucuaucugguaaauagaaguaaucucagaauaaaugaucuuuuaaaucaacuuuaaaguacaucuuaagcaauuguguugaacuuaaugguuuuggguccugaacauuuccugaaauacgaacuuugucuuauuuuaaaccuuucuauugaaaauaggcaccuuauuuuuguaacuauugaaacuuaacauuuauuacuugugcuagcuuguucuuagucuaaguaguaccaugguuucacagauguauguauaguaggcccugacaaguacagaguguuagccacaauuacauuuccuuaggcaaaagugaguaucuucucucagguccagauagucuugcccauaaauacaugggugaguguuugccugaguuuuucugcaaagggccaggcagugaagguuuugguccuugugggccauguggucuugcugucacauugcagaccuuuaaagauagcaagagagcugcugugggcagcacuuaaagugagcagacaugauugggucacaauagaacuuugaucucagccggccacggccacaguaagcugguugaucauacauugccagcucuuagagacuuucauccuaacacagugagugugacauguguuugugacuacaguccuaaguaggccuuucuggagcauuaguacccauuuagcaacugaagacauuaguuccuacauuucguuuuuaagugaaacauuaaagaauuaaaaaaaaaaauagucuacugguggaaguuacugagucauaaaacuuaagguguucuccaacucaggaaauaugaauuuuaugaacuuuuaugugcagaauacucuagaaauauuucuaaagaagcuuuaaaugacagcauuauaagauacauuuuuacuugggugccagucaggugggucccugugagucugaggccagccuggucuacagagcgagcucuaggaacccagggugagagaccauaucuuuaaaaaaaaaugacuuuuuuuggcaucuggaaauacugugaaacacuuguacuugaugcaauaaaauauuagagguguuagaaacucacuucacuucuuuucggaguacaaacucaaggaccucauauuuuguauuguuuuuagugugugcuggaaauggcguccaguagaacagggguuugauuaaacuaugauaacuuccauccuuuguucauucugauuggucucgaauuucuuacaugugagaggccuaaauguucucacuuucuuuuuuaaaauaggauguaaggguuuuuuguccucagugaggauuaucacaguuuggaggaugaguguaacauuucuaagauuacuguucuuugccuugaaauaguaugcuuauaaucucacagugaaagcuuucacguugguaaauacuugcuaaugcaauuaagauuauuuuuuuauguauuuccauuucuuuuucuuuuuuuuuuucuucaguuuuaucuuaaaguuuaauuguaggguuuucacucaguggccauuaacguuucuuccugucucuugucgaauugauguaggucauaaugauuacgguuaucagcaaccgucguauccugaacaaggcuacgauaggccuuaugaggauuccucacaacauuacuacgaaggagguaucuauauaccuucacacauacacaugcacaucccuucuccaggaaugguaguucuugcauaggacagcgucucccaugcaaagcucucguacaguacuaguggcuggcuggcuggaaaguuacagggccccccaaacaaccuuacaaagauuuagaauguguaacuaugaugugucauuucuaacagcaguaaaaagacuaaaacauuuaaaaaugcuuuuuugcuccguggaaauuuacucuuuggacauaaauccaucaaccccaucccccaacccuuugugugugugugugugugugugugugugugugugugugugugcucacacgagaguacgaguguguacgugugugcguguaugcguauguauuauuuacaucucagcauagagccuguagggaacagcuugcugaccuuguguagcuagugugugcucuuguagcugucuuuaauuuugucuuuuuuauuuuauuuagcauagucaugaucuuaggccugugaugcuccaguaacuguaaugcucguaauggcagaggcgcugaaagagcugcaguucaaccuugcacaauuggcuuaaacugcaguuuguuuggccgaaauccuucuguuugguuugaguuuuuucuuuguuuuguuaaguuuuuuaaaaaauauggcauuucauuuuguucuuguauuguuggcugugcaucuuagagggaaaagccaaaaucguuaauuaggcagacuucucaggacuuugcgcuccucuucuccguuucuucuguaggaaacucccaguauggccaacagcaagacgcuuaccagggaccaccuccacagcaaggauacccaccccagcagcagcaguacccgggacagcagggauacccagggcagcagcagagcuauggugagcuucuucagucugcuugucuaccagaagacguggcaagaggucuucugaaauacauacauagcauuuaacuuuuauucuaaauguuaaccaucuguuuauguuuagcgaaaguggugugugugucuguguacacauguacacgugcccacauggagcacagugcacacauagaagucagaggauagccugugugagucacuucuuuccaccauguguguccuggaaauugaccucagguuaccagguuugguggcaagugccuuacccauggcaucaucugccucuccagcugguaccauuuuauaagcauaauuuuagcccagucugccauuauaguguugauuucaagugcuccuuuuaaaggcaugggaaaauaaccgaguuaguaaaaguguuuauuacacaugcaugaggaccugagucagagccccagcacccaccugaaaacuacaccucuuuagccagagcacugcagaggcagaggggcagaggggcagaggggcagaggggcagaggcgaggguccuuggggccuuuggccaguuacuuuuacccaaagacucagcuaccaggagugugucucaaaaaauaaggcagaggcuuagcaugagcguacacaugcaugugagcacacaccauaaucaaggacauuacaugcagguguuacccuuaaauaaacuaaucauaucuguuuccgaagaacuacaggcuaaagaugguugguucauuguucagugguaaggugacaauuuaaaaaugagaagaauggauuuuugcgucuguuacgagcuuagauaagugauaauuagguacauaaguaacucacuauaaaaaguacuguuuuuuagugcagagcaaaagauuauucagauaaauaaagacaauguuuguuguucuagcuaaaagcacugcuaagggugucuuuacugaauucguguauccuacagcguuucggagaauguacagcgguauuuccuguaaaauuuucauagugcugucugcuuccucugcuuggugugcacauggcccuggauuuaaaaaucuauuacaaugucugacuuuaaauauuuuucuuugguucuuuaucugucuguccacccacccaccuauccagucuuacaucuaggcaacgucuaccacuuuauguguagagagugaggcgugggucgucugcagcaacaguuugucaguaugggugugccuuucugcuaacuguucucuuucuugugaguaagugcuuugggccguugguguaagccugucugcuuucuggcacugucuuugucugcuuaugaagaagcugagauucuugugucccguagcaugugcauuaccacuaacugauggggcaucgaaucucuucgcagugaagagaagucuagguguguaugacggcuaguacuuauccaugggcuuucuugccuuuucugaauggcauuuccuuuucaugacuuuuguaugucagauaaauuuuauugcaaguacaugaaaacaaauuugaugucacuaaaugagcuaaauauacuaaccugagaaaaacaguuuucacuuggaaaagacaaaagaauuuucuuuaaauacuuaaauacuuacugauuuguugaauggcaggaauccuaaaggaggccuccccauugugcucauuuagaggccuuacuggucaaacugucuucuagguugguguuuuaauaauuugauauucaauaauugaauaaccugguagaauuuauuugaaguugaaaguugauuauucucuucugaguuucucuacagucauuguuuuuguuuugcuuuguuuuguuuuguuuuguuuuuugagacaggguuucucuguguagcccuggcuguccuggaacucacuuuguagaccaggcuggccuugaacucagaaauccaccugccuuugccucccaagugcugggauuaaaggcgugcgccaccacugccuggugcaguccuuguuuuuaugguaggucuuaaguggcuguuggggaagacacugaaguguccaagccaugagcuuccgcuggagaaauggcucucggcugucguuaguugaguuucuaaagcggacaagcuugcuuaacacaggcggucucucccauagggacaauuacacuauuaacaauacuugauucucaguguguuaacucucuucuaaaauuuaauuguauuucacggggguggguguuuugcccgcuuguauguauguguaccacgugugugcucaguguuucagaaggucagaagugggcauggaucccuggaacuggaguuacagagccauaccugcagccuucaaaguguaacuuuucacucagcuuuuuuucacauuacagcuuguggcuuuuugagucauucauuuuuuauuuaaaauucuguugauauaaguuuauugauggugguacagcccuaccauuuugaugacuucaaauguaaauuuaaucacacaauuaguaugucauuguuuuuacaacuuuagucagaaauuaugucauuugggccugcuucuagguuauagaaccaggaccugauccuggcuaacuuauggaucuuaacuuaguuauuauugagggguuacugugggccauugcuuccugggccugcuuuaucauagucccagucauuucacugaagcagcagccccuauuuugcuuuuacuauagucauuagcuuugaucucacugugcaaaagugacugacugcccuuucaguuuagauauaagaauuuuguaacaucuguuugaaauucuugcugaaauuguggagacucuuucuagcuuuaccuuugggcuuguugcuguugucuugcagguccuucgcagggcgguccagguccucaguauccuaauuauccucagggucaaggucagcaguaugggggcuauagaccaacacagccaggaccaccccagccaccccagcagaggccuuauggguacgaccagguaaguugccuaccagccguggaguuaccacgcuguccuucauuucuguggacuucugagucaagauuucacuauguuguuguuuugaaccugugaucugucagcuuccaugaacuggaauuucaaccaugaugaaucacauguagcccccuucucaugacugcuagccacuacuacacucuaauuaguacuuuaagauauuugagaagaccagcacaguugaauaacaaucacucuugauuguaacagcuugaaguacaacagcagcucauuguccccggacacacugucaucgguacuucuccagugucccucauuagugaacgcggcccgugcuuuccucuguuccccagugcagcucacccggcauacuuggacuugcugucagagcucuuuguguuccaaguucccugcucacacuuucacacguguuucuaucgccaaguguuuuuucucuacccucgauuucagauguugaaaugugucuuacuuauccuaagauaagauucccuagaaccugguaguauccaucuggguuuuucucuuuuuaaucagaccccgcagacuuggacugugcgccuaggcacuuagggaugccgccgugguuguucugacuugcucugggaaugacuauagaccacggaauguuucagguuugugcagugaauuugcagugaggacaucuuaauacauucacugcuuguaagguacuaaagugggggaguuaggaacauggaacuguguguagucuauaagucagggaucugaggcuaauguagaagaugucacaauuugagaaugcuguaacuagcacuagagcugcaagcaguguuuccugcucugucugucugucugucuaucugucaggccugcagcccuuuguacuggcacuuggucucuaaguaaggacaagaggacaagagacagacacgggaagggugaggugcaugagcgugccugcuucugugcagagcagagugggggagagggcagaaauuguacucuguguacagugccugggaagguccgaaggucacacuagguucccugaaacugcaguuacagacacuugugagcugccgugugggugcugggaauugaguccagguccucuggaucagcagccagugcucuuaacuacugagccaucucuccagcccagaaauaaagucugucuaagaaguaaaauuauuauugaauaguuaaguuaccuuuaaaagaccugaugaggguccuagggagauggcucagcuguuaagagcacuuguucuccuggcagagacccaaggucaguuuccagcaguaugucaggugacucacagccaccuuugcuuccugcuuccaaggggaucugacuauaucacgugugugcaugguacccguacacagacacacggauaugcauaaucuaagaaaaaugcuuuaaaaauuaaaaccagauuagauaacuugauauauuuuaaaaggugagacucguuguucuugcaagcguggugugcagcuaagacagacagaugaaugcuuccggcuucuagagcggaugucuccaucuuccugcuucugucauucggcacuucucugccucugccuccuccuccuccuccuccuccuccuccuccuucuucuucuuuuauuuuuuuuccaauuuuuuuauuagguauuuucuucauuuauauuucaaaugcuauccugaaaguccccuauacccucccccacacccugcuccccaaccuacccacuucugcuuccuggcccuggcauuccccuguacgggggcauauaaucuuugcaagaccaagggccucuccucccaaugauggccgacuaggccauccucugcuacauaugcagcuagagacacgaguucuggggguacugguuaguucauauuguuguuccuccuauaggguuccauccaauagaugccugugagcauccacuucuguauuugccaggcacuggcauagccucacaggagacagcuauaucaggguucuuucagcaaaaacugaaaaaacaaacaaacaaacaaacaaacaaacaaacaaaaaacugguguauucaauagugucuguguuuggugacugauuaugggauggauccccgggugccgcagucucuagaugguccauccuuuugucucagcuccaaacuuugucucuguaacuccuuccauggguguuuuguucccaauucuaagaaggggugaaguguccacaauuuggucuuccuucuucuuaacuuucauguguuuuacaaauuguaucuuggguauucuaaguuucugggcuaauauccacuuaucagugaguacauaucaugugaauucaaggcccauaccuaaacauaauaagagcaaucuacagcaaaccaguagccaacaucaaaguaaauggagagaagcuggaagcaaucccacuaaaaucagggaauagacaaggcugcccacuuccucccuauucaauauaguacuugaaguccuagccagagcaauuagacaacaaaaggaggucaaggggauacaaauuggaaaagaagaagucaaaauaucacuauuugcagaugauaugauaguauauauaaauaacccuaaaaauuccaccagagaacuccuaaaccugauaaacaguuucagugaaguagcuggauauaaaauuaacucaaacaaaucaauggccuuucuguacacaaaggauaaacaggcugagaaagaaauuagggaaccaacaccccucacaguagucugccuccucuuuuauaccauaguccaccugaacugcaagguagagcacuuagguaguuagccaaguuccugaacaauccugcuucacacuuuagccuacacaagacacuggcugacuuguuguauuuagaauguguguggugugucuucaucugucuguaugcugacuggggcagggucucugaguugaacucagagcaccccaguuccuuuggucuagccaacuggcuugcuguaggauccuucuuuugucugugccucuggagcuggggguugcaacccaugccugccuagcuucugaucuauguguuuuugagauuggaugagggaaugaaaaccaacgcagauugcuuagcacaauagugauaaaguugucguggcaguuuauauaguuacagugagaaauggagagugagcgccuaccucuaccucuucaagguacauuugugcucucugucucuggaaacaguuccuuugucugacagucguguuagccucagcaaacacaccucccccucccauccacccccccaugaguaaacauugaaucaagcaacaaauuucauuaccuuuccuuaaaacugugucuacuagcuuuuuuucaaaaccuuuuucaaaacugcaacugucauuugcccuuccuggcuuagcugauuccauccugcccuaucuagagucugucuguucuccacacaggaccuggaguggccuuuuaauaacagucaaguucugccaccuucccgucagugguggcuacaguguugagaaguguuagcuuuguauguugggccugggaagagagagcgcacucuuuccagucuccugccauacagcccagcuguggcugcagcaugagcggccgcagcaugagcggaugcagcaugagcggaugcagcaugagcggaugcagcaugagcggaugcagcaugagcggcugcccuccuuauuccucuugccucaugccagccuccugcucucucugaugugcgucaggcucucucagaaccaguuugguuuuuugguuuuuuuuguuuuuuuuggcagcuccugguaccuggaacuccccccucuaucugcagucccucccuggccuugucagauggcuacaguagugaacacccaccuuggauuacuuggucuuccugucucuauuguagaauagccagggguaguggcugaugccuggggagauugagagggacacaguggauccugaguucaaggucauccuccaggacgguagugaguuggaggcuagacuugucuauaugagacugucucaaaaaccacaaacagaauaacucucuuaagguuuaauuuacauguaacaaucugcacaucaaaguuauacaguuuaaaccaggcgugguggcgcacgccuuuaaucccagcacucgggaggcagaggcaggcagauuuuugaguuccaggccagccugcucuacaaagugaguuccaggacagccagggcuauacagagaaacccugucucgaagacccaaaaaaaaaaaaaaaaaaaaaaagucauaccguuuagugccuuuuaacuguaugccugugaugucauuaucaaaaucaaaauaaugaaucaucgugccccacgguuucugugccccugaccccuuuaaaaccaccacugcauccacugagacucucccuacaugucugcugauaggcuuucugucacuauaaauuuauaguguguguguguguguguguguguaugcaugcaugcaauaaaauuugugaaggucaaaagacaacuugugauagucaguucucccaucaguggguccuggaaauugaacucaggucauuagacuugguagcagaugcccccugcacagcccuuuugcaagcucagucagacuucuuuuauuggccaugauuguuuugauauuugcucuuacuauugugaccaugaacaauucuuuauagcugacuaguacucuuugauaaggcuuucuacccaguuucaguuaaaguaccugaacaaucagguucaauucuuuuuggacacauuaauuuuuuucaucuaaauaccuagguguggaugucacaugguagcuguguguuuagcuugagucagugcuggccugcugccucccuucacuccuugcagccuguguguuacugccuucuaggugacagcaacucaauguugacaaagcuagacacacuggugccuuugcagagcugucaccgcagcauagagagcaucgggacagacacuguccagaaggauugccuccuaaccuguagcaaccacagcugcagcacaagaaguaguuguguucaucacuacauaggacagugaucucacauggaaaacaaaguagaggagcccgagaaacuauuagugacucuaguggagggaaaugacucaggcccuuucccggagggagggaaagggaccucccucaaacuuagugugaccugaagccauucgagcuuuuuuaagugaaggccuuguucguacauugacuugaguguacauacucacgugagcaccguggugcccccauggagaucagaagauggugcuggacucaguccuuccaggacuggguccugagcucaggucuucaggccugagccaagccuuccccaggccccuucccagugaguuguggacaaugcacuuucuuuauuagcaucucacuucacauugccaggggagaauuacccaccaguauugagacuugguguguuaacuaaucaguucuuuaguuaacuuauuuugggacaggcuuucguuaccuucuuggucucaaaccuuuaguuugaagcaguucucuuugaccuccaugguggcuugcacugcagccauaagccauggcaucucucugggaaaacgcuuuuuccuauccucucugagaugccaggaucauaauagcuaugagguaggauuuaauaucaucagucugugguggaagggaaacuggugcagagcuguagcuuacccucucaguucauggguaaggaaacuggccuuaaagaguguuuucacaggcguaaagauaccaacaggguuagugugugugugugugugugugugugugugugugugugugugcgugcgugugugcguguguguguguguguguguguuugcgcgcgcgcgcuugagcaggcgugcauuuaccacagagucuguagcacuucauuuugagugcacugaccauuaauuacgcuuuugagauguaccuacucucccugccagcccagcccaauccaagacuuucacgugugugcuaccggguccagcuuuaaaguacuaaucgucuggugaugugggcuguacaaaccauuugcauuugaguauaaugucaggaaaauuagagugaucgugcauaaacacuuguauuuuuuggauggauagucacuuuucugagaugaugauaugcaaauuauauuuguaauuuucuguguuaaacuaacuuagguuaagcuguuagcuaauucuguuuuucgaauuuaucuuucagggacaguauggaaauuaccagcagugaaaauguccuuacauuccaauagccaguaccuauuagcaggcacguugucacagcacugcaccauggacaccccccugggaagacuccuuccauuccagcuagguuuuugggaaaaccuuuggcuaaguggcugcuucgucagcaaguagcuguuaugguuuaguuuguaaaggcuucguagcuaccgaugcaccugauuucacguuucuacucuagauggcaacauuggacagaaaaugcauugacgugaggaguuugcagcgguuucagaacugugcugcaaauggacugucacagccugaaaggugugagcagcuggguguguguucgcggagcuucaggggguuucauacuuuuccaccgauuauuuuguaaggggaagggggaaauguacacuuuuuacagcagcaauauuuugucuauuauguuuauuucaugugauaaauaugcaaagcgguacacuacacacugggcagaaucagaaccccuguuaauguggagugugguagaugcucggugcuguggugcucugaagacaggcgaggggaggcagaagcccaccacaggcccgcuguuaguucuuagaggaaacuccucucucucuuaucuaccagauuagcaagggcgcugugauacaguuuuuugaguacaaagacauuuuuuaaaaagccuuccaguuuugugcauuaaaaccuuuuuguaaauaugguuuauaauacuguuuucaaacgcaaggcaauaauuauguugcaucugugaacuuuggcagguuuguguaaaaggagggaagccucucuuaaaacagcaauaacagaaaaggaggaagcgggauguuuuuaccuugucuuguaaucagggagcucucaccacgucagagaggaggcagcauuggucucaccuuacuguuuuuuacauuaccaugauugguucauggagcagggaggaguccacgagacuucacacgcuugugcuuuaacuuucuuaacugggcacaagcaaagggcgccuucguguuccucucuucaucuuaguuaaugcgcgaggaaaaugcuuugauggccauuucucauucgcacugaaagccgagaggugacauuuuacgguuucuuguuuuuaagcacgacauacuuaaucauuauuugagacugauuauuuuagcuaaauuuggggauaugccauggggcaagaaaacauguacugagagauuucuaaacacaucuauuuaagcauacuuuaaaaauaucuagcccaaagguaaguugcuguauccucacaguugucugcauccagggaauaugacugaauauaacauaucuuuguaauugaauuaguuuuugccacuucuaacugaaaacagaacagaaggagugccauaaaugcaaagaagcaaaguguacuguugucaacauacuguaaucagaggagggguuucaaugugucuggaugagaguguguguguuuaaggucagaguauaggguguucuucaacuuggacaguagaaaauaggcaucaagugugaaccggugaggcguggacagccuucuugugacugagaugcuuguaaguucugugccagguucuccaccacuguguacuuuauugcuauuuaaaacuguaucaacucuaacgaaagaauaaauuauuugugauuuuaau

SEQ ID NO: 12246 - RNA, 25569 nt, Mus musculus
cuggcuguguuaaugcuguuaguuuaauguugacaguuaaugaggacgagucagcuuggagaggagcacacgguguuuguugguguggucagccuugcaucaggccccauaccuuccagucuagagugacagggcacuggguagaacacuuuuagcugccgcucaguacaagauccaggaugaggcgggacuauagacagagugaaggucaagagugguggccacuccugugagcuuaggaaggggccaccugucccaagaagccuguagucuaagcaucugucagggaggcaagccuucagcuuacccacagccuuugagacucuugucuuuugagacauaaaucagucuuuccauugaaacacgagaguuugggacggguuuuuuaaaaugggaauaggauggagaaagagaacuaggggugcaccaguuggcauaguaaauauagaggcuagcacugugagaaccccacuggcagugauggcccaggcucugggaacaaacggggccucugaccuccccagaccccucauguucugaagugucagagcugggccaagcugagggcgaaguccauauguucuccccaugucgcccgugccauggaggaggccaagcugggacguagagagcggcaggacucggcucucccucccacuucagcagaacugguaguuguuaggcugcagcaggggcugggcgauguccccuggcucacagcaggccagguguucacuggagcucuccucuucuggcucacugcugcugccaccgcugcugccaccaccacugucacugccgcugcugccaccgcugcuuggcagguuagcauaguccugggguggggagaagccagaaacagcugaaguuucccagacccggcccagccugcucuagccagccaggcaucugcuccaucccucucaccuggucucuccucuccagucgggccugcuccuggaggaggaagcagaucuguuggaaggugggucuucugguaggcuccaggucccagcaggacugcaugaugcuguaucuggaaacaagacaagcguugcccgugucagccuccucgggcacauccaucaccagggagaggugaaggaccccagcacuagucaaaaguaaguuugagggcuagagauacggcccagugauacagcaccuguuagcaugcuugaggccgcugggguucaaagcuaaguagagaaccucaaugcaaugaagauggaaaccuggcucuagcaccuuguacacagagaccagggccaugcacucuuccaacaacuaccaaaacccuagaaccacccaccccuggguugagugccuuugcguacauguucuucggugcaaauacaggcugggccauuugguauccauccuucaccaguuuguagaacuuguuguucacuaggaugccgggguagggguucagaccugcagaguccaagaucacauaagagaccauacuugcuucccacuuccccagccacacgcuucucaggcagaguguaaagggcagaggcgagugaaggaaggacccaggaaguguacaucagccagagggucugaauuacacacaggugcugcaguacugguucaagagcccucaccaucccauugcuccugccagcccuugcucugucuuggacaccgacaucuuugaguagauuucguccaugagguucaagacaccgauggcauagccaaagacgggucagcccuaggcugcaccugaaaacaggcuuagcagcucaccaagcgagaagaucucccagaggaggaugccguaggaccacacaucacucugaacuguguagacgcagucaaagaugcucucuggggccauccacuuuacaggcaggcgggccugacaagacaguaccaugucagucaagggcucuccacagccugcccaaccaaucucaaucucucucucucucucucucucucucucucucucucucucucucucucucucucucucucucucucucccucccucucucucucucucucucggcacucacauugcccuugacaacauaguuggagucauucaugaugucccuagccaguccaaaguccccaaucuuggccacauguccgcuggucaacagcacguuucgagcugcuacgucccgguggaugcacugaagaaagcgcagagagauuauuagucaguuuauccuucccugaggccugaggaccagaggaggagcaggaggucuugggucucuguugaaguagaugcagguuuugguagucuacugucuacuccugucuaaaccugugcaggccugaggucugagacgauuugauguggacaauuuaacauuuagaauucuagccccacagcccuguuuccaauggcccucuggcccuuggagccacagggcugcuccugccucagaggcaaugagucccugugcugugagcagccuguggcccaccucauacacaacaccaacagcugccaccuccaaguacacaauaccaggugcuuucccaagcauuugcauacacaacaacccguuagaccccuaaacaauuccugcaaauacccaguuugcagacacagacccugaggcuuacagaaccuaaauugucauagcaaagagaagagccagaagucacaccauugccccucuagagugcucugagggugguggucugagccccaacauccuuacagcucauccaacaagacuauguuuuaugaggagaagcagcuguugucuaguuugcuuggcugagugaaaccauuguuaagccuguugguggccacauagagaaacaggcauaccaaggcugaggcuagaccuccaggagucugcccuggguacugcuucgucccgcugccuccugaggcccucuguacauuccucuauuccuccguucuuucucacugggccuccucuuccucauucccacgaccaguaggaauucagcuuuucccccacccagacucacguuuuuagaagcaaggaaggccaugcccugagccacuuggcuggagaaguggagcaggucccagagcuccaggggccggcuggccucuuuguccagaucuguagaaggcaaaggcaucggggcaacccugucacaccuugcuguuccucaggcccaguucccggccccuaggcccauucacccuucucuccccucaucccgguaccuccgcaccuugcuuaaagaaggagucacuugaagaagucgagacaggccucaucuccacguaggugucuacacccugacuggagaagccacugucccuggguaggaaagagaagugggaaagaucccaucacugccuagcccaggcauugcccuccagcugccuuguggauucccuuagucacucagcagaggggaagaaaccuaaaggucagcugagcaucacucucugauaagggaggcccuaugcuacauucgacuugagcaaucacugugccacguuuagccuucccagacacacccuuuagccagaggcaccccuuucugucacuaggcggcucugccugcucaaaguucuuccuugcuccuaaugccagcaugcuccugggauuuucuucugaucuucauccucaaaggcaggaagaccguuaucucuagcugccccgcugggaugugagucagucccaggccccuucccugaucucucugcacagcauugcacaaguuagccucucguucaaaguuccucgaggaggguggcacugacugccaagccugagaaccugagcucaaucccagggggucgucgcguggaaagagagaggcccagcuuauccacgugcauuacagauaaauaagugcaaaaucaaaaaguuuaaaaucgcacaagaagggggcuggagagaugccucagcaggugagaguacuugcuacucauucagagggaacuggguuuggcucccagcacccacaugguggcucacaccuuuaaccccaguccuaggguagcagacaccaucuuuuggcccauugugagcagcaggaacacagguacacacagacacacacucauacaugcuuuuuuuuuuuuuuuaaaucgcuuggaaagguuugaauauuccccaugaccagagcagucaacucacagccuuaaauuugcccagaucuagagcagaacuuaaauuggcucagggcaucuaagccccagagagucucaugucccuguagguuuggguagacaggcaacacccagaaauacccagacacuugcuauggugacaggccaccuggagaagcacaguccuaccccaacagccacuacugcugcgggucagccagacaggccugguuugucagcagcugcucagcagcugcucaacaccuaaacucuguccauguccugaggcuuccaggaggagaaacuaggaucucccauuaguguccauggaauagucaccaucucuuuguucuggaagccauacuucuuuaguagcauaacuugggauccauaggucgaaccuguugcuuugccugucuaugcacuuagagaagggagccaagccaccucuucuaccuuuagcuccccaagucucagcagcugucaauaccuacacuauaaggacaguguacacuuuccugguucugagugcagccugaucccagcacuagggcacaagcuaccaugacccaauauugaaacuccaauuuaaaacagcaggcuuaguucagguucccccucugcccgauucaugggcaacaagaaacuuguuucuuccccucucugcuuccccauauggcuuuauccauagccucugguggcuuccaggaaucccagaacagcagaagacccugaaggguuaaacacucuguugucugaacuggaacugaggcccgagugcacuaggaaccucgccacaggccaggauguuccacuaccuccauccaacaacuaauaaacucuguucucacuuccccucggagguguagagacacaucagccacuccucacuggaauauguguccuguggcccccgcagacauacugugggacaaccagcauuuccuccaaguccuccaaccucuggcuagggauccaaguuugggccugggaaaaucuuuccacaugugaaggucauguguccaugaacccaucucucaacuuugagccucccaucuuuguccuucacauuccuggaacaugguagguaugcagauauuuauggaaugauggaaaagugugguaagaaagccuuagagccuggggguagguauucuucauagcccagacuggggacggggcuucccauccuggcuccucucuauccuguccuaugccagcgagcuaccugcgcacauauuucuucuccagguggauguucuuguagcuggagucucccucggaguccugaccaggacucaggcuggguccuagcauagccucggccuuccuucggagaaaguugaguaggucuccauagcagcaguauucagugaugaccaggacagguccuaaggcagccagaagugagggugagugagguucaccacaaggccccacugcccacgugaacaggggucuuuggccuggggaccaguaugccugaguucuaauuuugcaaaagccaaugacaacuuacaaagcuuucuaaagaggaauuuaggcuagccuagugugacugugcuugaggcuaagacaagaagaucucaagguuaaggccagccugggcuacauaggaaauuccaggccagccugggcuacauaggaaauuccaggccagccugggcuacauagaaaauuccaaaccagccuggauuaaaaugaggcugucucuccaaaaagggaaaaaaagaaaauuuuaccucaaaaaaaucuuucuucagaggaggccccauggcaguucauuauaggacaaagccacuucauaaugaagaauaagggaugacuuauagucuuggugcauguaagugugggguaggggcuucuuaaaagcuggauuugggguuucacgcuaaauucccuguaagugggcucagggggcuacacauggauaucugccucagccaugagcagcucuugcucugucugaguccaggcugggaguagcagagauuuggagacagggauccugcagacacuuagagcaaaugagaaggggaacuuggagccagauguccagggacccuugaaugcucaagaccaugaguccccccacccccacccccacccccacccccaccccacucccauccagcucuuaccuccgugaguacaggcucccaagagguugacuauauucucgugcugucccaggugacucaugaucuucagcucugacaucagggccuccuucucaucagcaugagccguggcugggagaugggaccaaagucagagcaaacgggguggggccacccagagacccaaaaagaggaaugagaaaugcaggcgugcaaaugaggaggagggaaggagggaaagagggagagcagaucccaauggguuagacauacgggaagcaccucuugugacagcagagccagacuauuugcagcagguaccacuucccauccccccauccccucugcaucucccccacucacacuuuagcaucuucacagccaccuucagcacugcaucuucuuugcccagaccaaaggcuguagccuccaccaccuucccaaaggcaccggcuccuagagucuuaccuaucacacacacaugggcuccuuagguuccuaagucucacagggucccuguaggccccauaugcccuaugaugggagaucacagagagcuaagcgcucucgcucucucucucucucucucucucucucucucucucucucucucucucaccaaacugcagguuguuccgagggaacucccacuucucauuguagggcaacugaguagggucaaugaagguguagcuauugccuucguaucucucgaugaucuuccagcgcaccugguacuucggcuucugcaggaggaaagggaggcguggggcugagggucuagcagcccgacuuugcaccucaccucccaggagcaugggaggacaauccagaagcuugucagccuacuaugugcugagagggaccauggcaucuuguggacagagcauccaaaacuagucugugcuugauucugccuuuacuaugugaccuucccuccuucgucaaggcucagacucauuuaaaacuguucacucaaagacucagaugauucccaaaguucucccuugaugacucuguauuugacauuuccugggccaagguggaggaggguagaaguugagaacuauccacucauuauucauggaccuguccacuugcucacccaaagaguuuauguucccauuucuguuuugggugcuagggauugggccaggaucuuauauauguguaagaacauacuauacaacuaagcuauucuccagcccugcuuucuuuuucaauucuagugaaguauacaaaacagauaauguaccaucccaaacauuucaagcauauaccucggugguauugaguuuauuaguaaugauaggaaaccaauaucuagaacucuucugaccuuguagaaacaagcucugcuguggccaguggagagcacuccccuacuccccccuccccccgcucuuucuagccacuggaaggcaugaauuuauuuuacuguucugaguauuucguaucaacagucacgugacaucuuuugggaccgccuccuuucgcugagcaucaucucaucaucucaacuacacugaagucaaacuuugcucucuucuccaggcugaacaauacagccucccagacauuuuacugagcacguauuucuuucuuucuuuuuuuuuuuuuguuuguuuguuuuuguuuuuucgagacaggguuuuucucuguguagccuuggcuguccuggaacuuacucuguagaccaggcugaccucgaacucagaaaucugccugccucuugagcauguauuucuaucaucaugcaugaucaacuccuugauuggcccuguggggcuggcauuugaauggcuaaaagagacauucaacuuaaauaaauaaauagggaacagucagauaaugccucaaaagacgugcaaauaaagucgggucugcuauuggagugucuguaugcuuucugauugacauugaggcuacagguugaagccacaucugguacuguaauuuuggucaaaagcuccuggcuagggaggguacuagccuuaguggggacuguccagcugcuguuuugcuaaauggauacaguagugccugucaacuaacuuucuaaauaagucugccuguccccauagauagugcuguucucggcuuuccuuggagaagcugcuguuugcaacugucagcaguaacugcagagacucaugacugacaaagugcugagagugagcgaccagugaacacugggccauaaaggagacagccagcugcaucgcucuggggcucaggggacaccauagaaaagaauacaagagcuggcaucgucuggaggguuaggcacuacugucagccgggcgugaugugccugcugcgcugaacucacagcagcuguggguaccugccuaagauccugacaggaucagucuuaucaacaucccgucguggaggagggagaggcucacaagugcuccccacccugaauaucugcaggcaguuagugauuacugguggugggagagauguuuucuucaauuguauagcuuaaucucuauaaauaacucaccuacacuucugcaagcaacccuaaugauagauauuagaacauaugcaugcauacauacaagcacacaaacacacaaauauauacacauacauacauacauacauacauacauacauacauacaccugcgagcaagcacacacauauucacacacacauacacaaauuaaagugaaagaggaguuuggggacagaaaggggaacagcagauaugagcgggggacgaggguaaugggaggugaaugugaacaauaucaucaauauacauuagguacauguuugaagaugucacaagaaauucaucauuauauauuauaguauaguauauaaucaauacauacuaacaaaugcuauuuuaauuuuuuauuauuuuauguauauggguguuuuuccugcauguauaacugucgcaccacaugcaugccuguuauccaacggggucagaagagaagguuggauccccuagaacugggcuuacagaucauuuugaaucaaccugugguugcuggaaauugagccuggguccucuagaagagcagucagugcucuuaaccucugagucauauucccagccccagaaacaaauguuuuaaaacauuugaaaaaaaaaauaaggucaugaagccuacgaagcagggugacagggcagagaaugguauaagagagucccugaggaggcagaaguaaguguuccaggcauagagcccacagaugcugggcagccuugagauggguacgauccugacaaacucgggaaauagguaggugaccaugugacuuaguaaauagaggggagccuccaggcaggaaggucaggaagccucuaagacaggggcugucuccuaacucuaggaagaaggaaaggugcugaggaagugcccucccacaaagggggugcccugcauaucacacauucugcugucuccaguucccucucagguucucaguagcagagggagugaguacuucaccuuucccugccccaggggcaacugcaugagggcaucaugccaagagcugcccugagaagaacugagggaaggccacauauaugggacagugaaagcuaggcuggggugguggaggacaccaagacuuucaguccccugaccaacuuguguucagucaggccuuggggacagggacugggcuguguccagcaaccaagguccuuccuucaagggugcuuagcaagaagagcuaaaggaugcaugaguuaguguuggggaggagguagccuauugcugaagucuuacaggcagaggagaguuuauguagcuacaaggaagaccuuccagcuggagcuuuaagagagaagacuguaguuagacauaaggaaggacacccagugggcaugaagacacacacuggcauccuugggagauggaagcaggaagaucgggugucuauggccagccuuagcuacagagggaguuugaggccauccucaaagcuauaggagacccaguccccaaaacaaaacaaaacaaaaccaaccaaccaaccaaccaaacaaacaaacacaaaacaccacuucuaguaacagcaacaauaaaguaaguguauguuauggcuugggcaaaguggcugaagugagcucuggagaggaacucccuccggcugggugaccccucccgucacuuccaucuuccaucuccaggagucucuguggcugcaacuguuuuccuucuagccacuucugcuucccuuguuccucugcagcugggcugacucagcccucccaccucugcuaggacaauguuggaagggauggucugagggggaagggagguucagcuggaagcucccauggccgaauccaugauuugagcacggaggcccugccaaccucaagaauucuuuccguccccggugacucugggguccuguccuugugaagguagaguggccugugaggucccuuccuagaaggagggaugacuggaaugcuuugcuuucuugggagcugggccuagcuaaauccucacugcagaucaauucacugguugcucaugcuagcucuaaguugaggcucuccacugauuccuugacagagauugaagagggcuugggaacaucagaccuuggccacccuccccaucaggcccuuggucugugggguagguauugagccuggggaugguaaagaccugggcauuucuccuggaagcucuccagacccuccuccuucaauuuaggccugggcccaaaaucuguucagugguuucuuucugagucuacccuucccuucucucuacccaucauccucccuaccuuuucccuaucccuggggccagcugacucggguccuuuccucuuccccugugccuuccccacuguugugguuucucugggggacagaaggggaugacucaacucagcccuuagcagaaacaacccuuccauagacaggccaugucucacucagaccuggggauaaagacagguggggccaaguccccuaccuacaaagagguuggccagaagagagcugcuaacuagacugccucuuucaggucuuucuuucaggagcaacucagucaauggacauccaagggugaaggagaaaaggccagccugaggcugcagguccccuggcuuugggcuacauaagaagcagguaaguuuccuggaugggaaaugagacgguacccagggugauauauucagaaaaugguguuguagagagagcugaggugccuuagaccaccaugaggugaggccugucagucaaggcagaaagagcucugagauccuggugcuuauggggcaccagagacagcuuuuaguuccguaugaggaaggguuuuguguuucuccaaggacagguagucacgguagugacuaagcuaugucugagugguuaaguagcaaccagaagccacuuugguguguggucaaggagauaccaacuucagccacacucccaucccaaugugugugcgccaacuggaucugcagacaacuuccuccuugcaaggaagcccacugacuuugacaccuuaccccuuccuuauacaugcaaguuggagaaucuugguaacagucugccaccuugaacuccauuuuacagauggagaaaggagcuuuaacauacccacuguccuauggucccauaggcagagacaggcagagacaggcacauuuuagacacacccucauuuuuauaccuucuccugcccccaacaggaaagcuuaggguuauaauguuaggagcuccuuggugucagcccauguugacacacagaaaacuccuacuaaagagcucuaguugcaugacagccugucagaaugagcaaccaugagcaggggccauccacaucuggcucccucagguuccuggcccagcucugcugcccaacucaccugcuuguacuuguacaagagcagcaacagcaguagcaccagcagagacaugacagacauacaggccaccaccaccggagugaagagggacucaucggggagcugcuugcuuuguccuggaagagggagacagaggagugaacagguggggagauguguauguagccucaccccucggccaguacucagccacugcuuucaugcaaaccccagugagagggcguuaucacucccccuugugggcagaaagaccuucuggggauugaaccuaaauucuccucggcuuuccugugguuucucuuuguauccuuaaaagcucagcagccuucugagucugaggggcagcucagggacuccaggucucaccuuccugaccucuaauccuaguuaucuugaugguguagaaaggacacgguucauuucugugcucagcuaggagcucgggucccuuaguagaugagugacaguaaacuaggacaucucugaacaugucaggugugucauccuuccaaaaugaaggaagacaggacuuugcugcuagaagagugaggggcaguagaggcaaugcuugguacagcaacagcauuccucacaauggcugcuccaccacuuaaaacagccacaaucaacagugacacagagcauucacagacaaaaggggcaaccagucuggcagccaacugcuccagguuacugacuggaggacauaaugggcaugaucccuuagccaagcagaagccaagggucugcccuguucaguuuggauugagagccucaccaaggcccugacaaaauaguugccuaauccuagcuguuuaagggccugaauaggcuguggguuucugagugagaccaaaaacagaugcaagcuccauaucagcacugggcaagcccuugcacggugucucaggauuggggaggggcaaggaacaaggagggaacuggagagagauggagaagcauccucucuagcccuggacuugcaaugagcuguauuucuucauccaacuccucucucccucauacaaggaggagcaggagccaaaggaucagguucggugucucucuguuucucuguccuuucucagucucugacuguugccucuuugccucauucuuuuuucccccacucccugacuuugcccuuuccucuucaguccccaacacuggaccucuccauguagcugugccuggagcucuguggcucaggauuagccagggugacccagaggugaaacucagcauggcuaggaccuuuuccaaguaggaaucccugggugagggagcaaguagucucuacaugccugauguccauucuugcugaggaggaggaacgauggauuaccuagggagacggcccugaaguacugagagcuguuacccacacuguuguggguuuugcaaaaauaagucauguuguguuuuaaggucccaaugggcagcuggcucugaaugaucacuuugucgaagggcuucugacucaggacuucagggugggugucauuccaaaccugcaaagccugggcuucaucacaccuggaacaacagacuuugauucaggcuuuagggucucccgaaucaguaugcccuuccaagucauggguacgcaacccagacuuagacucacccuaaggaggaaaaccaagcccacugaccuaucgguguggccccugcacuccauccaugucacgcugggcugaggguacccagagacgucacagaacaggacaucagagccauucacaggcauccauguaacacugaccucugggggaucugaggaggaaagcaaggauggaggagggcaggaucugucuuaggggugagggucucagucucuugaccaccugcccugcuacccucaccccucccaguacacccaacccugggcagccugucccuaucacucacaucgcagggugagcucaaaggucagauuauuccagccugccuuguuuugugccauuaagaaguacuggcccgccucugaggccuuuacacgguucagaaagagcuugaauguguaccugcaagacagucaagagaugcugcuguuaucaucaggcauccugugcaggaaaguggcacacccuuuguucaaguuucagggcacagaggcuuuguuugagaaccagguccuccucagaaguguaccacggagacaaaagaaacuaccuaccccaggccaccucuguccucucaucuaagaguauucuuugccuccugccccaagagguuuauuagagaugauguuugcaaggucuugagagauacaugacaaguccccccugugcccccuuuuuaucacugaacuaaguguucacaacaccaggaccccuacugaaaaccccuaaugugcuagcccugucccaagggauggugacagagacaagagacagcauugcuucugacccgugcuauccuuguugccugugggacuuuagacuuucaacugcuaaggucuucauuuagcucugagaguggugcugauauuuuuuuaauguuuuguuuuguuuuguuuuguuuuguuuucacaggcuucgcccgaggguugaagggaugugcauuuagaaugcuggacaagaaccugacucaugauagggacuuaauaauuuaacaguguccuuuauuacagaaaagucugaaagcaaacgcuguuuucuguuucuaacugauaaugugcccauugugcguagaguuauuguuugagacaugguuggauacagcccagacuggccucaaacuugaaccucgaucccuuugcuucuguugcccaugguaaccaggugcccucauguccagcuagugaaugcauuauuuagguaguaaacacauuuuacaggacgagggagauggcucagugguuuagagcacagccucuugcagaggaucuggguuugguucccagcacuaacaugacgaccccccaaccuccagcuccagaggauuugaccuccacuucugacucugcagacaccaggcacacaaguggcacacauguauucaugcaagcaaaguauacacauaaauuaaaauaaauauuuaaaauacacuuuccccacuuaagacagaguuccucuguguagcccuggcuguccuggaacucacuuuguaguccaagcuggucucaaacucagagauccaccugccucugucuccugagugcuaggauuaaagguguuacaauacauuuuaagauucuguuuuguuuuguuucuugguuuuuuuuuuugagacaaggucucuccauguagcccuggcuguccuggaacucacucugcagaccaggcuggccucaaacucacagaguucugccugccucugccucccaaguacugggauuaaagguguucgcuaacaccgcccagcuuaggguuuauuuuauuuuaugcauguaagugcuuugccugcuugauugugugaguacccagugugugccuagugcccauggagguugaaagaggguauaggauccacugaaccuuggacccugauccuuugcaaggucggcaagugcuccuuaaccauggaaccaucucuccagcccuaaugagagcaaaguaccagguuuugcuugaacagggccuacagccacugcuugacuaaaauucccuuauugagaagacauccucggacuguggguuuggcuuaccuaacaaccuucaggugcugcaguaggagaguaaaacccucaaggacacagcccauucagagauaggcagcauagcucuacagugguggucaugugaccaacccaaguucuaagaguagacuggugccagcagagggggugcggaggaaacauguaccccgaaaauaucccagggccuaaggagaggacuucuagaagggugauugcguuccucugcccccuccccaugugacuuuggcaggugccuccugugauugcugucucagauacaucuuggggcggaagucacggucauuuccuacauuggccauaacgaggacagaugaagcugagagguucccagggacccugauaauaugcaccucccagaaaugguagaguagcugagaaaagcaccaggcuccccagugacacaagucacacacacacacacacacacacacacacacacauuuaugugggggcugauaagacguaccuguauauggcccuuugggugauaaacucaagcuugcgcuggucuucaaagaauggaccuagguagguccaguuguaaugcuguaugcuaggguaggcaucugcauggaccgugaggaugaggcugucacccacagacaccuccugcaagaggcucugcucagaggucaaguuuaaguaggcacucucuggaaaucaacgcaggagaucuggcgucaguggggagaugcccuccuucacguguucacuggaccaaccaccccuugacgcagggucugagcacaucuaugcaucagguuuagagccuccacccagccaggacucaccucuacugccucuuuucccaccaccauccauccauccacucagcugugcaaauuccucccacaaccucgaugaccucucuagucuggacucauccaccaccuuggaccacugggaaagucuaauuuaauuuacucucucuuucucuccuggggcaccaggaaguccuguugauccaagucugaccuaaccuuccaacugcuucucaccuccuccagaaguucuggauccuuauaugggaucucaggaccaacuaccugcccaguuuaccucucugaucucaugugguaccucucaucugugccaacccagccccacuggccaucuccuuccuugaauccagccuguagaguuaucuuaauggcacgacagcugcuccgugaacuggagcccucuugcccaagugucugagcuugcccuccaucaacuucaagccugaacacacaucugggcaaaaguuguaugagcacacacauuuauggaauugacuccugaaugccugcuguaggaagcaaguuggcuggugguguaacaggaggauaaccuugcgugaguucugccucucuucccuuuaccuggcagcguugggaggagcucccugugggugugcucugaggccacugacuugugcucccccaucuccuccccucugacucucacucaacacauggucccuuagcaggucacacugcuagagcauacuccgagccccuucccacccuguaaaacugcugugcugugggcuucucagccuguggaaugccacuguucccaacucaauagccaggcaaugggagggcaccuuaagcccaucauucaucaucaccaugguuggcauccucaccacuugguccaacuugaucuacauucacgauuguggcugcuuccagcauccacuccccccuacauccagcaccagggugagucuucuaaugcgguauuuucuugcacgcucuagcaguauggaucucaccagggcuucuuccagguuuucuaaauguacucauagacuauuaauacccucauucauuuucuuuuucagauaaaggaauugcagcacaaagagguuguucgauauugauguuuggcagggccacguuugaugacaugcagaaguguguacuccuggcugccagucccuuuugugcaagcuaagcccugugaagaccucagcccugaccucucuacaggguagggugcaaauucuccacccacuccguuaacgcuccaucgccagcagccuccugccucagcuucacuuccucaucgccauuguacauacucuguaugucagauguucuuagcugcuucagugucucagagaugcuuggguucucuucccuugggccucacacauggugucccucuucuagauguuccguucccuuccuuucucacugaggaccaacaauuccacuaccacccaccuugccccagcuuagagacccugguuagagggaccacugguguuuaagaauacaaucacugcaaagaggcacugucuguugguguguccacaugauacccuaaugcucucagaagugacccacaugagcugcaguagggaacugcugggcuccgaucucagcccagaacagaauacauuuaaguaaaccaugacccacgcucuacuggaggaaguugagugucuagaaagucuccuaaguuggagcuccuggauuaagccacccucuucccaucaucaccuucaucucccaacagccacaggccucccccaucgccugaugcucacccaccaccuggaaguucaugguggccgugcgugugccaacaucauugcuggccacacaagaauauaugccagcgucuuggaaguccacagcguugagacugagagcccggacuuuuuuauaauaguuaucuuggaagucacuguuuagggggauuuccagcuguagacagaaagaauugagaugacuuaagcaaucuaaaauuauuuaggaccugaauucaaauccuccaccuuuaaaacgauggucugccugugcacggcgagggacugaacucugagucucaauugcuucaucuacaaaaugggggagaauuuugguccccugcccucgguuaaagugagggaggguagacucacaaagcaagggcucuggacuggaccugacacacgauuaacaucgggguaaggaagcuaagagguagccucuccauuccuuccaggggccuccucaucuucauucucacucaaagucuuucuggacuagccaccaugucuccgugcuucuaagggagcuuaggaacuucucuuccugucagaagggaguacucuucaagcugcagcaaagguacaggguaauccccgaaaaguguuagauugccaccccuauccagcccaagucagcugcugcugcauggggucucaggccccucuucucuaggccacagccauguccccugcccagagagcuagacugaacagaagaugccucugugcugagggggauggacagacuuccccuugucaucuccuuccccccagggacugaccuuggugucuccacguuugaggauaacguugaaucccacuucggcguuaguggccgagcacacgaucugcgcagccuccccucgaauccgcaccagcuugcuaggcuccaauuuuaucugugggggcucuggguggacugagaccagaaacacaacccaugaaccuccaggcucgcugacacugcacccaacaccauggggcaggauacuuggucagggucccaucauucucccaccccaaacccugggaggcagcccugaucccuccauguucccaacaagcaagucacuaggagaguccgcuagcuauauuacccacgaguccuacuucccagcaguguuucagccuccuccugccucccaugucacccaccuccuggcagacaaagucaggucccucucuugcccucccccccaaccuguguaaacauucacccucagaauaaagccaguuucuggcuggucacaguggcacacaucuugacauuuagcacguaguaggcacaaguaggaguucuaggcuagccagagcuaaagagugagacaggggucucagaaaauaggggggguccaugggaugcuugcuguaccugcuaggcuuuguauccugcucugcagcucuacuaaccugguccaucacagggcuagcaucugcccucuuuccuauaguacuuugcuuucuaugcccuugaaugauggcugcucuuguacugucaauuugcugcugcugcugcugcugcuggugguggugguggugguuguuaguuugcagugcuguauauuaaacccaaggacagagguaccgaggguaacugcucaacugaguuauauccccagcccgugugcuugugcauguguguguguucaugcacgugugagugcagguggccacaguagugcccaugugaacgucagaggacaacucgcuauagucgauguucucucuucuacuacaagaguuccagggauccaacuuggucacuagccuugguggcaagugacuuaacauacugagccagccccugguguuuuugauacuggcuaucauuacauagcucaggcugccuaaugcugggauuacagauguccuccaccauguccaguuccaacuggugauccuuaagcccccaaguucuccaaagagcucauguguagcagaauuagccuccccacuaccccucacccuggccuuucccauugcuucuccuacacagucugcaucuaccuucuaaucugccuuucuaguaucaugucuagucuaaguagaugacacccuuggcuaucagcaccaugccugacacacagaaguuacagggcaagccuagaaauugagucuaguauccugagggguggagacagccuggaccaggacauauagaggucucccuaccgugaggauuucuaugccaaaugcucuuuggucaauuacccuguuuagcucaucacagcuggugucauggucagaguucaacccugcacaccucaccccacuugcccuggagagaaaugaguaguugaaagaagagagaagaauuguuuuuugucuuccccacacucaugccuggcuggguuuuucccauccuacauaccucgauucaccuuaagccagaugccaguggagguggauucccuaccauucaccauggucuugcacacguagguauugcugucaaggacuuuagccuugcggauaaugaacccucgccauggcgagaagaaguagaccguuuugcguaagaccugccugccccccucacgcaucagugagacacuguccuucagugcagggucagugaucagacagggcagcacagcuuccuggcccucaaccacugucaccuccugugccagcaaauuccaagagugggccggaucugggaagaagagaguucaaggugacaacugaacauucgugacgggaggaucaaaggccugagcaucugcccgaugcucuguacuggaccauuccagguuggcuucuagagccaggugcuccuaaggcccuuguugcuacaugaccucaggcaaaagauucaagcccaucgaggcuccggagaauggggguaaucauagcaucugccucacaaacauuaacauugcucuaggugcuuggucacggccaaugcuuacccuccuaaacugagaccugccaaacuaugcauguugaugccaggagcuagccccuccugcccaaccaauauggggaauuuggaguccucaccuuugacauacaaguggauggugguacugccugccauggggucuucaagcucgguacaacgguaggucccaguguuuuugaaggucgcguuucuuguggucagggugcuuccgggagauucaggguccaagguccaguagggagagauggggccaucccauuccacacugccauugcucacacaucgcagggucaccguuucacccggcucuacaaccaguucugggccacuaggcucgaugacaggggcccccugaccugaaggagguggcagacacaagugaggccuggggugcaccccagaugucccccaacacuggaccaugcuuuggaagggauagcucuggcucugguucuggaaugagucuggacccuucaaucagcuuccaacucuauugacaucugccacucucaggaggcucaucccugagaccuacgugggcgccuccuuagccacacauguaggcuucuccacaaagccacggaggcccagccuuuggcaucguuucccaucccaggagagggcaccaucaaucucguguacuaagcaggccaagccuguuuaaguaagacauguuucaaauaagccaauggagaaacagauggccaaguccugggccaucuuccuucacuugggaaagaaaaaaaaaaaaaaaaagacacaugaguucuuagcccaguagaaagagaucuuccaagugucuccugcugcccccacuccuaccacugggcaucgggucugugcgcugugggguggccugagaccauccauccuccuccucccuuuugucuuuucacccacaagugcagacagugagcacauugccccgccaugcuaagcuguucagaugccaggaaaccguugugucauccccugcuccaguacagacucauugggggcucagaaugccaugcucaugaaggagagagguacccagucugcugagguacccagucugcccucgcuucucugagccugcuggguuucuuggcagccaaucucuuuuaaggaaaauuugcuugaaggcgaaaggagaacucaaacccccugucaggucuuagggaaggaggcucguugccuguguggugucagcauuuuucccaggcuugaaauaggggggaaggggggaagugagaacugauucacagccucugagggccuggcaggcgcccccggccugugugggcggaaacacauugcuggcacccggcuggcccugguuuccgcccagccuguggcccuucgacacuugggcucucacuucugcuucccuggccuccuggccauuguccuucucacacacugagggacucuuggcaaggagugcuggguuucagagcacacugggcacagucugucugugcugugccacuguccuguuugcugaccccgcaagucaacccuuccuacacagugacagggcagcccuaagggcaucaagcccuuagaggacuucaggguuuccuacaaccgcucucagugggucacacacacacacacacacacacacacacacacacacacacacacacgagcccagaaauggaaagucucaucucacagaugauuucagccugguuuaaugucugcucacucugauucaaacucuuuggaaacauguggccugucugcccaagccuccaaccagccagauguggaacagaggagagcagugugcugcugcugauguagggcucuggcucuccugggcagugaucagcaggaagagggacgagcuauuucacccugggcucacauugacuauggcuagggacccugauagccauugacccucugagcaucagauauucuucuguccugugagaacaaucccagcggccaccuagagggcaguggaguccuccugacccaccugcuguucucaggccguacugcuaaugucccucuugggccugcuaugugguagcuaaggaccuuaacccuaaaggucacaggacacaucuuuggguuccagacacuucucccuucucccgggcuacucugcucugcuuaucuuugucuccugucuuggccuccaggaaaugugcuccgagagaagcuuccuucuuauuucugccuagccuguugcccuggauauuuacacagaacagggcugacgaauuccacguaagccgcaugauggucucacuucccgcuggcaggguuggcgggagggaagcacgcugaucacuaccuucccuuggaugagcacuugauggccacugaugcccugauccuggccauucuucaucucgcaucucccuucuggaauucuccccaugacccaaacuuucuccucuuuguacuugcaaaauggacucuuccaccaucagcuccaggaggcuccccaaccucuugcacucaugacuaccacucaaagagaagaggccagucucucucucucucucucucucucucucucucucucucucucucucucucucucucuuucucucucucucuuucucucucucugccacuaaaugcuucaacacuauuccagcuccuacagaagcccccauggucccacccacacaccaauaauuuuccagguuaaaaccccaggcuuuccacugauaucucccaacuucucuuccuuuuggagcuggauacagacagacagacacacacacacacacacacacacacgcaggcaugcagccacucacacacucugccccacaagcagcccucgagauaaagacugaaaagcagugaaccaaaaaucacaggauuuucuggcaugagaggaauaauaauugucucuuucuuagcugagucagggcugcauugacacacacacaucugucacaugcccuuuaacaguauucuuaagaaugugugcuuucucaugcauacauaccaaucccauucuacuaggaaugugccagugcacgagccagugagaucggcugagccagcaaagagccuuccacggacugucaucucaccaauuccccagggaccagaaugagccuguccuuccccagcaucuucccucaaggucuuuccaaauaagcaguggugugguauagaacaugugugugcuaggccagcuggagccuagaugggauccuugcgcugcacugggccauuuauguucguucucacccucagccagaccuccuccaagaaugggaguuccgaagcagcuucugcugcccgagaaguuggggggagagaccuaggaagacagugucuagggagacccucucuggccuuccccaggccccucucuagcauccuuccuugcuuauucauaggaucucucacucacggguguucuccuccgaccccuguccaaacuuuucacccuugaguccugggccaaaaaggccucuucuuuccucuacccugacccuuuucacccaagccuuccaagaaugggccagguccuaauuaaccacagccugcugggcuguccagcuggugggaccacucaaagaagaacagcaaaagcuauugagcagcccugacgcauaagauuuccucagaaaugcgaaucucaguccugaccaagaccuaugggaaucugccuuaaaggagacucccagguaacaccccaaagcgcugcacucaagguuagcccacuaccgcccucccucccaccugcagacgaguagauguggauggugguccugaaaauaccagggucacacucagagcacaccgugagucaaagccuaggcucagacacauccacagcacuggccccgggugguuccacccacucucaccuacucuucucgacagauaaacacaaaucugcacucuuaugccagagaagugaagcagagaaugaggcaucuacugcaggacagcgaugcccucuuugcaacacucccccagcaggacuccccuuuucuccccuuaccaugccaaacuguggccagcagcaggaccagaggaggccccaacuccauagccuccaggggauagcgugagccgaugcagguuggagagucggcugggcacggggcucccagcugcuaguucugugaggacgggaacagaugaacacguuccugucuguugcacuggcuccucuuccccuuuuuuuuuuuuuuuuuuuuuagguugccugaaagggaacuacagaauuuggaaauauugggucucuagaagaaaacaaagcacacacacauacacacacacacacacacacacacacacacacacaccacacaccagaggaagaggcagaaucuggggccaggcucaacugauccugaagggagaugauggaguuugagagacuuaggaaaccaccucuaaggacacuuaggagaggagucauaccca

SEQ ID NO: 12247 - RNA, 8242 nt, Mus musculus
cugucuguagaggcggcuugccacccgagcagagggucgugaaguuccgagcggaccgguccacagagguucaucuggagagguggguccccugcgaggugaaaggcgccgcugagacacgcccccaccccccguggugcaagugguucagcccaagaacuuuucauucauaaaaaagaccagacuccgagaggcgcgagugagucagaaccgcagccgccaacgcggacccuaccgaacauccagcccagggcauguaccgagacuacggggaaccgggaccgagcuccggggcuggcagcccguacggucgccccgcgcagcccccgcaagcucaggcacagaccgcccagcagcaggugagacuggccgaaucgucggggggggggggaccugaguuuggacagcaucagggaugcugggauuagucuaguuugcuccgggauuuggacuggggccccgagcagcaucugacucugguggucgcgaccgaggauccugcacguucuguguggucggggaaccuauguacccgguggccaaggggacgagcgcagcgggaagcgcgaauaucugcgaauuccccuucucgcucgcccguaucucccuagcugacugucuuucugccccuccgucuccguuacggucuuacauuuccuccuaucugccccuaauacgcugucccucuaaauaccugccccaucccugccuggacaggaucagagguguucuccaucuccaguuaauaacugggaccuggggucugggcacauagagacgggguccaucagaacucagccgggacagagaauucuuagcagccuguccgaggcuguccguguguugcucugguuguccgugucccuuuauccggucaaguccucaucucuuugugcgcaguauagagcccaugggccccaggcagugguuccgagggguuccuggagaccacgaaguguugggaugugcgcggggucaccugcccggccacacucgcgcuccacauucucggcacccgacgucucucacugcuggauaggggcacuugagagguugcagguguccauuuccugucgaggggccgcgagcacgugucgccaggggagggaaggagcugcguccguuucgccgagucacagcgggccgagucacugaggcugagucacccugggugccccucccuuccuggccccaaacggccccuaaggaccgacgaccugggagcgagagaugccccuggcagugcuucuagcccagaacgggggucacugagaugcugggucccccaguauugggcuggggacauagcuguccagacuugccuaagcaugugaggugcuuccuggacuggaggggccccacauccuuagcucacagagcuugaacccaguuuucucucccagaacgcugagcccccacccccaccgacacucaaucccaacacaugccucagauuucugcaagaaaaggaaggaaaggaugccagaccccuuauaggaggcuuuuacucucuucacuuuauuucauggacuuaaaaaaccccaucaauuuugaacuuucaaguuuuuaagucgacagcuaggcaugcauuuaaucccagcauucaggaggcagaggcaggcagaucucugggaguuugaagccaauuuggucuacaaagugacuuccaggucagcuagagcuacauaauagagauccugucucaaaacuuaaaaaauaaaaaacaaaaacaaaagccgauuaaaacucugauuucugagcuaugagagcuggcuucucaacagcaauggaacguugaaugauguuaauaacagggaaacugagacuaaauaacaugccccagucucaaagcccaucaauggccaagcuccaagcugaugcuggacucccaagcucuggugcuacaugucuauagucuuggugccugggagguagaggcagaggaaucgugaguuuaggucuagccugagcuaugugagauccugcccaccccacccccggcccccaaacaacaaauucucauccugauucucagaauugccuugggagcuagaagcugaaaguaugcccaucugugaggacugggucucaaaucuuaguuucuacuuacuagcugugggucuaugggcaacugcucuccugucugaaaacaggauuauggcagcugugugagucacuauuuguuaaauaguuggaacaguguuacgcaguccauacuugauuuaaaacaaaaaaccaaacuaucucugguggggaaacagacagacgaagagagacauuuugugaccugcccaaaaucacacagcuccugaacaaguaaguuucugguugccaaauguugcuccuuguggucucccaaaacugguaucuacacugaggugaagggagacagaaguccagccucuguccccgggaagccccucaguccacacagaccuuaucauuucccuucuuaucucucagaaguuccaccuugugccaagcaucgacagcagcagccaggaacugcacuggauggugcagccucauuuccugggacccacuggcuauccccgaccucuggccuauccccaguacagucccccucagccccggccaggagucauacgagcccuagggccaccuccgggggugcgucgcaggcccugcgagcagguaagaaacagcgauguuucacuuuccauagcccguagggguccuacuagacagggacaggaucuugcuacgagggaauuucuauucagcauugaaguuccugagaggccaagaaggagguaaaaggucaccuuugagucaaggaaggcuuccuggagaaggcuacacguuaaccuaaaccacggauaggauuugcguauggaagcugaaaagaaucuucugggaggaggguuggaggcacagaauugaggugaaggggacagaguguuaagugagcaugucuccacugucugacgugcacaggguggaaggaagccugaugcuggcuuuguaccucggggugacucuucuuuucaacagucacggaaucucagccuauuucuuuuaauuaucacaaaaagugagugggcagugguggcucacaccuuaaauuucagcacuggggaggcagaggcagguggaucucuggguucaaggccagccugguuuacagagugaguuccaggacagccaaggcuacagagaaacccugucucaagaaagggaaaaaaaaagugaaugggaaauguauuucaauuuuuccaucuuccaucagaggaagugaagcauagagggguacucacuuguccagauucauacaaaugugaguaaugagacaggacugguccuggccugaggucuacucaacucccaaagucagagcuuaaugagccacugucucaaugggagcucacagaaggcugcagagggagugagcugagaacuuuugccucccugaaugccuuucuaaaauaaagaaggguguguuuugguugguuuguagagguggggucuugagagccuccugccuucccaagugcuaggaguauagguguaugcuagauacccgacagggaugacggaucuuuuaggccauagcacuuucuuuccucucccugaaguacugagacugagucuagugcagggaggccuccauacuaaaaagcuggguguacccguaaucccagaacucggaaaaucaagacaggaggagccauucaagucacgcucagaaacauggagaguuuaaggucagccugggauauauaaacccuaucuccgauaaccaaacaacaaucaaagcaaaccugacuuaaguguuaaguaggaaagaauaugcuguaagucaucagccuggcugggggacugaccgccucugagggacugaagaaccugcuucaagcccggagcccugcacucaaccccuaguggaugcacacacagauccuugccaugauggcucgaagagggauggcaagacccugggagauaugugagauuggccagagaagagccagcaacaggcuucccagcaagggaacagcuuaccucugugaucagcuggggcgugagcaagaggcaagcccagggugaauccuuccuuuagcccuguccugaggagacaccuuuugaccacggguacuaguggguuggagcugugagcuguggguagguggcuuccccucggugugcucuggaacuugaacaaaucacucauccuuccugagcuuccucacaugugagugugcagagaucuggaugggugacucagcagcggcucuggcugcuccuuagaggauccggguuccaaucucagcacccacguggcaacucacuguccacaacgucccccaaagguucugaugcccucuucuggccuccaccagcacugaaugcacaaggugcucauacaaacacacaggcaaaauacucagagguaaauuuguucuuuuuuuucuuuugagacaggguuucucuguauagcccuggcuguccuagaacucacucuacagaccaggcuggccucaaacucacagaggcaucugccugccucccaaguguugggaccaaagauguaugccaucacuauaagccuuuuuuuuuuuuguaaauuuuauuuaugaaugagugcuuccauguauaccuucaugccaggagagggcaucagauccuauuauaggugguugugagccaccguguguggcugggauuugaacucaggaccucugaaagaggagcucuuaacugcuaaaacaucucucuagccccagucuacauauuuuaaaucuuuuuuuaagauugauuuauuuauuauacauaaguacauuguagcugucuucagacacuccagaagagggcgucagaucuuguuauggaugauugugagccaccaugugguugcugggauuugaacucaggaccuuuggaagaguagucaaugcucuuacccgcugagccaucucaccagccccuuuuuuaaucuuuaaaaaaaaaagggggggggccuggagagauggcucagccguuaagagcacugaaugcuuuuccagagguccugaguucaauucccaacaaccacaugguagcucacaaccaucuguaaugggauccaaugcccucuucugguguaucugaagacagcaagggucuacucacauauguuaaauaaauaaauaaaaauuuaaaagccaggugguguugguucagacagcagaucucuguuuaaggccagccuggucugaucuacaaaccaaguuccaggacagccagggcuacacagagaaacccucuaaaaaaccaaucuauguagggggugcuggugaaauggcuccguggguaaagguacuugcugcgaaauuaaugaccugaguucaauccuugaaauccacacaguagaaggagagaaccaaccuccaagggugcuaugacacacacacacacacacacacacacacacacacacacacacacacacacacgacuauauauaugaauauaugacucuagccaggcauaguguggcacaugccuuuaaucacaguacuugggaggcagaggcaggugaaguuugaggccagccuacagagugaauuccaugacagcuagaacuaugaagaugaacccugucuuuaaaaacaacagcaacauaaagaaucuauguagggaagcuggaagggaugcugauacagucugcaauccuauuacucuagagguggaagccaaagaaucagggguuucaggccggucuugccuauacacugagcuaaaggccagccugggacacaugagacuuugucucuuuuaaaaagacaaaacaaggggguugguuagauggcucaguggguaagagcacccaacugcucuucugcagguccgaaguucaaaucccagcaaccacaugguggcucacaaccaucuguaacgaaaucugagucccucuucuggagugucugaaaacaacuacaguguacuuacauauaauaaaaauaaauaaaucuuaaaaaaaaaaaaaaaagacaaaacaagccagaugaggucugugaguuccaggccagccuggucuauaaaucaaguucaaggccaggcagggcuacucagagauucugucuaaaauacaaagaaacaaaacuacaaaaagcagaaaaaggaaucuacgaaagggcuggugaagggguguaacucagugguagagcauuugccgagcuagcauguaccaagccauggguuugaucccuagcacuaagcaaaagaaaaguccuacaaagggcuuuguuggcauaguagauugauucccaguagcuuuuggcacucaagagcaccuucuacaauucacagcuccugggggaagaaaucccaucuuccacagaugaggaggcugagaguccugugaaaagagauaaucaugucucauacacucaggagagaaggcuacuucugccugagaaaugaaaaggcuuccuggggucccaacaucuuaguccaguccuaagaugcggaagggaggaagaucaaaguuuacagagagggaaagcauuucaggaaagaaaccagcaguaaagcuaggugugugugagcuggaaaugucaccaaugagaugacaagcguccgguacagagaagcaacuguggaguguugggugguggcaccuagacuacagacugaaggaaagcuggaugaccagcucagggcagcugguggcucagagucagccucauugucucccuucuucuaucccaaccuagaucagcccagaggaggaagagcgccgcagggugagacgcgagcggaacaagcuagcagcugcuaagugcagaaaccgaagaaaggagcugacagacuuccugcaggcggugagcaucauccccaggcccggacccacagagccccaagaggggucucggcucccaagaacacaaaagacccaaaauuacuccucaggacucugucauccucccugccuguggggaaguccuggaaaaaggauaagggaaaguggcuuaaauauuguuugucgggcuucgaggcagagucgaagaugguaggcagcaauucuccuaagaugcccccgucugaugggagucauggccauuuucucccagaggcucacgggagggaguugcaguccagacuuguuggggaugacaggcacagucccuacuccagccugaggcuuggggaucuuuagccuucauuuuccuaucuuucugcuaauccuguaaaggagaccgacaaauuggaggaugagaaaucggggcugcagcgagagauugaagagcugcagaagcagaaggaacgccuugagcuggugcuggaagcccaucgccccaucugcaaaaucccagaaggagacaagaaggacccaggugguucuggcagcaccagcggugcuagcagcccaccagcccccggccgcccagugccuugcaucucccuuucuccaggacccguacuugaaccggaagcacugcauacccccacgcucaugaccacacccucucugacuccuuuuacuccgagucugguuuucaccuauccuagcacaccagaaccuugcuccuccgcucaccgaaagaguagcagcagcaguggcgaccccuccuccgacccccugggcucuccuacacuccuggcuuugugaggcacccagccacaucccuugcuggugcuacuccaagccauccccuuucucccauugauccagcaggccuggaccauacccuugccccaaaccagcagaucuuuuaucucuuccgacuagaacaaacacauuaugcuuugauguagagccagcuuggaggggauccccaaagcugcucacuguuuuucuagagcuggccuaucauaauuugcacaaaauuagaggaaaauauguucccucugccagagaacgccuggcagcccagacuuuguagauccccagggguccuuugacacccuuaccccuugcagaccacuuucccacaccacgucacuuucuucauguuauccagccuacucuacaccuagacagaaggugcccuuugacuagccuagaacacuaacucacacagcaucaacagccagcagcaccggacauccugcaggcuccuccugaauggcacaacgcaggaggcgccaggggcuucugugaggagcggagcugcacucccuagcucugagaagcgcuuagcuucaggguauccgagccuccaccgcaagggcagcugcuauuuauuuuccuaaagagacuauuuuuauacaaaccuuccaaaauggaauaaaaggcuug

SEQ ID NO: 12248 - RNA, 10642 nt, Mus musculus
ggcggggccgggaacgggaccgggaccccgagcgagccgcgcugcggagcuuguagucgggccggccucgggacaaacagccucggcguccucccgccgcgcugcgguguccccgcccgcgcgcccgccgcacaccuuccgcgcccagcgugagucgcgcaccugcucucggccccccacgcgcggcgguggcgguggcggcggcucagcgcgcaggcgcggccggauuccgggcagugacgcgacgacgggcgcgcgccgcgcauuuccgccucuggcgaauggcuuuacuuuagcgcgccgugggcucagcugcgaccccggccccgcccccgggacccugaccauggacggugaggcugcccucuggcucgggggauggcugcccuagagcuccggggccugcggcggaaucuccccccuccccgcgccgucuuccgccccuuucugcgccgcggguugcugcgcagggagcggcaggccggaugguggcacggggcggggcgggcugcgagggggucugacucaguuaccccucucaguggagggcgccuugacucagugucccuccuggguggggguacgggugaaucuugacuccguuuccuccggcuccccccacccccgugucgaugcgauuaguucuggcuuccuuuccguguaaggaagaaaguaucugacucaguuuccccagaagaggagaggaggguauuacccccuccucagugucacuuaugaacguaaaacaggcacugacucaguuuccccuggcaaaggaaugccucuguguccccuuucucuaguuccccggccucugucagggcagguuucagggucuuggcucaguuuucuuggaagggagggagcuuggcucugucaggccuucgcaggugagggugggcacuggaguuuauugacaaugugccuugucuuucccuuucagaucuguuuccccucaucuuucccucagguaaguuggaccauccauccucaguagucaggggcuguccuggagucggggccguggggauagcaccugauggcugacugugucacccacagagccagcccaggcuucugggccuuauguggagaucaucgaacagccgaagcaacggggcaugcgauuccgcuauaaaugcgaggggcgcucagcgggcaguauuccuggcgagagaagcacagauaccaccaagacacaccccaccaucaagguaagcaagagcccccaggggugucgcugggacacagaugugguggaacgcacugugcagccccagcagacuugccuccuggucaccgugcccugugucuaagagccagauuagggauugcuggccacuagaguacucuguacuuuggacagaucaauggcuacacaggaccaggaacaguucgaaucucccuggucaccaaggauccaccucaccggccucauccacaugaacuuguggggaaggacugccgggauggcuacuaugaggcugaccucugcccagaccgcaguauccauaggugaguucccuaugggcuggggguggugugagggcaggguaggagcaggccggccaggcagcucuuacaguguugcucuuuucuaaacacaggcagaauccagaguucuuaacucugucuccaguuugcaaacagaccuccuuugucuugaauucucuaacaguugggaacuccuuaucuucuuagagccacaaacccuauggcuggacaggccagccucuuagccucuuggaucagaaagauauccaaauggacccuccuagagcuuaaauaccaguugguaaaaccaggcgauaauuguacagacagauagacgagauacugguagagaauuauaacuuccaugauggaaagaaaacacaguuauaaauuaggaggaggagucuggucucaggaagcucaagcuggccuugaacucguuaggguuccccugccuccucuucucaacuccaggggaauaggcauguagcaccguguccugcugcacaggucucacgacuuuggguuggaggguuacagaaggccucugugcuaacucuuaaauggugagaaaaagcagacagacccaaaagaacauuccgugcacgagaaagaaguacaaaaaaaagcaagcaagcaagcaagcaguacgaugcccuuggaaggggaguacguuccauuucgugugcuuaggucugggaaaggaagccccuguggcugagguggggcacuggcuuggaggccugcgagggccagcucccucagagacuugccaguggguaaggagugggaagccuagacauaccugagagcuguggaguugggaggcaagaaggggcucugcuggagacacaaaacuaauaccugaggccucagcuuccagaaccuggggauccagugugugaagaagcgagaccuggagcaagccauuagccagcgaauccagaccaacaauaaccccuuucacgguaggagcaaggggcaaagacauugaucuucguguggugcaaguaucucugucaccuucccugggccucugccgcucaucucccuccauggccaacccagcagcaggaguggaaccuugcugccagcuuggcacacacucacacucugccguugagagucaggccuagagagggcuccuggagagccgugauggaucuagggucuuccuccccuuagacuucuguuuuacaucuccucaaaucaccuuccucuuuccucagagcucccuggcccguccccccucccccacccccaaugccuuccaccacaguguuuuguuuuuuguuuuuguuguuuuuuuguuuuugacaguuccuauagaggagcagcgcggggacuaugacuugaaugcagugcgccucugcuuccaggugacagugcgggacccagcaggcaggccccuccuccugaccccuguccucucacauccgauuuuugauaaccguaaguggccggcugcaguagggaugagggcgggcuugggaacugaauggggaccgggugggugaggccugggagaagagcucuggcuuccuucagucauccagcgccuuccagcugugcugcagggggugggguggagaagacccagagcugcccugugacugaagcggccaggaugcccaggagccuggugggaagugacugcuucccauaucugggguugggaagcuggucugccaagaacugugcucaggacuuuaggaaacaagcucucagagaccagauccuucuagacagcaggaauucagcuguagcagcucccaggaagcucucagaugaccuggcugacuuugauggauugcagucuuuagcagcaggguaaauuaaaggaaaaccaaagggcuucagaguccuaagaaccggaagccaggacuaacuggaagugaggcgggaugaaccgaaagcugaaacugugccgcuaagguggagggcggcagguguggucagaguguguccucuggacuggaggaucucuggagaacagggacauccggccuucagugucccuucaccuagagccaugcuacccguacugcagagagacugaucgggaauugccugacauagagagcagacagcagcggucugcagaaguguggucagcaggcuguggccuggacguggcgggcugggcguggcgggcguuagagcuccugcaggguacccugagaccgcugauguuucaggggcccccaacacugccgagcucaagaucugccgaguaaaccggaacucugggagcugccucgguggggaugagaucuucuugcugugcgacaaggugcagaaagguacacacuggacucugcacggagaggggaggggugaggcugagcggaggugaugagugccagcuaccucagcggcuucagggaaagcaggugaugucacagggaaaaacaucagguguugaggacaacaaccaguugggucacacauacuaacccauacugccacugucuccugcagaagacauugagguguauuucacgggaccaggcugggaggcacgaggcuccuuuucucaagcugaugugcaucggcaaguggccauuguguuccggacuccuccguacgccgaccccagccuccaggcuccuguucgagucuccaugcagcuacggcggccuucugaucgcgagcucagugagcccauggaguuccaguacuugccagacacaggugugacagccgccgcugcggagggagggcagggccacagccgcugcugcagagggcgggaccaaagccgcugagccccagcuaggagagagaccagggcugggugucugaggccagcacuaggguuuagauaugcuguaguucauagcguguaaugauuucugucaaaggcaagccacaugguggucccaucagacuacacugucuaaugacaaaggugucucaguguguguaaguacccuuaagacauuuguguaauaagcugggugcuccagcagcauguccaaccugagaacugguggcaugguggcucuaucaagguguuccggaagcuggccauggugacuggcccuuaggcccagcacucaggaggcagaggcaggcaaaucucucugaguuugagaccagccuggucuacagaacaaguucuuggcaagccagggcuacauagugagaucuugucucaaauaaauacauaaguagauggaugguuggauagaugagagagagagagagggagggagagagagagagagagagagagggagagagagagagagagagauaagguaguuggagcuggagugguggcagaguaguuaagagcacuugcuguuuuucccagcacccacaugguggcucacaaccaucucuaagucuuauuuccagggcgucugacacuucugaacucuacaggcaccaggcaugcacguuuugcacauacacacaagcagguacaacagucauacacaaaaauaagccuugaaaaacaaucaggugaagaguggucgagcuuugcccucagcaugcucaugagcacaucuacacaugcaugcaccuccaugaacacacacacaccacacacguguacacacacacuauaauaagagauguucauacaaugacagauuugcuaaacaacaugucuuaggauguguccccguuguuaacauuuaguuacagucagaaucugcuucuuauuuaacagugacacccaccgugcucagcucugucggcuagaucugcccagagugagcacaagcgaacgacuugacuuuaaucucucagcacuuuucaugggaagacuuaacucaccagcaguucgaggcagugguacaucugagccagggucacuuggcucuauggacuuuuugccaccuucugucucuugucacuaccauaugacccagcuucauuuugcucaaggcuuagugcaccacuaaagccugucccgggugcuguacauaagaaaucaagugaggcaggagccggagggaugguuaagaacacuggcgacacuuccaguggaccuagguuuaauuuucagcaccuacauggcaucugguaaccuuguauaacuccagucucagggcuuccaugcacaaggugcacagacaugcugacaaaacaccauacacauaagcaaagaaauauuuguuuguuuguuuguuuguuuaaugauuuacuuauguaugugaguacaaugucacugucuucagauacacccaaagagggcaucacuacagaucccauuacacaugguugugagccaccauguggguguugagaauugaacucaggaccucuggaagagcagccaguguucuuaaccacugagccaucucugcaauccuguuuuuuuguuuuaaugagacagauuccuuccucuucaccagcucagugaggagacagauguguaaaugaugugccaagugagaaaacaauggugcagaaagccggccgagguggcguuuaccugggaggauccacaaguguaguuuucauucuaguggccuaguccuggaaggacagaguuguuggggaauacacagcuggcucagggacaucgugguggaaacugucuucagacagugagcaagcccaaaagauggcccuguuaagcuuagucauaucugagguuucauucugaaagcagcagggaugcaucuaagauuucuuucuuucuuuuuuuuuuaaagauuuauuuauuuauuuauuauauguaagugcacuguagcugucuucagacacuccagaagagggcgucagaucucguuauggaugguuuugagccaccaugugguugcugggauuugaacucaguaccuuuggaagagcagucagugcucuuacccgcugagccaucucaccagcccacaucuaagauuucuaagcagagauuugacgugagcauaucuggaagcucagccuggcuucucugaguagaguguuagagauggagaggggcaggggcguagcuuaacgagggcuugccuagcauguacgaggccuugaauucagucccuaguaacccucaaaccagguguggugcugacacuuguaacccagcacuggggaggugaagacaggaggaucggaaguugagggcuagucucagcuacauaggaaguuugaugcucuccaaggcuacaugagaucuugucucaaaaaagacagaguugucaagcugaggaccucuguuuaacccacgugaucaaaggagacaguucagagugugacaguucaaugugugacucucacacauugucucugaccucuuguugcaacacacaugcacacaugaauguuuugggggcuuugggguuuuuuguuguuuguuuguuuuguuuuucgagacaggauuugucugugcagcccuggcugucguagaccucacuuuguaugccaggcuggucuugaacucagagaugcaccugccucugccuccuaaaaggcauauaccaccacuguuuggccacacacgcacauaaauguaauaaauuaggguguuuuuuuuuuccuguggggguggggugggggaauugagacuucaacagccaaaaggaauccuggcacuuuuguuguuuuuuguuuuguuuuugagacaagguuucucuggauccugguacuuuuuaagguccccuuuugaugacuaaaucucugugugcuuacucaucuccaguugcuaguaggugcuuggcaagugguguugaguuaguauuggaggauugaaagaaaaaaugauguucagaauuguuccagguugcaguuugggugccaggacagacagggagacacaggggaaagaagcagugcccuggugugaaauacugcuucaccuagacggugugcagcugagguggucaaauaauucugaagcuucaaacuaaaggaagaagccauacacugagcugagucuggagccuucggccugugaugcucugcccacagcacuucccucuccaccuacguggaugcuucugugagcagcucagauggcgugcuaggcucuugucccccagagcaggggucaagacaaccaacaaggcuggcuguguggcccacaccuuuaguuacagcacuuuggaggaagggcagugaauuucagugaguuugaagucagccuggucugguguguguaguuccaggacagccaggacuguauauagugagacagucucaaaaaaccaggggggaagaggauucaaccaacagacccuucucugaaggucacacaucccuucuuaacugguugggagacuaggucuuaggaaacuaugacuccacuacccuccuggagagcccauagaagggagaagugcagcccggcuaaggagaguaaacccaccauccauauugcuuucccagaugaucgccaccggauugaagagaagcgcaaaaggaccuaugagaccuucaagaguaucaugaagaagaguccuuucaauggugagaugaggaaagccugagggagaggagugggcaggccagccaaguccuagagucagugagaggacacccggggucugaaagcugacuuagcuuuugcccuguaggaccaacugaaccccggccuccaacccggcguauugcugugccuacccgaaacucaacuucuguccccaagccagguaaggaaguccuuuucuuuuucuagaaugagggucucauuuguucagacugaaguaguaucuucuagaaggggaccaaauuggucucaccugcagaguucugaaaucugcucuccauggggccuggacuucucagggggaggccggggucucugccaggaccauccagggcucuugucacagacugauaaacucaaggcuuugaaaguguggcacaggaacuggccauuuccuaaagucaguagaagucagaagccaugcuccugucaaacccugagcccuuuauucccugcugcucaagagaguguggcaggagggucacaaguucaaggccaucuuggacuacaagguuauuaaguuuaaggucaguuugaagaacccugucucagcuuuaaaaguaaaagcagggauacgguacagcucauguagagcgcaugccuagcaccagagacccuagauucaauauuugguaccaagggacuaaauaaucccugaguuggauaccuugagauacagacauuggaaaugucucugcccucagcucuccauugaauugagaaagaagaaaucaccucuaaaguaaucaguuguggggcuagagagauggcucgguuaaaggcacuggguucucuucucagcagcugucucuagcuauagcugcucgccaagggcgcugcacgcaugcagugcacauacauagaagcaggcaaaaugcucacaaauaaaaacauuuauuuaaaaaauuaagcugggcugggugguaguggcgcaugccuuuaauccuagcacuugggaggcagaggcaggcggauuucugaguucgaggccagccuggucuacagagugaguuccaggacagccagggcuacacagagaaaccgugucuugaaaaacugaaaaaaaaaaaauuaauagguuguggguucuggugcguggcucacaagagugacagacucccaccacugagcccgugcuccaugguucauccucuucgcuggcuuugcagcuguaacauggugagagcuuuaugaccgcaguagcuagggaacaccucacuguggcccuuggaaguggacccuacaggccuggucagauuuugguucccagaaagguacugauucuaagcaugguagagcugggucaggugguggcagaggggccguguaugucucucacugccucugagccuuuguucuuugucucucucuccagccccgcagcccuacaccuucccagcaucccucagcaccaucaacuuugaugaguuuucccccaugcuguuaccaucagggcagaucucaaaccaggcccuggccuuggcaccguccucugccccaguccuugcccagaccauggucccuuccucagccaugguaccucuggcucagcccccagcuccugccccaguucuaaccccggguccuccccagucccugucugcaccuguuccaaagagcacccaggcuggggaaggcacgcugucggaagcccugcugcaccugcaguuugaugcugaugaagacuugggggccuugcuuggcaacagcacagacccaggaguguucacagaccuggcaucuguggacaacucagaguuucagcagcuccugaaccaggguguguccaugucucacuccacagcugagcccaugcugauggaguacccugaagcuauaacucgccuggugacagggucccagaggcccccugacccagcucccacaccccuggggaccucggggcuucccaauggucucucaggagaugaagacuucuccuccauugcggacauggacuucucugcucuuuugagucagaucagcuccuaaggugcugacagcgacccugcucagagcaccagguuucagggcacugaagccuucccgaagugcguacacauucuggggagugugcuccagcugcccccgacuuguuugggugaucucucuggggcggcacguuuuacucuuuaucucgcuuucggaggugcuuucgcaggagcauuaaccuccuggagacggagcugggaggacucggugcaucccuguguugauagcuccugcuucgguagggaacucugagauccugcuuccaucuccagcuucuagcacucuccuagagagggacagacuggagccauggccuuaggccauauagccuuacuaucaagugucuuccuccacgcggauuccuguacaccuugauccaaagcagugcucccaagagcagcuccuacguggugcugcccgacaccagcacaugaggggccgcucuucuguccuguggagcuccugcccugccagcucuccaugcugagcuguggccaaggggaacaggugggauguugcuggccgccuucagaaucggggggaguuuagucugagacaucccugcucccccuuuuuucaagugccuuaauagcagggcaaacuguagagucaggagggcaggcuagaugcucagccacaagacagccuuuacugaaaaagcuauuggacucuugcucuuucuagcucugaacuaauaaaugucuuaucacgcug

SEQ ID NO: 12249 - RNA, 10040 nt, Mus musculus
ugguacccggaccccgcccccuagcuucugucugcaggccccgcgcuccggcccggggcagcguacgcacaccuauccuggcagcagaggccccuggagccccacggcucgccuuccugggcgccccgucccuucuuccgcacccgggcggccauccugccguaaaggagcucccgaaauggcgcgggggguuguccccaagacgggcagugcaaggccuccacgaucgggaagaaggagcuggucuucccaucccggucacucgguccagggggagcaauaaccaucgcaacgaccauugcauccgacggccgagcuucagugaacggcucuauaaguaaucacuaagcuguuuacagaguuuucaccagcuccccagggaggugucauuaaccccauuuuacaggagggaauucgggcccagaagggcuggaggacuuaucagccgaagcaggccuccaggauccaaaugggaaccccaaagcagcccucgcuggcuccugcacacgcccuaggcuugaggaaguccgaucccggaauccggagccuggggagcgacgcgggaggaaggcgguggagaccagcaggucggcgcaggggugggaccuggcuugggguggccccgccuccaggccgacccgggauuuacuucgaaaacugauugggucagaucugugacaguucucgucgcccaggaaacuagggccgggcgcccuuagaacuggagggaggaggcaggcccgggucaggggccucgagaucgggcuuggggugagaccuauucccgguccuaacgggcagggggagcgcacuagugucuggacagagcucugaagagagauuuaauauucgggcgacagccaggcagacugagcagacaaaugagggauugggaagauuuggggaguugagcuaccguggugggagagggagacaggaguaccucuccucugcuucucauaaacacuguuugccuagcuguguagugaguacuucuuaccuugucucuacagcccagaguauguuccagaucccagaguuugagccgagugagcaggaagacgcuagugcuacagauaggggccugggcccuagccucacugaggaccagccaggucccuaccuggccccaggucuccuggggagcaacauucaucagcagggacgggcagccaccaacagucaucauggagguagguuccucacuaccauuaucugccugucccaugcccccugacucucaggugccccuuacguugcuguugcagccauacuuccuaaagauucuugggaagccccagauagcuccuuucaucagauugcuucuucuacaaaccaucacugggcuaauucacagagauguaugguaugcccuuaaugauuaagcugacucacugaaugcugaaaacagacccccuuauuauguccccaagaucagugggagguaagcagagccccaaagaagugacuuuucucuuuauuuauuuauuuauucauuuauuuauuguaugugaguacacuguagcugucuucagaagagggcaucagaucccauuacagaugguugugagccaccaugugguugcugggaauugaacucaguaccucuggaagaggagucagugcucuuaaccacugagccaucucuccagcccaagaaguggccaguagguccguucguucguucguucuuucuuucuuucuuucuuucuuucuuuuuuuaaaaugauuauuuuuugguuuuucaagacaggguuucucuguguagcucuggcuaucuuggaacucacuccuacagaaaaaccaauaaauaaauaauaauaauaaaaacuaauaaaaaaggaagaagaaagcugaagguuaaaagaagggaugggggaggggacuggaaaaauggcucagugguucagagcauuuacuaccaggcuggccuugaacucagaaauccucaugucucugccucccaagugcugggaucaaaggcgugcaccaccgccgcccagcucaguagguucuuucuuacucuauggcucgccuucagcccgacuauucuugcccagaugggacaggcaggugacccuaagugacaaacaagagccgugugaagcuggaaagugugagugagugccaagauggaaggagaggccuuggagauacugguuauacuccccacuucccauugcugacccuguauagccagagaaaucugagcucaaccagguuugucacuggcuccauagaacuuaacuuaucccuacccccucauguaucccuggacugucucaaacuucuauacagcugagacuagccuugaacuccugauccuccagccucuaccuaccaaguacuaggaucacaggucaccaugccuggcacuccacuuccuuuuuuaaauuauuuguauauguaugcccguguaaaaugcacaugugcaagugcaggcuuggaguccagaagaggguguuggauccccuagagcugggguuacagggggcuggugagauggcucaguggguaagagcacccgacuguucuuccgaagguccagaguucaaaucccagcaaccacauggcucacaaccauccguaacgagaucugacucccucuucuggagugucugaagacagcuaaaguguacuuacauauaaauaaaucuuuaaaaaaaaaaaaaaaagcuggaguuacaggugguugcugggaacugaacucacauccugugcaagagcaauaaaugcucugaaccacugagccauuuuuccaguccccuccccccaucccuucuuuuaaccuucagcuuucuuauuccuuuuuuauuaguuuuuauuauuauuaauuuuugguuuuucaggacaggguuucucuguauagccuuagcuguccuggauuacugugcucaaccaggauggccucaaacucaagagauccgccucugccucucaagugcugggauuaaagauguacaccaccacugcugggcauaucuccagauuucuuuuucuuuccuuuuuuaaaaaaguuaauuaauuaguuaauuaauuaacuuguuuacuuaaugugagaacauuguggcugucuucagacacaccagaagagggcaucagauuccauuauacaggguugugagccaccaugugguugcugggaauugaacucaggaccucugaaagaacagccagugcucugaaccccugagcugucuuuccagccccacggaucaaguuccccauggcugggacucaccuuggggccugggaaggccuuguucugcuucagccucaccaugagcuccacgugcagcugcgaucugcagagguggcuguggugggucugccugggagggcagcuccucaaaguauaggcagaccccacuuagcugcagcagcuuguggaggaaggcaggcggcuggugcacguccacagguggggccuggcuggggucccgcacugcuucgucacaguacuccagucugcagagugaagggcccggccuuguccagacaaccccaggcuagaagcccccucuuuagagcugucccagcaacauggaacugaggaaccuggcuucugucuugugguugaggggugugcuggucuagcccccaaaagaggagcugccuugaguauuacaucuacucggugcuucaacaggaaggaggugacaauuggcuggcaucaugcuaggacaaagugacagggucugggaugagagacuggaaggaaagguggggacacucauaggaggaagggcaagccugagguuugaagugggggagggacacugacagcuuugcaaacagcuuuagggagcgcaguagaagcagggccugcugcugggaggagcagagguguaccccagcuccaugaaggagagcugcugugaaugaagacgaccagggcaaacagccauggggagggaagguagcugaacguguguccucuuugcuucccucccaucccaugcuaggcagagacagacacucccugggccagugugugggguguguguguguguguggcagguggugauggaauucauaaacauuugauuuacuuuucaguggucucaaaugcagaacuggguaugguaguauaugccgauaaacuuagcaccaagcacagaugaguuuggggauggcuuaggcuacuuagacccugucucagcaaagcaaaagcaacacaagugagaucugcaagugucagaccugccagagcuauggaccuucucugugugccaucucugugugcacagucagcucacccuaguccuaccucuccugacuaucugcaccaagguccacugggcugugggcauccauagggcaggaacugcagcacacagggacugcacaguaggaagagaguggggaggccauaagaugggagaagcagccggugcuggccucugggcuagauugcuguagccgaggaggccuucuaagugcagacugagaggccaacugcuucugccuucauuccuaaacugugaaaugggaauagagcugguccuacuucucagggcuccgguaacugcuuagaaacugccuggcacagaggagaccugauggaggcccuaggcccgaccaccacccuaguuguggguaucauuguugcuguugaguuggcucauucucugcagaccuaggguuccuucaguaguaaguacaauuuaugcagugccuuaaacauccauugcucuugccuggcaaacauaagguauagguuagacucaggacagaggugacucgaagguauacagauaaacaauggggagccacugaagguggcauaguuggauuuuagaacagggauuuagacauggaccaaauaaucccugugcuuuuguacagcuccugagcuaggaauauuuuuguuguguuuugagguuuuaagauccagguccagggccucagcuuacuaggcgaggacucucucacugaaccacaucuccagucuuugucacauuuggugagaccgagucucacugugcugcugcccagggugaccgcaagcuccugggcuuaagcaaccaucuggccucagacacccaacuagcaaguagcugggacuaccaguuuauaccaacuucaggaaauaguucugcuuuauuuugagacagaguuucucuguguagcucaggcuuuucaggaacuagcucugcuagccuugaacucacgccucuuacccccaggggcuuuggacuaagggcaugagcuaccacgccuagcugggaacaguuuuaucuauugaaguggcaaagggacaaaauccagggaacaaaguauuuuauuauaacagguaagaacugugugaaaaucacauuucaguguuacugagugaagcaguggugggcacaaagguguuuucugggacauuuugucucugaauccagguaccagcaagcugcgcuguuguuauagaggcucugacagaauguuuggcccgagcagggccagguaaggccccaggcuagacucuaaaaugccuuuccucaaggcuacugcacaggucugggcaggccauuguggagacgaggcagacagaguggucugcccugccugcgggcagagccucacugugcuuggaagcgucugggaaacaaugguuuuguuuuuauuacucuccucccuggucaccacaguuuuuuggguuuguuuguuuguuuguuuguuuuuaacgaguuauuuuguguguauaaagacauguauggagaucagaggauacuuuuauuuauuuauuuauuuacuuauuaauuauauauaaguacacuguagcugucuucagacgcaccagaagaggucaucagaucucauuacagaugguugugagccaccaugugguugcugggauuugaacuucaaaccuucggaagagcagucgggugcucuuacccacugagccaucucaccagcuccgaggauacuuuuuaggaguuaauuugguucucuccucuucucucuuuagucuuaggaauugagggcuugguggcaggcaccuuuccaugcucucauccccuaggcacucccaccgauuuuagaggaguaugcuaggauucuucuugcacuguggacuugcugguucagccacacccacuuacccagaagcccuguggguaaggagcuaaaggugccuaucaaccgguuucucgcugcuucccccaccuggggggggggggggaugaggcaggccuaggccucaccuuacccacccucuuuguccuaguaguucacagaaucuccagguucuuucccauaauuuuuaaaauuccauuaaggggcuggagaugcagcucagacuguggaauaucugccuaagugugcgugcagccucagcuucuagccucagcuucuagccucagcaccacaugagcugcugugggggaaggagcaggaggaccagaaguuuaaggucagcauuucugccaccugagccccuuucucaucagccagcacaaaugcucugacacagacggauggcauucugccgcugaggugcuuggcauugcugagugccuuuaguaaucaacaguucuccauggcacagcauggcucuuggcauggcugacauuagucagggcgggagaacaugacuccuccuaguugggccaccaaggugguuugugguacugcugaagggggcugggacaugaacaaaacacagaccccagagucagacugguguguaccagucuuugucacuguuugcccucguuucacuuccuguaaaaagaggagcugccuccauaggaguuaagaacuaaaugaacagauccaaagggaucguccagccuggccuggucagcauucugacugacugguugguuuguaaggugcugggauggaaccuugagcauguuaagcaaggauuuuuauuucuuuuguguuuugagauugucucuauguaacucuggccauccuggaacucacuuuggaccaggcuggccuugaacucaagagauccaaagaccucugccuccagagugcuuggauuaaagcugagugcuacaaugccuggugcuaaacaaggauuuuaacguagcuucugaaagcagauuuguucaggaaggggugcgggugccacguguccgggugcuagugggggcucuuuuucccuuuccauggauuccacggccccacucagcucaucuggcuguacugagugcuccuccacuggcugagcaaucucaccagcccuuguuuugcuucuucaugaaggaggggaggcugagcucaaaccaaggccaccuggaagacauucgccuugccaccaccaguucagcacacaaacgccuugauuccagggcucagguucauuacucggugcugaugggcugcaccagcacaaggcaggcauguuccuuucggugucagacuucuauguaagaugggagaacuccacaucugccacacaggagccaagaaaccaauggaugcucaaaggacaggguggaguggugacuaugagacaggcugucccugugccacagacaaagacugaggugacaaggaacuggggaaauggguccaagaucacaaaagggagcccacccagcuacugagucuagugaaagcacucuguaggugagcaaugauauuggguccuggccagaugcuuggagcagaccuggccacgucuuucauaaggguccccccccuuaucucugcuuuuugucccgugucugcagcugggauccuacagcugagcugcagagucuugacagcugaccuuugagagagggaagcaaauuuaucaaccccugaacaugugggugauuuuaccuccucccaagccugcagauaccugggugugggcagcaggcugugcuuagcucuggacucugccccuaggagugguucugggucuucacuggucuggacagagggguacagauggcagacgucaggauggcacauaauacccagaccagaggagaucacccacaaugcucuugcugcucacaggacaugucuacacaccgaugcgaccuucacacagguggggugcguuaguauguaggcgaggugagacugucccuucaugaagagaaccucaguaaaagugaaggguggcugggcaaggcaagagcugcacagccugauaggcucuggguuccaaacccagggacuucgggccucaggccuuuaacaaccauguuaaccugaggaaaugugaccucucugaccaccuguguagcuauugugugcaugugucuucguaggucagugucccccaucccaccccacacuuuuuuuugugaggcaaaagacaaguucuccuguagucuaggcugaccuuaaaccucugguuuggaccucaccaguucugggauuauaaauauaaaccaccacacccagcucaagccaccaugcugugucuguugaaccaggugguggggaggauacuuuagcacguacauacuccagucucagaaaaauaaaacggaugagugaugacaguucuugacacugucucacaaggaaggcacaauaggggacgcagaccauuguuuuccaagaccccugcaaagacacagcaagacaccucucuauguaaggguugcuaugagaccaugugauaguuauagcuuauguccguauuuuaugaaagacacuguaaacuuuuuguacacuaaagacuucauuacaugcacuguacuaggauuuguggaaguuaaccgauuucucacaaaagcccuccgaguucucugcauucacaaaggagggacuaaggcuguggaacagauaacaggccagagagucacaccucuuccacucccugaccucugcaggcgcaggggcuauggagacucggagucgccacaguucguacccagcggggaccgaggaggaugaagggauggaggaggagcuuagcccuuuucgaggacgcucgcguucggcuccccccaaucucugggcagcgcagcgcuacggccgugagcuccgaaggaugagcgaugaguuugaggguuccuucaaggugagcgccagcguuaggugcgaugggaccugaacccucagcugcuaccccuccuuugaucuagggcaugucgggauuucuaguuucagagccaccaauuuucccuuuuguguuguagagcaugcugggacuugcaguucuaauccguccucucucaguguccagugauuugcugggauuuccucccucuuccuccuuuguccaagaccccguccccagucccgguuuaugccuucaccuguaaucgagagcucuuacagccggaccgcuaugagaaccgaaaucuguaguacagaccaacuucacaccaaaguuucugaaccgccagguucauagaguacgaggcuugcuggcaucugagccucuccccaacuucuuaagcuacuuuaaauuguugaguucuuccccauccucuaaacacuagaucucuggcugugcaguuucauuuaggaucccggcacacgcaucaucccgugucucugaccgcccagugcagagcaagcuggugguggggaccugauucgggaugccagaaugaggcucacucuuuccuccuccuucccugaagggacuuccucgcccaaagagcgcaggcacugcaacacagaugcgacaaagcgccggcuggacgcgcauuauccaguccuggugggaucgaaacuugggcaaaggaggcuccacccccucccagugaucuucugcuccacaucccggaacucuacccgcucccgucgcccgccauauugggugugggcggaagucuuucgaggccuuaggaaaaaaaaagaggaucgcugugucccuuuaacagggagaagagcugacguacagcuugagucccuuccggugcgugcaauagccacggagggguggcuccuguuuggaguuucaaaguuuuccacgcaccccacccccuaagccuccggaaguggcuguuuucccucuccuguucuggacugcccucgggugccugugcuaaguugggggucugggugcuguccugucauaacuggggacccgaggucgcgagaaacgugcuuuauaauaaagccugcgcaugugc

SEQ ID NO: 12250 - RNA, 10040 nt, Mus musculus
gcacaugcgcaggcuuuauuauaaagcacguuucucgcgaccucggguccccaguuaugacaggacagcacccagacccccaacuuagcacaggcacccgagggcaguccagaacaggagagggaaaacagccacuuccggaggcuuaggggguggggugcguggaaaacuuugaaacuccaaacaggagccaccccuccguggcuauugcacgcaccggaagggacucaagcuguacgucagcucuucucccuguuaaagggacacagcgauccucuuuuuuuuuccuaaggccucgaaagacuuccgcccacacccaauauggcgggcgacgggagcggguagaguuccgggauguggagcagaagaucacugggaggggguggagccuccuuugcccaaguuucgaucccaccaggacuggauaaugcgcguccagccggcgcuuugucgcaucuguguugcagugccugcgcucuuugggcgaggaagucccuucagggaaggaggaggaaagagugagccucauucuggcaucccgaaucagguccccaccaccagcuugcucugcacugggcggucagagacacgggaugaugcgugugccgggauccuaaaugaaacugcacagccagagaucuaguguuuagaggauggggaagaacucaacaauuuaaaguagcuuaagaaguuggggagaggcucagaugccagcaagccucguacucuaugaaccuggcgguucagaaacuuuggugugaaguuggucuguacuacagauuucgguucucauagcgguccggcuguaagagcucucgauuacaggugaaggcauaaaccgggacuggggacggggucuuggacaaaggaggaagagggaggaaaucccagcaaaucacuggacacugagagaggacggauuagaacugcaagucccagcaugcucuacaacacaaaagggaaaauugguggcucugaaacuagaaaucccgacaugcccuagaucaaaggagggguagcagcugaggguucaggucccaucgcaccuaacgcuggcgcucaccuugaaggaacccucaaacucaucgcucauccuucggagcucacggccguagcgcugcgcugcccagagauuggggggagccgaacgcgagcguccucgaaaagggcuaagcuccuccuccaucccuucauccuccucgguccccgcuggguacgaacuguggcgacuccgagucuccauagccccugcgccugcagaggucagggaguggaagaggugugacucucuggccuguuaucuguuccacagccuuagucccuccuuugugaaugcagagaacucggagggcuuuugugagaaaucgguuaacuuccacaaauccuaguacagugcauguaaugaagucuuuaguguacaaaaaguuuacagugucuuucauaaaauacggacauaagcuauaacuaucacauggucucauagcaacccuuacauagagaggugucuugcugugucuuugcaggggucuuggaaaacaauggucugcguccccuauugugccuuccuugugagacagugucaagaacugucaucacucauccguuuuauuuuucugagacuggaguauguacgugcuaaaguauccuccccaccaccugguucaacagacacagcaugguggcuugagcuggguguggugguuuauauuuauaaucccagaacuggugagguccaaaccagagguuuaaggucagccuagacuacaggagaacuugucuuuugccucacaaaaaaaaguguggggugggaugggggacacugaccuacgaagacacaugcacacaauagcuacacagguggucagagaggucacauuuccucagguuaacaugguuguuaaaggccugaggcccgaagucccuggguuuggaacccagagccuaucaggcugugcagcucuugccuugcccagccacccuucacuuuuacugagguucucuucaugaagggacagucucaccucgccuacauacuaacgcaccccaccugugugaaggucgcaucgguguguagacauguccugugagcagcaagagcauugugggugaucuccucuggucuggguauuaugugccauccugacgucugccaucuguaccccucuguccagaccagugaagacccagaaccacuccuaggggcagaguccagagcuaagcacagccugcugcccacacccagguaucugcaggcuugggaggagguaaaaucacccacauguucagggguugauaaauuugcuucccucucucaaaggucagcugucaagacucugcagcucagcuguaggaucccagcugcagacacgggacaaaaagcagagauaaggggggggacccuuaugaaagacguggccaggucugcuccaagcaucuggccaggacccaauaucauugcucaccuacagagugcuuucacuagacucaguagcugggugggcucccuuuugugaucuuggacccauuuccccaguuccuugucaccucagucuuugucuguggcacagggacagccugucucauagucaccacuccacccuguccuuugagcauccauugguuucuuggcuccuguguggcagauguggaguucucccaucuuacauagaagucugacaccgaaaggaacaugccugccuugugcuggugcagcccaucagcaccgaguaaugaaccugagcccuggaaucaaggcguuugugugcugaacuggugguggcaaggcgaaugucuuccagguggccuugguuugagcucagccuccccuccuucaugaagaagcaaaacaagggcuggugagauugcucagccaguggaggagcacucaguacagccagaugagcugaguggggccguggaauccauggaaagggaaaaagagcccccacuagcacccggacacguggcacccgcaccccuuccugaacaaaucugcuuucagaagcuacguuaaaauccuuguuuagcaccaggcauuguagcacucagcuuuaauccaagcacucuggaggcagaggucuuuggaucucuugaguucaaggccagccugguccaaagugaguuccaggauggccagaguuacauagagacaaucucaaaacacaaaagaaauaaaaauccuugcuuaacaugcucaagguuccaucccagcaccuuacaaaccaaccagucagucagaaugcugaccaggccaggcuggacgaucccuuuggaucuguucauuuaguucuuaacuccuauggaggcagcuccucuuuuuacaggaagugaaacgagggcaaacagugacaaagacugguacacaccagucugacucuggggucuguguuuuguucaugucccagcccccuucagcaguaccacaaaccaccuugguggcccaacuaggaggagucauguucucccgcccugacuaaugucagccaugccaagagccaugcugugccauggagaacuguugauuacuaaaggcacucagcaaugccaagcaccucagcggcagaaugccauccgucugugucagagcauuugugcuggcugaugagaaaggggcucagguggcagaaaugcugaccuuaaacuucugguccuccugcuccuucccccacagcagcucauguggugcugaggcuagaagcugaggcuagaagcugaggcugcacgcacacuuaggcagauauuccacagucugagcugcaucuccagccccuuaauggaauuuuaaaaauuaugggaaagaaccuggagauucugugaacuacuaggacaaagaggguggguaaggugaggccuaggccugccucauccccccccccccccaggugggggaagcagcgagaaaccgguugauaggcaccuuuagcuccuuacccacagggcuucuggguaaguggguguggcugaaccagcaaguccacagugcaagaagaauccuagcauacuccucuaaaaucggugggagugccuaggggaugagagcauggaaaggugccugccaccaagcccucaauuccuaagacuaaagagagaagaggagagaaccaaauuaacuccuaaaaaguauccucggagcuggugagauggcucaguggguaagagcacccgacugcucuuccgaagguuugaaguucaaaucccagcaaccacaugguggcucacaaccaucuguaaugagaucugaugaccucuucuggugcgucugaagacagcuacaguguacuuauauauaauuaauaaguaaauaaauaaauaaauaaaaguauccucugaucuccauacaugucuuuauacacacaaaauaacucguuaaaaacaaacaaacaaacaaacaaacccaaaaaacuguggugaccagggaggagaguaauaaaaacaaaaccauuguuucccagacgcuuccaagcacagugaggcucugcccgcaggcagggcagaccacucugucugccucgucuccacaauggccugcccagaccugugcaguagccuugaggaaaggcauuuuagagucuagccuggggccuuaccuggcccugcucgggccaaacauucugucagagccucuauaacaacagcgcagcuugcugguaccuggauucagagacaaaaugucccagaaaacaccuuugugcccaccacugcuucacucaguaacacugaaaugugauuuucacacaguucuuaccuguuauaauaaaauacuuuguucccuggauuuugucccuuugccacuucaauagauaaaacuguucccagcuaggcgugguagcucaugcccuuaguccaaagccccuggggguaagaggcgugaguucaaggcuagcagagcuaguuccugaaaagccugagcuacacagagaaacucugucucaaaauaaagcagaacuauuuccugaaguugguauaaacugguagucccagcuacuugcuaguugggugucugaggccagaugguugcuuaagcccaggagcuugcggucacccugggcagcagcacagugagacucggucucaccaaaugugacaaagacuggagaugugguucagugagagaguccucgccuaguaagcugaggcccuggaccuggaucuuaaaaccucaaaacacaacaaaaauauuccuagcucaggagcuguacaaaagcacagggauuauuugguccaugucuaaaucccuguucuaaaauccaacuaugccaccuucaguggcuccccauuguuuaucuguauaccuucgagucaccucuguccugagucuaaccuauaccuuauguuugccaggcaagagcaauggauguuuaaggcacugcauaaauuguacuuacuacugaaggaacccuaggucugcagagaaugagccaacucaacagcaacaaugauacccacaacuagggugguggucgggccuagggccuccaucaggucuccucugugccaggcaguuucuaagcaguuaccggagcccugagaaguaggaccagcucuauucccauuucacaguuuaggaaugaaggcagaagcaguuggccucucagucugcacuuagaaggccuccucggcuacagcaaucuagcccagaggccagcaccggcugcuucucccaucuuauggccuccccacucucuuccuacugugcagucccugugugcugcaguuccugcccuauggaugcccacagcccaguggaccuuggugcagauagucaggagagguaggacuagggugagcugacugugcacacagagauggcacacagagaagguccauagcucuggcaggucugacacuugcagaucucacuuguguugcuuuugcuuugcugagacagggucuaaguagccuaagccauccccaaacucaucugugcuuggugcuaaguuuaucggcauauacuaccauacccaguucugcauuugagaccacugaaaaguaaaucaaauguuuaugaauuccaucaccaccugccacacacacacacacaccccacacacuggcccagggagugucugucucugccuagcaugggaugggagggaagcaaagaggacacacguucagcuaccuucccuccccauggcuguuugcccuggucgucuucauucacagcagcucuccuucauggagcugggguacaccucugcuccucccagcagcaggcccugcuucuacugcgcucccuaaagcuguuugcaaagcugucagugucccucccccacuucaaaccucaggcuugcccuuccuccuaugaguguccccaccuuuccuuccagucucucaucccagacccugucacuuuguccuagcaugaugccagccaauugucaccuccuuccuguugaagcaccgaguagauguaauacucaaggcagcuccucuuuugggggcuagaccagcacaccccucaaccacaagacagaagccagguuccucaguuccauguugcugggacagcucuaaagagggggcuucuagccugggguugucuggacaaggccgggcccuucacucugcagacuggaguacugugacgaagcagugcgggaccccagccaggccccaccuguggacgugcaccagccgccugccuuccuccacaagcugcugcagcuaaguggggucugccuauacuuugaggagcugcccucccaggcagacccaccacagccaccucugcagaucgcagcugcacguggagcucauggugaggcugaagcagaacaaggccuucccaggccccaaggugagucccagccauggggaacuugauccguggggcuggaaagacagcucagggguucagagcacuggcuguucuuucagagguccugaguucaauucccagcaaccacaugguggcucacaacccuguauaauggaaucugaugcccucuucuggugugucugaagacagccacaauguucucacauuaaguaaacaaguuaauuaauuaacuaauuaauuaacuuuuuuaaaaaaggaaagaaaaagaaaucuggagauaugcccagcaguggugguguacaucuuuaaucccagcacuugagaggcagaggcggaucucuugaguuugaggccauccugguugagcacaguaauccaggacagcuaaggcuauacagagaaacccuguccugaaaaaccaaaaauuaauaauaauaaaaacuaauaaaaaaggaauaagaaagcugaagguuaaaagaagggauggggggaggggacuggaaaaauggcucagugguucagagcauuuauugcucuugcacaggaugugaguucaguucccagcaaccaccuguaacuccagcuuuuuuuuuuuuuuuuaaagauuuauuuauauguaaguacacuuuagcugucuucagacacuccagaagagggagucagaucucguuacggaugguugugagccaugugguugcugggauuugaacucuggaccuucggaagaacagucgggugcucuuacccacugagccaucucaccagcccccuguaaccccagcucuaggggauccaacacccucuucuggacuccaagccugcacuugcacaugugcauuuuacacgggcauacauauacaaauaauuuaaaaaaggaaguggagugccaggcauggugaccugugauccuaguacuugguagguagaggcuggaggaucaggaguucaaggcuagucucagcuguauagaaguuugagacaguccagggauacaugaggggguagggauaaguuaaguucuauggagccagugacaaaccugguugagcucagauuucucuggcuauacagggucagcaaugggaaguggggaguauaaccaguaucuccaaggccucuccuuccaucuuggcacucacucacacuuuccagcuucacacggcucuuguuugucacuuagggucaccugccugucccaucugggcaagaauagucgggcugaaggcgagccauagaguaagaaagaaccuacugagcugggcggcgguggugcacgccuuugaucccagcacuugggaggcagagacaugaggauuucugaguucaaggccagccugguaguaaaugcucugaaccacugagccauuuuuccaguccccucccccaucccuucuuuuaaccuucagcuuucuucuuccuuuuuuauuaguuuuuauuauuauuauuuauuuauugguuuuucuguaggagugaguuccaagauagccagagcuacacagagaaacccugucuugaaaaaccaaaaaauaaucauuuuaaaaaaagaaagaaagaaagaaagaaagaaagaacgaacgaacgaacggaccuacuggccacuucuugggcuggagagauggcucagugguuaagagcacugacuccucuuccagagguacugaguucaauucccagcaaccacaugguggcucacaaccaucuguaaugggaucugaugcccucuucugaagacagcuacaguguacucacauacaauaaauaaaugaauaaauaaauaaauaaagagaaaagucacuucuuuggggcucugcuuaccucccacugaucuuggggacauaauaagggggucuguuuucagcauucagugagucagcuuaaucauuaagggcauaccauacaucucugugaauuagcccagugaugguuuguagaagaagcaaucugaugaaaggagcuaucuggggcuucccaagaaucuuuaggaaguauggcugcaacagcaacguaaggggcaccugagagucagggggcaugggacaggcagauaaugguagugaggaaccuaccuccaugaugacuguugguggcugcccgucccugcugaugaauguugcuccccaggagaccuggggccagguagggaccuggcugguccucagugaggcuagggcccaggccccuaucuguagcacuagcgucuuccugcucacucggcucaaacucugggaucuggaacauacucugggcuguagagacaagguaagaaguacucacuacacagcuaggcaaacaguguuuaugagaagcagaggagagguacuccugucucccucucccaccacgguagcucaacuccccaaaucuucccaaucccucauuugucugcucagucugccuggcugucgcccgaauauuaaaucucucuucagagcucuguccagacacuagugcgcucccccugcccguuaggaccgggaauaggucucaccccaagcccgaucucgaggccccugacccgggccugccuccucccuccaguucuaagggcgcccggcccuaguuuccugggcgacgagaacugucacagaucugacccaaucaguuuucgaaguaaaucccgggucggccuggaggcggggccaccccaagccaggucccaccccugcgccgaccugcuggucuccaccgccuuccucccgcgucgcuccccaggcuccggauuccgggaucggacuuccucaagccuagggcgugugcaggagccagcgagggcugcuuugggguucccauuuggauccuggaggccugcuucggcugauaaguccuccagcccuucugggcccgaauucccuccuguaaaaugggguuaaugacaccucccuggggagcuggugaaaacucuguaaacagcuuagugauuacuuauagagccguucacugaagcucggccgucggaugcaauggucguugcgaugguuauugcucccccuggaccgagugaccgggaugggaagaccagcuccuucuucccgaucguggaggccuugcacugcccgucuuggggacaaccccccgcgccauuucgggagcuccuuuacggcaggauggccgcccgggugcggaagaagggacggggcgcccaggaaggcgagccguggggcuccaggggccucugcugccaggauaggugugcguacgcugccccgggccggagcgcggggccugcagacagaagcuagggggcgggguccggguacca

SEQ ID NO: 12251 - RNA, 78635 nt, Mus musculus
gauggauaugcacugcaaagcagaccccuucuccgcgaugcaccgugaguaccggcgcccggcuccugucucgguuccaaccccauguagccccagcgcgguccggcccccugcgcucaggucucacccuagaggccacacuggccuuucccugcucccuccuuucguccuuucucuuaccuaguguuucucacgccuucagccaccguucugcuuuuugccacgccauacucacgguucugccugccuuucuaccuucacuagugucucaccucccucggcuccuuccaccugcuccuccuuaccucucgggauccauaacccugggcccagguuccagccacccacccccuagucagucuuugcccuggacuaaaggacuaauuggcaguaguuuucaggcuguucucucucucucucucucucucucucucucucucucucucucucucucucucucucucucucuccucccucaucuuuaccuuccucaaacuuagaguuguggguaaucgugaggaggcuccuaguuugggcagccuuggugucaggacaauuaugccuaagauccugggggugugacccccuucugagccuaagcucucggcgccucuuguucccuucggcuuaguuaaggcuuccuggggggcugcuuugcuacgucccacccuuucucccacccucaccucuuccccccccccuucccuucccuuuuagcuaggaacaggagaguggccggucacuuuuuuuuuuuuuuuuaacuuugccuagggaagugaucauucuaaaaaaaaaacaaugaaggauuuugagaagaaaucaaagucagggagagagguagagccauccaggccagcaccuggaugcuguacacucgagagacuuccuugccugucuccacucacuguugaggaccauucagccagcgcccuggccagggggucagcaagaauggauauaaucagagggaaagaacaaaagaaagacaaaugccaaggcugaggagaaaggaaggagaaaucaaaccaagaggggggaaaaucaaggaaagaaaauuaaaaggauguuggggaagagaaauaagaaaauaggaauagaggaaauaucauaaugauauuugaaugcaucuaauucauaacggcucuuuagcuccgaaaacuauuugucagguaucuccccuugcuuaaaaagauaaauaauauucuaaguagaaaagcccuccccaucuauagauuaauaauuaaggauaauuuguaacuuuccacaagguaacuuuuagaccuagccugauuugugcuuuaaaacgcgauccaagagggagccguguuuuguuuguuuccuaagcacauauugagcuucacgggacuauaaaaaaaaaaaaacaccugcaauaaaauauaguucccuaaauaauuucuagguaaaggaaacccaaacgcgagacuucgggucgcugcgaaucucucagccggccgggaagccuugcucuuuuucggagggaaugaagcagguucauccaggcggccggucucugccucagcccugcugccucugcagcacucggggguuuuugaggauugcuuccuggacccaucaaucggggccagugacggggaaccucuucgaaacccaaaggggagaaaagcgagcagaagguggucgaaggaagggagagaggcucugcacgggccggcgagacgagcagcuacagcccggguuugcgccagcggcaguugcgcauucuaggcccgguuccgcacagauccuccgcagcccauccgcccugaacuccagcggugcccgguugcaauccccaccccauagauuagggcagaggggccgggcccggagcccggugaggcugaauuauucaucuuuaaucugcccgcagcugccgccuuuucauaccgguaacgcgaguucucccggggccuaaauuauugaugguccggguuuguagggagcagaggggugggggagugggaccaaagauggggagaccauagggauggggguuguaagauaagagguucuggccucccggaaccacuggauuagaggccucuguccagggguuucuucucccaagcuuguuuuuuaucucccuauaaaaagaugggagagauuuaaagagggcacgagaugcgcccgcuuucuucgaaacucgcuggaggccacggagcaguggcugcagguuguagaccuugucuggccugacucugccgcuagaagccucugcggcuggguugcugaguaauugcggcugcagguuaaucgcucuaggugcaggauuucugggcugcuuuaggccguagaaaauggggcacccggcagcggccuugagccugacacccgggggccuucuuggcuuccagguugggagcccucgcccaguuggacgggaaaccaggagcucugcucuggccgccagagcauccgcccuuacuguuggguuugguaggcagcugccgaggucugagaaaggucagagggucccgaacuggcuuagacuggcaaugcggagucccggaguccuaaguccgcaggugcggucccuaccaagccaccuucaggggagacuguggggggagaggcuagccuugugcagcauggaaggcaagcgaaccccagcagccggcguuuuucagcggcugccgggaagagcgagaaucuucgccgccucgcggucucugagcgcagccgaucccgaaccaccaccucuucugccgcuccuuauccaccaggauuucuuuccaccauagacauuagaggugcagagggaaaauauuguacaaaacaccugaagagcaaaaacauaaagggaagaaagaacuccugauaaagacaaaaugaaaaacagggaaagaggaaacaguaugauuacaauuagaaguagguacaaggggagaaggaagaguuaggcagcgaaggugaacgggauguguuuggcuuuagucucccucuaugcugaagacucugcugagcugagucaagaagaccccgacccuccaaauccaucuggcucccagcccuugugaaacucaagccgcgccaaaccugcggcgcaggcggguuucuaguccgcagcagugcuguccccguccgguccuucuuuuccccacaucucuacugucaucccccguuaacauuauuuccccuuugucguuuauuccucuccauuuuucagcucugcucucccucuccuggcuucucuacgcuucccucacuuucuccuuugcggcacacuggugugagaggcggguucuucgcuagcucagcuugugcgagcuuacagcuagccgggguucuaagauagauaauccucuauccggaccgcccaccaagccaccuuucucccccaguccugggauaugccccuuaguuuugccugcuccuuucgcacguggcgggccucggacccugacuaauggccggucccugcugugugugggguguuguguuuuuuucuugucucuccccagcagggcacgggggugugaaccagcucggggggguguuugugaacggccggccccuacccgacguggugaggcagcgcaucguggagcuggcccaccagggugugcggcccugugacaucucccggcagcugcgggucagccauggcugugucagcaaaauccugggcaggugagggccgggugcugccucccuucccugcugagguuuuaguuaaaagucgaggugccagacaggaaagaaaggaaagggcuugaaggaucuaaagggcuggcugccccuuucgagaagggcguucaaguaauggcugggacuuggaaugaggguggaauagggucuggcuagcguaacccagcucccgggcccuucaagagaaggcagcuacauucagaaaaggagguaucccccccccccccagcuaaucaauguagaugggguuggaggaagagggucccaagaugagaaaagucagcggcagcguugggaagacuacaggaggguccagguuccauaggaacucugugcuucggguggggucagcucacccagcauggguccuucucugcuucccacguggaaaaccagccuuccacucccagggaugccugcucuagccacuguccauacucagccacucugccuguuucccacccuagucaagcauccucuggagucucugcucagcuacacagggccuuuuucccuucacgccgaugccuagggagggagagcggcuuagcagcucuggagcuugcagccccccugcccuugccgccaccggcuucuugcugaccccgacggccuuccuggcccagguacuacgagacuggcagcaucaagcccggagugauugguggcuccaagcccaagguggcaacgcccaaagugguggacaagauugccgaauacaagcgacagaacccgacuauguucgccugggagauccgugacaggcugcuagccgagggcaucugcgauaaugacacaguucccagugucucauccaucaacaggugagcaaagccccccaugggccuggagggcaggacuccaguucccuacuccugccuguugggcuaccucccagggccucucuuggcucuuuguccagccuccuccacccauccuuuucagcucccagccugaaguccuuugggcaugguaaauagaccugggagguagaaguagacagacagacagacagcccuuuccaaaucggagcugaguuuuccccgccaggcuucucccgccgguguccuggaaaugaauccaaguguuugugguaauuaagacuccaagauuacccgccucgggaucuagagacaaucacagcccauagcaaagucuuuaaaaugaccacugucuauucacugccuccaaacagaguuuuuucuuucuaaagucauguacccuuccccaggggcagccagaauccugguuccuuuacccucucagccaacucccacaaagcucgccucccaggagcccaggucucucuagccagcuccacacaaauuuccggcccagaaucacuggcauccaggucuacagagcagaugccagccaccagucaggacuuggcagagaguagaggagcuggaccaagguccgggaugccaggcagggagugagaguugggucccugugguugacuccugggagaugcucccgcuugccugucuugaggcuaaaaucuuuuccauaaugauagguucagacacugggaccaugugggcucuacucaguucaacuugcaggacaauuaaacuucuuaauucccaggucacuccaaucuggggucugggaaaccacaugaucaugcuuuauguagaugcaccucauccucugugugccaggguaucucucuggggugacuccagagcccucaggcaacaccaaagcccucaagcccagaccagcuucuuaacugcagaacugcagcuuugacaguugugugcgggagacucuggacugcaaaagucacacuccagccagaggcagguguccacuucucagacacccccaaaucaagaggcagcuaagaguuuuccccucuguuauucuuccuacgcuucaaaggcccauuaucagaacaacuaauaauucagauggugccucuuucugcccuaacaucaccuaccuuuuuuuuuuaaauccuuugcaaaugauguggaauuaucccaaaucauccugaaaacagcagguaaaauuagcugguagaauguaccuuggcuaaagaagauucccucugccacacucgugcuguaacgggcagcaaggcgaccccagaaauuaucccagugugugccauuuguauuaaaaugguuauuccguuaugaacaggguaacauaauacugaucagcuaauuauacacccuccgaaacccuccagcuucccgggccuggcucagccagguacuggaaaugugcggcuguuugacauucacuuuccaaaagaacuggagauaaacacaggguggacugagaaagcgauaagccuuuaaaagucaagaggcuagggagcuuggguaucgaggcaggcguggcagugggugggcauggggaacaacacuuuuuaaaaauuuuuucuccuuuuuauuuuucuuuuccccccugaguuaccucaugacuuugucugugguccuugcaaugaguuagagcugaguucuuuagagaacaguagcuaagccaagaguggccaggaugaggaguaaugucaccaggcugggugguggugcucugggaacuauuuuggagauaccuuuauuguccauggugggaauugcaagcuuugggagagcccaagacagacagaguuucagagguuugcuucuuuugaguggggugugcuggcagcccugccuggcacccucccuggucgcccgccccccauccagcacauauccaccgauggcugggcuauauuuaaagcugguuuagguacaaguuugaggauguuucauccuaaaacauagagcacggaggacaagugacccuuacaucaaacuucagaggucugaaguuucgccuaccaaaccggaagaaaguagacuagcuggcuacccaugugaugaguguuagggaaagaaugggcccaacccugcuggcucugagagccacagaggcuguugggaacaacaaccucuauuacuagagguacauauaggcuuccuuuggguguggagauagagucacuucuggguaggcauggcugaagguagaaggagcauaagacgaggaccagggaagccaccagcagcaugggcagccccggcugugcgguuaagcuugcuuuguuaaugggaucuaucaggcuauuuuuaaauguugcuuugggaagaauccucccgugguugauacuucgggaagauugguuggggcuucccaaugugucacugggacacauucggacaucaguguuauucuggugggcgcucugcccuuaagggaaagguucuucuggagccagguuucacgcaaaugcuugauaaagguguggcauuucugcuacugaugguugucccaggagcuccaaccuuccuguuuuaagaauucucacucacugcuagaaggaccuggagauugaccuguauguagagagugguaugcucuggaaagcgggccgugccugaguucauagcauuggggaugauaggggaccucuguguugcuguuaccauugguacauauauguaugugugugugugguuauguguauguauguauacauacauguccagaguaagggugcccaggagccagcaucggcaaggaaggaagucuacaaccugcucauucaccugagccaaagguuuucaucuccuccucccccaaacagaugccgucgccgcacuugaaauaugcuguuauggcuauaaacuaaaucgcucuucaugcuuuaaaaaugguuuuggcauucucugauccugccacaauaaagcuuuggcuguccaaccugaguucucccccuggcaaauccucauagaaaugccucucugggccgaaggugugguagggaaacauccacaucuggagaccacuggcuaaagucuuagcucugagcaggucauggaauucauugaaucauuauagauacugggcuacuuagugcugaguguggcguugccagcucuucagcuaaauagcaucucuguuggggacacuguaaauagguaacuucagauugaaaccuggcaugggaaaugaccuaaggguaggguagagaugggagaucuguguaccuaaaaaggaggcaagugccucaucggguugaguuauugacaaggcaggaaggauuguccugaugcuaucaccgaucuucagauuggaguguugccuugggcaguguggaguguaaagcuaaggcuacauccucaggggugaccucaagccagcugauggacuucuugaggcuaaucaauacugugggggggccagcgacucuguauucuuagaucuuugcaauggacccuugaggcuugccaaccacccaccaccccguauucugucuuagcccguuugccuuaaagugagugcaaauauucauccuugcuguggcagcacuggcuucaagaaggcugcagguucagugcucauuguuaagcaaugacaguuggugucccucagguguccccacugaguaauucaccaguguuuaucauuggucuggcggagagugggcaguggucuaccacuugucuuuccaaguaagcugauaguuacuaaccauagccaugggaauucuggagacucauccuaaaccaacauauccguuacagccuuuggaacucaaaccuaggucccuuagauuugacucuugaaccaggcuuggcgcggaagccggaggagagggguagcauugcuugucacaucucuagaucuaugcagcgguuugguugucaccacuuuuggugucaagacaaggagcuagggugggucagugaguuaagaaaaagacuucaucccaaagaagaaugaaaaugaucaggauagagagcaugucuugggccucaggcagggcuugcaaguaguuucuucucugugguuucuggcucaaagccaugcuuagccuuuuuuuuuuuuuuuccuugugggagucucugcuguccuggucacccauccuuagacaggcaggugaaacaggugugguccuuauccuguuucuuguguuuuagugcuucacauuucauuuuuguuuguguguguguguguguguguguguguguguguauguguguguguguauguguguguguguguguauguguguguguguauguguguauguguguguguguguauguguauguguguguauguguguguguguguauguguguguguguguguauguguguguguguguguguguguauguguguguguguguaugugugagugacaccuaccccaguguucaugugcaggucagaggacaacuuguaagagcugguucccuccuaccaagugagaucuggggacagaacuuugaaggcugugauagacuucugggccagacggucuccuguugguuggcuuaugguuauucaggauauggcguagguuuucaguacuuaacugcuuugaguuccuaccucagcugaccauguuugagaaguaaagaugagggguuauccuaaaaaauaaaaaauaaaaaacuccauguuggguuuggagggugauguagagaagaaaagagagggggaaccccaaaauaaacaaagucucgacuguucugagaacucaauaaaacaaucacaucaaauaugaagaggcauaaaucuugugucugcacagguaaccuacucgauugcuuuuauuaucgcucaggcugacuccauuuauuaccauccacagcccgggcaaaggagacugcguggaggguggucucuggugcaauccuauaccccgagaggcaacaaucagcccauacagccagggauuucgaugggagccaggaagggcccaucugucugcaugaaaccaaucaauaacucuguaaccagagcccuugucacagggaaauggacaacacaacaguucaauagaggggccacaaggggaauuagccaaguggagauggugccaggcggaagggaacaggguuccuggaggagagacugggaaggcaggaauggcagggcucugcaugcuuuuaggcacaggugagggucugcugcgcagccagccuggggaaggagaggcaacguuaaugguuggaguggagggacacauguccuggaggacagcuggggagugggcuugugaugcucaaacaguagcucaacugccaacacaaugggguagacuugagggcuagaacauucuuagcuuuagucagagaagcagcugugcuacacagcacagauuagucauucuccccagggugugcauucuggagaagggguucccagaggggauggaggcccagcuucucaguuuucucagcaggacugaugaaggaacgcuuuaacccaggggcccagcguccauucccagcuuccauccaucgguugcagaccuggcuauucugcagggcuuuagagcucagggcuccccugaaucccuccuugaugccauacauacaguucuuccacugagaggagaauguagacauuaagaagucacuuuccauguccuuaaaauaauucaguagauggggcccaaucaauaugccaguuuucuagauucuugaugucucuucauaccuccugccccaucagagcucagguucacaagguagaggcagcuacagccaaugaaucacccagagaacaaagaaggguucccgaaaccugaagaccagggccucccaacugguaccuaagcaagggcaauagugguuggaaaggaguuacgccuccuggauuaucugucuuccacugggcagagaugguuuucucuugugggucacauuugcuggauuugaugcuaucaaggugcaguuagaauuguaugcaaaguguauauacaauggcauauaggaguaaagguuguuaucuucugugugggagacuguguaucuaugccuuaucuauucuuagguacagggcucugaggccaagaaaacaaagaaaaugguccccaguaugggagcugccauuacagugcaagacuggguaccuuauccuuggcucaagugguuaaucagcaagucagucauuuggcuuguuaccugcaguggcaacagucacagaguuuggcuaaagaucauugcauuucacaauuuagacaaccuggguucaaguuuuccaucaagucuuguuuguauuacaaaucucaauauauuaguccaguuaaccccaaugcaaaggccugggcugccaugauacccccuuugugauggagacuuuugugaucauaugugcaucuuuauuuugacacuugagcccaagcccuguuggcugggcuagcuagggacgagugagugauaucaguaaccaaagcaaugcucuucuagguacauacuuuucucuaaaacugugaucuacacuagacauagaggugcguaccuuagauuccagguagaucuccaugaguucaagguaagccugcucuacagaaugagauccuguggcaagcaagcaagcaccaacacacacacacacacacacacacacacacacacacacacacacucauucucucucucucacacacacacacacacacacacacacacacacacacacacacgauccaggaaaccauagcuuauuuuuaagccauggaauuaucaggacuucuucuuguguuucuuuuuuaaaaagauuuauucauuuauuuuauguauauggguacucuaucugcaaguaugccacaugccagaagaggcuaucagaucccauugcagaugguugugagccaccaugugguugcuggggauugaacucaggaccucuguaagggcagucagugcucuuaaccauugagccaucucucuagucucuucuuguguuucuuaagggacaaugugaugagaagauauuuugugucgagagagagagagagagagagagagagagagggagggagagggagagggagagggagagggagagggagagagagagagagagagagagagagagagagagagagagaguacucaucuagucuggaauuugacuuuggauguggggguaaggaaaguagagccccaaaguccagacuggugccaccaagagcagugauggaaaugcaggcagccacaagggucacacacuaguguucccgggaaaacuggcaggaaaaggugcauggauauguacaggaaauggaggcaugggcucagccuacaggcauugauccagagaugguuuuugcacucuccauugugugagugugcaugugcauaugaugccgucugacgacgacuuuugggaguugagucuauccuuuucauucuacccuucccccacuuuuguacauaguguguauauguauguauaugugugugcgcaggcacccacaugcacacauacaugugcacgugcgcacaggccaaagauuaaugccaggaaacagccuccauagcuuucaaccuuauucauugacaaaaguuaucuccaucaaauccagagcuugcugaugugacuaguuuugcuagccagcuugcuccagggaucccaucucugccuccugggcugguacuacagaugggccacagcuccugcucagcaucauguggguuugaggaaucuggaccugaauucucugggucucauacuuacacaacaaacucuucacccaccgaggcaucucuccagccccuccccugacguuguagguucuaggcguugaacucaggguuucaggcuuguguggcaagagucuuuaccuggugggauaucuuuuuuuuuuuuuuuuuuuuuuugguuuuucgagacaggguuucucuguguagcccuggcugaccuggaacuuacucuguaaaccaggcuggccucaaacucagaaaucugccugccucugccucccaagugcugggauuaaaggcgugcgccaccacugcccagcccugguggguuaucuugcaggaccccaaaagacaaauuuuuuaccaacuccaugcuaaccaaguaaagugcauuuugggucugauucuauguugggcagcaguuggcagccucuggucuguguaacucuacacacugaucucuggucuaggaaagagcuaugaccucaaaguaagugugagagaaccagcuuucccccuacaccuuaauacagaagcuucugggaugcccauggcagcugguagagcuuucuagcuggaaggagcgggugagucccggaugaggaagggugugucacagcaggugugcugcagacuaagagagugacugaggaggugagaagcuaagaggcgaagcagucuggcagccuccuuggccuguaugguauuuggggauggagcaaaaggcaggcaagaacagccaagaagggagauagagugccacaaucuaaauaagggcuuuugguccccugaaacaucuuagaugugguuagaggaagccagugcccaggguagugcugguuguucaggcugguggcauucugagaagcccagaguugacaaaggagaaaaggagaagucagcuggagagacguuuccaaccugaggguggggcagaggaagugacauugcaggcaaauucucaaggucagaguuuccugguccuuucuaagagucagcuaugggaacguggacacagcucuggccaccugccccucugcauucugcauagccuggcaauggcugugcugccauuggcaggcccaagaaaagaggugggggggggggcaagaagaaggcaggguaaucccuguuuucucgggcuccacaauggagcucucuagagcuuagggccacauugcuccagacuuccugcuaugcuugcuuuuaggcaggccugaucauggugagcucccucugcaauggagcagagaaagcuggggggacgugccaggccguuccuggcaagguuugcagcagggcagcuggcuggaaagcgagcaguauucaccuugcaggcacagcagagaaacaugaggaagggagccuagaagagagaucaggaaggguguuaaagagcucaagcaaaugauggcuagcuaguacuggggaugccuuuccugguucuggugcucccucuuggccuuaaguucuuugaggguucagacgcccaugccuucaaggcaagggaaggagcucagguggguugcuaacagcguuggaucugauggaucgcugagaugaucaggcacaagagccugauucuaacccuuacucugccagccuuugucugacuuccaugguuccuugugugguccucaagagaauaggaugggccucuguguggcuuuguuuuagagaauguguggcuggugguuucuagcucugccuggcuuucauagccuggggaguuggccuagcauugcgguuacaucucagaagucaagucuugucaaagugagagcugguagccuacuuauucagaaagcuucuggcuugcuggacugucugaccccaaagcaagaagaaucccuggcuucacuuggauagucugcuuguuugggauguuacugaaugcuacccagagggcgcagggucaaagggacaguagauguccuggugggucaauagcuaaggaucaggccaggucuacaaaggguucugacacaauuaguaagcacgccuguaucucaagaaugggcccacgugagaucagugcgaacuggcucuguuggaggugagcgugucaccugcauguggcauuaggugaaccgguggccauagccuugguuguguaaccucagaggcagccuguguagagaugagaccaaaggucaggauaguuaucggcuaucaucugcggcuugcgccugccccgcccgcccgccaagguccucccuccucugcgggguagauggauugguagacgaggccaaucucugacugaagagugaggagaugauucugauugaagagugaggagaagcugauaagagaggccaccuuuccuccagggaucaacggaggugucauguuccccacuccucugcuucccuagaaggacaggcugacuuccacuuacugugacugucugacuucugggaaagccagagggaaggagguuccuuccccugugguccugggagggaaaaccuggccuauucccaggugagagagaaaaggcagcagaaggaagacagcaggugagaggugagggccggaugccuugacacugauuggcccugccccggcuggguguggagccacagaaagaucccaaggaagggcagcuguggggcucacagcugaccuucugggccuggugcuuggucuccugcagagggcacagcucuggcucuaguccagucccuuccagaaacaggggucacccccauucucuauccaauauccuccggccuccauaaaacaucugccucuucuuccacucccaugaccucaacuccugaccccagggagacacuccagaaggucgugcagacuuaagagaugaccucucaggguagguagaaaaaaguugagagaaauucauuucauggcuaguggcugguuagaaaaggcgauuccgguguucggaugugauaaauguuaacugagcauuaaucgcauuaaagagggcccuauaaacuuuucauuucuaauuaaauucauccagugaugcugcccaagcgaguacucugagccuuuguuuauguggaaaauuaaaaugcaaauacaaugggauuuauuuccaguagagugaugcucuggucccuccggcuacugggcucgcucugggcccaucaggcuaggugacucugcaggugcuauccacugugccacaaauuuuuguugugaagggaaaggccagaguucaaggucaaaugcaacuagacaugagaagccauuaccguaagaguuaaagaggagaaaaagcaacagagaaaccacuaauguagggaggcauuuucuuggauuucuaaccuuccuacuguaagaauaguaacccgcaaacaaacaaacaaacaaauccuuauuugugaauaaugucaccauaagcaucccuugcaauugugguuaacaaaaaaacaaaaaacaaaaaacaaagguaugggagggaggguuuggaggcauauacgagacuguuccucaaagaacucaaagauguccacaggaauggaaggccuuaaguccggcuuucucuccagugcuuggagggucagcugcuaucuacaucaugguuuugcuggguccuuccugccaauuccaaguggcucuagcacaggguaguggagcauagaggcacaucagaaggacauugugcaugcaugcccgcccgcccgcccgcacacagccucuuacacauaagagagagcugguggcucguaagaaggaacaaauggcccccacaaaugagccuuuuaguaccaugaucccuuugauggaagcagaagcccuuaaugcuauggaguggagcgcucugaguucuugcucacuaacacauaaauuaaguugagaggagagaaaacccuagguaagaaaaaaaucauuuggguauaucaguuagagacacugaaaaauagcuacggugcggcgcgaguaagggaguuguaaauagcauuaaaacucgagagggaagggaaauagaaguaggagggacucgaaaaggcagaguguuaaaucacaaauaggggcuuguguacaaagucaccaaccagauuuauaccaaguuuugcaaaaaucuacagccuggacugacaguagguggggaauccaggugccugcguccacaggcccacccaaggcacccugacaguguagagagagggcaggcugcucacugugcuggauucugggauugauccauccacuccccaagcaggagucugauugguucggcucugcagucaaggauacagccgcaggagagccuuuaaaggucuuuaagcacacgagucucuugugagcuggauccguguucuaacgguucuccaagguagcaacccauuccuggaacaccgccugcuugccugaacuuugcaacaacugcuacccccgcccucuuuagucuguuuuauucuggguuauucuuuuccucuuuaguguucacuuguaucuugggaaugcaaugagcacuugcugacaagcagguuaaugaccauggcgacgcccaaacaucuggaagaaaaucaaaaaaaaaaaaaaaacuuuagucaaucaucuauguuagcuguccauaggaugccaaagaucuggugauuuagcauauccacaugguugauuggcuuucuccgguuucauuccggcacagaaccagccuacccgggaaacaccuauuucagaggaaaauauucuaggaagcaaaguguggugguuaggaaguaucuuagacacacuggguuugguuucugauuuaaaggggccaggcacagggguggaagcagugugugucuggacaagcucagccguuggcuacaauggaagaggcuccauccaaaugaccuucagcuguccacuaggccuggcuuccacuagggaaucugccaucugaaagcccuuaauagacaugagcaaucauucgcccacccucccaaucacccauucagaaauaucucucuaagcaccuccuguguacccggccagucaccuaaagcuucaugguacacaaugcaaugugaggggggggggcuccagggagaaaucgucauauuuugagucuggcuaaccuccuauccuuucuguaccucaguuucccuagucauauaagguggggauaaucacuuaacucuuuuauaggcucucacaaggguuaaaugaacacacccacacccacccaccacccgccauaaaucuacuuagaauugcaacuagccaauauuaaggaaucaauacauguacuauucuuauugcaauaguaauaaucaaguaugcauuuuuaguuuuagccuuugucaauaugugucuucggguuucuauguguauagcacugaagcauuuuaaauaagaagguuugaagggucgggucucucggcucacaucugugaucccagcacucaggaggcugaggcaguaguaucuugaaauuaaggccugcuuaggguuacauagagaaaccuugucuaaaaacaaacaauaaaugaaaaagaaaaaagaagagagcaugauuaacgagccagaagggucuuuacgagcagggcuaguaucucgagcacucaugagguucacgguauccugugaaccgagcuaaauucaggaagugagcugacucuuguguuuuucagccaguggagacucucugugacucaggucuuggaccacugaauagacuuagucaagggcuuaccucuuuguccacuuugaaagcccggccugucuccaugugugcauaugugcgugcauguuugcacacucaugugcacagccaugccgucuuccuggaugagcuggcuguuguucgaggacuuggagguuggcauuuuccuggcuccguggcauuuucccaaguugugcucuuuugcauuuguaauuuuuuuaaaagagauaaaugagacggcggugggcaaguaagucuucaggugauaguuuugaaggguuuuucugguuuuuaaaugccauagcggggagcgagaagggaggcaaccaggaagagugggggaagaaaggcaagaaaacgagauuaaggaugaaagagaggagcaagagaauagcugaacucaaaccauacccaucaagugugguccuugguagcugggugcucuggggaggguggggauccuguaaccacuacaguuagcaccaccacugagggaaaaguauuuuaagaaaagaauuuaggaagucaaauuacuucggguuuugucuacuugguacaaugguccaaaguaacuggauagugauauacucugagcccagcaagaacaaggugaaaaccaaaguuguccuaacucaggaugccgugucucuaugggaaaccccgugaaauggagcugagaccugguccugugcuuucccccuuggguucagugaccucugucaguucagugaacccugaaaagccacacucaagugccuaaccaguuacuucucagauaucuuaagaucucuuuuauuuuuaauuauguguguauaagugguugugggugugggugugggugugugcacaggaaugcaggugccccugguggccagagcuguuggguucccuagugcuggacuuacaagcuguugugagcuaccagacauauccaucagucaaauuagcuguuaaagggccauguauauauuuuuaauuauaaagguaacuuggggggggaguauggggggcaggaauugagccuagggcuuuguauaagcuagguaguuacuuaacacugaguuauaucccaagcccuaggaaaaauuuaaaauagguuaaguugaaauugugggggcuaagucacccucagaguguuuucaauucucugcaaaccuacaugagguugccaucuucccuuuuuccucgucauuagaauagagccagcuguugccuuuaucaacccccagucccugcacugucuaaacagacugggagagggagccccaucccaccucacagccagaggagugguacccaacugcaguuuuuauacuucuuuuccuuaaaacaccuugugauuuuauaugcauuggcauacuugcauacuuguuuacauuuggccgaucucauggcuguuuuacccagcaagcauuugaagucaucuccaucaccaucaccagcaucaucacuaucaucacauuccuagcuaaccaguccuugcuacaguaaggcaguguaaauaagauaauguauuaauugauguaagccuguugaacaacaacacaacgcuuugcagcaguguuuguagauguaguaacugucggaguauagagaagugaaauaacuugcccagagucacagacuagguugcagaucuagguuuugaacccacagaggaguggcacugaagcccaugugcuuauuauccaugugcuuauuacaucacgguucuuaucuacucugcaucagagacaacgaaaccagagugaucuauucuccgucuugggcccugcugcaaucuuuacuuaagcuuagagcauggacccggugcccugguggaaggaaggucacaacuauaauuguaaucuuuuuuuucugugacacuugucuucuacugggccacaucaucuggaaaugguggagaaaagaugccuugggagcaccacagaauggaaagggaggaccauggagaggaacagggacucugggagcucaaggucauggugguguguccacugggaugggagcuuuaugggagucuauccucccauccccagcugggauguacacuucacauagcgauaguguuuggccuucacucccuggauuaagcagauguagggaggguaagaccaagaccugaaccaguaugguuuagucagaacucucuggaccaagaguagacauguacacuuuaucaucaagaggauaguuguccugcaucucuagaauuuucucucuggaaagaaacaguacaaacgacaaggcuagaggaaggucaaaaaaaaaaaaaaaaaaaaaaaaaagcaggauugucgcucucacccauaacuauaaggaggaagccauuaaagcaauuacugaaucacacgaccaccauccagauccagcaucaucacucagcccacgucaccaaggagacaccaucagcaucaucucaccaaggagacacccauuaaccuaaucucugagacauacacuaugaauaaagaguugcagauaugaucaaugaacacaauaauucaaagcagaaacagacacugucacccaacaauagucaaauuccuccaacccagucuuacaggaagagcagucgccucaacacaauaccacaaagcaaaacaaaccucaggccaguugcugggaugcauccacacaaugucacacaugcuaacccacaaugcaauuccagcucuccauccuacaggguaucugcacacaaaggcaggggugagcuggcccuuggagcagugauaaauagugguaagacauacaaagguagggucagcauugaaacucccaacccucagcacacccugcagaauacagucagagauacaguguccccagcucaguacagcugccaggacggagcaccgccuccuguccagcagguggacauaucuagaccaucacuucugauaaggccucaaggcucugguugcuacuaaaagaguaaacuguccccagagccugcuucccgagacaggacaaaucagcuccauccuggcugggauuuaauaagaccucgcuguuaugggaaaugacagagcugcagggacggagaggacagguggggguugggggagcucuucaagcugggugcaggaauuccccucugacuccugccucuauggcuguuuggagcugaagcccucucuugcuggguguucacugaguaucgauucagucugcaagcaauuuuaauauuucuucagggacuuuccagcaacagcacaagucauuaauucacccucccaaauugcuuauucaauagcaggaacauggcuccugaauaaagucccagaauuuaugugacuugcacgagucaggaggucaaacaacuguuauggagcgaaguuaaaaauccaaauaaaauauugacacuuuuuuggggaggggaagagaggaggccaagguauuuaaaauagguuuuuguugcaaugccuccaggauaaagaauggaaggggacugaagacaaguuggaguuuauaaaaucaauggaauuuauugcacaucuacuuggcauuuaauaauucucucauuuccacaucccccacccccauaccauucuggccgcagacagggagauacacagguauacaaaugcacauuuaugcacaucaauacugcccgcacggacugauaugaaaacaggauugugaugugcgagacucaggcauccagaauagggaacaucaauggguuucgcuguagcugaguguguuuaacagaagcaggcauaacuuggcagauauucauuaagccacuuuugauaaguauauucacuguuauaaaucucggaucaaugcauuagauaugaauauaaagaugugcucaucaacagaaauaguuucgaaaauguagaugccgcgaaacaucuauaugcaggaucaucaugggacuguguacacgauuugcaaacuaugguuuguuuguaacauggacacgaugcuuauuaaauaagugaugguccaugcaugggagaggaaagcauguuucagaucacagccacaugcaaccccugcuagccaccuacagauguucgcucgguuguccaaaucauguaugugggaagacgaagaaaaucguuccugcucaaauagcuaauagacacaaagcauuauuaauauaggaguuuccagaggagaucauauuacacagcccucagauauugaagucacaggcuugggaccaaagcaaucugauauuaagaaugugaccuugggugagcugcuuagccgagcuguugacucuaagguagaauagagaacacaccuauuugauagagccgugguuaggauuugagugagaaagugcguuguguaccguguuucuuuuauagugaauucaaaauauaugauaggggccuguaaggugguuagguggguggagguaccuggcugaugaccugcguucaacccccaaacccuagucaaaaaaagagacacugguguaaagagauaacugacucugguagcugcucccucugacuuccacacuagcauuccacacaggaauaaauaaaaguaaagacuuuaaaacaaaugagagguaugacuuuagcugcuauucuauguagcucuucuagugaggucuagacuuggaucuugacuuguuuuugguaagacuaacuuuuucuaacaaguggcuaguggaguagacucuaacgugggacauccauguuuaaauucuggcucuguuagagugugacuuaggcaaguuagcuaauauuuccgaucucuaguuuccagauuaaaggguagggauaguaauauucguagguaccuacagguacuucacaggugcacaaagacuaauuuuuuaaauuauuauuauuuuuaagacaagauuucucuacauaguucuggcuguccuagaguucacuagguagacugggcuggccuugaacuuacagagauucgccugcgucugccuccugagugcagagauuaaaggcacauaccacaauacucugcaagaguuacauuuuaaacuccacauaaaguacuucugacaaugccugguacauacagagcauauguuagcccaccguagcccauaagcuucuucuguuccaauaauauuaauaaugugauaguuauuaaguucuuacauuauagcuggucuugcuuguugcuagaugguaagaaaaagaauuugugacauuugucuuugcugaacugagucucugggaggauucagcauaaacuggguaaggcacgaaagaguucaggucugugcugggcccugaggggacaaggggaacagacaaagguugacuggaaagcuaugggggcaggaggcaggugggaaagauuuugaaagcuagcugagaaacucagacucuauccauaacaggaagaagggguagguuuagcuacauccuauucuuucaagacagauauggauggauuuuuuuuuuuuuuuugaaucugugagugacaagagcuagaggcagagaggcccagguagucaccagaaagcccaaugucccugcaggcuuccuucuucuuacagagggaugucagcaugcuuauggaggagcagggaugauagacacgggcagaggggagacuuacuguacuagugagccuauaacuggaccaauuaccauuacaucaggcagucccugagccaccagccucuuccaggcaggaccauggggugaacagcugguagaccccagcuucagucagaagcccugacagaugagggaagggccagugacaggaggagguagucuggucacgcucuggcuuggcacgcacuacagacugguuuccaaaugguuaguuaagcacauugccccuuaauuuuuaaaccuaugcauaucuugaagugaaaucaauccauaugcuuaccguucaucacagaaaccaccacuauugcccccucgggccagccccguggcccaucuaaccugguaaauugugucuggccugagcucccagggacacacagugggaggguuauuacccacaaugccagucuuagaaggcuggugcagggaaucucauagugucuaggcaacagcuagaggucgaucauccuggaaaguacaagaacucuuuugaaaacuugaaauguuuuuauuuuuaaccuggaguuuagucucuacagagaauaugauaaguuucuggaauuuugguggcugcugguuggagucggauggugggcggugugcccugaaauuugaguaagggccaucuccaugcacuaggaucacuccugagucuccuacccccaacuagcaggugcuucccacacaucuuggcucaucuucucagaguauagaauucagaauguuuaauuuaccaagagcaaggagagacugaggggucugcauuuuagccaacagcccaggggauucugaugcacggagcuccagggccaucauuugagggcacccuucugcgcaauuucuggaagauuugccauucucagagcuuaagcauaacucccagccgaaugugccuacaguccaugcacuggggaagcugaggcaggaagaauaagaauaugagacaagccugagccacacauauauugaguuuaagaugugagccuggggccagguuugguggcacaugccuuuaguaccagcccuugggagguggagguagguggauuucugaguuugaggccagugugaggucuacagaguuaaguuccaggacagcuagggcuacacagggaaacccuguauugaaaaaccaaaaagaaaaacaaaacaaaacaaaaugugagucuggauuauaugagcaccaccacucuuugucucaauauauggauauauauguauacauauacauacauacauauacacauauguauauauauauguauauguauuuauauaugcaaaucuaagagcucuugacaucaugaaagggaagaccuucugcucuaguuggaguggccuguucucagcuauaaagaauggccugacucaccucacugguauccccauuguuuaaacuaaaacccacugaacgagccuggacaauaccucuaaacuauacaaauggcaggagagccuaccaagggagcgugugcauggagugccucaaaguggccacuggggaggccaggggcagaaugucgugagguccuuguguaaagagaaaguagaucucagucucugaucuauaugaaggggcuacucaguuccauuaggcccucuggggugagcacccuaucaggagagguagcagcucccuagaugaucuaugacaucucacuugagaaucugcuaggcaaagucccaggcuggcucaccucagggaugagcuggggauacuugcccaacacgagcacugcucaaagaguggagaugaagcaaucaccugcauuuguuggaaaagcuauccuuugcugaagcaaguauaguuuguuuuuuagaaugauccaacuuauaauagccaggcagcuuaaagucacuggcagagacccuacccucuuauugguuagcuggcucaguggccauacagcuuagcuagucugaaacauuccuacccugcuuuacagauugcaaccuggggauucaguauguucuguaagacucuggaguggagcagucuauacugguuuauacaugaacguagggcacgggugucaauacuugacauuuuacuaguaaggcucuuugagcaaagcaaugauaugaccaggcuugggggcagccugcuguuccuugaggaaacaauuccaaaguuggggggacagccggcuccaagccagugagcaagauuccaugaggacacucuuggagauccagucucuacauauucucagcagguggcuccaacagaugucauuguucccacauucuggugaggaauagugaguuucaggggaaccccuuaaccuuuguuucuaagagcagacuaccaaguacaggauauagaagcuggugagucagugguuucgaaaguuucccgggcagcaguagaccugaguaguugaugguaugggcucuaggauucgucuaguugaauucaaaucucugauuugccacauaugaauaaauggcuuaugaccaucuggaagauggguuccuggggggacggaacaaacaaaauguuugaaguacucagaccguugccucucacacaggaaagauucaguuccuaguguuuuuuaaucacucugaggaagcagcucucuugguaauccugaccaaccuaagcuuuccuacuuccaaggugagcugucugaggucaucucaaugcuaauaggacugcuuucuuguuuccaccugaggggaaguuuuugcacaccauuuauuaccauauaauauaauacaauauaguagcauacauaacauaacauaauaugauggguaggcuaacuuggaaacccugaggcagacuguggauggauggauagaugaauagauacauuuguacuaaguauacauacauuauaucauucuauugauuuguaaaaaguucccggucugccuggcuguaaugagauuuuugaacuuugcguggcgaucaaugagaggaauauuauuggccuagagaauugauauaccugcucucaguggcuuguucugcucccaggccaacccggccccccagguguacgauuccagcagacacuuaaccuuuuuuacagugucaucaggcuaaaaggaaucuaauagugacacaggacuugugcucagcacucugccacuauugcuuuccugucacaaauaauuuauagccuucuauuuccaucccugagcccugcaccccagcccugccucucccuuucccccagcucccaggaaucgauaaacucacagagccauagugggacuucagggugcaaggagacggacagauggacagagagagagagagagagagagagagagagagagagagagagagagagagaaaggggggcagagaaagacagagaugaagagacggagaagacaaacagaggaaacaaugggagaaggaggcagaaggaucaaguaggaucccgaguucccaguggaaggcugaacuaucucuuugccaauuuaaguggcuugcugugauacucacacacaccuuugucugucucacagaggccccugaggcugcucuguucuucccagugggaggaaguggaggucuccugggaauuuaacaaaaagaggaagugaccuuaccacuugcuucaucccccuuugcucuaaagcccucccaacacaccugccaccacccgaaaccucugugauccuuccaaagcaugcagguagaacuugguccaguccccagucugucuucccagaagucuuucugacugcaagcuccgugacccugcugguaugcuucccuccuccccuccguuucuucucagguaguacucucagugauccagguggggcauacugagaagggaggccuccugccugguaccuggcucagcccuuaaacggaaagcagcuggguacagaggucacccacagggauaauaaugacacaagugugaacauaauuauugcagcuaacacucaccagccaaacaucauacuagucacuuuaugugaauuauccuucuuaauccucaccacagccauacaaaguacacaguaguguuaucucauuuuacagauaaaggaaggagagaugcccaacgccaucccaggaaacagcugggauccugacucaggugacugagccuggaguuaagucccaaauccccucacuagagcaggugugguuguacguaccuaaacugcuaucacucagcaccugggaggcaggagggucuuuuacuuugagguauuucuggguuauauaggugaggcccuauuucaaaacaacaagcaaaacccagaacaaaucaggguauagagagaugucucaaugguuaggagcauuggaugcucguguaaagaacccggauuugcuccagggggggauccaaugaucucuucuguccuucaugaaugccaucauguacaaaguacacauacucaugugcaggcagauaugcguacacauaaaagaaaacaaguaaaucuuaaaacaaacaaaacccuguauucccuuagcuguacaaagcacccuggggagacacuaagaucccaguagucccuguuugggcgcaggauaaagcacugagcagggugaggucucacugacacgaaagaggaaagagcauccaguguuggcaagccugcuuggcuaggaagggggagucuuccauguugggguaagcacagaauguaggagggguauagauaacuagaggguuuucaugauccugagucuuaaaaucccuauggucagcuccgggaucuggcaggugcccgcugccugaggucauggauggacaccaaaagccauaauaacucauagcagacacccugcccaacuucucucccaugcaccaccaagcugcugucaaggcauagcgauuuuccaucacuagacgccucagcuaaaucuguaucggugccuccggggucagaggcucugguaauaaagacaggaacuccaccggccaguccuguuaucuguguccccagucccagcccugcaacuccuuagaccagaaccugucagccuuuaagcagagccacugcagguccaccagacccuggaagcuugugugggagcagcuguuuggcaucccucuagucuuucuugaaggugaggccauauggcucucagcugccguggucuccuccuccugacucagagacugcaaagcugcgaaggcuucucucugaagguccacucaugucggauuaacucugucccggucccucuacuccaguuccccauuauucuucccugcucugcaucuucuauggucucccuggcaaccucacucucuuccucuucucugauacucucuuuccugcccugaaucauccuuucuacaucugugguugcugggccacccucugacuuccacacuauggucaucuuuuagagcccugcucccucuucccugcgccucuucugccaggauccuguuccagcugccuggcucagaugcuucgccucaaagucacuaauggcuaccuugguucccaaauauaugucucuucuuauucccaaucccuugcauucuuugaugucaccauugacacuguagauuaaaucuuaaugugucuuccuugauccacuuaagucagaccacccugaccuacacugguucuaccuauggccacuaccacagccuaccauacuguuccaugcccuuuacuaauaagcuccucuggaugggccagcuaugccuggacuugcccagcccaaacauccagagccaacaucacacuuuccuccuacaccacucaccuuccugcaucccuauccuucagaaugucacgugccaccgagccuccagugacacaggaguguuuagggccauggcucacucagguuaguuaccgaaucuuggcuacucuuccuugcuucucugcuuucacacucucgaagauacuaugcuuuugugagaccugcuuguuauuaccuuaugccuacccauuaccuuccuggggaucaaucacuuuggccaugucuccucuaguuugagcacugcucauggcuucagaccucugaggauugauucuuacgugacaagggacggugacaaaguagcagaaagacacaaguuucagggauugaauugggaugccgcccuaaccgguagugugguccuauggaagucuuaaucauuaaccuucgucggcucugguuuuccaucugcaaaaugaagaugauagcauuuauucugaaaguuucaagaauuaacaaaaguaaacaaccuuauggauuauauauaauagcgaugugcaauauuugaaugaguggaaacuggcugcuuauaccaccugaugcaacuuuucagucuuaauuccucuccuuccugagcaccccuccccuaccucuggcuguggguccaggcaccaaccccugccuuguguucccccuuggcuuccccacuaaucuucaccccaccuccagcaccuguauauaaugcccccccccauuaucuuguucaucuuagaaucauguuaacucucccccccccccccccgagaccuuggagaugcugugugccugugagccuuuuauucuuaaguuggaaaaaggaaggacaaagacacaaagugauuaaugugacuucuuaaugacaggaaccagcacuguccuugcccagccugguguacuuucuacuaccuuccguguuccccaaacuccuccauucaguucugcucugcuuugggucaaugccgggcuccuccuucucagucacuuccuuccuucaguuccuuagcuucaaggaugggcucuucccagcugccccauugcccugggauaccuagcauucuuuaaauguaaauccccccuucucaacuuuccagcauuggaagaauaugccuguauaagugucuauuuaugugccuaucagugucagucaaagcuaaggcccagugacucacagcuugccaccgaccuggaugggagaugugaacucagauuucuguuuacuccuccugggaagguuugauuuguuccuuuauuuccugggagugugugcaaggcacuccuuagguagucccauaagaaaagaagucccaugaagaaguuuugacucaagcaggacccguaggaaagaagcagaagcuguaagccaaucagaugaggagcagguuguguggguccugaugccuagcaaagggacuaggugcuguuuguuguggaguuaucuguggcucuuucccugcccuucugccuucucuccuugcugcaaugugugaggaagccucuucccugggcucuagaggauugugguaugguccugguuggaaagcuggcuaaaaagaccuccggacccagagagguuccugguacuauucgugugugugugugugugugugugugugugugugugugugacugaggaaggaagguagaccacuaauccagguucuugcucuuagccccacgcucccagaaauaaggcucagacucaagacauauuuacaaagaccguggccauauaaccaggcucuucucugacuagagcauaacauaaaauaucccauuuauuuaaaccuaaauucuaccaugcagcugguuaccugugcucaaguaacaugugucuggcuugucacaucuucccagguaauucuccccugccuggcucuaucccugaauucuuucugccuccaggaugucccaccuucuauucuacacuuuccugcaggccacagguuuuuuuuaauugacaggugaugcaucuauacaaaauacaagauauucuuucugcacucaccccucagaaauggaaaagaccauuuuucuacuugguuuguccuaauccuugcugcccaaacucaagcugcaguucaguuuggcgcgcucagggcaccagacagcgcagaccaucccugcccagagcugugcuaaguggauugcagagcagacaggagggaagcagugggugagggugggaaggcaggggcaggugagugaggacagggcugugcugggcagagucccucuaccagcaggagaagccugggccuggcauguggcauguggcuuguggcauguggccugugacaauguuguggaugcuuuugcaggaucauccggaccaaaguucagcagccuuuccacccaacgccggauggggcagggacaggagugacugcccccggccacaccaucgguaagagagcccagggaaggagaaaugaacuuagaaaacacagccgagcccugggaacugccuaauccagggagacccagggcuguccaugguccccacucacuccuuucccucguagggucucucuggugguauuaguucagugccucccacccggccucuccagucugugucuccccuccccuuccuucuccuccccuccagcccccccaccccuaccagccucuaucugaucugaucucccucugcauccuuccuuaagucccacgcucuuucauguuuacuuuuuuacuucauuuuuuuuuuuuuagaaaaaccaucuuuuuuuggagugggggugggggaugggauggagaaguggcucagcaguuaagaacgugcacuggucuuacggaggaccuaaguuugauucccaggacccacaccaggcaggacucaugugcacauacauuuuaaaaguagaucuuuuaaaaacaaauguuggcgaggaagggauggaaccccuuaugcaugguaggcaaacacuuuucccuguuacaugcccagacuuugaucuuucucucuucuucccgucucucccuuccuucccaguccucuucccucccuucaugaguaugguuauggaauugucugucugucucucuccauccuuccuucuggccucuuuucuuuuggguuguuuccucuuaucucuuggucucugccucauguucucuguugcucuuugccucuuuggaccucauagaccuccaugggaucucagagauacagccaaggccugccagaacuccugcugcaaccuucacuauagcauacacacacacacacacacacacacacacacacacacacacacacacacggggaggggaagggagaggaagagggagacacaaacacagagaggggggaauggagagagggagagggacacauacacaaaccaacacagagaagagggggagagaaagggagaggaagagggaaacacacacacaaacacacacacacacacacacacacacacacacacaagcacugacuucuccuuggucuccuucccuccugagcagcaggagauagaauugacugguccagcacugcuggggucaucaggagccauguuuccccaggccuggauuagugugcuggagggaagguuguacucagauaccugagcugcucauagaagagagauuggguucacucguugguuuccuaagagggaacuaggaccuucuccagugauuugaagaccaguagcagcugggagagagcacugcuuccagaggacauuaagagcagcuugugucuccccaagcaugggaguaagaucuuagggagcccuagacuuuaaaucggggcugguaaagacuccacccaggagacagagaagcagugagcugggguuuguuucaaaggauuugcucaaccuuuggauuagguggcauuggaagagagugguuccagagggcacaguugauccugugcuauccagaaggucauugaacugcuuuccagucagauaaucuuggcagucucugagccuauacuacauccaucuugaggggagggggcuugagggaccauaaaugccauagguggcagaggaggccuggguugaccggucaccacuuuccccaggcugggcuaacagccugcaaugucugucugugggagugauuccucccucaagccucagcggaaggaagaggcuaugagcccuuguccuuccuucugcccucugugccugucugucccugccuggggcucuagucucaacugcucuucugauagugucuccuccuucuuccauccaguucccagcacggccuccccuccuguuuccagcgccucuaacgacccagugggauccuacuccaucaacgggauccuggggauuccucgcuccaacggugagaagaggaaacgcgaggaagguaggaggagggacgagcucuggcuccccccuuugcaugcuuuguccuuggacucugagcuccgguuucugcgggccagccuugcagcugcucugcugugagaucaguuuuagcaugggagccuagguacccccacugcccugcuggcucccggagagggggagggaggcugcugguggggucaccagcuucaccaucugcucagccccgauggucucaccuucuguggggacucaccccagcugucccugugggaugccagggggaguggcaucaccuguuuaccuugagaagguuguagagguugaggagacagcugguaccugacccagggaugaaaggccagccuacuuuggccucacuugaucuuuguuagaagguagcagcugauacggacauggacagcccugagguccuuucucuguaauacauggacacggcucccacugaagucacuugaggagccagaccuaaggccuugagauguucuuugucaugagagugggcaccauucugacucccacuucuccuaccucucccugggcccucaagggauagccaguaccuugaauagcauagacccaggaaugaagaauuaagagggggacacaggaugaaagaaaauuagaggagagacuaguagguguauguaugggacaaggggcuuuucagaaacuguuucuccagugaugcauugugaccagucaguuuucuucuggugugugaggccugggcacucagaugaacacauaccaguaccucaguccugcuucuagcucuaagucucucaggaucucagcuagggaaggaguaacuucuggucuucgcaggguguauaggauucugaagagaguuuccauaaaauagaaccuaacagccggauggugguggagcacgccuuuaaucccagcacuugggaggcagaggcaggcagauuucugaguucgaggccagccuggucuacagagugaguuccaggacagccagggcuauacagagaaacccugucucgaaaacaaaacaaaagaaucuaacaaagaugagcauuaaagggggguagugaccauauauuccacuagcucaagguagucacaauuugaccuauugucccagcaccucaaacaggcaaugucuccuucuccccuccucagaaacguuaugguuggacaguagauucugugaucauugcaagcauagacaagcucuucuugagggcuuaaggaacagcaucagagacaaagcugacauuccuugagcugcagucuggauucuccagacccaggcagagggaagacagcauaugagccuuggccuccagcagaagggacagagugcaggagagaccuaguccuggcaagacagugaugaccuggcacuggccuccugccagaagcccuaauggucucguuucacagggaaacagcuugucuggcucuauuucuccuucuuccaaaauauccaaacccauuuggcugccacggccuuugccacucacuaaauuucauugugguuguuuuggcggcagccccugaugggcagggggaggcaaccggagaagcccuaagccccaguucuccccggagcuucugacauggaggccucagccaagcucccuggcacccugagugccucgguagagucugccucaaagccuaaggguuucucuuuagccaccugccuuguuuagaaugugagguguccagggggaccggaaggccacaggaacgcuucugugcucucccucauuggacugaggcuggcguugugugugccuucuguugccugagccuucauggguggugaagggaggcuggggauacccagggcugggccagccagugagaucaggaacaggguguucuccccaauucuuguuuacauccauuguuuuuaguccucucugccugucaguuaggagaauagcuuggugcagaggguccccgagccaaacgagauaugaugcuuguccuuaggaaaccuauacucuaggacauauguuuaacaguguauccagggaguagaaaguccaucagauaugguauaguggagaucuggccaucccuuuauaggggaaaagaggcagggaagaaacucucugccaggaagggcugcucuuugaggaaggcccugggugauggcugaggaggcuguuaaggccagugugagccugaaguucuaucugacgcaucaagccuaugcacaggaagggcaggguggccuuagcaaggaugugcugaguaggcagaaggggagcgcugagaagcaagcccaaguagacagagucaugggaggugaccaagacugugauacgugagagcaagacugugaaacauacgugagagggcgggcucuucuguaucccuguguguaucugggcaggaagagauagaagcaggguugacuugggggccuccauccuggcaacacaggaagcagcugcagucuucaggugaggcauagugacggccucagaggcucaucugcuaggccuaaccaggaagcaucaggaacuaugccacuuccccccugagggguuucuugcccugucucuacuuuuuuuuuuuuaaaccaaccccaggccagauggagcuguccauucuuuagaaagcuuuccccaaccaccguccaguccuuaacccauggaacccagaggggaagggagccaauggagaggagaccacaaagggagaucuguaggacuccucccuucccccacuccggaggccuccaagcagcagggcccaguuugcauuagggagcagcucagaugauuaagaauggggagauaauuaugugucaagaugauguagcccaacucugcagucaggccaagguagcaaagcagcuggcaggccagucccugucguugcugcaggaggcgucucgggcgcacagcccguacaguacggacacucagguguguccuucaacucucuggccaggacuuuuggguacaauggaaauugaucugagggacuguaagguauugaggugagacaagagaugccuauccagggacuagaccccagagggacgaaggggaucagguucauuuucucugggauaguccuaaauguaccagcuagguuggcccuccuuugaccccaaguggggugacaucacccuagaagugucauaucuugaggagagcuggaugucccucugcccuucuuauuguggcccauucuuuaucucuaaccauauuacggggauggaccccagcaaggacuaugacuauagugugucccaggcauuagcgaaggccuucucaguaaaaauuacugguacucacacugguaacacccagaacguugcuggcacugacccuuggaacgugaaugccaucuguaucaguggcauucacauccacgggggaaacucaugaagggccaguuggcuuugacucaagguuggguugggauucccaacccauggccugucggagugugcaaaaaugcagacuuuauuaggagaaauaugguacucaagaagguuggaaccuccuccuagagauccaggaccccaguuagaaagaccagggagagauaaagagauuaugcaugagaaacuugggacacaggcugacucuuagcccaaggaggagaaauccacgucaauacccuggaagccuucauuuccaaccuacaguuauaggcaggguuauuaaagcuugacucucugggaaaucuaagaaacacaguuccaugaauguucuacaccuuggcuccuguggcuggaaaacagagugguaccaaccuaccugucuaucaucagauugagaaagaaaaccgaggcugaggcaacuuaagugcuggccuagcaggcauaagguccuagguuugauuccccagccuggaaagaaacaaaacaaaaccaaccacagaaaccccaugucuuuuaccuuccccaugccugccacugcuuucagccacaguaaagcacagagaaguuuuauaacuugucuaaacauccaagugaagucauaugaugagagucugcugaucugugugaugggggguguuguggguguuggggggggggcggggauguugguaugugugagcuuugcagggggugugguuuugcauuccauucuuuagguacacaacgaauugugcaaugggguggaggcaagcuggugcaguugugcguuugcaggcaggguagguugcauggcugcaaaugccuguccuaucacccuucugcuuugaaggaugcuguugcuggaaaacacugauggauuauuucuuuaguuaguguccuccuaugagucccuaagagcucagguuaugcuuggggcacauaaggaagcugaguuacagagacgaucaagacuuguuuaggggcccugaacugagacaaaagaaaggccuggcagggccaaagccugcacagcccuggccuaaccuguguacacacuggcuuugaauccuagagcuauucagcugaaagacuuuggggaagucauuuuauugccccaucuccccugucaaaugggguaauagcaauccuuacuucuuauagagaaguuucuagaacauucuaugucuagagcggagguucucaaccugugggucaugaccucucggggacggggguggggggaaucaaacaacucuuuuacaggggucaccauagaccuuuggaaaacagauuuuuuuuuacauucauuauaauuccuaacaguaucaaaguuaguuaugcaguagcaacaaaaauuauuuuaugguuggggguugccaccucauaaagaacuauauuaaagggucucagcacugcgaugguugagagccacuggccuaggggguuaagccaguuccauacuggaagacagaucacuguauaucuagguuaaaagauaaagaaaaggaaagaaaaagaaaaagaaaaagaaaaagaaaaagaaaaagaaaaagaaaaagaaagucuccuuggcuagugaagauuucacaagaaaauuaaguugugagagaaagaagucuauucagaccuagacacccuaacugcagugggguaccuuguaacucuggaaugagcucaucugggaaggauggguggcuggccucacuuguacaguugagacucccuuugucugccuguucacuuguugcucugugguuauccagugagccacuugucauuauuuuaaaagcaucaaccagaguuuucuaugcaugaaacuauaaaagccccccccccuuuuuccgaauacaaggcccugacucccccuaucuuucugugcacauuucuacuccuacaugcaagcuuguuuauuugccuuggagaauauauucuuguucucugaaccauauauuuauuuuuguaugguuugugcaagggcauguguguggaauauugcucugagaucuuugguaguaaggggguauagaaugucaaaugcugagaacgcaugcaguuugcuaggugaugugcauguucggacagagcacuguauggcuguguaugugcuggcaccaguaaccagggagaguccuaagccagaccuagauauguugaguguucaugcuccuaagcaugggccugcauaugauuuagccccaagaucccaccggcaucaaccuacaucuguugacaagucagcagacuguccuaagcccgcuccuuggaggaaguggcugagccccaagacuagggaaacugaggcagaauugcuucccauucaggcugugugugauuuguagcucgagacuuuuuuuuaucucuuugaagaggggccuggucucccaguuugggggucuggcccccgaucuaccugcuuguccuucgggaugucucagugucugucugucucuuauuuacuccagucgagguauacacugauccugcccacauuagaggagguggagguuuacaucuggucuggacuuuaagagguaugagggcuagagggagcacggugugggggucaaggggaauagcuugggggguggguuggcuagagaacgucagagaaugggucugaggguagacagccaacuggaggcaaaggcacaggcucucaccgggagcccaagaagcuaacagucucugcaccuggaucaccucugccaugggccaccgcagagguuuuggggcugaggccugguggcccagagggucagccgcucaguggaugggggcaguuuuucuagcccuuggaaaaacaaagaguggaucggguaguaaaacaaaagcaaaggagaccuggaggcaccugacagcccuaauucaucauggcccaaguuuuuuccuguguucccauuauauuuguuuguaaaaguggaaaucaauuuugaagguaauuuucuggaaagaauggaagggaggugggagggccggauaaggcagagaugguaaaaggaaaaauuuaggccaggcacagcccaggggcagcucuuggcaaggugaaagaaaauugcauauucaaucuccauccaugaaucucccucacugcuacccgccuccuucuugaaaacaaugaaggcuuuuucccagcgcugggcagggccuccguaucagccucacuuuaacuucagggucauuaauucccugauuauugaaggagaagagaggguugcagcaucgucaauuccaaaggcacccccaugugaucagacaccggcugagauggggggggggggacugcgaggugaggugaggugcuuuggaagggggcggggagagaggaaaugggggagccaccuggacuggggggcaggaagccgggaggguagaagaggcagucauuacugcauaccucuguuguguuguuauugcaaauuaaaaguagcauguuccacuccacagcuaucuuuggggagggaggggcacugagggaggugggggaucuuaucauugcuucuucagcagaccagcgguggugucaccgugugaggugacauuugaauuuacaauuccgcugagaaaagccauuaauucacaaauuaacauuucucccucucccucucucuuuaacacucucucccucucucacauggaugugcaagcaauugaaaagacaaaggaaauagccuuaaggaagagacuuuacggcuagucugucugugcugagauugcucccccugcuuccagauagauaaaccaauuaccugagcagcucggcuccuggccgcccgugaucgccuccuuuugugggcugccuccguggcuggcuuacacucguguaucucauuaauggaaaccaggcgugcccuggucaccaagcucuucccagcuguccuuuggaggaaccgugggaagagaaccggugguagaggagacaggcaagggggauucuggggagguggagaagcuguccuggcccuggaucuugcuguaccaguagguuaggggugagugugcagaugagcaugguuggaaaggcuggcuugcucugaccuggaauugaguguggacuggcauugagagacagagacuguaaacugagucugacucucgcagaggccuuuggucucauugcaaggagcugguggacccauggagggaucugagcuugucccucaugggaaggccacagcacagggaaguuuugcugacuacaugcuauuucaguggaacaggauuucaggauacagccugaaggagcugggagaaaugcugagaaggguuagaagacccaauaaggucgcacauguuggggcagcaaagugagauuguauugauuccuuaagauaagccuagugccuggguacaacugugcccaccugguaccugccuuacauacuuacacacacacacacacacacacacacacacacacacacacacacacacacacacggaguaagaaagugagcuacagagaaaggaggaagcuaucugauucguuucuuagagaauacaguaguccucucuuacccauagggacaucacuccaagaccccugguggacacuugaaaucacagagagcucuauauguccaagucuaucuauacaugcuuuguuuccccccaugcauacagacaaaaguuuaauguauagauuagacacaguaagagaugaacaacaacaauacuaaaauagaacggucaucgugauagauugggacucagaguuaaucugauaaccgaggcaguuacugagugaccaacgggcacgucacggguacauugaacacaggaaugauucacacacagggugggacagagcaggcagcucaggauucuaucucauuacccagaaagauacacaguaaaagccugugaauuguuuauuucuggaauuuuccacuuaacauuuuuagauugaagauaacuaagccagaagaagugaacccugggaugaggagaaacugaggcucuguggauuacugaggcugggguuuuauggcuuccuaugugcugugcacuaccugugacaugucacagacucugauucagugcaacaggucccuuggaaguccagaaaacaaagccgagacauggagaccccugucuagacaaacccugaggucugacugaauuaauagcacucaguuuacguucaucuccagcaaggacucaaaaccuggcuacuauccaguuccagaaagaguucaguucaaaggucacuaagacuccagagagagaaacucacuuauaaacacacacucuugguucugauuuuaccuucucaguagccaaggaaaggcgaccggucauaccuacagcagguuccuuuuuaucuguuagaucacauauuuuagcugaacucucuggaucacaugggccacgagccugugacucuucagaagcaaacgcagguugugucgacguuuugcuaagcuuaugccugugggcucugugcagaagugauguguuuaucuguggggaggugccaaguuuagucauggcugcaugggacugaugggugcagaucuguagacuuaaacacuagagacgaaagccaaauuguuagguucuuucuucagcuaguucaugcugcugcugcugagguggcggcggcgguggcagcggcucaagauggaguugcuuaaaguauucugagguuuaccacaacagaugcauuuucuauccauugacagaaagucggaacagagagguggagaaaaggcugcacaggucacuguuguaucucuguuccugaacacuuaguguaggucgcacauucucugcaaaguccaacccggcauuccgcgccuucccuguguuuuggcccucaugggagaacccaucauaucagaauggcucccauuccucaucuuccccugggcaacuggccuccagcccuguauguugcugugguuuccccuuuccacucccagcaagggcaucaagcaagaaauccauucccuaggcucugcugucuuucucccucccccacccccaccccucgaacagacuccaaacauaggagggaguagccaggcucagggcccugcugcuugugggcucaccuuccugggugccccauuuucuggagaccauuggauaaugaggaaagacaggcagcuagcauguugagagacccaggaugccugcagucuccuagacaauugagaccagggagcaaccugccucccucagaacccugguaguuuuggagcuguccgggacccucauuuucuggcccacagcgguggaaaggccagacaggcugggagagggugggccuggcgcaagagcuaagagucagucaugagccucagagccuaguuacagcagagccaguaauucaaaccauccugacccuuccaugaacccaaaccugcugaccuugacagcaccagacaagaggccucgcaaagcucgaccugcugcaggccagccuuccuucccucccuucuuagcagcccuuuggccuggcuuccagguggcuccucauuuggccaucuuuaugaaaugucagcauacacucccuccccgaagcaggccagcuucaaaggacccuuugugcucauccccacuggagauagggcgugggcauucccuggagccuguggaggaccccuggcagugaccuucugccacgacugaaugagcagaccauauagcccuucccuucugcucagucuauguguauguguguauauguguguguacaugugugugugugcacccauucaugcauguguuagggugcauagaggggcagagaagaugauggagacagagaggaugggggaggaaagagaauccagagguaagaaaccccaggaaccugcauuaaaguaaauguaguuuaugaaguuugcgcuuuccuccuugggagagcugaauuccauccaauagccucuccaaguuggccaagcagguccagaagaugaaagugugggaaggaggaugagugagccagcgacagagggagaaauguucauacacucgugcgugcgugcaugcacacacacacacacacacacacacacacacacacacacacacacacacacacgccugcagacugagaaagccuggggagccgggacagagagaugcagaagauguacuugggaagaguggcucuguggcuccaagaguccucuuuucuucucucuccaucccgccugucaucucuaccucccccugcccccgccccagggcaguguggucagcauagacacuugacuguguggguacugggaggcauggcugugugguaaacugaagcagacaauauggagcaccuggagcagccagcuuacaggagccaggagcauacucuggguggucuugggcagcggaaaugaggacuuggccacaaaagggaccagaaugugguacugcuaaguuccuugaaauuuaccucuucugaugcuggcuaauguccacgugggcucccugaggacugaggacagcuaguguagucucuuagggaagaugguuugagaccuuugucuuuucucugagaauucaaaggagauaaaugacuaacaaggaggaggucgugagagaucucagagggacuuaagaguaucagccuuuccagaccugugugugcacagcacagggcucgggcugaggguacuaggaacagcugagugggccagagcccacagcuuuggguuuuuauuagcaaacauugguuacagauaauaaugggcuucauuauggcgucuaauacauguauguuuuuguuauauucaccccauaaugucuucuuauccuuauuacuucuaugaaucugcucuacccaaccagucccuuuuaucuuuuucuguaauaguggaggguuuucuuuuguggugugugugucuguguauguguguguguguguguguguguguguguguguguguguccuacugaguuuaagcaggacccuuaacuuuugagaacagggacuauggagaaaaaguggcugagaggaagagugucuucacccugaccugcagaugagacaucagcucacacacacacacacacacacacacauaugcgugcgcgcacacacacaugcaugcacucacaugcacaugcauacacaugcacacaugugcaugcacacacaugcacaggcauacacaugcaugcacacacaucuacacacaugcauaacacaugcacacacacacucgcacauauacacaugcauacacacaugcacgcacacacacacguauauacacacacacaaacacacacaugcauacacacagauacacauacccugaguuuauguucaaguucugccagaagcugggacagaaaagaaugacaggguucacaaagacaccgaaaggagagaggagagggaaggaaggagagagggggagggugggcugauuguggaggauaccagagcauccaggguaugccaggcacagaaugaggcagaaacuguccggggauggccuuggcccuugcuguccgcugcucuuuccucugcccucccccccucagugcuccccucuucccuccacacaucuuuauuggcucugguaauagccuugauuugcaugucaggcaaagccuugcuacacacaaaaagaaagccccaaccguggcgguguggcagugucagcucucgcuguuguucgacaguguaaaauuaaauuaauaaagcccccaacacaggaaaacauaacaggaaauuaauggccuuuacugucgcucugaugcagucauuugcaacccugcuuuccgcaccaaggacuucauaaaugcaagcaguuucucuaaacaagcauacuuagggcggccugguauguaauuuuucgccuugcuuguguccuuagagcuaacaaagcccccuucccucuuagcuucagagagguuucuaacugguuguggcccaacuacagcccacugaggguuguucuaggcagaagggcccagccccuuuuggagggguagaggaauugcuagaguuccaacagaggaauugcucacuccaugagccccucuugucuacuggcucugaggguuaggcaacaggauugcacacccaaggcuccuucugucuguucccucaucaccugcauguguucauccuuccuucugucucuggcuuccaucuuccucuucuccaucucuauuaaccgagcaucuccaacuucuucacacagguggcaaacuuuggggcuggcuccgccauagcaguggguaaccugugggcuuucuuggggugcaaaagaaagccagcugaaagcucaaaaugggcaaagaagccgugcuaaugaaguauucuggggcucuaggcuuccucuguucuuaaagguaacccugagggucccaaaugaucauucucacugucccucuguucucaggcagauucuagaccugagagucuaugagcugcugugguaggaagguaggggacugcuuugugccagugugggcccuggugcccacuaggcugggcagaggauauauuaggaaagcggggcuucacagggcacacaggcagcugcucguuaagaacugagucucaugguuaugcauucaagagggguucagggagaugagaaaaagggugagcaggcaguggggcuugcccaggaaauuggcuguuuccagggacaccucccauguggauggaggccaggggcuggggaaccgacaaggcagaaucccagauucuugaggggccguuggucuugccuaccuuuaccauugagccugccucccugcaacucugcuugcugggccacagcccgcgcauggucacggguguagcugaacugcuccucuguucgcagcuaugcuuuucucugcuucaaggacgggcacaggacagaaguccaccccgugccucacugguaggauguuuagauauuuaccucaucucucacaauccuaguuuacucuuugcuaaaauauuuagaguucaugacauuuaucaguagagugguggauggugauaaaaaagaccuccauuugauaucuuuucucuuacccccucccucccucccucccucccucccuccuucccucuuccucagucauccaccccacuuacuaagcucucagcaaacucuaggcugaacccuggguggauuucagcucuccuugagguuaaauuccuacccuugaaggaguucccucaccauccuggccaccuaucucugaauucaugaacaccgagucccagcgacaguccagccaaggccaaguacuuaauguggaaccacuggcccucgccugccuggagacuccacacccauagcgucuccuaagauuacauucgauuuuuuuagcaggcgugucagacucaagcucauauuaaguucauggucaacgaaaaccucaagaucuuuuuuacaucaauugcuacccagccagguccacccauucugcacucuuguaauugauuuaaaaaaaaaaaaaaaaaaaaaaacuaaacauagggcguuccauuuaucucuguugcuuuuccaucucauugguucagguucuuagugcuaccugaugaaagucauaaggaugucuucucugacaucauccaagucagagaaaacaucgucuuacaggcuguuuuucccccuccuccuccuccuccuccuccuccucuuccuccuccucucccuccuccuccucuaucuuuugcuccucucuccucuuuuuuguugucauuauccuuucaaaaaaaaaagagagagagaaucacauggcaaaacagugaagacccauuccugguuguaguacacaaucgcuuuggguaccacugagcuugagucaucaacauuuagcucugaaagaggagggcauguccucgucaaauguuaacauucacuguauccacaugacuuucuuaacaaaucagguaaggauggaauauccgucuaagcacugccuacggccguguaaaacaugcacaaccaccguacaaagguaacuggaguagcucuugacuucaggaggcuuagcauccagcggagaggcggaugugcaaaagcaggugugccucccaucacucaagcagaacgugacugaugcuguaaucacgacaggaaagcuaugaagaauguuuuaaaagauaaaacaaaacagaguuguaucuuccagccagggcaauugggcaagccaucauaguggggcgggcauuuaaucuaagcaucgauaucaaguuuaaugugccacagcugacucucggugagcgcauucagguuccaggguaucacaguuacuucuccaguccuugcacaucgcuagugcgaucauuucuuucagaaaauauauccaaagccuuacuuaggcuguugaaugcauuguggagucuucugaaaccccaccuucggggcucaaggacucagcaacagcugauuuagaauucuggguuccucucacaguccugagguguaacagggaccugaaaaaguuagcucaugggaaacagcucagggcuacuggcugggcccucccuggggguuguuuccuacaagacaaaggcaagcuaagaguucacucugccuuuccucucuccuguccucuccuguccacuccuguccucuccccuccccccucucccaucucucuucuccucucuucuuuccuuccaugacuaucucuuuucccaagcuuugagcuaaacaugccucccuuugcccguuugcuuugucucagcuccucugggucuuugucuuccuggcgggccuugcucucucaucucucucccugguuacggucccuccuuccaucuguuuugugcccuuuauggagggcuggugcuuuugccugaccauaagugcaguacacgcuuauuguaaaauauuuggacaagccaauguuucuaaaaauaauccauaaccuccucgcugagugaugauaaccaauguugaaagucggcauauuuuggauccuuuuccuccugugcguguggaacuuuagauauguaauucuuaauuaaaguuggagugcuacuaugcacacagcuuugugccuugcuaguuuuacuuaacauuauauaguagcauuuucacaugucauuacauauuccuugaaaacaugauuuuuuuaauggcugcauaaucuuccacuguucgauguacauguccuuuuaaauucuaggcucaucauauuuuaaggcuuagccgugugcagcaacggugauuuccuuaaacgcccuucucgcuccacccucccucccucucucccagucccucuaccucauccgguugauuguuuaagcuuauggaggcagaauuucaucuuucagagcaucugucuucuguggaauuaugucuucuuuuagaaucucuugacauggaguccucugcguguucuuuccuccugugagguucccccaacacccccuuccuuggccagcuuuagacagggcugguuucuuuccagaucuccaucucuucccuuuaacccauuuuucuuucuuggccagagucaaggcaccccuaguagggauaggacagugaccaucucugucacacagaaacauugccuacccuuucugggcugcguuuuguucuagucugauuuuaaauuucuuaagagggaaucagcccagaucaccuucccgauacucuuugcagccccugugcuugcuucuuuuucuuuccaaaagguaaaaugugggggacaggccaguucaggauucaucuacuucugucuuuagaacuguauugaacaaauuggucaacacuugagaucacaaaugucaggcccuaugccagguuuacaaagaugagaaagugggaccucugccuucagagacaguucaguaaagaaauccaguggguuuuuugguuuuguuuuugaacuuuuaaagagauuucagucaagaaaagcgauaugacugaguuuacuuuuggcucugacacuuaucggcuaucgugaacaguuugaggaagucaccugucuuugaaaacccuguuuccccagguuaugagcccagguuccagagacaacauacuguggucuggcucugccuugucugucauucauuagcugccucuauaugaccuugggaaaguuccuuagucaccaaacuucuguuuccuuaccuaugacauagguauacucauagaagcucccugguaaguuuuucuuacaaaaaugaacuguugccguaguaaaaauucauacacaagugccuauuuuacacccacagcuuaacaaauucuaguugccacuguucuaagaauuaaauccguguguacauauuaaggguaguauuucguauccuaacagaaucuggcuccauuuauuauuuuuuuuuaauauuuuuuuuauuuauaugaguauacuguugcuaucuucagacacaccagaagagggcuucagaucucauuacagaugguugugagccaccaugugguugcuaggaauuggacucaggaccagcucuugaccacugagccaucucuccagccugcuauuuauuauuauuuuuauggcagagauuaggauggagagcacuggaauacugagaaaagaaaaaaaaaaaaaacacuguugcugagggaggaccuccagcccuccuaucuguauccgaggaaacgcaauccagaaaagcucucaggauuuguccaaggucacacagaaagugaaccaaacaacaagaagccaauaucuggggauguuacaccuauucaagggcugaaucuugacuuaagggcgugacauguaucccagccuugccuuuuuuuuuuuuuuaagauuuauuuauuauuauacauaaguacacuauagcugucuucugacacaccagaaaaggaugucagaucucauuacaggugguugugagccaccaugugguugcugggaauuggacucaggaccuucggaaccugcugagccaucuugccagcccccuagccuuguuuuagggucccuaacauaauguccccagaaguaaguaggugugggugggcauagcaagccugaggccaggcguacuaucagccagcccagccucucauccuaagaugagcccaguacuguuuagaagcugccuguagcauucgggguuugccagugcuaguaugccaggcagaacuaacauugcccagagccaaagcuuugggccaggcucccaagggauucuuuuuuguuguuuuguuuuguguuugagacauagucucguuauguuauuucuggcuguccuggaacucucucuguggaccaagcugagcuuaaacacagagauccaccugccucugccucccaagugcugggauuaaagacauguuucaccccauccagcuuuccaagggcuucuuucugacuuccuggcuugauuuggguucauggugagaccagaccccaagguuguccagaguuugaagugggaagcagugggaagcaguggggugcuacauuccuaucucaaguucaggucacugcaacacaguauccauuuucucucccccuccuccuuccaucucuccuucucucuugcuccaggcuuccugucuccucuucuccucuuucccguaucccuuuccccauuuuauuuccaucgagacucccuucccucaugcccauuucuucuugucuuuuccccucuuccuucagccuccuccgucccucauuccuucaucccucggcucuucuccaaauacaaaaggcacuccaguuccagggagcaaucccauccccuguuccacuaucagaugggagggcccaaacagcagcccaaaucuccuccagguccugcugugccacugcugugggggguggggccggggcugcacaggcgggcugcccugaaugacaagagaggcuauugaucgcauucugaacucagcccagcagauagaagguaauuaaugacuccauuugccucaguaccggggagaacaauugaguuugcaacagcagcaacuggcagcugggagcuggggagacuggggggcgagaugggggugagcccucuucggggagggaugugaggaugagguagaacaucagauguagugcuccuugcccaagcucggguaggauucccuccgcacucccugcucuccuucccuccuagacaaguucuugaggucuuucuucugacagugacuaaaguuuggcuuccucccagggaucgcuucuugccagccccgggaucuugugcauauuuugaacguuuuccagagcuguuuccucuggaaaagguuggauagauggaaccucauucucgggugcucuguggggcgcuagaggcagggagugacaaaagcaccuugaguuugccaagaggccaggacgugagcaguuaaaggauggguguggugagaauggacuuggcuuacuaggaagaagggagcguucuggcuucagauccaggcuaucuacuuaaccagcuggaugauguuagacauaccaacuugcucccugagacuuauuucuuuaucugaaaaacaaugaugaugaugaugauagcuagaaucuaguaaaauugaacagauuuaauaaguguaagugaaagcauaucacugguuuccuaugaccagugcaccuuuguguuugggcuuagaaacuaaagcgcggugcuugcaugcuugccuggccuaugugaggcccugaguuugagcauugccacuagaagggaaauaaaauuaauccugaaguugauauaguuuaauccuauguuaaaaaaauucuuggagguuggagagauggcucacugguuaagagcauguacucuucuuacagaggaccagaguucaauucccagcacccagagccucucacaaccgccuguagcucuagcuucagugaaaugucugcauuugcauggacauacucuuacacggaaaaaaaaugcaugcauacauagcauuaaaaauaaaaaugauuuugaaaacucauuuuagccugcucccaaaaccuaccucuuuuuuuuuuuuuggugagugcauagcuccauuuaucucuucuuggugacuucccacucaccaagcuacugagaucucacuggaaagucccauuugugauugcccagacugaggguucuggccuagggucagguaugggggacaggggcugcuccacgaacagcugggaugaauaguguugaggaaguaagaucuucaggaggugaucagauggagcuguaagacauuuccuucuucuuucauguuugcacauacuguguguguguguguguguguguguguguguguguguguauguguguguacacucuaucacuaagcuccuuggcuaguccugagauaucuuaaagaacaauucucgaagugaucugugcccuagacaacauaggaaagcaaagacggaaacagggaaauuugcuuaugaucaggaaguagucacugugaccauguuggggacaguauuuucagccaagaugguccuucuacauucgugguugccuuucucuccguagaggcuggcugggcuuucugcuauggagcuacucgagcguaguugucaaucauuuuagccuauagcuaaacuguuuguugaguaacuuucuugugcugggcucccugguaaacacaucccggccacuugcccuuauguaaucugcacuucagugacucugacccuuuguuuucucagaagcugaagcggguuacaguuccuaccuauguuggagaguuguuuagagggccaaauaacucaagaucuguaaagacuuucugucagguguucaauaaauaaggagucagagaagauaauauggacuuaauuaguucaucuauagcuugccugugcuccauagaggacuuguggugggcccacccacauugagaagaaucauaguuuaguagaaggaacaucuagaauagccacgugccugaacauucuacugcccaguugggagaacugggagaacuggcuucucuccucccauucgcccaacuagguucuacaacuauaacacgauaaauuuagugcccugaucgucugggcagucugugcuuagucagcacacuccacagagguuagccucacuauagggaaaaugccaguggagaacuggagaugcacccugcauagggccaagugguucucagcuggacccuggcuuuaguaccuagguagagaagaaacuuaagaggcaaguucucauggcagaccuggacuuaaauccugacuacccuuuacuaggagugaggucuuuaacaagauacuuaacguccuuugucuugguuuccuuauacguagaaggaguaccauaguauuucuuucacagaaggacuauucugaaguacagaugcguugcuuuuugcuuuuuaguacuucugagacagggucucacuagauggccccugcuagccugggacucacaauaucccccgcuuuaaccuccuaaauccugagcuucaggcauguaucgccauguuacagcuuuaggauucuuuuuguuacuuuguuugcuuguuuucugguacuagagauuggccgcaaauauccuauguaacugcuucccuugggccacacccucaguccaaggggcugucgaucguuguaugaugcuaggguaucuggcaggggccggaggaagcaggauuuaauccaccauugguaaugacuauuagcccaguacaugggcuuucuauagcaucgagagagacguaguaagccuauagcaaccauauuugccaaccuuucuuuaaaagcauggccugagaguuggaaagaguauuguaagcagggguuguuccagaaaguuuagaauauacagacacuauacuccauccagacuucuuggcacagggaguucaaauguagacucugagccccguccugggacagcuucuuccaccugcuuuggguagaagcagguagacucuggguagacucugauuccaaggcuaaguaaccccugaacccggaacaguguuuucugucaucuugaagcauuguaggugugugggugguguugcugagggguucugaguugaugcugucagagucuaacaggacugaccaaaaaugaguggguauacuuguguuggaccaaucagauucuggccagucuagaaaauuucugccagggguuucauacuaaauaccaccugggagagcucacucacucacucagccagcuagucacuuauuuaaugggcaccugcuauguaucaugccuagcauagacuuucagacaugcaucagucaguuccuaggcucagaucuuggcuucuuggauggggaauuguccuugcaauggauacuacccaacuacucucacauguuccuuuccccuaggucaggacuccauuuugccucugacaguaguuuugcagcuuagccagauagcccuucacgcuguggcuaguccuugcccuggccucuucuccagucugccuaagcauuuuuuucugucaccucugggaggccaucccgggugucaagcacugccaaccacuucgcuuuaugacccucucccacacucuucucccaugguuucucuuuccccuucuacucacuucuuuuccuccuccuuccugguccuccagguugcucuccauagcugaacacccagccaggacaccagguuccauccuucggacaagcguccccacccuggccagcgcccccacucccccaguugcuggaguggaagguuccuucccuuucccgguccuucuaccugcccucucuuagccucucagcuuacuucuuccagaagcaucucccuccuccuugcaccuuccuggccccucccacuuccuuuccuugcuuccgccugcccucucugccuuagcuccucccccuuucuucacacccaaaggagggguacccaucucuaucauucacagagcauagagcagaccuguggccggguuaggggucaggggaugucuuucugucuccccaaugauagugaugcucucucugccuucucucugcccuagaguucacuuacugacgacucuccccccccacccacccccccuaccucuccuuccccuccccgcuccaugauucccuccaccuuacuccuucgcuacuugucaaaaccccaccuuucuuccuacuuggaacugcccucgggacuuuuccccugaggucaguguucucugcaagcuugguggcccugugccacuaaugcuuucuaacuaccggccucccccccacccacacacacacacacauacacacaccccugccuccaccuccaccucucccagcagagggcuuccuuuuuccuucccuuccagcccuccccggcuuuccaccggcugccucuguaaccugucucaccaccagggccuguguguacagaaaaaauaaauaaauaaaaaggucagcgaguagagggagcagcaauaaccccuaaaacaguacuaucaguggaacaugauugaucaauugaauuccauagcggcugaaaaaugugggauuaaguaguguauuauacgcacaaugaguugaggcaugauguucauuucaaguucauuucgccggccucugccaccagaucaggcaaucaauaggggcagcagauaucauauaucaccucucugcgggcuggggagagagcgccauaaucucucgcaaauuuagagugacagauuugucaagaucugaagggccccugaauaaaugaaggcaaagagacuccuccagccagugaccugaggacaaagcuuuaguucagcuccuacacacacacacacacacacacacacacacacacacacacacacucggucacagggugaggcaagccacacacaggcauguacacaaauccacacagaggcaugaaaaacaucuugccacacauaggugcacacacacacacacacacguacaagcacauuugaaugcaugcucauugacaaauguaccuucuacuccuuaggacccuuucaguaagagcaauagauagauacaaagacccuugauucuacuuucccuccgcccuagcagcagggcauccccagaagguaggaggguugcaagcagagacgguuaggcacaauggggcaugcagauagugacaggcuauggcaguagggagauauacauccuggcaagaggagggcucgugggagaaagggaccgugagcuuacacuccucacguguccagguucuuuucaaaggauuccugcugucauuuaaacucauccagauccuuuuuuauccagguguuuaugacuuaggcauguacaugcauagagaacucucacacaaaggggaaaauaaguauacaguauuucaguucccccuacagggucucuaaugguuccagagccaugcaggaaaaaaaaauacaucaaguucuguccaaaggaacauaagaaugacauuauagcagccucugcccaccucaggcuggucuuacugucucucugucucucucucucauucucugccucugccuuucugugugugucucucucuauuuuuuucuuucuacaucucuacccccaccccacgccccaaacacauacucuccuugguccugaacaguaugguaagaagacaggagguccuuuuggaaaacagugucuuuugcuccuucuggaaggccagugaggaaggacggcuguagauugagguuaaucaauauguaauacuuucuauggucucccaaaugauacuguacgguguuacuguauauaaugcaauauugauuauaucauaucauauaaucaccuauaaacugauauauauaacagucccagaggaacacccuggggccuagagcacagggcuggccccaggcucaagauucccucgcuuauccuggacugaaggaagucaugaaauagcaggccggggcuggggcuggggccgagggccaucagaguuacuaagugaggguccaaagaggcuguaggacaggcucuuuguccucagaaugcucuaaaagcuccaaguggccaaacauuggaaggcagggauagaggaaauagagacaaaguaacaaguggacaaaguagagauuuggagacccgacugccuucuggccggaagcaggcucuaguagugaccagcccuaucuccauggagcaagucuuggcuccugauggaaaccagguguuccaggagcugucuccuacugagccugagccugagccauccacaagagaaagauggcugggucauagccaccggcaugcuucccagagucugaccauguggagggccaagcagcuccuaugacuacugacucuucuuuccuaccgcucuguguccagccugaccagaguaccucagcuuugcucucagggccccuccuccccaggaguaguuaaugauuuuacccagacucuauguuauacuuagcuuagagauuugaugauuuucaauccuuggaaucgguagaacugaaauuuaucugaacucaguucaauucuccacaguaauauaugucugagagcccagccccuccucaccuagugugacucaggcugggggaugggggagguucuggggaaagaaagccuuggagacagcuuugugggaccuccugccuccauuucugccuaguccuucugcccaacauaugaccucccuucuuucucaaucuccagcucuuucagaguucuggcuucuccacccugucucugaggaagggccagccccuaggccuuuagaccuaggccucuagccuccucuagcuugugaacgaaaagaaagggacccuagcagggguacagacauggacucaggggcacaggggccagagccaaguacccaaccccuuaaccacugcauuuuuccuuauuucuguuggccuggugcucaugacuuaagugucucuguguuucccagaugugucugagggcucugucccuaauggagacucccagagugguguggacaguuugcggaagcaccugcgagccgacaccuucacccagcagcagcuggaagcucuggaucgagucuuugagcguccuuccuaucccgaugucuuccaggcaucagagcacaucaaaucagaacaggugagagcggaacuucccguucacccagaacauaauggaacugggcagaaugagaccagacgaccaacacucccuguguuuauacagcuaccacguguguaccacgugaccacacagauagacguuaaagccuaguuaaggaaaauaauuucaguauacagucauuaaaaauuauaagauauggaucaaaacauaaaugcugucccuauucaaaguuuccaauuccuuaugaagggcacugugucaucccucaguccccaccccaccucuggcauucugugacucuacuaugggacagucagaaauauccucuugcuaugacccuugcccugcccccaccaggucccacagaaagucugugaaaaaucuucuugccccauaucagaaagaaagcccacccacaccugccuccuugucccugauacauccauccagugugaacccaggcuggauggcagcugucuuggccacccacgauucucccagacacagaaaagcacagagcacacaacacaggccaaagcaugcacugccacagcaaaacacagcacucuaaaauguaucccuaaagccucacauuucagggcuagcaagaugguacagugggugauggcaccugacacccaacacugcaagccugacaggcuguauuugguccccaaauucauguaaaguugggggagagaacugaccccacagagcuguccucugguuugcacaugugugccucagcaugcccuacucccuaugcaauaauaagcucuuuaucuuaaaaauuaaagguuucccauuucccaucaucauucaccuguccuucccacugcacacaguacaugcuccguagcccaacaguccugcagggcccauacauguacacacuucccaggccggcugcuccguaacccuagagcauaccccuccauccacacaucaauguaguccccaaccagccuacaaauauggccuagguuaggccucuaacuguagaacaauacaaccugcugugcacacacucacauuguacacacacacacuuccacacuggcuucaccuuaagcuccacauagcauaguugcacuuuaagacuucaacagccccuagccucucgccuuucuccccgcccguccuuuuaucccauaagcuguuugucuucauaaaacaaaaaucaaaagucuuuuuaaggugcccugagccauaaaccaacaaaggaggagcuggccaaggcgggcggcucagugcacccuccccaagucccuggcuguauuacaaugaauaaccuuuauuuacuuucauuagacuauuaaacaccagcacagucauuuuucccccugaaacucggagcagggcccauaaagcaaauccgaagccuaauugaguucauuuuaauuucucuccgaucacagcgaauuacucuggugauaaaucagggggcagcuucacccccaguagaaggccuaauuugcagcuaauuacaaaacugauuucuacaggaagaucaauacgagaaggaauuggaaaugacgaggcaaucccguccagccaaggaggggaggggauccucugggggggccaggaagcggaagggaaaaaaaacggacccgaaagagcagaaaaucaguuuuaauuuaacguaauauuaaucagagcaacuuuucuugcuuugugcaggcuccuggucugcccggcuccugggucuggcuugguggugguugcaauaaaaaggcaauuacccaaguguuucgggcaggacauccuuucagagucaauggcuggcccccuccuacccuucuguuagccauguggacucucccccuccccaauuucauaccccagugcacaggcagagagcaaggggcccauggggcugucuuuguuuguuuuuuaaaaagggacacccauaccccaucagcuaacccagcagugccaggccggaggccccacuagguccuucccccaacugcuaccucagccauguguccagcuccauuucugcccuccauggccccuacucagaggaacuugaguaccccauacuucuuagcaaggggauccccauugcugugcucccuccuggagcaucuuaggcaaaagauggggaugcugcuuuagggacucacccccaguguauagaccgaaucuccacucagcgugucagguccacccccacucucaccaaacucucccuccccacacagugagccccuccccaucucccugccccaccuagccaucuccuuccaccccaucugggagggcuccgggguccuccucuccaucugcacaccgagucuuucuguguauaagcaucaauagagagcugucacuuuucucccuucucccaggggaaugaauacucucucccagcccugaccccugggcuugaugaagucaaguccagucuaucugcaucggccaacccugagcugggcagcaaugugucaggcacacagacguaccccguugugaccgguaagguggcuuccaggagggugggggcacugcuuccagugggggugccucagucuaugccaucugggccccaaugagacaaguggcccccugccaugguaucugcagagugagagagagagagagagagagggagagagucuuuuccugaacagaugugugccgauguagggauagaaacauuguggucagaaaucugggcuucagccugaaaagauggaggcuaguagccagcugcugacucucucuguccuugccuccuuuccucucucucuccaguugucugguuaggacauauguagacgaauguuaaggcaaagaggccagcuggggaaagugacucagagguuccgggucucuagccuucgugcuuuguccccaagaguauugcagagcuugcuuuucucucucaaagcagcuuauacgccugggacuugggaccuaagggugugguaacagcccugcagaauggaagccgguuacuguagccuuucuguuguauccuagaggaagccaaugagaagaaguuagauuccaaggacuggggaggucaaaugagguggugaggggagaggcccccuggccaaaccuuccagggaugagaguuacagagguaccuggagaucuaacaaaugaugcuucuacuagagcuucaugugccggcgucagaaggucccuggcacaguggaaggguuuccgggccaggaaaguguuccaguaagagacacacauugagguguuauuaaaauucaccuaauuauccuggaggcacuaaagccagugugccauuccuaccuugggagacaggaugacugagaagggacucaguggggacugggagacacugaggcguuaccagagagugagcugagaccgccuagggacagcaaggcuguuguagguagccagcgucaccuccaguggcaaagacagagaacaggcuauaggaaggcucuauggugauucgucuggguggugacuugguaacuuuguguggauaggagggcagcucuggcugaggugggcucagaguaaucauccaaacuugaggaggcucccgagaacccuaccuuuccuguguucuccugaagugagugaucucuugguacagugguguccagcaaaaauagagucguagucuuuagcuaggaauccaaagagugacuaggcuuuaggggagcgauguccuuagugaggcccgccgaguuaguucacugcuuagaccagugaaugguucucaaccuuccuaacagugcaacccucccuuuaguacaguuccucauguuguggugaccccucaaccauaagcuuaguuuuguugcuacuucacaacuguaauuuugcuuuacacuaugaaucauacugcaaagauccaauauuugaucugugaugacccgcaagggggucacaacccacagguugagaaccacugucguagcuccacgggcccugggucugagcuuuccaaggcccccuauaguuguucucuggccuuccaacccaagccagaccagcuuucuggugcaguggauacuucucaaaaguggugaaacagcaagaaagacuuuucucaguaguuagugccacaguccagaagguaggaacuuccuggggauggacacauggcucuuccgggcaggacuccugcugcaggggacacugggggcuaauguggaaaagugccuccaccuugaacagcccccauccuucucccccccauggcccuggaacggucccagcucagccugggaacaucuccggcugauccaucuggauccaagugugagaaaaguucauuucagacccagcuugacauucccagguggcaaguuagcaguaacaucucaaucuguaugcgacauuucaaucaagcgaggaguaacaaaagcagagccauuaacauucggagcuguucaccagugguaaugacggggaaacuccgcucagaaacuggaaauuaccaaaaaagagagaaguguggcgaggggugggggaggggaggggaggggagggggcgggugggggcagggaaugauguuuuccacacuuggaccgagauccaguguuuggauuaauagugccauuacucgagcaagggcugcagauuauguucauucuuaaaauguucuuuuggcuggcaauuaaacggcugcagcuauugaucuuuguugauuuuauguucccccccuaauuugcauaaucuauuaaagaugaaugauucaugauguguuuaucgaggggacagacagaguuugcuggagguacugucaaggugagaaaacagguauugcccagagacuucauggaccaucuugggaacagguuuagcaugguagcuuuugggccagggcucguuuaggaagcauuaagcuguguaucaagaacaggcagcacaaaugaacuuugacuguguucuucuagacagauguugacaucugugagaacaggggcuccaagcaggcugaggaggugagagacucuugguguaauuugcagguauucuucccaaagauccuaccccauagaaucucacucugcagcccagacuggccacucauagcuauccagcuacaccccuucccagccucccgagugcuuuaguuaagaagggugaacugcuguacccggcucacaggcauucuuuaaaagcuuauuucauuugagacuaguaagggcuuuggcagaggaagaaaaagguguuuaggugagugaaggcucauggguaauaaaucagggggcugcaaggccaugauguguuuagagccuuggaugugccaaggaaucccacagguccuuggguacucagcucauccucucccuagaagccaaagcccaaagaacgggucuuaaggaagcuggcugggaagaccuuagcccaaccugagagaccggaccugauugauauuccugccgucuccuggcacucgaggcugauuucaaacuucaccagccacuugauacagcuguuccacaaggucaggacugagaggagacaggagccugaacuguuguguggagagagagugggagccagugggccaggacacagcuaaucacauugcaggcaaggguggcugccacaggcuaggacucucagccugauccccuccccacacagcuuccagcagggaaccaaggcaagacaccgauuucucagggugguguuuggaaguucagcugagauuuuuaauuucacugcaucacaacucagcaagcugccaagucaagcugguuauuuaaauuuaucacccacucuccccucugcugcuggguugcucuagcucagcugcaucucuuugcuccagcccacugcucuaggcugccggucuggaacagagccgacucucaacuaagugauaaagaaaaugggacccacuaguugggaaaaugggcugggggcacucuggccuugggcuuccuuagugugguugcuuggagcugcugccuucaaccacuuucauauccucuucaaagaacaccccagggaaauggccuuaacccuugaguguuccacagacccucuggucugggacucuauagaaaggccucugcuacagccacuguauuguucacuucuuaaguuucccaacaccaguaccaauaagaguucugcuuccccauggcuuucucucuggccuuggcccaggcugcagcaauaggugagucugcagagacccugaaagugauguuaaucuggaaggaggagaugaaaacaaggucuaggauccccaagucacuggguggggggguucuuuggggaaguucaagggugccuuggccugggcaaagucuguucaacaacagacagcaaguuuccuucccagaagccauggguugaguuggugcuaaagggaguuagugcucacaaagccccagugcuucccggagacucuaaagagcacacguguccucagagcagcugcauagagugggcuucacuggccucuagugggcaucacuaccaagcacugggcaagccuugcacaaaugcaguucucagaggugugagaggaacgaagguggucuucagaaacaagggacuaagcuuagcacaacagagcugaguaaaaaauaacagaggagcaguuaacgcauagccacaccuugcucuggagccagagacagagcaggaugcgugacacugugaguuucacacagagguaaaccuuaggguaggaauguugagguauaaugcacacagacagggcaugugaucuuggacccaagaaaaaaacagaggcaagacagggacaacacugucuaggaacuggagagccacaggcuuuuccccaugacccagggaaauaaaggagaggggcacaugccauugugagaaacagagacaugaaagcccagauguagaacuaaguucaaguucaugucauaaguagccgcagggagcccucaagccaagaagguacacagaacuuugugcagggcaaugguucacucuggcguuagcagggaugcuguggaaucuacccuguaaaaacaccuuaugauccaggaugcaagggacucccauugagaaagacaaacagaaagccaccauagaagaugagcucaccauaaaaaaagcuuugcacacuccaugugacacugagcuacugugagggggauguuagcagaagggcaauuagcauccccaaggacuagauagcaauggaauaucccagugugaagaucaacuaaagaaaagauucaacagaaagacuaguuuuuauuuuaacccagaucuggacccaggagcccucccccccccuccaacccccccccccuagugcugagccaacugucagauaauggagacccaaaaggccaauggaugaaaaggaggaggggggaguuuguccuagcuuaucccgauucagagucuucccgguaaagaaucuuacuuauuuuggauaauauugaauaugagaagcuucauggucagggcagugcccucccuccuccacugugugugccuguguguguguugcccaagucagacaggggagguagaagcugucaacuuugaacagaaguggggaggcuggagacgccagguucggagcuaaagagcaggggugacccuagaacucuggagguuagaggaagcaaagcugguacaaacgcagaugcagcucagcaguuucuauaagcugccugcauagccaauggaaagcaaaguggcccucuggcagguagaacuguggacccugggaaaccuccuucuacucaaagaguccugagcgccuccagggaccuccccuuuccuguaguuaacaaccccuuuccaaugcaacugcacuucccccauaaaauaaacacauagcccucggccaaccccuuagggguagguaauaaaagcucugaaauguuccucaaagaggcugggagucccuuacuccugucuauuggcucacagccccugauuaucuggaggaauuuagggcacagacaucagaguuucccuccaacuuugaaagaagaaggugaggccaacuccagacaugugguaauaggagagcccacucccauggccaccaagccaagccagagggcuuuccucuacaccuccauuuaggcugagaaggcccaaggcauagaguugaggccuccuuuagcuaucucugaggccucuggcuacaucccuaaggacccccagccccagaccucacugugauuuaauuauggaggcauuuccauagcaaugagacauugacaaauaugcagugcccugggccagcagcuuagggaggcauuggaugagacucuucuuucucuuuuuuuuuuaauccagucuaccuuuugaggagaaagauguuaaaaagaagagacaugaacccacucuggggcugagggcagccagcuuagaguagaaucaaagaugaaccauuuuaacaccaacccaugucuguuccuagcagccauccuagggaugaugggcuagccuccccaggggugagccugggcacacaucgaggccacauagggagucaugggggagaugaaggauuuggagaaucuuagcaaacacguucuguggccuucuaagcugagccugaauuggguccgcaucauggagucgacaccacuucucucuaucuuuucuauccauaaaacaaacccaagaugcugggugugucaaacacuuuuccuucuucauacauucucccugacucauuuagugaucagggagacuggccugucagaauucaaaucaaaacauuugucacaaaccuauggucuuuauuuuaagugcauacaguacccaacccagguuaagcagggcugccugggcaaacacccuguuuucacagugagggagguagggaaauccuuucacaaugcuacgggguggguguuauuuagagaugcuuacgguagcccagagaggggccucucaacacuuagcuuguuuacucugcucuuuggcgcuuccuaagaagagauugcuuaaggaaaagacggcuaacacaaccuuucccaaaugaccagaaucguggacaguggcguucuaaggaaugucacaggcacgcauggcucagaaacgucuuaguggccuuaaagccaccuagacaagacuugaaaccuguuucucagagaaccggauacuacaagaugacaggaaggcccuccuuagcugucgccucaggacaaauaagccaaugcuuuuuuuuuuuuuuuuuuuuuuuuuuacccaagcuuuguaccaccgcuacugucauuucuggaaaggcuuugcugccuucagcuuggaauccuuugcucuccuccccaguggcggccgggcugccuggcagaggaggaaauccaguacugugcuccgaaagcaggcuaaugcuccagcagcuuaagcgccccaccagccuugggauuaggguuucacuuacacagagcgccugaaaaacgcugugcuuucagaaggauuagagcugacaauucagugcucuccgggagcaaaauaaagccagagagguccuaggagacccagaguaucaggagacugugcaaacaggcuuacccucugccacccagcaugggggucucucguacagugggcuggugagucccuggcccaaccuccugagugccagccagccccugcucagcucugcucuuuauuuggagucagagaaaaaaaaaaaacagucccgggaagcaagcugaguauuggagauuucucuuccagacucucgguuucuaccucuguaaaugagccaaguuuccuuccagcccuuugaguguguaguucucaacagcacuccucaucuucucucaggcugagacagcagcucauucauggcccugcugcguuagaggaagccccuuccugugggucccugugcuguaggacacagcccuccaagggccuugugugaggggaggagguggagacagcccgacuaguuguguccagauguuuguggucaaggggcagaccucacugagccaaugcagaucuagcaucucugccuaggacaaccugggaugaagguccagccuuuagaggacagucacucagcuagaacagccacccugaacugugagcacagcccccucugcuggagcaggaguaggugggaguaggcgagccaaaacaggggccuaggugggguccucccacgggcacaaagcucuguucuagaaggcaaacugugggagagucugggacuccuagaaauagaaccccaaaugaaauagaaaaugguucuccugucucuugaaagcagauucaaagaucacuguuuuaauacacuauauacaacuugcaaaugcaaagauaaaauauauuuaggcagcaguuuaaaagucggugacuauauucuuguguguauuauaaaugucuugugucccaugugagcacagaccuccagccuugaagaccucauuuucugagaggcagacaaacuugaggagaggauaguaaaacaagaguuauguuuucuggccuuagggcccuccacggugucaaauggagagcaaaaaugcuuauuuucagagaaaggugccaagaaaaagcaucucuaaacucuguggcuauaacuucugccauauaaaucugugucuaauaagccuaguugcaaaagccauaaguagcagcaauuucugcuuccuggacagccuccuucugcuuagucccuuggucuucucaaugcuggcacuggccuggucuugagacgucugaugcuucacacuuugcuguuucuuucuuuuaaaaaaauuauuucuauuaauuuaauuaugcgucuguacauauuauguggggcgugggguacaggguccauguacaugaguguaagcacccacaaagacuggggugcgcggcccuuccggagcugggauuacaggcaguuguaagcuuccuaaugugagugccggaaauugaacuuaggaaaaucacuauaugcucuuaauuagcgagccaucucuccagcccauuuuugcuguuuuguauauaguuuuauuaaugucauucgaauaguugcaaacagaucagcuucuuauaccaaagaacagaaguuuucuuguuugcuuguuuuauaaacauaacuuauucacuuuggagugaugaaugcuuuugagaauacaaguuuuuaaaauuuauuuuuauuuuauauguauuuguguuuuaucugcauauaugucuguaugagggugucagaguuacaguuaugagcugccaugugggugcugggaaucgaaccuugguccuuugaaagagcaaucagugcucuuaaccacugagccaucucucuagcucugaaaacaaaauuuuuuacuacucagaaagagauauguaugauaacacuuauguaaagcuuucuguggacccuugaaauauauauuuuggugccuuaucaaacccauaaacuccaaucucaaaucuccaacugcacaaaaaugaagcaagcuaaaacacacaagaaauaaacagucuuaagccuggagugguggcacacaucuuuaaucccagcacuggagaggcagaagcaggcggaucucugagauuagggucagccuggucuacagagcaagcuccaggacagccaggacuacacagagaaacccugccucaaaaaaagaaaaauaagaaaagaaauaggaaacagaaacagauaacccaagauguccucucauaggauagguuguuuaucagguuacuuuuucccagaccaaauaagcucuguuuuuaggucugucagauuugguaauaucauugaaguaucgaucuccuggucuaugacuuauguaguccaggcuccucuguggaugagcuaugaacccugaccacaauccuuagcuccucuguguuucaguuucuuauuugaaaaaaaaaucaggaauuaaaacuaggucagcugauagaacugguaaaagacguaaaggaggcaacacaguaagacacugaaggcaguugccuagcacacaacaguugcucagugcauucuagagggaccaggagcagagagaugacugacccaauacccagcaagguggcacaagugaucugaugacucaaaaugucuaaucucuccaucaagucuggcgcuuugcuucuguccgcacuugggagagaggcugcacuuaggauccuccaaaacaguugauuugcucuggcccauuugcuaaggaaugccugacgaaagugcacugucugauucagacagagcggcugcugcaaagauuggcuucggagucuucagggacuacuacaguugaaccaugaaggcauccucaccaagugccucgcuuccaacacuucuggguacuuuaagagccuccacuacuccugcuugucagggaggcuuuuuguguuagaaaacucucagaggaacugaagacaccaccccauagaguuuuacuacagaccuuucacgcaccuguucauuccugugucccuuuccuucccugccucuacuuaacggcuacguaaugguuagacgcuuugcuugcuggcaaacuuuacuuucuuguuggcucuuuugggggaguaucuggguccguguugucguuaaaggcgguguggcauagacauggcuucuaauguuggugcuagcguugacuggccauggaaucacaggagagccauuaugcccaugugccuccaucuucuaucuuuaaaacaaggguguggucuuccagaagacucaucuuugaaagcagaaagaaagcaaguggacagcaugaaaugcccagucucuccuaggaacguugaguuucuauccauuuugauccccaguacuauuuuuauguuccuggcauugucagugagcaaagcaaggguuuugcugcuuccugucuuccgugggauggcacauauuuuauaacugacguccucugacgggaaacaguuuuucuccuguuucugugauucugcccguguaaaggagauggccaagccaucucacaguuucagagucccccaccccacccccaccucucuguagcacugugguaaccagugcucugucagcuuuuccauuucccauugcuauucccuacugaaggaggcuugcucgaagaacgcugcugggcaaaugguaugacagccucaguaauuugaaaacuuccugcauugccugcuuuccauuauugacaaugguguuccaggagaaucuaugacucuagcaagacuuuggucaaucucucucugcucuucuggugucagcuguguacuaaugaagucauugagcaugcuuuguaugcaguggcucccaccuuguugacuucagagguccugaacagguaccucuuugugguaacacuguuacaggacaaaccacacacaaacacacacacacacacacacacacacacacacacacacacacacguaugacaaacacuagacauuucaaaugcuuuuuuucucacuaugggccucuuaucccgacacuuuucaaaucacuaccugcagacacaggguuuuguuuuguuuuguuuuguuuuuaaguagaauuugaaaacaugccuuccaaucaaguguucugagaguggcucucagcaggcaaagccuucuaccugcugaaaguugaacauaccauuuugcaggcgagauagcugugggaauaaacugugcaagaggauugccuccauguuaacuggggagacagcuucugaacuacccaucccauccuuucuuugucuccuccaaaugcugucaggcuugugugugugugugugugugugugugugugugugugugugugugugugugugugugugugugaauaccuuccauuauacagaauuuauguucaacuagcuacaggaaaguucaaaugcauccuauuuuucuguuauuaacaaagaggcccaacaugaaaagaaaaauagagggagaucaaagaaaagggguauagaaggagaggagagguguacgcugcuuucugguugcuuuguaaauguuaagaucacagggccuggaggaauugaguucuaugucucucuagcuucaaaaccuucacaucucccauaauccucuucucuucuaaaucuucucugaccaauaaaugucauaguguucaucucucucaaggaacuaauaggcauuucuucucgaugugcacuuuggguccucuccacuaagagauggucaggagauguguacuuuuuuuuauuauuauuauuggcaauagaagucaauacaaggaaagcuaccaaagcaaaugcaagcaagucgugguagcacacauaucugcacuugugagucugaggcagggggaucacaaaucugaggcaagccuggacuggguauaauaagacugccucaaaacaaaacagaauauaacaaacagaaagcaaaugcagauuuuucuacugccugggauuuggaagggacccccucuuugcuaguucuccucugacuagugaguuucaggaaaccuaaggcauuaaccacacuccacaaguuuaaaaaaaggaaaucguucucuugcaugaugaguccccagagaggaaccuaucacagaaaaucuuuguauguaaaaauuccacucucguuucuauuuacuuuuuaguuucuuaaaccuugauuuauuuucauguguaugggugauuugccugccucugagucugugcuccacauuccugguauccaaaaaggagagaagaggauaucagauccccagaacagaaguuacagaccguugugaguugccaugugguugcugggaaucgaaccaggguccucugggagagcagccagugcucuuaaccauggagccaacucucagccccguuucaauugauuuuuuuuuuugaggaaaagauucaagcacauuuuauucuggcuuugcuucucuacauagaucaacacauaugaagcaauuaggaagccauuauaauccaucaggaauuggcagugcauacaauggggugagugggguguggguaagaguugaucaacaagcacuuauugagagucagcuggguucucaacucugcaggacagaucagaauguggguccuacccuugagugaguuauggucuguuugaaaaugaaaaccucggcaugaagcagcagaccugauaaugcauguugucaaucauagaacacggaugucauggaaaccugaaagaaacuuccaagaugaguagaaggaugggggauguugaggcuugaacuggaagaaaacuauaaguaagacaaggaaaggucacaucagagcaugggcauuuuacauggggaggucaaaacagccaguagugagaagccgaggugggcacagaccaggaggguacugagugucugcaggguuuccaucuaagcugcagccuacagggaaucaauggcaguguuuauaaggaggugguccugugaaagcaauguguccaaagggcuagcggaugcguuucagacugguaagagggaagaauguagaggcaggaacacaagcaaagaaaaaccacugcagcaagccaaaggcugauacucuggagucaaacuauaaaugugacaggaaaacagagaugaaccuaagagagguagcagaggagagucgacugcacaucggaagggacaggggaggaaggcugugucuagggcucugaaguucuagaugugucuucaaaaggaccgggcuucugauggaggagcagacagucugccuuuauuccuccugaguuugaggugacaauuggucagcuccugaggaugcucacaugguggacagaaauggaaaagccugagcugucccucuguccucuuagagaaggaugacucuuucagguguguugggauggaggugagaaagcgcauguaucugaggagugaaguaggcgaugucuucacauggacagugguggagagacgcuauggaauauagaagagucccauggaccugaccaugauuaggacccaacuuagcggggguggggcggggaaaagaacuaggggaggugugcauagugcacuaggggaggugugcauagugaacaagggagaugcacauagugaacuaggagaggugugcacauagugaacuagggaggugugcauagugaacuaggggagaugcacauagugaacuaggggaggugugcacauagugaacuagggagguauacacagugcuaugacguccuccagccacaccuugcuuucuuggggacagauggagguauaaggagcagaaugguugucuggugaggaagacagggggaucugcagcagaaucaugggccccagaagaggcuaggcucuaguguauggguggggaagguaggagggagccaaugcuguccaugaagacuggaguaugcuaggaggggcagagaaggaagggaagccugucacaugcagccauguuccagaagcaaagccuuggugcggcucuaauguuggcucccuuugccuccccccucacccugcuccuggcaaggaaaguccugccucccaugcccugggcucuguguaauagaggcucuguauaauagaggucuagucuccagggaggcugcugguagggggagcaaaauuuugcucauuggaacuucgucugaucugcuuauccucaaaguuccugcuucacuucagagaugguuuucuaucguguaaaugcuacaaucauagcaaaauagcccaaggguuagucccuuguccuccagaccuaacgggcucagcaucuacuguuccacucagaauaaagaaagcaccuacccucauagaagaugguaaugggguaucuucaaagccugaaggaaagacagggguuugggaagaggagauguagaggagaguagacaugacagagguccaccagaacaaucauagcugagcaucuauagagaaagaauaaaaccaggucaucuccacccaucuccaucuggguugaggcuguuggagauacagacaagggcaaacacacaaugcacagauacacaaugagcaauauaaaacagaggugugcauacacacacacacacacacacacacacacacacacacacacacacacacacacguagacauuuggauccauauccaggcacucaggaguccgaaugccugagugcucaucuccuuccucucuaagagcauccucucccuagagcaucccagagcgagcugaggcaggccccucucuucuaggccucacuccuuccccuuuguguuuuuccaggucgugauaugacgagcaccacucuaccugguuaccccccucaugugccccccacuggccagggaagcuacccuaccuccacccuggcaggaauggugccugguaggugacaaugcuguagaugucucaucugggugggguuaacuaaauugugggagagcugcuaguggacuguaaucuguggcugggagucggggguuggggggggggggagaaccaacaagccauuguucugcaaaccauuguccuucuauggccauagcugacucuuuagaagcaaugcaaggaggaagcauacagaaauguucccuugucaacacagcuuuagguuauagcccuuccucagcacccauccguccaagucuaugccuaacucagcuagcugacacugccuggaagagccugcccugguuuccauggaaacuuggaaccaaggaccauuuucaggggcauggcagucauucagacaaagccaugcuggucuacaccaagccaggggaggagaccacuguggagaaccaaucccaaucuagagagaaggaagcuagucucaaaguggacaggagggaaccagagagauguuagcuucagagaaaaauuagcuacaacaacuccacaugucuucagaggacccagguccucugugcuccucugaaucucuaguguacccuuuugcugagaggcacuggacuuggguuugggguucaggaagcagccugguggcuguccucucuaaccuucaccccaaaugagaguggcuuaaagucaaagagaguugaaguuugguguugaaacaccaaaaucucucaccuuaagguggcuaagacucucccagccuguaguccacugucucuggagcccuuuuguaugccccacuccucaaguucaacccucacugguagagggagaaagagaggacagaaagcuggauuggccuuauucaucaaggcacggcccugaguaaggguugagaaacuggggagcccguuacagccuguuaagagaauagggcugacugagagaaguuggaggugcggaugaagggauuggggcucacacuugggagaaggcaaguagaagcuguuggugggggagcaagggauggcucuggaagaagaucccagcagugagcagguggaggcuggaggaggucuuagggaggugggguggugguggugaggaaagaguggggaggugggggguggggagucuacagggagguagggaugaggggagccgcagagagcucaugguggcaaggggggagucguuaaacagaaucuagugcugaugaggaaauuacacuuguuucauuagcgauggggaaggagauagcucaguuccucuuggucacaguugagcucagaagcucauuauccugcugcacgcaugcuuucccuccucgucaauaaacaggcuuuccaguggcugcaucccccacccccacccagcuccuucuuggaguggggccccuucuccucuacuuaacccgcgguuagggaucacuguaaacagucuggggucaucacacaggagaaagggccaggggggaaacccauaggccuggccuuucuccuccuggagggagggagguagcucccgaaggcucccaacccacugugcccuccacugcucacugcuccugagccugcgagcaguccaguggauucccgcaguucacuuccccaguuacguggcccuuguacugaaccucaggagggaaaagugggagggguuauuucccaggagggcaccaccacuaccaccugccuagcuuuggcacagcucugagaugccauucuuagggcuuucugggacaaagugucccaggggccuuccugcuccaccuucccccucucucaugcuguagaaucccuaaagccaguguccacuguaaaagcucucagcucccaauuuacuuaagugggagcagccagaccaagaccaaacccuuccugggcagcgaucucuugcaggagagcccaggcacaaacccgcccacagauucccuccaugccuaggugugcagggaucuggcugcuacuugucuaugguggcuguccccaugcagagcucggaguguguggauuaccuggccucuggccugcucccaggggcccuaucccugcuugaaacacccaagacugggacuagugaggacaggacagaagaggccaacuggacacguugaacgccucuaauuccaguuccccgcccucccacagggagcgaguucucaggcaacccauacagccauccccaguacaccgccuacaaugaggcuuggagauucagcaaccccgccuuacuaagugaguacgccaccuggcaggccggcggcucccaaggucgccuacccgcucgccagcucgggcgcgcaggcugcuucgggauacggaucccacucaggaccaccccaauucuggguacccggaugggccagggagacaggcccauuagagcagcgccggguccuggggauaccaccaggacgccugcgccuccagccucuucccuccccuaccucuugaucacuggagggcucuuagccaacaguggccgucggaccccuugggggauccgcagccgggugucaccuguccugucccucucccgcccuguggaugcagcacuacuccugggcaucuggccucggggccgagccacaguccuccaggccugaucccgcuggacccggggagggcuuuucuuugcuuuucuuuccuuuuuuguucuccuguuuguccucucacccagcccauucuucuccuguguuaacuuccagguuccccuuauuauuauagugccgccccccggggcuccgccccugccgcugcugccgcugccuaugaccgccacuag

SEQ ID NO: 12252 - RNA, 6474 nt, Mus musculus
ggccucccgccccucccgcugcgggggcguggccccggcgucauuuccaggcccgcccccuccggcuccgccucccccugguauuuucgggacuuuccuaagcagcacuaacuuucugccccuuucccgggccagccccgcuccggaucucgaccuccaccggaucuuacccgccacgcccggacgggcggcuggaggagaucggacccucccccagaucugagccccccuccccuacccaucccucucccccugcccaccccuauccugauaucuuucacucuucccccucccacgccucucuucaccuuaggcgggcguccgaaacucuggaaagcugaaccggggcccgaagccgcaagacacagcagggccuagcccagagauauggacaauugcuacgauccagugagucacacugccugacccugagggcggcgggugcccucugugucugcuugucaauuggacgcuccuccacuccccuacuucugcacugucuucaaauugucuuagucugccagucugugcugucugcaaacccugcccagaaaugagcuuccucauagcuugaggaggaguccagggagugacugcagagggcuugggagggggugguuggggggacccuugauucagcugccaccuucucugucuauaacgcagggccuggauggcauccccgaauaugaugauuuugaauucagccccuccaucguggagccuaaggauccagccccugagacaggucaguaagucuuuggccucgcaguaucucagaaccuagaggagagugagcauguccccuggaggccccacugagggauggucucagagauccuggcucagcaaggccccucuauuuccagcugauggccccuaucuggugauuguggaacagcccaaacaggugagugagugacagagagugguggcuucaccuuuggggaaaagguggggcggggggggggaggguaguuauaccuacugaucagauuaaauagcuugcugcugauauguugggggcuuaugagaaggagguacacuuuuggucacuguggucagugauggcuagugguugccuuguggggaugacgggggggggggggggguugccucuccugaucacaaugucucugcuauggaaccuucagcgaggcuucagauuucgauauggcugugaaggccccucccauggagguuugccaggugccuccagugagaagggccggaagaccuauccuacugucaaggugagcucagaugacaccggaggguagggaugguguauggggcaacuacugacuauccuuugccauucucagaucuguaacuaugagggaccggccaagauugagguggaccuggugacacacagugacccaccucgugcgcaugcccacagucuggugggcaagcaguguucagaguugggagugugcgcugugucuguaggacccaaggacaugacugcucaguagguggcccuggccccuggcccccagugggaugcucauugccugccagccuuaggucucaucucaggccaccugugugacuagcacacaaagugggaagauuuacuuuggcccaggaaccucagagcucaacuauaaagagcaguuuccuuggagaacagagccaggaugagccugaccaugggggguggagcguggggguggaggugccucaggaggaaagagccucauggucaaagaggacaaagccuccuccuuguccucuccagauuuaauaaucuggguguccugcauguaaccaagaagaacaugauggagauuaugauccagaaacuucagaggcagcgucuccgcuccaagccucagggccuuacagguaugguaacaaaagguguuccgagagguguuccuagaggagccgggaagagcagcccagagcucacaccacccacauuguccauccagaggcugagcggcgggagcuagagcaggaggccaaggagcugaagaaagucauggaucugagcauuguacggcugcgcuucucagcuuuccuucgagcuagcgauggcuccuucuccuugccccugaagccugugaucucccagcccauccaugacagcagugaguauucugcagggggccaagcaugcauucccaaaagagcgcuugagauaccuuccagcuaugggucugaaccuggcccugccacgugugggguggugagugcucgguagucagaacaucugaguguugcuucugagugguaaaugugaauacugcauuuccugaaguuugauaaugaccccaccgagccuccgaucccaucaaugugucccuaacccaucccccaccuuauagagucuccaggggccucgaaccugaagaucucccgaauggacaagacagcggguuccgugcgcgguggagacgaaguuuauuugcucugugauaaggugcaaaaaggugaggcagaagcccucugggagcuggaaacgcuggcuguaaggguaauuucgggauccaugcagcggggcugcaggcucucccuguggcuaagccgcacuuuucucuguagacgacauugagguucgguucuaugaggaugaugagaauggauggcaagccuuuggggacuucucucccacagacguucauaaacagguacugagggacuagggccuguccuggagacagaacuacgaagaaaccuuacugacaccauguugcucucccauccuccaccccaguaugccauuguguuccggacaccgcccuaucacaagaugaagaucgagaggccuguaacgguguuccugcagcugaaacgcaagcgugggggcgaugucucggacuccaaacaguucacauauuacccucugguggaaggugagucgggcuucagcauucccaaaggcuggacggagcgaggcgggccaggagguggccuagaguugacucccaggagccagcuugaggaaucuagggucugacccauauuagguuuuaacaccccguuucucuuuccuccuagacaaggaggaagugcagaggaagcggagaaaggccuugcccaccuucucccagcccuucgggggcggaucccacauggguggagguucugggggcuccgcuggggguuauggaggcgcuggaggaggugaggaggugcaaguggcagggagaaggauggaggagauaagggaaguuaggagaggaaucugggagaguccuggcuggcaccucacacugccuuccccaugcccacagguggcagccucggcuuuuucuccuccuccuuggccuacaaccccuaccaauccggugcagccccaaugggcugcuauccgggugggggagguggagcgcagauggccgguucuagacgggacaccgaugcuggcgagggggcagaggagcccaggacgcccccggaggcuccccagggcgaaccacaggcccuugacacacugcagcgagguacaucucaggaacgcugggggugggcgcgcgccaagcuggggaucuggcccgcacccacgcccccugucgcccccuagcucgcgaguacaacgcgcgccuguucggucuggcgcagcgcagcgcccgagcguugcuggacuacggcgucaccgcagacgcgcgugcucugcuagcgggacagcgccaccugcugauggcacaggacgagaacggagacacguaagcaaccagaggacgggcuuccgugggaccuccaguggcuggggucuucugcuaccaggucuagauguucggguagaggaaucuacaaagagcugaacccuaggcuuggacagaucuggucucagguccucgcuguuuucuacuucuguucaagauauuuacucuccccgaccuucaauuuuauuagcugugaagggguacaaauagcaaggugugacaaaagauuaagaugaugacauuuagguuucaaggggccucgguaaaggagaccgcggaaguguggaguuuugagggcagaugugcugcucuggguggcuggguuucugaagacaaagucucaaucuccaacccucaggccacugcaccuggccaucauccaugggcagacuggugucauugagcagauagcccacgucauuuaucacgcucaguaccucggcgucaucaaccucaccaaccaccugcaccagguaaggggaagccuuugguaagagguugaaggcagggaguccaaagcuggccuaacgcugccucucuccucagacgccucugcaccuggcgguaaucacugggcagacaaggguggugagcuuccugcugcaggugggugcagaccccacgcugcuggaucggcacggagacuccgcccuccacuuggcucuccgggcaggugcugcagccccagagcuguugcaggcacuguugcgcagcggagcccaugcugugccccaaauauugcacaugccugauuuugaggguaaguuuccaaccuacuccuguccugggaacaaggguggggaccgaggaguguauaugaucaauaaacacgagcggagguugccuggucagagugcauccggaggccauuuugagggucaaagcugcaggcgcgugugcuauuucucuaggacuauacccuguacaccuggcaguccaugcccgaagcccugagugccuggaucuguuaguugacuguggagcugaaguggaggccccagagaggcaagggggccgaacugcccugcaucuagccacagagauggaggaguuggggcuggucacccaucuagucaccaagguaggaaugaggacuauggaagggauggggcugcggacugugggaggacccggaaugaugaucugcguggcaagggcuuggcuggcuggacuaugcugcucucugcuugcacccuacagcuccaugcuaaugugaaugcccggaccuuugcuggaaacacaccccuccaccuggcagcuggacucggguccccaacucuuacucgccuccuucuaaaggcuggucaguuucaccauugguguaugaagggcaagggggggaagggggaacccccagcuccccaugguucaguccucaauguaggagccuccacuagucucuccugaggacugccucccucccccaggugcugacauccaugcagagaaugaggagccucugugcccgcugcccucacccucgaccucugggagcgacuccgacucugaagggccugagagggauacccaaagaaacuuccgaggccauaccccucuugaccucacuugcaguaccaaggugaggccacccuugcaauagaaguacugagguggggacuggggaccuucuggacuugggggugugucccagaugauggaccuagggaaagcugggcuuaagguccggaugacagucaacaccaucuccccaggugaagacucugcugcuaaaugcugcucagaacaccacggagccaccccuggccccacccagcccugcaggugagguugcaguggucucaggcaccuccuuccagaggugauauccuuagggacucuggcgagggcuuccuuugucuagcuccucuuccaugccccguugaucuguccaccaugucugucagguuacaagggagagaagcugucuggguacgugucccugcacaccuauuagcuaacucacagguccguauuuguccccuaagggccagggcugucccugggggaugcagcccugcagaaccuggagcaacugcuggauggucccgaagcccagggcagcugggcagagcuggcagagcgacugggguugagaagccugguggacacauacaggaagaccccgucucccagcggcagucuccuucguaguuacaaggugaggcagccuguacccugcccugaagccugaaaccuuggccucucagaguucccucccccaccaagacucucuaaccccacacccuaagcaucacucagaccuccugucgccuuuucucggcagcuggcugguggggacuuggugggucuauuggaggccuugucugacaugggucuccaugagggagucaggcugcugaaagguccugagacccgcgacaagcugcccagcacagguaaggacaaccaccuuggaaggugugucugggcugaggggagaaggcaugaggcuugacucuccccuguucccuagcagaggugaaagaagacagugccuaugggagccagucaguggagcaggaggcagagaagcuguguccacccccugagccuccaggagggcucugccacgggcacccccagccucaggugcacugaauggccccggucaacuuccacccagaucccucuguacagcaucccugucuaaucgaaaucuuauuuaaaccucaagcccacaucucggugggucaaauaaaggggaagaccccuccccaacuuacgguacagcaaccccaaugugcugcccaucccagucccugagcgagaauagaggaggaggcccagccagcaa

SEQ ID NO: 12253 - RNA, 6474 nt, Mus musculus
uugcuggcugggccuccuccucuauucucgcucagggacugggaugggcagcacauugggguugcuguaccguaaguuggggaggggucuuccccuuuauuugacccaccgagaugugggcuugagguuuaaauaagauuucgauuagacagggaugcuguacagagggaucuggguggaaguugaccggggccauucagugcaccugaggcugggggugcccguggcagagcccuccuggaggcucaggggguggacacagcuucucugccuccugcuccacugacuggcucccauaggcacugucuucuuucaccucugcuagggaacaggggagagucaagccucaugccuucuccccucagcccagacacaccuuccaaggugguuguccuuaccugugcugggcagcuugucgcgggucucaggaccuuucagcagccugacucccucauggagacccaugucagacaaggccuccaauagacccaccaaguccccaccagccagcugccgagaaaaggcgacaggaggucugagugaugcuuagggugugggguuagagagucuuggugggggagggaacucugagaggccaagguuucaggcuucagggcaggguacaggcugccucaccuuguaacuacgaaggagacugccgcugggagacggggucuuccuguauguguccaccaggcuucucaaccccagucgcucugccagcucugcccagcugcccugggcuucgggaccauccagcaguugcuccagguucugcagggcugcaucccccagggacagcccuggcccuuaggggacaaauacggaccugugaguuagcuaauaggugugcagggacacguacccagacagcuucucucccuuguaaccugacagacaugguggacagaucaacggggcauggaagaggagcuagacaaaggaagcccucgccagagucccuaaggauaucaccucuggaaggaggugccugagaccacugcaaccucaccugcagggcuggguggggccagggguggcuccgugguguucugagcagcauuuagcagcagagucuucaccuggggagaugguguugacugucauccggaccuuaagcccagcuuucccuagguccaucaucugggacacacccccaaguccagaagguccccaguccccaccucaguacuucuauugcaaggguggccucaccuugguacugcaagugaggucaagagggguauggccucggaaguuucuuuggguaucccucucaggcccuucagagucggagucgcucccagaggucgagggugagggcagcgggcacagaggcuccucauucucugcauggaugucagcaccugggggagggaggcaguccucaggagagacuaguggaggcuccuacauugaggacugaaccauggggagcuggggguucccccuucccccccuugcccuucauacaccaauggugaaacugaccagccuuuagaaggaggcgaguaagaguuggggacccgaguccagcugccagguggagggguguguuuccagcaaagguccgggcauucacauuagcauggagcuguagggugcaagcagagagcagcauaguccagccagccaagcccuugccacgcagaucaucauuccggguccucccacaguccgcagccccaucccuuccauaguccucauuccuaccuuggugacuagaugggugaccagccccaacuccuccaucucuguggcuagaugcagggcaguucggcccccuugccucucuggggccuccacuucagcuccacagucaacuaacagauccaggcacucagggcuucgggcauggacugccagguguacaggguauaguccuagagaaauagcacacgcgccugcagcuuugacccucaaaauggccuccggaugcacucugaccaggcaaccuccgcucguguuuauugaucauauacacuccucgguccccacccuuguucccaggacaggaguagguuggaaacuuacccucaaaaucaggcaugugcaauauuuggggcacagcaugggcuccgcugcgcaacagugccugcaacagcucuggggcugcagcaccugcccggagagccaaguggagggcggagucuccgugccgauccagcagcguggggucugcacccaccugcagcaggaagcucaccacccuugucugcccagugauuaccgccaggugcagaggcgucugaggagagaggcagcguuaggccagcuuuggacucccugccuucaaccucuuaccaaaggcuuccccuuaccuggugcaggugguuggugagguugaugacgccgagguacugagcgugauaaaugacgugggcuaucugcucaaugacaccagucugcccauggaugauggccaggugcaguggccugaggguuggagauugagacuuugucuucagaaacccagccacccagagcagcacaucugcccucaaaacuccacacuuccgcggucuccuuuaccgaggccccuugaaaccuaaaugucaucaucuuaaucuuuugucacaccuugcuauuuguaccccuucacagcuaauaaaauugaaggucggggagaguaaauaucuugaacagaaguagaaaacagcgaggaccugagaccagaucuguccaagccuaggguucagcucuuuguagauuccucuacccgaacaucuagaccugguagcagaagaccccagccacuggaggucccacggaagcccguccucugguugcuuacgugucuccguucucguccugugccaucagcagguggcgcugucccgcuagcagagcacgcgcgucugcggugacgccguaguccagcaacgcucgggcgcugcgcugcgccagaccgaacaggcgcgcguuguacucgcgagcuagggggcgacagggggcgugggugcgggccagauccccagcuuggcgcgcgcccacccccagcguuccugagauguaccucgcugcagugugucaagggccugugguucgcccuggggagccuccgggggcguccugggcuccucugcccccucgccagcaucggugucccgucuagaaccggccaucugcgcuccaccucccccacccggauagcagcccauuggggcugcaccggauugguagggguuguaggccaaggaggaggagaaaaagccgaggcugccaccugugggcauggggaaggcagugugaggugccagccaggacucucccagauuccucuccuaacuucccuuaucuccuccauccuucucccugccacuugcaccuccucaccuccuccagcgccuccauaacccccagcggagcccccagaaccuccacccaugugggauccgcccccgaagggcugggagaaggugggcaaggccuuucuccgcuuccucugcacuuccuccuugucuaggaggaaagagaaacgggguguuaaaaccuaauaugggucagacccuagauuccucaagcuggcuccugggagucaacucuaggccaccuccuggcccgccucgcuccguccagccuuugggaaugcugaagcccgacucaccuuccaccagaggguaauaugugaacuguuuggaguccgagacaucgcccccacgcuugcguuucagcugcaggaacaccguuacaggccucucgaucuucaucuugugauagggcgguguccggaacacaauggcauacugggguggaggaugggagagcaacauggugucaguaagguuucuucguaguucugucuccaggacaggcccuagucccucaguaccuguuuaugaacgucugugggagagaaguccccaaaggcuugccauccauucucaucauccucauagaaccgaaccucaaugucgucuacagagaaaagugcggcuuagccacagggagagccugcagccccgcugcauggaucccgaaauuacccuuacagccagcguuuccagcucccagagggcuucugccucaccuuuuugcaccuuaucacagagcaaauaaacuucgucuccaccgcgcacggaacccgcugucuuguccauucgggagaucuucagguucgaggccccuggagacucuauaaggugggggauggguuagggacacauugaugggaucggaggcucgguggggucauuaucaaacuucaggaaaugcaguauucacauuuaccacucagaagcaacacucagauguucugacuaccgagcacucaccaccccacacguggcagggccagguucagacccauagcuggaagguaucucaagcgcucuuuugggaaugcaugcuuggcccccugcagaauacucacugcugucauggaugggcugggagaucacaggcuucaggggcaaggagaaggagccaucgcuagcucgaaggaaagcugagaagcgcagccguacaaugcucagauccaugacuuucuucagcuccuuggccuccugcucuagcucccgccgcucagccucuggauggacaauguggguggugugagcucugggcugcucuucccggcuccucuaggaacaccucucggaacaccuuuuguuaccauaccuguaaggcccugaggcuuggagcggagacgcugccucugaaguuucuggaucauaaucuccaucauguucuucuugguuacaugcaggacacccagauuauuaaaucuggagaggacaaggaggaggcuuuguccucuuugaccaugaggcucuuuccuccugaggcaccuccacccccacgcuccaccccccauggucaggcucauccuggcucuguucuccaaggaaacugcucuuuauaguugagcucugagguuccugggccaaaguaaaucuucccacuuugugugcuagucacacagguggccugagaugagaccuaaggcuggcaggcaaugagcaucccacugggggccaggggccagggccaccuacugagcagucauguccuuggguccuacagacacagcgcacacucccaacucugaacacugcuugcccaccagacugugggcaugcgcacgaggugggucacugugugucaccagguccaccucaaucuuggccggucccucauaguuacagaucugagaauggcaaaggauagucaguaguugccccauacaccaucccuacccuccggugucaucugagcucaccuugacaguaggauaggucuuccggcccuucucacuggaggcaccuggcaaaccuccaugggaggggccuucacagccauaucgaaaucugaagccucgcugaagguuccauagcagagacauugugaucaggagaggcaaccccccccccccccccgucauccccacaaggcaaccacuagccaucacugaccacagugaccaaaaguguaccuccuucucauaagcccccaacauaucagcagcaagcuauuuaaucugaucaguagguauaacuacccuccccccccccgccccaccuuuuccccaaaggugaagccaccacucucugucacucacucaccuguuugggcuguuccacaaucaccagauaggggccaucagcuggaaauagaggggccuugcugagccaggaucucugagaccaucccucaguggggccuccaggggacaugcucacucuccucuagguucugagauacugcgaggccaaagacuuacugaccugucucaggggcuggauccuuaggcuccacgauggaggggcugaauucaaaaucaucauauucggggaugccauccaggcccugcguuauagacagagaagguggcagcugaaucaaggguccccccaaccacccccucccaagcccucugcagucacucccuggacuccuccucaagcuaugaggaagcucauuucugggcaggguuugcagacagcacagacuggcagacuaagacaauuugaagacagugcagaaguaggggaguggaggagcguccaauugacaagcagacacagagggcacccgccgcccucagggucaggcagugugacucacuggaucguagcaauuguccauaucucugggcuaggcccugcugugucuugcggcuucgggccccgguucagcuuuccagaguuucggacgcccgccuaaggugaagagaggcgugggagggggaagagugaaagauaucaggauaggggugggcagggggagagggauggguaggggaggggggcucagaucugggggaggguccgaucuccuccagccgcccguccgggcguggcggguaagauccgguggaggucgagauccggagcggggcuggcccgggaaaggggcagaaaguuagugcugcuuaggaaagucccgaaaauaccagggggaggcggagccggagggggcgggccuggaaaugacgccggggccacgcccccgcagcgggaggggcgggaggcc

SEQ ID NO: 12254 - RNA, 37622 nt, Mus musculus
caguccauuccuccagcuauguggcuggagaagcuguuuaugaacgcugccugucugagccucacccagcagccuaccccagcuaccccagcagcccagcuaccccagcuacuccagcagcccagcuaucccagcuacuccagcagcccagcuaccccagcuacuccagcagcccagcuaccccagcuaccccagcuggggcuuuucacagacgacuaagugggcagguaaaugaacaccagccuuugucugcaggcugugguguuuucuggugaggaguucguguuggccaucgugcuagggggcaagggaaguggggggucuccagccuuuucugccugugaaccucucacuccaagacagcaaagggaaggaggggugaagggcuuggaccaagcaaagccuaaguggaaauacgaaagaaaaauggucuguauucagggcaagggauaagggauugcuugagggcuugaacuagguuuuaugucacaaggcagcagaaaacagcagaaaacucaguguugauagauggcuuagaucccagcccugccugucacugcuugggugggaauaggcaaguuguucuguuuuauuuuuguuuuuuuuuuuuuaaccucuuagccuucguuucuuuaucuguuguacaaagaggauaaccgcgguauuuuucuggguuuggcaaagacacagaggcacuguaucgugcuaggcacgcuguagccaguaaguggcagagucccuaugaguuuuuuuuccuuuaaauaucuccucgguuccuagacuugugaacuauugaaaaggccagggcugcagagggcacccacacaagagugucugaugacuauggauagaaaagagagaaacaaaaucaucaugagcagcaggcccacauuuagaggaacugugguccagaagcgguugagugggagacaaucuguuucuaguuagggaacaaacagacaacgggagaaccguaaaguuguugcuucauaagugucaaagcucaacagagagagggggagguggaggaagaggggggagagggagguggagaggaagauguguugugaaugauguacauguguguggcauaugugucuguacaguguggcauaugugcuugauguguguguaugugugugcacgcacgaguagaggaguguuaugucuauaguaagauugucgagacccuggcuucuuuucacuuucaguguuuaguaaugauggaaauauuuuuauguaaauuuaguauaugcaugccuucuguaacucucccagugacucccagguaaggaaagugagucuuaggucacuuguugauggucaacccaacuuucugauagagguggcccugagccuagaccuacccaacgacagcaguguucaggcuuacuccugaaugaaggaacuccugaaugcaaauagacuucagguuuggcucugugucugcuacgcggugagcucuucuuguggcaagucaccuaaacaacuguguucuguuugugcucccagacccacaacuuccugugcagcuuguugccacccucauuuuuauuuuugucagcucuuccucugaggcaggccucaccccagugaugcaggcucacuaguuggaagacggcuggccucugggcugagcccgaacauucaauucugccucagcccaggccaacugggcgugucaacuugaugagaauguuugagaucaaguguggcugggggcccuggagaacuucagcuuccugccauuccuggggugagucuccagaggagagaaggccccaggcccucucuuggcauguucacaacacaguaaggcuucagcugugagcugcuugcaguaguuuucucugaauggcucccucaggcccagcaaauggcagggaugcccugggccaaacccagaagugaaacccuaaggggagacaccccaacccccaccccugccaauagcucuuauauagaaaauagaaguuuucuucauuuauuugcucuuuuaccaaacauuuauuggcaagugccuacaagcauuaagaucuggccuuucagaaauccacaguuccaaugggagaaccaaugucaaaacacaaagcugaguccagaggccagcaugaggcuacacaggcagcuagggaaucguggaaccuguccacccuggcucagccuggugaauaucagcucuggaggcucagucaggauucgagaaguaaauacugauaucaaccaaguauuauuauuuacucagugauacaagauaucaggcuucccaccaagaaccguacagauaucauuucuuuuaauuugagcauuggcccuagugggaaaggugccacgcuucucucuguuuucaggagaggagauggaggcacugcaugugagguaacucgcucaaugugaggauuuuauuuguugagcgaaguucaucugggaagccaccuguuuagguuucaugaggcuaaggagcacagagaagauaagauugguguuuuuuuuuuuuuuuuuaaagguuucuuguaugaggcggaggcugugccaagcacggccugcuugggcacgcgguccucccuagcucucaggucacauaaaccaccucugcuguggcugggaacuaguuuguuccguggaacaaguucuagcuuguugcuggcccugcucccucgaggccuguggccucuacuuucaaauaggucuucccccuucucucugccugcagaaauuuuauaaggcuuccuggacuuaggauucagaaagcaaacacggccuuaauguaccaccccaggcuacuucccuccugauugugcaagagcuggagccguuucacaggccuuuuaaacgucuucccaggccugugguguucccugggaaagcugcucagggcugucagugacucaggcaucuuuaaagagagguagaguuagcacucugugguaggagaucuacuucuagaggguaacaauauuuuugggaacaacugcucuuuuggagaaagucacauuugucuguuaaggucaugugaucaugcuuggaaaacuuugguuucaaagcaguuauauagccuccaauaaaccagcuccaucggugucuguggccacuagccagccagucagagucaccuuguggcucugagcacaaguauucaccaugcaguucuagugccuuaacaccugccuuauauuucuaaaagagucuuaagauuuauuuucaacgugucugaguguuuugccuguguguuaguauguguucaugggugcuguguguaaguauguguacgugugugccggguauccaaggaagucagaagagagucucagaucccugggaacuggagucacaucuaguugugagcugucuugugggagcugggaauccaacucuggauaaagaacaaguacucucacccacugagccucuuccuggggccucuaacgccuaaugcugugacccuccuuauaagauuauuuuuguugcuacuucaaaacuguaauuuugcugcuguuaugaauuguaauauaaauaucuguguuuuccaauggucuuaggugaccccgguaaacuaaucccagguugagaacccucugcucuagaaggugcuuaagagaaggagguguguaagcaaaaaccaccaucuaaacucccaguuguaaauguguguaaacacgaacaaggguggccuagaagcagacucuuauaucaucugccaacuuugagauuauuucgggggucuggagagaugcauacuggucuuccagaugaucugacuuuggucccuagcucccacaucaggaggccaucucuaacucuugaagaucauaaggauggagaccuaaggccacuugcacaaggagccucugauguggaccugaaaacggcaucaaacugcauucuccugaguugguguuuuccagggugcgcuccacaagguguuaauaggaaacaugcacaaagagggccaggaucaaggcguucacucugcacuggguuguagaaagucacgggaaacucacggaacguggcagagcgcauucccagaggaaucaaaugauguuccucccuaagaacuucaaggacuuuaaauaaauucaugaguuguguggcugugccuuuuguuuagaagacuucuggcgacuucauaucuacugcuggcauauugauugaguagagauagcugcauauugauugaguagagauagcugccauacauaaccagaauaacuauugggguguccuauucuccaucauuguccuaguaaagaugggguuccuuuaaagaugcuuugugaugguguaaaauaaaugcaucauucuccccucagagggaauaagagauaauguauucuggagccaaauaugaucaugacccgagaacacaaauuuagguuacugcaaauaccaguuuccaugggaacaguuccaguuaguuuuugguuugguuuguuugucucgagacaauguuucucuguauagcccugguuaucccggaacuugcucuguagaccaggcuggccuugaacucagaggucaugcugccucugccccaaguguggcuugcaccaccauuguccagcuccagguaguuuuuuuuuuuuuuuuuuuaugcugacggaacaaaggucauaaacuacuuuucaaauacguuagugaguuccucaggcuggcgguuacagggaaaggaaagcccuugcaagccuuaggucucgcacgcugucuggcgcauucucagcuauggguuggugggaagcaagggcauuguuugcacauuccaaagaaauucaacuaaaagucacaaggaugugcggucacacacagaggggggcgauaaaugaccacuuaagggguuaacagcccgggacaaguuaucuuuggaccuauaacauuccaaccucugcacaguugcccaggcucuacccuguuaagcagcuuggcgaguugcucacuaugggugcagcuuucuucugagaaaguuaacuaacauuuagggcugcuccugguugaaccuacagaggagaggaaagcaugguaggccaugaugauggagcacuccccugaaacaugcugguggagcacucccccugaagcauccugguggagcacucccccugaagcauccugguggaacacucaccuugaaucaucugguggagcacucaccuggaaucaucugguggagcacucacccugaaguauccuggugagcacuucccuugaaacauccugauggagcacucccccugaagcauccugguggaucacucacccugaacagagacccaaauguuagagcacaauauuuccccagucuugaccauuuuggugaugugauuuuuuuugucuuuagaaaaauauuauaaagcagcuggggcaucaaaugcauauucauaauuaaacuugcauaaaauuuagaauucuuuuauaccauuugaagugcaucaauaaaucauuguccuagauuccuugccuucaaagagaacuaucuaaaaauaccacacacacauacugauacauacauacacacacauacagauagacacacacucacagauauagucacacagguauauacagauacacacacucacagauauagauacacacauacacauacauacauacauacauacacacacagacucacagauacauacacauagagacacauacauacacacacagacauauagacacagacagacacacagucacagauacagauagacacacacucacagauacagacagacacauacacacacagacaugcacacacagacauacagacacacacagacauauacucacagauacagacagacagacagacacacauauguauguaagaauauuguccccucugcagcuauuuuucuuuccuuugcauucauaguucccagaggaacucauugccugcuaaguccuauuuggaggacagcuuuguccuuuguacugaaggacugccaacugcguuucugguuaugcucaguugcagagucuggggauuuuucuggagguguggcuuaaaaaugccaggccuaguuuuucuauuuggaagucgucccccuagauuuuuggaagaagagaaaggggugugugugguguugcaaacauaagaagaggcacaagccacaagcaaaagaucauguggggaaagagaggaaggcagcagccuuuggugcgaccaggcgguugccugcacucgccugggagcaagaucacucuuuuggguuugguucuguucuccuguauucuggccaagcugucuucaccaggccacguccaugcccuuccccuguuucucaccuuccauggagucagucugaucuaggggcuggggaugguuaagccagggaagagcuugcuuugcuagcacaaggacuccaguuccaucuccagcacucauacacaaagccuggcauggagauuuguggcugacucccagcaccagggagguggagacaggaggacuggggcuugcuggccggcccuguagccuaauuggugagcucuaggccaaugaaagaccuugccucaaaggagguggaggguguucuugcugaugccacuugagguugcccuccagcauccacaugcacgcaugcaacauguaacugcacaggcacagagacucaugaaauaugcguuacaauaucguuuucuggcuuuccccuuuuucuugucacagacuuuauuuucuguccaagauaaacagaaguuugauuaacucuguuaaucagcuucaauuccuuugguguaccaucccuuuucucuugagccuccccaccaccccuuuccagcuuucucugcauuuccuaggagaguugacuuugaaucaugacgcugcaccauucguuacucucauugacugccacgaaaaaaaaaaaucucccauuucucuccgaggcuccuauuagccuuguuuggcgucugaggggcaagagaggauaauggcgacuaaauguucucaaacacacaacggagagaagagaggguuaauucucagauaugugaagccuggccaagaacccuccaaaagaacacaaauggagccuccagagaugcagugggaggagcccgacaccagugguaguaagcacaggaaaguaugggguuccccaacugaccacugcaagggcuagaggcgcuggacugugcgugggcucggaagucagagcaaguguagguguagagguggcaaaauuuuauuuuauuuuccagggaaacguuuuuuucuggcuuuccucauccugaguugagcucguuucuaacuuguuauguagcaggacugauuuggcaaacaagcuguaugaaagacaagaugccacgaaagucuuucagagccgaacugcggaagucaaagcuucggagcugcucagcccuucuggguauauaccgugcugacacacugcaccuucuggguauauacugugcugacacacugcaucugcuuaccgugcugugccucuggucacaccguggucuucuugcccagguucuuggaaccgucucugaagcacuuuuaacgucagucaggcgcuuccucccgacuccauccugcccaucacuucuggggcuuuaagacugccauuugaaaaacucagggcugagcaguagaaagggccuagugcagccuggcuuccagacggccagucuuccuguccauaugauuccuacauggcccgugcacugagaccuucuuuccuauccuggcuuugaucguaacugguuaugaggguuuggacaacucacuaaauucccgugcaucuaauucucuacucaucaaaugaaagguuugaaguaggggaauuccccaaauuugcucuccacauaaaagccccgugauuacuucugucucaccuccaucaccucuaaagcacagaguguccuacccacauacugggaaguggugaaaguauacagagaagugcucaguaaaccuuaaagcaaugcaaaugucagcuggcuucccuaagguucuuucugcagcuuccucuucaggccauguuucagguuucaccguuugugccaaaggagacaugccguggcuucuuguggaaauuccucaaaucuugucuucugaaaaagggggccaagagaugggugcaggcaaacggggcugaugcugaugccaguuggaucugcaaguucucuggaaggaagugcacuacuacucucacugcagaaaggcggauguuuuucaguuucuugcaagggugagaacagugcuuaagagucagaucucaaauguggcuucguccagagccccgaggucaccgccgcaggauccucggcgguuugacuuccauuucuguauuucuaggccauuuacucgugugccaaacguaacaccaaccaucucucuguccuuuuucugauuaguggauggcuucaugcgguuguccaggcuggccuugggacacauggaaguccucuugccucucucugcuaacugcuggaaucacaggugugaccgugccuggcaucuggcgucacucuugccugugggauggagggaaacuucauuaucaaagcuuugcaaccacagacagauccucgauugagaucgacucuuauuuugcccauaccccauugagugaguccuuccuugacacuagaggaaaauuugguugucucuuguucaucauucccaggacuccuguggugcuaucuaaguucuuggcagagccucucaagguguuaggacuugaacgaaucccagagaacccuugaaguagauuaugacuucuuuuauaguuugccaagagcacagcuggauuaguuaggugcuuuucacagacugggcagccaauaaauagcugcagauugauuugcucugcaagaguucuugguaccugguuacuuuccuauuucuagugcauuucuuucauguuuauccuuuuagaacauuuagcuguaacagcacagguuuccuggauccaguguggcuggaaggaaugucggugauagugucugucaucaucuauagucccaaagugguuucuugcaacacauuccaggauaucuugaagaaaaagaguucuguguuuaaauaaauagagagacauugaguuucauaggcuggccaccaaaguugccaaagaguuaggaguaaaggaaaauguaacuugguugaaagguguucuuuccaagacguggccaugaaacaguuucuccccuacauuuuuuuuucaggaugccuauuaaaguacuacaaaaauucauguacuucugaauuuuacugguaaagaaacaagucuugaggagagagugggguuguuauagagagagacuaagcagcugggacaagaacaucauuccuauuuuguccaaacuggucaaccacauacuaagguguguuugggaauuucagguaucagggugaggguggagaugguuagcagaagggauuugaauguuuuauucucuacuaggccuuuuucccccccagggagcaauuagacaauauuuucccagggggcagauuuccuaaacagacucuuuuaaagguccaagauucccuuuuaaaaaugggaguuguuuauucuuaucuccugauuuugggauaguugccuuauaaagccuggauguaguagcaugugccaagugacgcuuuagaugcuggccaugugaggaagucccgagcaagagccggugaugacuacugacuuuugggauucucugugagcucgcacaaggcguacuuauuacauggguauaauauaucuacaaagcaccucucaagcucaccauacuaagggugagugagacacggggcuugugggacaagccaggacugggacucagaugaaacaaugccgggcagaauguccucagucccugcagacuggcuggugcuccgcggaaucagguuucagaaaauggaucauacuggcaugagacuugauaaagacugagggaggcugagagacuuggauaagauguaccaggcagagaggccaucuaggagagacauuucgagaugauaugauaaaagaccuggcaagacacaagggaggaugcggagcagugagcuguccaaguggguucaggaggacggguauccagggguuagggugugcagacauagccuugaagccuauaagucgcacugugggcucuagggugucugcugagaagcaggcacuccagggaggcaguggggagcuugugaaggugugugugugugugugugugugugugugugugugugugugaagaacauuagauaacaccaggcaguaagagccgggguagaaaggcccacguuaggggauggugguugcuaucgagcaguucaguucugaaaagaccaagggaaacauucugguauugccauucagacuaaagguaaacauggccagagaaagcaggucagucacuuuccaggugcacaggaagaacauacggugcugcacauuaucucaggcgauaacauccgagacaaaaugaaggcuagagauggcagccagaaggaaacgucacagaagacagcuagagagggcugauucaauacacaaaccauagccaugguugagaaacccagcuuuggaaagaaugcaagcaccauaguggccuggcugguuagcaaagggacuucaguuuuuguaucucuuuaucugggaaaagggagcgauuuuuaucucaaagggguuaggcuuuuccugcgagaaacuuccugagcacguggacacacggcaggagccacgcgagagcaaggaccagcgggcagaaguuaaguagugguugcagauucucccagacgcccagaaauaguggggaccucaggaaauccacaaccgcccuagaauugggcugagacgcccuguagagaggacuggccggucugguccacgagccgcgccccagcccccagcccccagcccggcacagcccuccgcccgcuuucacaacccggcccucugcacuuaacccccacucuggcugguggccgagcgggucccaagcccagcgcgcaugcgccgacggcgccccgccccccugagccccgccccuauuuccacgucucacuuccccuagcucugccucgccgccucggcugcagcucggccgccacgauuggcugcgggacguccuccucucggccaauagacgccacgccgucgcccccguguuacuggguagaacaaaacaaaaacaaacagagcgagcggggccagaggcgcuccgaggcagcggcggcggaggcugaggaacggggucggggcccggcggaccggagacccgggcgagcggcggcggcccgagggggucaguacugugggcgcggcucgcacgcucgggcgggcggcguccucgucccuuaggcccgggucggcggaggcugccgcacguugggagggggagggggcguggaggccucgccgcgggggucgggacgcucggucccuguccacgcuggcccuggagcccuccggccaccggcgcucgcccaacgcccggggcugcggggagcugccggugcucgcucuccgaggccgggucggucgggccggggagcugcagcacgggcccgcccccuccuccgcagccccauccccggcggccgggcgugcguggcugcgugcgcucgcggugagaggagccuccgggcgcccgguccgacgcaguuggacgcgggggacgggacgguaggagaggggugucguccggacggagauccggugaggggucggugccccgaaccgaggccugguccgccucggccggcccugcccgcugccggaggguugggguccugcgggacaggcgucggucggugcgggcacggggcggggacagcugcccucccggcccugugccaacuccuccuugcagucuccuguacagggucccuuaaaaaaaguacaauacaaccuagagaaaacaaagccgagaagggagcccccucucugugaacgcaugcugugucugcugcccguggcuguccgcuacuguaauguacguagagggcgugcuuuuugguuuuugguuuugguuuuuuguuuuugcuuucccugaacagccucagaacugcagauguaggucucgccuaucuuccccgagccccuccuugggaacuggcucuguaaaccagccucuguagucgacuaccugcuaugaaugauucaaaaugcggcuccgggccugggugaggggugggugugaggccuacgagcugcguuuaagacauuuugauagcuucacagcuguaauacucuugauuuaagaguuugaaauuuuaggggaaggcccuagcauauauauucgugcucguauuuauauccauaauaugcgugcgauaucuaucuauauaucuauaucuaucucgugguaagaguagaggaaaauaaaauacuuguuacggcugcaaaaauaaauguacaugguugcucucaguagugguugcuuuugcguuauuguuguagagugcucuuagcagaaugcaaguugcuaauuaaugugacugcaucccagggaagaauuaaggucauuuucuaguuaacauguggucuaaacuugacuuccaaaaugucaaaguaauuuaucgggcauuuaggaaaugcacuggauaacaguuaauuucagcuuaaucguuuuuagcuguauacauagcuuccccuuaccccaugggaaaugauuuuguauagauuaguguggagcaaauggaauuuagauuuuuuuguuguuguuguugcuguuguuuugccuaagguugagguaaguauuuuaaggaucguuaaauuaaaagaaaaaaaaaagcccacugaagagagugucacauacuguccuuuagaacagcugugaagcuaugggugugucugcgucuugacugcuugauccaguuguuauggucuggagauagaacuauuuuuugguuguuauaauuaauaaaacaucauaucaugugauaguuauuuccugauagcuguuuucaguaucauaucuuuagugauuggaaagcaguuuuaacaguugguguacaaguccacguuguuaaaagcugcuuuuuguuaacccuaagaaggacuuccuuguaaggcacucuaagcucauguacugaauguacagcgucuggguucucguggucguucacccagugugaacaaccuugcagagaacauccuuuccuucuaaaccucuugaguugugugcaaagggaauacgugaagcucaugaaauaaugcuuacacaauuaguucacugugaaugucaaagggcuugauaagcacuacuuauauuucccccauuauuagacagaugcugcagaaaauauuuccucagagacuauacuugcaucuagaaugaaaaucacacuucacaguguuaaauucaaaucacaucagagcugacagacuuucucuagcauguaauucaugcacacacugaaggaaagcaggacauggccuuuucagccauggaagguagcaaaaauuuccauuuccaaacuacacuuggucuuauauuuguaugacucucuguguaucuauuuuaaaauucauuuuucuagauccuaaguuguuuaaaaugaaguaagcagccauguagacuugcauguuaguuaauucugaguagaauuagagaaugcuuuuuaccauguucucuugggcaggaugauaacaucuugauguagccuaacaguuacgacaugaauucaacaucaggugcuauucuuguuucacaaguuaauauccuuuuagagaaaaacgauauagagcuaaagggucuuacgcgugucaucuaaguucuaucaccugucugcucuccaccacagcacacaagggccgcuuguggagguguuaaacuccugccgauccuugcuugugcugccucuagugcuggauuacagaugugguuuuaccacgucugccuuuuauuuguucuuaaaguagguugaguguuuuuuuaaaugaaaauuuuagauuauagaagcgacaugcugaauauaaaucacauaagagaaaggguuacuuaaaaaacgucuuccuguuucagcgccucauaaaaaguguagugggcgggguaaugacccuacagcugcugcugcggucagaaaagaucaguacaugaaauauucuugauuagucaaaacugcuguuuuuauuuuggaguaaauuuuagauuuuguuagagaguuacccaauacuuaugucccuguauguggauguaaaguuaacuuuaagacuguauuaaaugugggcuggaaagaggaacauguguuaagagugcauaauguucuuccagaggaccugaguuugguucccagcauucucauuuguuaacucacagcucccugugaguccagcucugggggaucuagugccuacuucuacucugcacagcuaccuaaacacaguguggcuugcaagcacuugagagcauacacacacauacaccacacacaucacacacaccacacacacacacacaccauacacacaccacacacaccaugcacacacacacacaccacauacacacauaccacacacacacacacacaccacacacacauacacacaccauacaccacacacacaccauacaccacacacacaaacaugccacacacacaccccacaccacacacaccacacacacacacacacacacacacacaccacaaccacacacacaccauacaccacacacacaacacacacacaccacaaccacacacacaccauacaccacacacacaccacacacacacauacacacacacacauacacacaccaccacacacacaccacacacacacauacacacacacuacaaccacacacacacacaccaaccacacacacaccauacaccacacacacacacauacacacacacacacacacacacacauccagacacacccccccccacacccacacacccacagguggggggagucuuaagagauuugguguguauguuuaaguuaaaagcuauguguguuacaaacauuucuuuaaaccuuacauuuaagggauucauuggcacaugcugaaaucugaugcauuuuuaucucaaucuuuuucuuccuucucuuugucucagaaaagcucuuggagaaguuuggagcuaaguauuaauuugauuaacuuugaaagcauagcaaauuccuaaaaagggacuuaggcuuuuuuuuuuuuuucauuuuauucaaguaaguugacuuuaauugugucaguuuagaagccguugaaccuuuuucauuucuuuuuuuuuuuaaauagauccucaaggaagacuugcauuuaguaaguuguguauaaucagugcaagcgaaauuaaggaaaaauggauauagaaaaugagcagacacugaaugugaaccccacuggugaguaguguccuaaccccugccuugugaccaaacuugaaacuauuccauauuuuauguggggaaaaugagaguaaaacguuuaaaguacuuuuuuagccaugcauaagguauccuagcucugcaaaaaggcagcagaaacucguaaaagaucuucaaaagacagggaaagaugucuagugaaguuggaauauuugcauuuaaaaguauugaguguggugcgcuuagcagggacagugugcaugaugcuacgguacacaguaagaacuuguacacuuuauucugaggucauguggaaagcuuugagaguuuuucaguaagggcaugcuuuagaaaaccacucuguucacuuuggagucuguuuugaagauggaaggcugagagacagagacuaaugaaaugcuguaacacacugagugugcuugguuuggaucgcagcguuuucuuaguaacauuuguacuuuugcuaagaaucuaaaaggauugaauaagucuaugcuuuuuagauugauuaaauuuuuaaagucauauaugucaacuuuacaucauaauaguaauuaucaucauuacaauuaggcaccagacaguuugggugauuugucucuggcuuggguuacccaucuggaacaaaacugcuggaggaguagugaagucaguggccuuucugacuuaaaacuguuucuagagcaaggcugagguugccaugugaucuucaaagacaucugagacagggagaguggucuguugggugcuguugacaggaaguacagucugguaauguacuucuuugaggcuaugaccagggaagauuacuauggaaggaagcauugcgugcugcaguggguugcaugaucaugguaugaccauguagugucccugaggcuugacuuguuaggauggcuuccauggaggaaaugagauuagggguauauuuugaagaauucugauagaagauuaguuacuaaaugacuucuaagcaaaagacguuuggaaucauuuuaggugcuaaugagccaagauguguggcugggaacuuugcagagauagagauuuggggaauagcugaggagguggaggugaugguuugagagccuucccuagguugacagcaggguauucgauuacauauuugucaaauguggauugcagacuaaugucuccuaagcauuuguaauugaacagggaauguuuugaaaguaguuuaaauacucccugauuuccucaucuguaugaagugcugaacuuguacuguccagcauagccuagaaaguaugcuauaguuuuaugcucuucauacugacaaagguuuuauuacccaagcauguguaauaaccucuuuuuagaaaacccuguuaauuaaaauucaguaccuucauuuacuuuccuugauaaugggaaaaauaaucuuauuuguucuuuauaaaauugccaauguaugacuacuacuagccuaaaaaauguuaauuucaugugaaguaacuaaauuagguuuuacuucacauaacaguggauacuggaaauacuuagcuuaguuuuuuuucauuuucucuuuuaagacccugacaauuuaagcgacucucucuuuucuggagaugaagaaaaugcuggcacugaagaaauaaagaaugaaauaaauggaaauuggauuuccgcaucuacuauuaaugaagcuagaaucaaugcaaaagccaaaagacgacugcggaaaaauucaucccgggacucuggccgaggagacucagucagugacaauggaagugaagcgguuagaaguggaguugcugugcccaccaguccaaaaggaagguugcuagauaggcgguccagaucugggaaaggaagggggcugccaaagaaagguuagugugugcugugcaaagaaacaacuggaagaaccccagauccugugccaggagucccuuguucuaaauggacaaaagcauuaaccgcuccaggcuuaugauugcguacaucuuuacgggagagcugaaggcccauaccacuuuucuuuuuagguugauuuuuuuucuuugggguaaacuuucucuuuccccuaagcaaaauaaaguaaacauugaugcuuucuuucaguuaugauuuuauacacucuaugaagguggucagguuuauuauaacuguuaucaaaugagucuauguucauuguuaaaguaguaacuaugcauuuggugacaucuauguagaucuggguuuguguucucuuuuaguucugcugcuugagugcuguaauagauugauuuaucucacugcuguauccagugccuagacuauggguagacauuuaaaauucauuugggugagggucuuucagcuucuguccauagugggauuucuguagaauuuggagauuggauuggauuuugaauggugugagcuucaguuauacauuuaaggcacggauaauuuaaauggaccuugugaugaaagugcuuagaaggaggggaaacugaaacagggagauugaaugucagcaucuucuauuaaugaacaaagaacuaaugccaagacaaaaggaugauuaugaaaauuuguuaaggugaauagagaaagauaaauauauuaguauucagguaaaguauaguggucuuucagaaauuauuuugugacuagcuacauaauuauaugaaucaaaguggcccauaguuaucugguuuuggucugcuguguuggcaaggauuauacuccagguauagaaugaaaacuuaaaaagggggaaauggcauuaugaaggcuuuuuaaaaguauuauuuuagacgaauuuggcuuuguaaaaaugccacaguaaauugcuauggacaagcaacuuguugaguugaaguuguagucuuugaucuguauaccaaaguagagagaaacagcugucagugcuguugauuuuuaaauaguaauuauuuguuaaaauacugcuaauuucuaaguuuaguuuaaugugcacuugauguggaagaauauuacauguuagcaugaugguggucaauauggaucucuguggaaugauucuuuuuuacguguugagcuuuuaauggcacauauacugguccaaauguuucucuucuuucuuuuuuuuuucugguuccaagaacugucaaaauuuagagcuucaccauagggucauguucugaaaggucugugguauggcuguugcucagauuaaaaaaaaaguacuaugaagauauuuuucuaaguuauuuuaaauugaugcuuuugaaaauagcuaaucuugaaaaaguuaucuaaauaggaguuucaaguguaauucucaacuggaaaauaauuagcauaagaauuuuuacauuugaaauuauuucagauuucaguuaauauuuguaaacuaucaucuaucugaacuuucagguggugcaggcggcaagggugucuggggcacaccuggacagguguaugauguggaagagguggaugugaaagauccaaacuaugaugacgaccagguaucaacuauuuuuuuuauauauucaauguuuguaagauuucuugguuuuucacccauaagauugucaaguaauacauggucauauaucaauacuccauagcuaugaagauauauacaacauauauggcaaaaucauauauacagauugggaaaauaaguuuuuugauaguaaaauguauauaauuuccacuuguuuugggagucaagaggagguuuuuuauugacuugacuaaugauaauaaaggaggacugggauagccugggcugccgguaucaggcuccuuuuuagagucacuauugaacacaaguacuaguauagauguuauuuugaggacacgugcauuuucucucuuaugauaauacuuaguaagaaaugucuuaaugcaucauugugaaguucuuuuugucuuuuuaaugggaaaauuucaaaaguaauugguacaaugaaccuacugguacucgucuuucagcuucaccagagucacugcguuaacuuacagacaaucuuuuuuuucuuuuagaccaggcuggccucgaacucagaaauccuccugccucugccuccugagugcugggauuaaaggcgugcaccaccacgcccagccccagacaaucuuauuuaaucuuguaucuguuuacuugaaaaugucagugugugugucagcuuguuuuucuuucuguacaucacuccuaugcaugcacuuaccaguuuuaacagguggauaugaaacauuucuaagagauaauaaaaauauuuaaaggcugugggauugaaauacaauauacucugcuaaauauuagucuuuuaaguauaugcugcaaauaguauuuuaagugacaaguuguagauaaaauacuuuagcuuuucuauagaggagacacauggauuggugauaagcauuuuaaucuuacugaaauuaugcuugaacuguuuuuucuuagauuuuuagucauuacaauauugaucucuuuuuuuauauuuugaaaguuucugguuuugacaauauuaguacauagauaagaaugcuuaaucuuguuaaaaagucaaguuuuaaugaaaguaugugcuaggaugccauauuaaagguuuuggguuaaaaaguugguuuuugaggaauauaaaaguuaacgugaaagcugagacggcuugguagguaaggugcuugguaggcaggcguggagcuugaguuugcauuucuagcaccugccucagagcuggacaugguggugccuaucugugaucucagcuuugggaagggagaugaguggguuccaggcuugcuagaugggagcaacucagcgagagacuuugucucagaacaugaggugaaagggacagggagauggcugaggagggaaaagcacuuuauguacaaauugggcaacuugaguguagucuucacagucaggaaacccauaugaaaaacccgcuauggugagugugucucucauccagugcuucaguggggggaugggagguggagguaaauucgaccucuggucccugcccaucauaugcauguauggcacauaguccucucccuacccagguaagucagcgugcaauagagaguuuggagaaaacucauguauuugcuccagugaauggcuucagucugucucuagcuuguugagguuguuuugaaaguggcugcaugcagacccugugcaguuaaaacaggagguauaucuuugucuugccuuacuggugaucacuaaccagcugaacugugaaaguaucauuucaguuuaucugaauauuuaaucuauaauuccccuucuuucaggagaacuguguuuaugaaacuguaguuuugccccuggaugagaccgcauuugagaagacucuaacaccaauuauacaggaauacuuugagcauggagauacaaaugaaguugcgguagguuucaaguugcagggagaaaacacacuguuaaaccuguguagaaugauuuuggacuacucuggauaaauuuauguuuuuuucuuuuguaacaacaacaaauuucacaaucaggaagggaacuucuggacauggugguuuaugccuaaaaucccaguacuugagauguaaaggucgguagcacaggucuggguuugaagccagucugggcuacauagggcuucgaaagaaaaaaggaaaagagggauacaauuuuuuccuuaaacaauuuuucuuacauaguucugggcucugaugauacuucuaugccauuuccuuuugaggaaaacgccacaggcacuauuucuauauuuuuaaagcaucugguuuuauaaucuagacacuucuguggaauuuauagacccuguguagccucuucaggagcuucagaaugaucuguuuugggggagauuaaaaaauaucuguacucuccaagaaacagcguuuauacagagauuuggaaaaggauguauaugggcaccaggagaaucaaccuaagcuuugaaucauaguuuguauggggauaauuaauguguuuguaguaaauuuucauaaaguaaaucucggagguaaaauaaagugacuaguuuuauuagaauuaugggccugagcuauaacaguuauuaauuggaagucauuuauaauuauuaaacuccaaccugggcuuuugauuuguuuguuacauagguuugguagcuuuggauuuauagaauuacaguguaaaacaacuauuuguuuauugcauucugcugugugacagguuuuucuggggagacacaacacauacacacauuuacuuauaucagagagggaacccaugauaguccaaaauacagacaccaccacaguccaguuuguugagccaaugaguuuuauugggauuauuuacaggaauauggaugaggaguuacuuccaugagcagaaaugguucagagacaucugcaucacuaaagcccaccccagcaugagugacaggucauaaagcugggaaccuggagcccacugccuagccugaggcagcccagcagguuggagagugaccuucccagcugccucaguggguuuaacccuuauguaggcagguugucugcuccuuccaggcugcugcucccugugaauccuugcagcuuggcucugcucacucuggcaggaagagacuuaaugagccuggucagucucaggaacuuaucucaagcuuuaccuuccugcuuaaagagcuucccggcaggcuggaauauuccagucuuagaggaaacucuuacacagugcucugucccuuacucccaagcuuauauucuuucugccuuucuguagugaucccucagccuuagagggggguugacuauggauguccaucuauggcuaagaaguaugccaccguaacaugccacauuaagucaguucucaggagcuuggccagugcuuauaacagcgaccuauagguguaaacucauguuuagaaggcaacuugacagacauauuacauccacuuagaaaaaccauauagguugcuuccccacugggaccuaugaccuccuuagccacagguuuuuguccuaguuuaucguaccagaggugaacucccuuuuguagugaaguucuugauucuaguuggacccaugacagcugagccacuagugcacaaacuguuauauccugccuugcauguuggcauuucaguacacaggguccauagcccagcaggaaugcuggugacgguccugcaccucgaggccagcaagcaggguugggauugacauuacagucaggacauguucuugcagugucuucagcagcagggucagaccaucaagugcugaaauagaaccaacagcaguagcaaaagcuuucaugauuuguggggccaacaacucauaaggagagagcccucuucugccacuggggguuuguagucaguaagcuuguagcuucugggaguguccuuuucugccacuguagggcaccguuuggauuuaaacucuuuagcugaugguucaguuacuggggaaugcucagcagcuucagacaucacugguccuagggcagccugcauggcauuugugcuggggcuuguauauaccacaucucacuguuguaaauuugcugccgccuuuauggaguuggagucugugcugcgccagaaagcaguuuggccagguggacuuuaguccagcccuuuauugggcaagcuguucuuuagucacuaggguaguuauaggucccaccuguugcaauacuaaauuauuaaauucaaguaaacaguugcuguccuuugccucugcuccuuuuuguaacccaaaccuuaucgggccuuugcuuagguugcuuuugccguacacccaguuguagccuuaccaacaucugguaacuucugacaggagggcacauuggauuaguggggguauacagcugcuuaccuguccuacagugaucuuagccugcuccaaagccacuuuagccugucugugucaauccaucuaaccccuuucauuaucacuuuauacaaaggaugggcagcuugggcaggauuugguaugaaaaucugcugcuauuuuaagagcuccccgagugcccccagcaccuuuacauuuacaggcauagucuguuguaggauuuugacaguaauguugucagguaucauauucgucuuaucauacuagaccauaauacugccaaaaauuuuacaucugugccuggcccuugcacauguggauugaucuuccaucuuuauugaagggaccaggauugucucaggauccccaagaccaaguucuguaggucggggaaaaagaaacaaagacaggagggagagggagagggagagggaagaagaggaagggggaaagaguguuugucugggguugggaaaaaggacagggucgggacaguggagacagauguggcccauagcagauggcaguuuacaaagguuaagaagggaaacucuguguuagggugagccaaaaggggauuuugguugcuggaccucaauacuuugauagcuagaccuugguugucagccugaggaggaagaaguggccaaagggggcuagaccuuggugguuagcuuuuggaauguaaucuacuuguuuuuaauaagacagagaggccgggcagugguggugcaugccuuuaaucccagcacuugggagacugaggcaggcauauuucugaguucaaggccagucuggucuacagagugaguuccaggacagccagggauauacagagaaacccuaucucgaaaaaccaaaaaaaaaaaaaccaaaaccaaaaccaaaaaaaaaaaaaaaaaaacaaaaccccaaaacaaaacaacaacacaacaacccccccccccggcaaaaaaaaaaaaaaaaaaaaaaagacaagagaauaggggagaagaagggcaaggccugccagagcaugcuuuucauguucagacuguccuagagucccuucuuucacucauuccuuuagacacaccuauaggccguuuagguacauuucuggauguucacaaacacucagaaguuagcauuaugucauuuauauaacacauuuucuagagaaugggcaggacaaagcagcaccaagccaugacggggguggggugugugugggggggucuacaaagauaaccuuggugaaacauuuucaaagucaguuuaaucucuuuugagcaagcgucgggugagugcagagguucacaacuaagauguucuaaagugugacguaaacaagguccaauacagaaaggcuccaucccuuuguaucaguugcuuccuccacagauccagguuggguaccaagcaugcggauaggaggugcugacuuaauuagcucucuguaauccucagucauccucacugagccauuauguuuccaauccuggagcucuucacacagucucccuacauuucuccaaacuggauagacucaauagccugucucagucugcucagaccugcucauagccaaaggugaaugaggcucugcccucuccugcuggaccuaauggcucccuaggucagaguggcccgugguuggcaugguggcuguagcuucuccagucaccauucugggcuguuggggggaacuccuggcugaguaaaccaucuccacugcuaguauaaccuuuuccuggagagaaauaaacccuucuuacuuucaggggauaauuaccacuccuggggcaggcuugaucaucuucaccuguacuguuucucuugggugucuucugcacacugcuccucaggcuuuagagccauccaguagccccuuaucacacaguuggcuuuccuuuugucaguuuuuuccuuggcaacuccaaugagacccaaauccugccacaucugucucugaauaacccagacaucuuuuucucugcuuugucuuuuucuuuuuuucuuaccuccucuacagugcucucucaccuuacagacaucuugcucuaagucauugagaucugucaaagccccuccuacuuuauaaagcucuugccccuccaaagggcucagcaaagccacuaaagcuccacaccagacaugaggggucccugcuggaucaaccuuuccuuugacuccucugugaacacaguuguaacugacccagugaguuggguucaaacacagcuccucuuacuccuaguucccucaauagcaccugucccuccucuuuagcccuccaauuccugauguguauggggacuucagacagagaugacuaaauguuccuuauggcuuuuguaagccagcccaccagagacugauuuccaucacacugucucaggccauguagccauugcuuuaaggagagaugggaaguuacauuacucaguuuuucugucuccacagcugucugacgaaucccauccaccccuguguuucacagccucacaagccaggcugaaacaggcucuuuuguuacuuguuuaaacuucccuaauuucagcaauucaagugcugaguguuucuugaccacccuaguuucuugcauggaaccaaccauauucuggaucacagguuuucuuuuuaauuccauuaaagguuaguccucuacaguauccucuuaaugcuuuuaccauaaucguccccacucugacucuuccuauggauuccaaagucucggaucccagaagggcuuccgggcacagaucuaacuugcaaucucuuuuccuuccacccuccaaccuuuaagaagucaccucaucucauccucuugguuaucuaauuugccaaauuagaggcuaacacggaggaugcugccacaucucugucuuguugcauuugcuuauuuuuacacaaacagguucuugcuggcagccauuucagccuuggugcguuucugacuccacguaagaauggccagguaaccucugcggcugcugcuugccuaugguccccacccuugugcguggaucuuaaagacuucagcuuuuccuccaaaccaguggcucucaagacuccuaugcuaugaucucuaaugaagcucuucaaguuguggugaugccccagcuauaaacuuguuucauugcuauugcugugaaucguaauauaaauaucugauaugcgggauauaugacauaugaccgugaaauggaucacaucccacagguugacaaccagugcuaagcuuuuaacuuuucagagcaucuccauauucacauaguguaccccauuuaucaagcaggcaggccacccucaccauagacacagauugccauccugggauuuuccccacagauguuacuaauccugauggcucagucuuaguugcgugucuuauaacgagaaccaugcaacuuguagcacacaaacauagccaaaaagcacaccaaccaaccucuguauaaagggcaggacagcuguguuagagaucacugaccuugucagccacaggguugggaaaguaggcaucuccuaguuguauaucaugguuuaaacauugcaaggaaacuuaaaaguaggcaguguuaacuaaggaaguuagaguuggaacucugccucuaagguuauauacuacugcaaggauuggauucuucugagcauuaaauggagugguagaaugccugagagccaugcagcaugguuaguggauguuagguacuguugugcuuuaucauuugaaacaucaaucccagucaagcacugaugauccuacuuuauacucacaugaaagacuaaagcagacauuuauuuuaagaagagacaaggucuuacuauguggcucuggcugguuuggaacucacuauguaaguaagaucagguuggccuuuaacucugucuucuugccucugccucucuggugcugggacuuaaggcaugugcuacugaucccaguccucaagagaaaacauuuaaguagacuauauaagcaguguguaauauaaaauaaaucucuccaccaauguuugucaauuauuuguagaaauaauccuaauagauuguaaaguugcuaguuguaguuggacuguuggcaauguucuuccuaucuucaguguacugauaaccaggcagguagagcuuauaucacugcuguaaaccuaaugugccugcugggauuccuaaagaugagguggaaagauagaggagaagcacggcugcagcaaaaguaaggugugacugagcuagagagagguggucauuuccauucucucacacaggagauguuaagagacuuaaaccuuggggagaugaagaguggcgugccgguguuggcaguguccuuagccuuggaggggaaggccagccaccgggagaugacauccaagcugcuuucugaccuuugcgggacggugaugagcacaaaugacguggaaaagucauuugacaaguugcugaaggaucucccugagcuagccuuggacacuccuagggcaccgcagguuugugucuuccuuuugcuccuuuccuuugucuccucuguguacacacuccauguacacacuccguguacauacuccucggcaauuacaacaguugcaagggaguggcccacaguucuaaccauacaaaaguagcucugcauauuguaggucuuucuccccaacuucguuuuuauuuucuguacuuuguauuaaaccaagggccacccacaugguggcaagugcucuaccagugagcuaugaccuaccuaggucuugaugaaacuaaacaaaaccucuuuucuauccagcucuguauaguuuuuaggucauauguaauacauguauuuucuguucauagauuuuuuuuuauuauaugaacauuauuuuacuagcuacgaauuuugaagauauguugcuauauaacagauaaugacugacuugagugggauuuauuaaaacaguuaugacuauucccuuuuguaacuuugaaaacauguaauugcuguuaacauuugcauaaaaauugaauuuauagagaauuucuaaauguuguuucugugacaggcaguuucuaugagucaaaaucggauuuauuucccuucccuacuuauauacauauuuaaaaauggucgucugaguucauauuaauuacagaauuuuugaugaauaaaauccaaaaugaagaaaggccaggaaaaacccuccacacaaaccuguuaacauuuucauaacuauuuuuuaauuucuaguuuguuauuuauuaguguuauuuuaccuuuauuuaauuagaaaguagaauuguacuacaaacacuguuugcagaguugacuuucccagugccccacagugcacuuugcuuuguaugcacuacuuaagcauaauuuuacuguuggacacugaaguuguuuucagauugucuaauaaaguuugcuaugaucagauuuugaaaugaaccuuuauuugugcauaacuuucuccacaacauauucuauaguuaggugagaagacguuguggguauugaagaggagagguuuuuccuugacuucaggucacuuuaacagacaaccauugagugugcagaguccaggggauuagggagugagugaagcagaggcgccaucccauccugauggcaugggcuugaaagucaagcuaaugguugaggagcgugcauggcgcagggcacacaggcgcuucugcacaccccagcacuugugggucaguguaagggagugugcaccguguacacacacacaggugcuucugcacgucucagcauauguuuuagguauugaguguguaauuagacaguuuuuaucauuuuugcauuucaagauuguauccuaauaaagauuuauuuuaguuuuuuuauauaguucucuuuuuuucuuauuauaguuggugggccaguuuauugcuagagcuguuggagauggaaucuuauguaauaccuauaucgauaguuacaaaggaacuguagauuguguacaggcucgguaaguaaauucaugucugcuacuuagaauuucaaaaugagaaauccuacaacauucuguaacaugacauggacaugaaucagacauugugaguguguauuuuuccuuacggguucuucauugauaaaagauguugccguggugcagcaggaagacagcaguaauaaaaaugcagaaguucugaguuaaacgaugcggcucccucuuuaaguuucccucucagggccucaguuucccuacuuguaaaaugaaagcauugacugugaguguccaugcuaccuucugggucggacaguuguuugguuuaaugauuagaagccagacuugcugcuuggcuuuucuaaccuccuggaggcugacuuagccagccagaccucaggcuuccccagguacagguacucaaccccaggggucuuggaggaagauaaaaguuguauaugaauuuauguuccuuccuggcuacaugaccauuaguuugcaauguauuuugacgagaagugguugugaaagaauaugagaauguucaauauuuuaaaaaauaccuaauuuuuauuugaagaauuauuuucuaaaacuacauauuuuuuuguuacauuaaaguugccaauacauacacaguuuuguaaacuuuacugcuaaugugguaaacaucaggcaugugcauguauuauaaugacuuuucucuuuucugucuuggauagagcugcucuggauaaggcuacugugcuccugaguauguccaaaggcgggaagcggaaagacaguguguggggaucuggaggcgggcaacagccugucaaucaccuuguuaaagagguacuuacugagagugcuuacugagagugcuuacugagagugcuuauuacugagugugcuuacugagagugcuuacugagagugcuuacugagugcuuacugagugugcuuacugagagugcuuacugagaguacuuacugagugugcuuacugagugcuuacugagagugcuuacugagugcuuacugagugugcuuacugagagugcuuacugagagugcuuacugaguguacuuacugagagugcuuacugagagugcuuacugagaguuguuugcaagagaaaacaacagagcuacuacuagaugguauuuuuguggguaggaauuuaauguggucauauguuugcaaguaaaaaucugaauaauuuaugaauuagaaaaauuagguaauuguugcuguuuaucuuguuuuugugacucaauggugugacuguuagaucucucaugaauauaagaagucuugucuggaacguauaagaaaugagugauuauaaaaagucugugugugaacucuaaugccugaaaucuuuuuuauaguaguauuucgucuuaaaaugcugcugaagggagauuauuuguaauuauucaauaaacguuauuuauaugagcaguuugaguaaucugaaauuauaagcuaggaauuaugaacacuagaguagaccagaguggcagagcuucauaagugugggugcucaugcuauuugcuagaagaaaguaaagugauugagucacgucauaaaagugcaagguuugcuuccuguggguucucucuguucuguaacaaugggaacuguagggucuaacugcacaucucgagacugcagacagcgccgugggcuaugugcuggcuuagugcuuuccuucucguugugugugugugugugugugugugugugugugugugugugugcuuguccagaggucaaccucaagucuuauuucuuagaaaugccacuuuggccggguggugguggcgcacgccuuuaaucccagcacucgggaggcagaggcaggcggauuucugaguucgaggccauccuggucuacagagugaguuccaggacagccagagcuacgcagagaaauccugucucgaaaaaccaaaaaaaaaaaaaagaaaugucacuuuguuuuuugagacagucuuucacugagaccuacccuaugagcuaggguggcuagacagugagccucuaauuccugagauuauaagcagaccaaacccagguuuuuaccuggguuacaaaaaucaaacuaaggucauuaagcuuguauaacaagcacuuaauugacugagcugucuccucagucucauucauaugugugugugugcacgcgugcgcgcgugugcaugcguuugugugugugugugugugugugugugugugcucgcgcguguccgugcguuaagcaguucagauggguaaagaaauuaacauuuuugcuuuuaccuauguuagaauagauagguuaugacugauuuaugaaguuggaaacuuuaaaaaaauucaaaauaaaagauuuuauuuuuuaaaagauuuaaaaaaaacaaaaaauuugaagaauuauaagaaaaaaauaugaguuuguuaauaugcuagggauauuaggcaaggaagugcaauaaaggacauccugacuggaaaggaagaugcagagguagcucuguucucagucaaaguggcgcguagauuagaggauccggguaagucugaaaaagaacuccaaaacccaaaccacacuauagaucaguacgugaaaaucagcucuccguauuuuaggacucaaugaauagacagaaaugaaaaucguaauagcauaaaaauagaguaugaugaaaauaaaggaaauucaacgcauauacuaaaaugagaugccacauuuauggaguauuagacaauauuauuaauaugguaauacucucugaaggugauauuuugaggaauuaaacucuuaagaguaugugaauuaucuuucaauaaaaagagacuggaaauaaagccaauaaucuaugacauuguuguguauucucauuucgauagaagcaagggucaagggaaguguucauguggguuuguauuuuauuauuuggaaaaaugcacugaaucugacagguaauguuaguuucacuuuuuaaaaaauaagugauuuuuaaagauacguguauacguauguguccugccgguuugugcagcaugucuguugaggccagaaguggggcguggauuccuuggagcuaaaguuaggggcaguugugagccacugugugggugcugggaacugaacccagguccucuacaagagcugcagguucuguuaaccacugagcugccucuucagccccauguuucacuuuuucaguggcacaacaaauaucauuuaaauaacaaauauacuguaguuuuaguaaaaaauacuucaaauauuaaauauguguuauauuaaaaaggcauacauuugcacuagcuguccuuugugugugcuuagugaguguguaugugugguaugugguucccccagcaugggguguguguuuuugugccugugucuccccaccacucuccaccguguuguguugacacagggacucucucugaacuagaagcuggcuauguauuuauuuauuuauuuauuuauuuauuuauuuauugucuuaacuuaguagcuuagugagcuuuugggaucuacuugucucugucagcagugcuaggguuguuuaucacagccgugccuggcuggcuucaugugagaggugagcuuugaacuugggucuucuugcuugcagugcagcuacucucaucacugagccauucccucagccucaaauacagacuuaaaaacaaacagaaaaccaaaagaaaacacaucucuaauuagaauauagcuuagugguaaaauuuuacuuuaccuuuuaugaagauauuauagaaguugaaguagaggauauuuagauaaaauaauuuuauucauccagccaaaauucacuuauugccacuugauacaaauacccuuuucucagaaaauauauaaggaagauuauuuauaguugaaguucuuuugcugagaaaacauugagcauuuuuuccuagagccauaaaugagcaugcaagcuuuagucggaggugaagaauugugucucuuguucaauugcugaguguuuuuauuuuuuucaaauuauuguuuucauguguuuggguggguguuuugccugcaucuaaguuugugugcuacaugugugcagugcucgcagaguccugaagagggcaccagaucuuauagauaguagucagccaccauguggucugggaccugagccuugguccuucaguguacuuuuaagcacugaaccaucucuucuuucccacugaacaucucuagauucugaguuacaaagccucaguuuuagagggaagagaacuguaaagauucuugcccuuguaguaacacuccauuaucucuuauuuuugggcuuccauugcauuaagaacaucuugauguuuuguggcuuucuaaaagugaugagacuuuaaguuagugcccucuaguggcauuaaaaaauuguccgcucuucuuaaagauuuaaucauguguauguguguagguauguguauaugaguuaaggugccccuggaggaccgaacugcaagaucccacgagcuggaguuacaggugguugugagccauggaaaaugggugcugggagcugaccucagguucucugcugagcagugcaugcucuuaacugcugagccaacucuccagccucuaugucccuuguuuuugauaggcuacauuggagucuuaagagucacaagcaaggucauucauauuauaaaaccuacuuggagauacuagagauuccuuggaaaaccaagugcuguuguuuauuacuucauaccugaaccguuugaagcccggguguuuaauuugaauugugagagaguucuuuuaugccaccacucugccaaaucccuaugcucaauauuggugugaauguuaauauaucauuuagaaaaguacacaucuuuuaaaaaugaggaauucuaacauuucaacuuuuaaaucuaauagauugauaugcugcuuaaagaguauuuacucucuggagauauaucugaagcugaacacugccuuaaggaacuggaaguaccucauuuucaccacgagcuuguauaugaaguaagguuacugucucacaccaaagaggauuuucaaguccuccuuuuacaccacaguaauugguguuucuuuaauaauguaaaguuuuccccuuaaaaauauuaauuuauaaguuuauauaauugcuacauguuagaggagggauuggauacauuuuuaggaucaguuucucauaaguugauuaccaaaaauuuauuuacucuuuucuguucaaauuuuaggccauuguaaugguuuuagagucaacuggagaaagugcauucaagaugaucuuagauuuauuaaaauccuuguggaagucuucuacuauuaccauagaccaaaugaaaagaguauguaugacauuauuuuaaauacguuuauaaaaggucuaugccuccuuuagcuauauaagaguugaguaagaguuauuaauuauuaaugaaacuuuucuuuuagggaauguaauguauaguauuaugccuacagaguuuuuuuuuuucuuuagcucuuuauauuuuuggaaaauaacaguuuggguuuuuuuuuuuccuuuuuaaagaaugauuguucaguuugugugaugcaguuuuuuuuuuaucuagaugaagcauuuaaauugcauuuuuuucuauuuaaaauugugguuuuugaaauguuggugaaauuaucuuauauuuuuauacaagauaguuaaguguagauggggaagucaguagucagguagccugacuuuugccuggagcucuuuugagaauuuuuaaguauacguuauuuucaagguucaaauaugacuuguuuugccagguugcacugugacaauuuaugguauauugguggguuguuucauggcauacacuguuacacaggcuaacaaguuaucuauguaauguuguucuagggcuaugagagaauuuacaaugaaaucccagacauuaaucuggaugucccacacucauacucuguucuugagagauuuguggaggaauguuuucaggcuggaauaauuuccaaacaacuccgugaucuuuguccaucaagguacuuuauuuaaaucauacuuucucauugaaaaauacugaacgagauccuuggggagcuaagauagcuguuugucauucugacucucagaaaaauagugucuuuccugacaugacuggagaugaagacacuguguaggcagaguuugaauucagacuuuuuuagacuucaaggucuaauggacucugauguacuugguaguggcuucaaacuacagaugggagugauuuuuuuucagagcgaauuaauauuuguacuuuuuggauguaauguaagaguugauaagggcuuuucuccaugaaaucaauaagcuuguaauaaguuaaauaucuaguuggagccaaaccuacauuuucuauacauuuucaaguuugaaaaauguaagcaaaguacuuuuguuuugcaaagacucucagaaaaacuauuucuagguaggcuuccuugcuuuaaaaaguuuagacacuaagagaagaugaugguagaaaauguguagacaugucuggaauggaguuguuggcagcuguuguggcauacagcaucagggaaaccuccacucuggcagggucucuccuuuacugccucagccugcuccuaauggagucaguccccagccuuucuguucaagaacccaguaagcuucucucaguacuuugugguugcuuuuuaagauuuuuuuuuaggcucguguuugaaagucuguaucuuuauuggggcuuuaugacuuuuucugaagagucauuugaauagauccuacaguuguguaauaccaaaaacuuugacuuuuagucucuuacauuuuuacuuuucuguacuaaguauacauguaugugugaucuugcauguuugugcauguuagugagcagagagagaccaagggaucauccugaaacaggucucucugcacuuccuggagguugcuggacaguuggagacagguuugaguuuucagugguggcacaugccuuuaaucccagcauuugggaagcaaagucaggaggguuucugaguucgaggccagacuggucuacaaauacacagugaguccaggacagcagggcuacacacagaaaucuugucuugaaaaaacaaacaaacaaacaaacaacaaaaaaagguuccccaauuggggcauauaggcuagaagaaaguagauucuuauuugguugucuguacucaagauuuggacuuuucuaaggcugagaaguuaguuauuaaccagguauuuggccauauuauuuguuaacauuaauuugcuuguuauauguggguuugugugcuuauguuaugguacauauguggaggucagagcacagccuaugggauccauucuuuacuuugaccaugcgggucccagcaucggucaucugccuuguuggcaagagcacuuaccugcucugaaccaucuugguggcuguuuugagaaguuguacaguucuaucuuuccuaauucucacugcuguaucaagucuguuuggcucaccugcuuuccaauaaggucaaaauaaauguuaaagucuauaaguaaaaugucuucauuuucuauuuuaacuuuuauuaauaauuccaaguagaggaagaaaguccauuaguaaucaugcauuuauuuaagcuacucauacaugcuuguuaucugauguuuuauaaaacaucugauaugucuagugaaaaccccuuugaaaagugaagguuuuaguguuuuucaaugagucacauuuuuaagugcuuuuguguuuguucuuuucacuacaggggaagaaagcguuuuguaagugaaggagauggaggccgucuuaaaccugagagcuacugagcacagcaacucuuacagucuuagguguuaccaagaacagaucucaacuguaagaguugucaguacagguuuucuuuuccuuuuguuuuuguuauuguuuuuuuuuuuuuuuuuuuuuuuuuuaaagaauuuguuuuggguacaaggcauuucuaaaauuuuauaaacuuaaguuuaaugggauuuuuugaaggauuuucuuucuuuuucuuuuucuuucuuuuuuuuuuuuuugaggggaaauuaauggagggacagaagaggaaccaccgaaguguggguguucugauaagcuacuuucuaagugccauguuuaggaccugaucauuccaaguuucacguucauguaugacugccgcuccuuucuuucaaggacaguguuuuuuguaguaaaaucacugguuuauucaaagcuuuaguuaggggugagugaagcuacuaaaccccauguuggcugcugcuguggaaaugcugugcuuugagaguaaacacacacacacacacacacacacuuuuuguuuuaaagaauuuuuaaaaaaacgaguuagucaugagacuuuuucaucuuuccagggaacauauugauuggucuuaaauauuagacaguuaaguaaaugguggcuggaacaucuauuuuucuacaaaacuggaaaaacgaacccgguucuacaagaauguacagcaaaauaaaacaugugaaacacuguu

SEQ ID NO: 12255 - RNA, 37622 nt, Mus musculus
aacaguguuucacauguuuuauuuugcuguacauucuuguagaaccggguucguuuuuccaguuuuguagaaaaauagauguuccagccaccauuuacuuaacugucuaauauuuaagaccaaucaauauguucccuggaaagaugaaaaagucucaugacuaacucguuuuuuuaaaaauucuuuaaaacaaaaaguguguguguguguguguguguguuuacucucaaagcacagcauuuccacagcagcagccaacaugggguuuaguagcuucacucaccccuaacuaaagcuuugaauaaaccagugauuuuacuacaaaaaacacuguccuugaaagaaaggagcggcagucauacaugaacgugaaacuuggaaugaucagguccuaaacauggcacuuagaaaguagcuuaucagaacacccacacuucggugguuccucuucugucccuccauuaauuuccccucaaaaaaaaaaaaaagaaagaaaaagaaaaagaaagaaaauccuucaaaaaaucccauuaaacuuaaguuuauaaaauuuuagaaaugccuuguacccaaaacaaauucuuuaaaaaaaaaaaaaaaaaaaaaaaaaacaauaacaaaaacaaaaggaaaagaaaaccuguacugacaacucuuacaguugagaucuguucuugguaacaccuaagacuguaagaguugcugugcucaguagcucucagguuuaagacggccuccaucuccuucacuuacaaaacgcuuucuuccccuguagugaaaagaacaaacacaaaagcacuuaaaaaugugacucauugaaaaacacuaaaaccuucacuuuucaaagggguuuucacuagacauaucagauguuuuauaaaacaucagauaacaagcauguaugaguagcuuaaauaaaugcaugauuacuaauggacuuucuuccucuacuuggaauuauuaauaaaaguuaaaauagaaaaugaagacauuuuacuuauagacuuuaacauuuauuuugaccuuauuggaaagcaggugagccaaacagacuugauacagcagugagaauuaggaaagauagaacuguacaacuucucaaaacagccaccaagaugguucagagcagguaagugcucuugccaacaaggcagaugaccgaugcugggacccgcauggucaaaguaaagaauggaucccauaggcugugcucugaccuccacauauguaccauaacauaagcacacaaacccacauauaacaagcaaauuaauguuaacaaauaauauggccaaauaccugguuaauaacuaacuucucagccuuagaaaaguccaaaucuugaguacagacaaccaaauaagaaucuacuuucuucuagccuauaugccccaauuggggaaccuuuuuuuguuguuuguuuguuuguuuguuuuuucaagacaagauuucuguguguagcccugcuguccuggacucacuguguauuuguagaccagucuggccucgaacucagaaacccuccugacuuugcuucccaaaugcugggauuaaaggcaugugccaccacugaaaacucaaaccugucuccaacuguccagcaaccuccaggaagugcagagagaccuguuucaggaugaucccuuggucucucucugcucacuaacaugcacaaacaugcaagaucacacauacauguauacuuaguacagaaaaguaaaaauguaagagacuaaaagucaaaguuuuugguauuacacaacuguaggaucuauucaaaugacucuucagaaaaagucauaaagccccaauaaagauacagacuuucaaacacgagccuaaaaaaaaaucuuaaaaagcaaccacaaaguacugagagaagcuuacuggguucuugaacagaaaggcuggggacugacuccauuaggagcaggcugaggcaguaaaggagagacccugccagaguggagguuucccugaugcuguaugccacaacagcugccaacaacuccauuccagacaugucuacacauuuucuaccaucaucuucucuuagugucuaaacuuuuuaaagcaaggaagccuaccuagaaauaguuuuucugagagucuuugcaaaacaaaaguacuuugcuuacauuuuucaaacuugaaaauguauagaaaauguagguuuggcuccaacuagauauuuaacuuauuacaagcuuauugauuucauggagaaaagcccuuaucaacucuuacauuacauccaaaaaguacaaauauuaauucgcucugaaaaaaaaucacucccaucuguaguuugaagccacuaccaaguacaucagaguccauuagaccuugaagucuaaaaaagucugaauucaaacucugccuacacagugucuucaucuccagucaugucaggaaagacacuauuuuucugagagucagaaugacaaacagcuaucuuagcuccccaaggaucucguucaguauuuuucaaugagaaaguaugauuuaaauaaaguaccuugauggacaaagaucacggaguuguuuggaaauuauuccagccugaaaacauuccuccacaaaucucucaagaacagaguaugagugugggacauccagauuaaugucugggauuucauuguaaauucucucauagcccuagaacaacauuacauagauaacuuguuagccuguguaacaguguaugccaugaaacaacccaccaauauaccauaaauugucacagugcaaccuggcaaaacaagucauauuugaaccuugaaaauaacguauacuuaaaaauucucaaaagagcuccaggcaaaagucaggcuaccugacuacugacuuccccaucuacacuuaacuaucuuguauaaaaauauaagauaauuucaccaacauuucaaaaaccacaauuuuaaauagaaaaaaaugcaauuuaaaugcuucaucuagauaaaaaaaaaacugcaucacacaaacugaacaaucauucuuuaaaaaggaaaaaaaaaaacccaaacuguuauuuuccaaaaauauaaagagcuaaagaaaaaaaaaaacucuguaggcauaauacuauacauuacauucccuaaaagaaaaguuucauuaauaauuaauaacucuuacucaacucuuauauagcuaaaggaggcauagaccuuuuauaaacguauuuaaaauaaugucauacauacucuuuucauuuggucuaugguaauaguagaagacuuccacaaggauuuuaauaaaucuaagaucaucuugaaugcacuuucuccaguugacucuaaaaccauuacaauggccuaaaauuugaacagaaaagaguaaauaaauuuuugguaaucaacuuaugagaaacugauccuaaaaauguauccaaucccuccucuaacauguagcaauuauauaaacuuauaaauuaauauuuuuaaggggaaaacuuuacauuauuaaagaaacaccaauuacugugguguaaaaggaggacuugaaaauccucuuuggugugagacaguaaccuuacuucauauacaagcucguggugaaaaugagguacuuccaguuccuuaaggcaguguucagcuucagauauaucuccagagaguaaauacucuuuaagcagcauaucaaucuauuagauuuaaaaguugaaauguuagaauuccucauuuuuaaaagauguguacuuuucuaaaugauauauuaacauucacaccaauauugagcauagggauuuggcagagugguggcauaaaagaacucucucacaauucaaauuaaacacccgggcuucaaacgguucagguaugaaguaauaaacaacagcacuugguuuuccaaggaaucucuaguaucuccaaguagguuuuauaauaugaaugaccuugcuugugacucuuaagacuccaauguagccuaucaaaaacaagggacauagaggcuggagaguuggcucagcaguuaagagcaugcacugcucagcagagaaccugaggucagcucccagcacccauuuuccauggcucacaaccaccuguaacuccagcucgugggaucuugcaguucgguccuccaggggcaccuuaacucauauacacauaccuacacacauacacaugauuaaaucuuuaagaagagcggacaauuuuuuaaugccacuagagggcacuaacuuaaagucucaucacuuuuagaaagccacaaaacaucaagauguucuuaaugcaauggaagcccaaaaauaagagauaauggaguguuacuacaagggcaagaaucuuuacaguucucuucccucuaaaacugaggcuuuguaacucagaaucuagagauguucagugggaaagaagagaugguucagugcuuaaaaguacacugaaggaccaaggcucaggucccagaccacaugguggcugacuacuaucuauaagaucuggugcccucuucaggacucugcgagcacugcacacauguagcacacaaacuuagaugcaggcaaaacacccacccaaacacaugaaaacaauaauuugaaaaaaauaaaaacacucagcaauugaacaagagacacaauucuucaccuccgacuaaagcuugcaugcucauuuauggcucuaggaaaaaaugcucaauguuuucucagcaaaagaacuucaacuauaaauaaucuuccuuauauauuuucugagaaaaggguauuuguaucaaguggcaauaagugaauuuuggcuggaugaauaaaauuauuuuaucuaaauauccucuacuucaacuucuauaauaucuucauaaaagguaaaguaaaauuuuaccacuaagcuauauucuaauuagagauguguuuucuuuugguuuucuguuuguuuuuaagucuguauuugaggcugagggaauggcucagugaugagaguagcugcacugcaagcaagaagacccaaguucaaagcucaccucucacaugaagccagccaggcacggcugugauaaacaacccuagcacugcugacagagacaaguagaucccaaaagcucacuaagcuacuaaguuaagacaauaaauaaauaaauaaauaaauaaauaaauaaauacauagccagcuucuaguucagagagagucccugugucaacacaacacgguggagagugguggggagacacaggcacaaaaacacacaccccaugcugggggaaccacauaccacacauacacacucacuaagcacacacaaaggacagcuagugcaaauguaugccuuuuuaauauaacacauauuuaauauuugaaguauuuuuuacuaaaacuacaguauauuuguuauuuaaaugauauuuguugugccacugaaaaagugaaacauggggcugaagaggcagcucagugguuaacagaaccugcagcucuuguagaggaccuggguucaguucccagcacccacacaguggcucacaacugccccuaacuuuagcuccaaggaauccacgccccacuucuggccucaacagacaugcugcacaaaccggcaggacacauacguauacacguaucuuuaaaaaucacuuauuuuuuaaaaagugaaacuaacauuaccugucagauucagugcauuuuuccaaauaauaaaauacaaacccacaugaacacuucccuugacccuugcuucuaucgaaaugagaauacacaacaaugucauagauuauuggcuuuauuuccagucucuuuuuauugaaagauaauucacauacucuuaagaguuuaauuccucaaaauaucaccuucagagaguauuaccauauuaauaauauugucuaauacuccauaaauguggcaucucauuuuaguauaugcguugaauuuccuuuauuuucaucauacucuauuuuuaugcuauuacgauuuucauuucugucuauucauugaguccuaaaauacggagagcugauuuucacguacugaucuauagugugguuuggguuuuggaguucuuuuucagacuuacccggauccucuaaucuacgcgccacuuugacugagaacagagcuaccucugcaucuuccuuuccagucaggauguccuuuauugcacuuccuugccuaauaucccuagcauauuaacaaacucauauuuuuuucuuauaauucuucaaauuuuuuguuuuuuuuaaaucuuuuaaaaaauaaaaucuuuuauuuugaauuuuuuuaaaguuuccaacuucauaaaucagucauaaccuaucuauucuaacauagguaaaagcaaaaauguuaauuucuuuacccaucugaacugcuuaacgcacggacacgcgcgagcacacacacacacacacacacacacacacaaacgcaugcacacgcgcgcacgcgugcacacacacacauaugaaugagacugaggagacagcucagucaauuaagugcuuguuauacaagcuuaaugaccuuaguuugauuuuuguaacccagguaaaaaccuggguuuggucugcuuauaaucucaggaauuagaggcucacugucuagccacccuagcucauaggguaggucucagugaaagacugucucaaaaaacaaagugacauuucuuuuuuuuuuuuuugguuuuucgagacaggauuucucugcguagcucuggcuguccuggaacucacucuguagaccaggauggccucgaacucagaaauccgccugccucugccucccgagugcugggauuaaaggcgugcgccaccaccacccggccaaaguggcauuucuaagaaauaagacuugagguugaccucuggacaagcacacacacacacacacacacacacacacacacacacacacaacgagaaggaaagcacuaagccagcacauagcccacggcgcugucugcagucucgagaugugcaguuagacccuacaguucccauuguuacagaacagagagaacccacaggaagcaaaccuugcacuuuuaugacgugacucaaucacuuuacuuucuucuagcaaauagcaugagcacccacacuuaugaagcucugccacucuggucuacucuaguguucauaauuccuagcuuauaauuucagauuacucaaacugcucauauaaauaacguuuauugaauaauuacaaauaaucucccuucagcagcauuuuaagacgaaauacuacuauaaaaaagauuucaggcauuagaguucacacacagacuuuuuauaaucacucauuucuuauacguuccagacaagacuucuuauauucaugagagaucuaacagucacaccauugagucacaaaaacaagauaaacagcaacaauuaccuaauuuuucuaauucauaaauuauucagauuuuuacuugcaaacauaugaccacauuaaauuccuacccacaaaaauaccaucuaguaguagcucuguuguuuucucuugcaaacaacucucaguaagcacucucaguaagcacucucaguaaguacacucaguaagcacucucaguaagcacucucaguaagcacacucaguaagcacucaguaagcacucucaguaagcacucaguaagcacacucaguaaguacucucaguaagcacucucaguaagcacacucaguaagcacucaguaagcacucucaguaagcacucucaguaagcacacucaguaauaagcacucucaguaagcacucucaguaagcacucucaguaaguaccucuuuaacaaggugauugacaggcuguugcccgccuccagauccccacacacugucuuuccgcuucccgccuuuggacauacucaggagcacaguagccuuauccagagcagcucuauccaagacagaaaagagaaaagucauuauaauacaugcacaugccugauguuuaccacauuagcaguaaaguuuacaaaacuguguauguauuggcaacuuuaauguaacaaaaaaauauguaguuuuagaaaauaauucuucaaauaaaaauuagguauuuuuuaaaauauugaacauucucauauucuuucacaaccacuucucgucaaaauacauugcaaacuaauggucauguagccaggaaggaacauaaauucauauacaacuuuuaucuuccuccaagaccccugggguugaguaccuguaccuggggaagccugaggucuggcuggcuaagucagccuccaggagguuagaaaagccaagcagcaagucuggcuucuaaucauuaaaccaaacaacuguccgacccagaagguagcauggacacucacagucaaugcuuucauuuuacaaguagggaaacugaggcccugagagggaaacuuaaagagggagccgcaucguuuaacucagaacuucugcauuuuuauuacugcugucuuccugcugcaccacggcaacaucuuuuaucaaugaagaacccguaaggaaaaauacacacucacaaugucugauucauguccaugucauguuacagaauguuguaggauuucucauuuugaaauucuaaguagcagacaugaauuuacuuaccgagccuguacacaaucuacaguuccuuuguaacuaucgauauagguauuacauaagauuccaucuccaacagcucuagcaauaaacuggcccaccaacuauaauaagaaaaaaagagaacuauauaaaaaaacuaaaauaaaucuuuauuaggauacaaucuugaaaugcaaaaaugauaaaaacugucuaauuacacacucaauaccuaaaacauaugcugagacgugcagaagcaccuguguguguguacacggugcacacucccuuacacugacccacaagugcuggggugugcagaagcgccugugugcccugcgccaugcacgcuccucaaccauuagcuugacuuucaagcccaugccaucaggaugggauggcgccucugcuucacucacucccuaauccccuggacucugcacacucaaugguugucuguuaaagugaccugaagucaaggaaaaaccucuccucuucaauacccacaacgucuucucaccuaacuauagaauauguuguggagaaaguuaugcacaaauaaagguucauuucaaaaucugaucauagcaaacuuuauuagacaaucugaaaacaacuucaguguccaacaguaaaauuaugcuuaaguagugcauacaaagcaaagugcacuguggggcacugggaaagucaacucugcaaacaguguuuguaguacaauucuacuuucuaauuaaauaaagguaaaauaacacuaauaaauaacaaacuagaaauuaaaaaauaguuaugaaaauguuaacagguuuguguggaggguuuuuccuggccuuucuucauuuuggauuuuauucaucaaaaauucuguaauuaauaugaacucagacgaccauuuuuaaauauguauauaaguagggaagggaaauaaauccgauuuugacucauagaaacugccugucacagaaacaacauuuagaaauucucuauaaauucaauuuuuaugcaaauguuaacagcaauuacauguuuucaaaguuacaaaagggaauagucauaacuguuuuaauaaaucccacucaagucagucauuaucuguuauauagcaacauaucuucaaaauucguagcuaguaaaauaauguucauauaauaaaaaaaaaucuaugaacagaaaauacauguauuacauaugaccuaaaaacuauacagagcuggauagaaaagagguuuuguuuaguuucaucaagaccuagguaggucauagcucacugguagagcacuugccaccauguggguggcccuugguuuaauacaaaguacagaaaauaaaaacgaaguuggggagaaagaccuacaauaugcagagcuacuuuuguaugguuagaacugugggccacucccuugcaacuguuguaauugccgaggaguauguacacggaguguguacauggaguguguacacagaggagacaaaggaaaggagcaaaaggaagacacaaaccugcggugcccuaggaguguccaaggcuagcucagggagauccuucagcaacuugucaaaugacuuuuccacgucauuugugcucaucaccgucccgcaaaggucagaaagcagcuuggaugucaucucccgguggcuggccuuccccuccaaggcuaaggacacugccaacaccggcacgccacucuucaucuccccaagguuuaagucucuuaacaucuccugugugagagaauggaaaugaccaccucucucuagcucagucacaccuuacuuuugcugcagccgugcuucuccucuaucuuuccaccucaucuuuaggaaucccagcaggcacauuagguuuacagcagugauauaagcucuaccugccugguuaucaguacacugaagauaggaagaacauugccaacaguccaacuacaacuagcaacuuuacaaucuauuaggauuauuucuacaaauaauugacaaacauugguggagagauuuauuuuauauuacacacugcuuauauagucuacuuaaauguuuucucuugaggacugggaucaguagcacaugccuuaagucccagcaccagagaggcagaggcaagaagacagaguuaaaggccaaccugaucuuacuuacauagugaguuccaaaccagccagagccacauaguaagaccuugucucuucuuaaaauaaaugucugcuuuagucuuucaugugaguauaaaguaggaucaucagugcuugacugggauugauguuucaaaugauaaagcacaacaguaccuaacauccacuaaccaugcugcauggcucucaggcauucuaccacuccauuuaaugcucagaagaauccaauccuugcaguaguauauaaccuuagaggcagaguuccaacucuaacuuccuuaguuaacacugccuacuuuuaaguuuccuugcaauguuuaaaccaugauauacaacuaggagaugccuacuuucccaacccuguggcugacaaggucagugaucucuaacacagcuguccugcccuuuauacagagguugguuggugugcuuuuuggcuauguuugugugcuacaaguugcaugguucucguuauaagacacgcaacuaagacugagccaucaggauuaguaacaucuguggggaaaaucccaggauggcaaucugugucuauggugaggguggccugccugcuugauaaaugggguacacuaugugaauauggagaugcucugaaaaguuaaaagcuuagcacugguugucaaccugugggaugugauccauuucacggucauaugucauauaucccgcauaucagauauuuauauuacgauucacagcaauagcaaugaaacaaguuuauagcuggggcaucaccacaacuugaagagcuucauuagagaucauagcauaggagucuugagagccacugguuuggaggaaaagcugaagucuuuaagauccacgcacaaggguggggaccauaggcaagcagcagccgcagagguuaccuggccauucuuacguggagucagaaacgcaccaaggcugaaauggcugccagcaagaaccuguuuguguaaaaauaagcaaaugcaacaagacagagauguggcagcauccuccguguuagccucuaauuuggcaaauuagauaaccaagaggaugagaugaggugacuucuuaaagguuggaggguggaaggaaaagagauugcaaguuagaucugugcccggaagcccuucugggauccgagacuuuggaauccauaggaagagucagaguggggacgauuaugguaaaagcauuaagaggauacuguagaggacuaaccuuuaauggaauuaaaaagaaaaccugugauccagaauaugguugguuccaugcaagaaacuaggguggucaagaaacacucagcacuugaauugcugaaauuagggaaguuuaaacaaguaacaaaagagccuguuucagccuggcuugugaggcugugaaacacagggguggaugggauucgucagacagcuguggagacagaaaaacugaguaauguaacuucccaucucuccuuaaagcaauggcuacauggccugagacagugugauggaaaucagucucuggugggcuggcuuacaaaagccauaaggaacauuuagucaucucugucugaaguccccauacacaucaggaauuggagggcuaaagaggagggacaggugcuauugagggaacuaggaguaagaggagcuguguuugaacccaacucacugggucaguuacaacuguguucacagaggagucaaaggaaagguugauccagcagggaccccucaugucugguguggagcuuuaguggcuuugcugagcccuuuggaggggcaagagcuuuauaaaguaggaggggcuuugacagaucucaaugacuuagagcaagaugucuguaaggugagagagcacuguagaggagguaagaaaaaaagaaaaagacaaagcagagaaaaagaugucuggguuauucagagacagauguggcaggauuugggucucauuggaguugccaaggaaaaaacugacaaaaggaaagccaacugugugauaaggggcuacuggauggcucuaaagccugaggagcagugugcagaagacacccaagagaaacaguacaggugaagaugaucaagccugccccaggagugguaauuauccccugaaaguaagaaggguuuauuucucuccaggaaaagguuauacuagcaguggagaugguuuacucagccaggaguuccccccaacagcccagaauggugacuggagaagcuacagccaccaugccaaccacgggccacucugaccuagggagccauuagguccagcaggagagggcagagccucauucaccuuuggcuaugagcaggucugagcagacugagacaggcuauugagucuauccaguuuggagaaauguagggagacugugugaagagcuccaggauuggaaacauaauggcucagugaggaugacugaggauuacagagagcuaauuaagucagcaccuccuauccgcaugcuugguacccaaccuggaucuguggaggaagcaacugauacaaagggauggagccuuucuguauuggaccuuguuuacgucacacuuuagaacaucuuaguugugaaccucugcacucacccgacgcuugcucaaaagagauuaaacugacuuugaaaauguuucaccaagguuaucuuuguagacccccccacacacaccccacccccgucauggcuuggugcugcuuuguccugcccauucucuagaaaauguguuauauaaaugacauaaugcuaacuucugaguguuugugaacauccagaaauguaccuaaacggccuauaggugugucuaaaggaaugagugaaagaagggacucuaggacagucugaacaugaaaagcaugcucuggcaggccuugcccuucuucuccccuauucucuugucuuuuuuuuuuuuuuuuuuuuuuugccggggggggggguuguuguguuguuguuuuguuuugggguuuuguuuuuuuuuuuuuuuuuuugguuuugguuuugguuuuuuuuuuuuugguuuuucgagauaggguuucucuguauaucccuggcuguccuggaacucacucuguagaccagacuggccuugaacucagaaauaugccugccucagucucccaagugcugggauuaaaggcaugcaccaccacugcccggccucucugucuuauuaaaaacaaguagauuacauuccaaaagcuaaccaccaaggucuagcccccuuuggccacuucuuccuccucaggcugacaaccaaggucuagcuaucaaaguauugagguccagcaaccaaaauccccuuuuggcucacccuaacacagaguuucccuucuuaaccuuuguaaacugccaucugcuaugggccacaucugucuccacugucccgacccuguccuuuuucccaaccccagacaaacacucuuucccccuuccucuucuucccucucccucucccucucccuccugucuuuguuucuuuuuccccgaccuacagaacuuggucuuggggauccugagacaauccuggucccuucaauaaagauggaagaucaauccacaugugcaagggccaggcacagauguaaaauuuuuggcaguauuauggucuaguaugauaagacgaauaugauaccugacaacauuacugucaaaauccuacaacagacuaugccuguaaauguaaaggugcugggggcacucggggagcucuuaaaauagcagcagauuuucauaccaaauccugcccaagcugcccauccuuuguauaaagugauaaugaaagggguuagauggauugacacagacaggcuaaaguggcuuuggagcaggcuaagaucacuguaggacagguaagcagcuguauacccccacuaauccaaugugcccuccugucagaaguuaccagauguugguaaggcuacaacuggguguacggcaaaagcaaccuaagcaaaggcccgauaagguuuggguuacaaaaaggagcagaggcaaaggacagcaacuguuuacuugaauuuaauaauuuaguauugcaacaggugggaccuauaacuacccuagugacuaaagaacagcuugcccaauaaagggcuggacuaaaguccaccuggccaaacugcuuucuggcgcagcacagacuccaacuccauaaaggcggcagcaaauuuacaacagugagaugugguauauacaagccccagcacaaaugccaugcaggcugcccuaggaccagugaugucugaagcugcugagcauuccccaguaacugaaccaucagcuaaagaguuuaaauccaaacggugcccuacaguggcagaaaaggacacucccagaagcuacaagcuuacugacuacaaacccccaguggcagaagagggcucucuccuuaugaguuguuggccccacaaaucaugaaagcuuuugcuacugcuguugguucuauuucagcacuugauggucugacccugcugcugaagacacugcaagaacauguccugacuguaaugucaaucccaacccugcuugcuggccucgaggugcaggaccgucaccagcauuccugcugggcuauggacccuguguacugaaaugccaacaugcaaggcaggauauaacaguuugugcacuaguggcucagcugucauggguccaacuagaaucaagaacuucacuacaaaagggaguucaccucugguacgauaaacuaggacaaaaaccuguggcuaaggaggucauaggucccaguggggaagcaaccuauaugguuuuucuaaguggauguaauaugucugucaaguugccuucuaaacaugaguuuacaccuauaggucgcuguuauaagcacuggccaagcuccugagaacugacuuaauguggcauguuacgguggcauacuucuuagccauagauggacauccauagucaaccccccucuaaggcugagggaucacuacagaaaggcagaaagaauauaagcuugggaguaagggacagagcacuguguaagaguuuccucuaagacuggaauauuccagccugccgggaagcucuuuaagcaggaagguaaagcuugagauaaguuccugagacugaccaggcucauuaagucucuuccugccagagugagcagagccaagcugcaaggauucacagggagcagcagccuggaaggagcagacaaccugccuacauaaggguuaaacccacugaggcagcugggaaggucacucuccaaccugcugggcugccucaggcuaggcagugggcuccagguucccagcuuuaugaccugucacucaugcuggggugggcuuuagugaugcagaugucucugaaccauuucugcucauggaaguaacuccucauccauauuccuguaaauaaucccaauaaaacucauuggcucaacaaacuggacugugguggugucuguauuuuggacuaucauggguucccucucugauauaaguaaauguguguauguguugugucuccccagaaaaaccugucacacagcagaaugcaauaaacaaauaguuguuuuacacuguaauucuauaaauccaaagcuaccaaaccuauguaacaaacaaaucaaaagcccagguuggaguuuaauaauuauaaaugacuuccaauuaauaacuguuauagcucaggcccauaauucuaauaaaacuagucacuuuauuuuaccuccgagauuuacuuuaugaaaauuuacuacaaacacauuaauuauccccauacaaacuaugauucaaagcuuagguugauucuccuggugcccauauacauccuuuuccaaaucucuguauaaacgcuguuucuuggagaguacagauauuuuuuaaucucccccaaaacagaucauucugaagcuccugaagaggcuacacagggucuauaaauuccacagaagugucuagauuauaaaaccagaugcuuuaaaaauauagaaauagugccuguggcguuuuccucaaaaggaaauggcauagaaguaucaucagagcccagaacuauguaagaaaaauuguuuaaggaaaaaauuguaucccucuuuuccuuuuuucuuucgaagcccuauguagcccagacuggcuucaaacccagaccugugcuaccgaccuuuacaucucaaguacugggauuuuaggcauaaaccaccauguccagaaguucccuuccugauugugaaauuuguuguuguuacaaaagaaaaaaacauaaauuuauccagaguaguccaaaaucauucuacacagguuuaacaguguguuuucucccugcaacuugaaaccuaccgcaacuucauuuguaucuccaugcucaaaguauuccuguauaauugguguuagagucuucucaaaugcggucucauccaggggcaaaacuacaguuucauaaacacaguucuccugaaagaaggggaauuauagauuaaauauucagauaaacugaaaugauacuuucacaguucagcugguuagugaucaccaguaaggcaagacaaagauauaccuccuguuuuaacugcacagggucugcaugcagccacuuucaaaacaaccucaacaagcuagagacagacugaagccauucacuggagcaaauacaugaguuuucuccaaacucucuauugcacgcugacuuaccuggguagggagaggacuaugugccauacaugcauaugaugggcagggaccagaggucgaauuuaccuccaccucccauccccccacugaagcacuggaugagagacacacucaccauagcggguuuuucauauggguuuccugacugugaagacuacacucaaguugcccaauuuguacauaaagugcuuuucccuccucagccaucucccugucccuuucaccucauguucugagacaaagucucucgcugaguugcucccaucuagcaagccuggaacccacucaucucccuucccaaagcugagaucacagauaggcaccaccauguccagcucugaggcaggugcuagaaaugcaaacucaagcuccacgccugccuaccaagcaccuuaccuaccaagccgucucagcuuucacguuaacuuuuauauuccucaaaaaccaacuuuuuaacccaaaaccuuuaauauggcauccuagcacauacuuucauuaaaacuugacuuuuuaacaagauuaagcauucuuaucuauguacuaauauugucaaaaccagaaacuuucaaaauauaaaaaaagagaucaauauuguaaugacuaaaaaucuaagaaaaaacaguucaagcauaauuucaguaagauuaaaaugcuuaucaccaauccaugugucuccucuauagaaaagcuaaaguauuuuaucuacaacuugucacuuaaaauacuauuugcagcauauacuuaaaagacuaauauuuagcagaguauauuguauuucaaucccacagccuuuaaauauuuuuauuaucucuuagaaauguuucauauccaccuguuaaaacugguaagugcaugcauaggagugauguacagaaagaaaaacaagcugacacacacacugacauuuucaaguaaacagauacaagauuaaauaagauugucuggggcugggcgugguggugcacgccuuuaaucccagcacucaggaggcagaggcaggaggauuucugaguucgaggccagccuggucuaaaagaaaaaaaagauugucuguaaguuaacgcagugacucuggugaagcugaaagacgaguaccaguagguucauuguaccaauuacuuuugaaauuuucccauuaaaaagacaaaaagaacuucacaaugaugcauuaagacauuucuuacuaaguauuaucauaagagagaaaaugcacguguccucaaaauaacaucuauacuaguacuuguguucaauagugacucuaaaaaggagccugauaccggcagcccaggcuaucccaguccuccuuuauuaucauuagucaagucaauaaaaaaccuccucuugacucccaaaacaaguggaaauuauauacauuuuacuaucaaaaaacuuauuuucccaaucuguauauaugauuuugccauauauguuguauauaucuucauagcuauggaguauugauauaugaccauguauuacuugacaaucuuaugggugaaaaaccaagaaaucuuacaaacauugaauauauaaaaaaaauaguugauaccuggucgucaucauaguuuggaucuuucacauccaccucuuccacaucauacaccuguccaggugugccccagacacccuugccgccugcaccaccugaaaguucagauagaugauaguuuacaaauauuaacugaaaucugaaauaauuucaaauguaaaaauucuuaugcuaauuauuuuccaguugagaauuacacuugaaacuccuauuuagauaacuuuuucaagauuagcuauuuucaaaagcaucaauuuaaaauaacuuagaaaaauaucuucauaguacuuuuuuuuuaaucugagcaacagccauaccacagaccuuucagaacaugacccuauggugaagcucuaaauuuugacaguucuuggaaccagaaaaaaaaaagaaagaagagaaacauuuggaccaguauaugugccauuaaaagcucaacacguaaaaaagaaucauuccacagagauccauauugaccaccaucaugcuaacauguaauauucuuccacaucaagugcacauuaaacuaaacuuagaaauuagcaguauuuuaacaaauaauuacuauuuaaaaaucaacagcacugacagcuguuucucucuacuuugguauacagaucaaagacuacaacuucaacucaacaaguugcuuguccauagcaauuuacuguggcauuuuuacaaagccaaauucgucuaaaauaauacuuuuaaaaagccuucauaaugccauuucccccuuuuuaaguuuucauucuauaccuggaguauaauccuugccaacacagcagaccaaaaccagauaacuaugggccacuuugauucauauaauuauguagcuagucacaaaauaauuucugaaagaccacuauacuuuaccugaauacuaauauauuuaucuuucucuauucaccuuaacaaauuuucauaaucauccuuuugucuuggcauuaguucuuuguucauuaauagaagaugcugacauucaaucucccuguuucaguuuccccuccuucuaagcacuuucaucacaagguccauuuaaauuauccgugccuuaaauguauaacugaagcucacaccauucaaaauccaauccaaucuccaaauucuacagaaaucccacuauggacagaagcugaaagacccucacccaaaugaauuuuaaaugucuacccauagucuaggcacuggauacagcagugagauaaaucaaucuauuacagcacucaagcagcagaacuaaaagagaacacaaacccagaucuacauagaugucaccaaaugcauaguuacuacuuuaacaaugaacauagacucauuugauaacaguuauaauaaaccugaccaccuucauagaguguauaaaaucauaacugaaagaaagcaucaauguuuacuuuauuuugcuuaggggaaagagaaaguuuaccccaaagaaaaaaaaucaaccuaaaaagaaaagugguaugggccuucagcucucccguaaagauguacgcaaucauaagccuggagcgguuaaugcuuuuguccauuuagaacaagggacuccuggcacaggaucugggguucuuccaguuguuucuuugcacagcacacacuaaccuuucuuuggcagcccccuuccuuucccagaucuggaccgccuaucuagcaaccuuccuuuuggacuggugggcacagcaacuccacuucuaaccgcuucacuuccauugucacugacugagucuccucggccagagucccgggaugaauuuuuccgcagucgucuuuuggcuuuugcauugauucuagcuucauuaauaguagaugcggaaauccaauuuccauuuauuucauucuuuauuucuucagugccagcauuuucuucaucuccagaaaagagagagucgcuuaaauugucagggucuuaaaagagaaaaugaaaaaaaacuaagcuaaguauuuccaguauccacuguuaugugaaguaaaaccuaauuuaguuacuucacaugaaauuaacauuuuuuaggcuaguaguagucauacauuggcaauuuuauaaagaacaaauaagauuauuuuucccauuaucaaggaaaguaaaugaagguacugaauuuuaauuaacaggguuuucuaaaaagagguuauuacacaugcuuggguaauaaaaccuuugucaguaugaagagcauaaaacuauagcauacuuucuaggcuaugcuggacaguacaaguucagcacuucauacagaugaggaaaucagggaguauuuaaacuacuuucaaaacauucccuguucaauuacaaaugcuuaggagacauuagucugcaauccacauuugacaaauauguaaucgaauacccugcugucaaccuagggaaggcucucaaaccaucaccuccaccuccucagcuauuccccaaaucucuaucucugcaaaguucccagccacacaucuuggcucauuagcaccuaaaaugauuccaaacgucuuuugcuuagaagucauuuaguaacuaaucuucuaucagaauucuucaaaauauaccccuaaucucauuuccuccauggaagccauccuaacaagucaagccucagggacacuacauggucauaccaugaucaugcaacccacugcagcacgcaaugcuuccuuccauaguaaucuucccuggucauagccucaaagaaguacauuaccagacuguacuuccugucaacagcacccaacagaccacucucccugucucagaugucuuugaagaucacauggcaaccucagccuugcucuagaaacaguuuuaagucagaaaggccacugacuucacuacuccuccagcaguuuuguuccagauggguaacccaagccagagacaaaucacccaaacugucuggugccuaauuguaaugaugauaauuacuauuaugauguaaaguugacauauaugacuuuaaaaauuuaaucaaucuaaaaagcauagacuuauucaauccuuuuagauucuuagcaaaaguacaaauguuacuaagaaaacgcugcgauccaaaccaagcacacucaguguguuacagcauuucauuagucucugucucucagccuuccaucuucaaaacagacuccaaagugaacagagugguuuucuaaagcaugcccuuacugaaaaacucucaaagcuuuccacaugaccucagaauaaaguguacaaguucuuacuguguaccguagcaucaugcacacugucccugcuaagcgcaccacacucaauacuuuuaaaugcaaauauuccaacuucacuagacaucuuucccugucuuuugaagaucuuuuacgaguuucugcugccuuuuugcagagcuaggauaccuuaugcauggcuaaaaaaguacuuuaaacguuuuacucucauuuuccccacauaaaauauggaauaguuucaaguuuggucacaaggcagggguuaggacacuacucaccagugggguucacauucagugucugcucauuuucuauauccauuuuuccuuaauuucgcuugcacugauuauacacaacuuacuaaaugcaagucuuccuugaggaucuauuuaaaaaaaaaaagaaaugaaaaagguucaacggcuucuaaacugacacaauuaaagucaacuuacuugaauaaaaugaaaaaaaaaaaaaagccuaagucccuuuuuaggaauuugcuaugcuuucaaaguuaaucaaauuaauacuuagcuccaaacuucuccaagagcuuuucugagacaaagagaaggaagaaaaagauugagauaaaaaugcaucagauuucagcaugugccaaugaaucccuuaaauguaagguuuaaagaaauguuuguaacacacauagcuuuuaacuuaaacauacacaccaaaucucuuaagacuccccccaccugugggugugugggugugggggggggugugucuggauguguguguguguguguguguguguaugugugugugugugguguauggugugugugugguuggugugugugugugugguuguaguguguguguaugugugugugugguguguguguggugguguguguauguguguguguguauguguguguguggugugugugugguguauggugugugugugguugugguguguguguguugugugugugguguauggugugugugugguuguggugugugugugugugugugugugugugugguguguguggugugggguguguguguggcauguuugugugugugguguauggugugugugugguguaugguguguguauguguguguggugugugugugugugugugguauguguguauguggugugugugugugugcauggugugugugguguguguaugguguguguguguguguggugugugugaugugugugguguauguguguguaugcucucaagugcuugcaagccacacuguguuuagguagcugugcagaguagaaguaggcacuagaucccccagagcuggacucacagggagcugugaguuaacaaaugagaaugcugggaaccaaacucagguccucuggaagaacauuaugcacucuuaacacauguuccucuuuccagcccacauuuaauacagucuuaaaguuaacuuuacauccacauacagggacauaaguauuggguaacucucuaacaaaaucuaaaauuuacuccaaaauaaaaacagcaguuuugacuaaucaagaauauuucauguacugaucuuuucugaccgcagcagcagcuguagggucauuaccccgcccacuacacuuuuuaugaggcgcugaaacaggaagacguuuuuuaaguaacccuuucucuuaugugauuuauauucagcaugucgcuucuauaaucuaaaauuuucauuuaaaaaaacacucaaccuacuuuaagaacaaauaaaaggcagacgugguaaaaccacaucuguaauccagcacuagaggcagcacaagcaaggaucggcaggaguuuaacaccuccacaagcggcccuugugugcugugguggagagcagacaggugauagaacuuagaugacacgcguaagacccuuuagcucuauaucguuuuucucuaaaaggauauuaacuugugaaacaagaauagcaccugauguugaauucaugucguaacuguuaggcuacaucaagauguuaucauccugcccaagagaacaugguaaaaagcauucucuaauucuacucagaauuaacuaacaugcaagucuacauggcugcuuacuucauuuuaaacaacuuaggaucuagaaaaaugaauuuuaaaauagauacacagagagucauacaaauauaagaccaaguguaguuuggaaauggaaauuuuugcuaccuuccauggcugaaaaggccauguccugcuuuccuucagugugugcaugaauuacaugcuagagaaagucugucagcucugaugugauuugaauuuaacacugugaagugugauuuucauucuagaugcaaguauagucucugaggaaauauuuucugcagcaucugucuaauaaugggggaaauauaaguagugcuuaucaagcccuuugacauucacagugaacuaauuguguaagcauuauuucaugagcuucacguauucccuuugcacacaacucaagagguuuagaaggaaaggauguucucugcaagguuguucacacugggugaacgaccacgagaacccagacgcuguacauucaguacaugagcuuagagugccuuacaaggaaguccuucuuaggguuaacaaaaagcagcuuuuaacaacguggacuuguacaccaacuguuaaaacugcuuuccaaucacuaaagauaugauacugaaaacagcuaucaggaaauaacuaucacaugauaugauguuuuauuaauuauaacaaccaaaaaauaguucuaucuccagaccauaacaacuggaucaagcagucaagacgcagacacacccauagcuucacagcuguucuaaaggacaguaugugacacucucuucagugggcuuuuuuuuuucuuuuaauuuaacgauccuuaaaauacuuaccucaaccuuaggcaaaacaacagcaacaacaacaacaaaaaaaucuaaauuccauuugcuccacacuaaucuauacaaaaucauuucccaugggguaaggggaagcuauguauacagcuaaaaacgauuaagcugaaauuaacuguuauccagugcauuuccuaaaugcccgauaaauuacuuugacauuuuggaagucaaguuuagaccacauguuaacuagaaaaugaccuuaauucuucccugggaugcagucacauuaauuagcaacuugcauucugcuaagagcacucuacaacaauaacgcaaaagcaaccacuacugagagcaaccauguacauuuauuuuugcagccguaacaaguauuuuauuuuccucuacucuuaccacgagauagauauagauauauagauagauaucgcacgcauauuauggauauaaauacgagcacgaauauauaugcuagggccuuccccuaaaauuucaaacucuuaaaucaagaguauuacagcugugaagcuaucaaaaugucuuaaacgcagcucguaggccucacacccaccccucacccaggcccggagccgcauuuugaaucauucauagcagguagucgacuacagaggcugguuuacagagccaguucccaaggaggggcucggggaagauaggcgagaccuacaucugcaguucugaggcuguucagggaaagcaaaaacaaaaaaccaaaaccaaaaaccaaaaagcacgcccucuacguacauuacaguagcggacagccacgggcagcagacacagcaugcguucacagagagggggcucccuucucggcuuuguuuucucuagguuguauuguacuuuuuuuaagggacccuguacaggagacugcaaggaggaguuggcacagggccgggagggcagcuguccccgccccgugcccgcaccgaccgacgccugucccgcaggaccccaacccuccggcagcgggcagggccggccgaggcggaccaggccucgguucggggcaccgaccccucaccggaucuccguccggacgacaccccucuccuaccgucccgucccccgcguccaacugcgucggaccgggcgcccggaggcuccucucaccgcgagcgcacgcagccacgcacgcccggccgccggggauggggcugcggaggagggggcgggcccgugcugcagcuccccggcccgaccgacccggccucggagagcgagcaccggcagcuccccgcagccccgggcguugggcgagcgccgguggccggagggcuccagggccagcguggacagggaccgagcgucccgacccccgcggcgaggccuccacgcccccucccccucccaacgugcggcagccuccgccgacccgggccuaagggacgaggacgccgcccgcccgagcgugcgagccgcgcccacaguacugacccccucgggccgccgccgcucgcccgggucuccgguccgccgggccccgaccccguuccucagccuccgccgccgcugccucggagcgccucuggccccgcucgcucuguuuguuuuuguuuuguucuacccaguaacacgggggcgacggcguggcgucuauuggccgagaggaggacgucccgcagccaaucguggcggccgagcugcagccgaggcggcgaggcagagcuaggggaagugagacguggaaauaggggcggggcucaggggggcggggcgccgucggcgcaugcgcgcugggcuugggacccgcucggccaccagccagaguggggguuaagugcagagggccggguugugaaagcgggcggagggcugugccgggcugggggcugggggcuggggcgcggcucguggaccagaccggccaguccucucuacagggcgucucagcccaauucuagggcgguuguggauuuccugagguccccacuauuucugggcgucugggagaaucugcaaccacuacuuaacuucugcccgcugguccuugcucucgcguggcuccugccguguguccacgugcucaggaaguuucucgcaggaaaagccuaaccccuuugagauaaaaaucgcucccuuuucccagauaaagagauacaaaaacugaagucccuuugcuaaccagccaggccacuauggugcuugcauucuuuccaaagcuggguuucucaaccauggcuaugguuuguguauugaaucagcccucucuagcugucuucugugacguuuccuucuggcugccaucucuagccuucauuuugucucggauguuaucgccugagauaaugugcagcaccguauguucuuccugugcaccuggaaagugacugaccugcuuucucuggccauguuuaccuuuagucugaauggcaauaccagaauguuucccuuggucuuuucagaacugaacugcucgauagcaaccaccauccccuaacgugggccuuucuaccccggcucuuacugccugguguuaucuaauguucuucacacacacacacacacacacacacacacacacacacacaccuucacaagcuccccacugccucccuggagugccugcuucucagcagacacccuagagcccacagugcgacuuauaggcuucaaggcuaugucugcacacccuaaccccuggauacccguccuccugaacccacuuggacagcucacugcuccgcauccucccuugugucuugccaggucuuuuaucauaucaucucgaaaugucucuccuagauggccucucugccugguacaucuuauccaagucucucagccucccucagucuuuaucaagucucaugccaguaugauccauuuucugaaaccugauuccgcggagcaccagccagucugcagggacugaggacauucugcccggcauuguuucaucugagucccaguccuggcuugucccacaagccccgugucucacucacccuuaguauggugagcuugagaggugcuuuguagauauauuauacccauguaauaaguacgccuugugcgagcucacagagaaucccaaaagucaguagucaucaccggcucuugcucgggacuuccucacauggccagcaucuaaagcgucacuuggcacaugcuacuacauccaggcuuuauaaggcaacuaucccaaaaucaggagauaagaauaaacaacucccauuuuuaaaagggaaucuuggaccuuuaaaagagucuguuuaggaaaucugcccccugggaaaauauugucuaauugcucccugggggggaaaaaggccuaguagagaauaaaacauucaaaucccuucugcuaaccaucuccacccucacccugauaccugaaauucccaaacacaccuuaguaugugguugaccaguuuggacaaaauaggaaugauguucuugucccagcugcuuagucucucucuauaacaaccccacucucuccucaagacuuguuucuuuaccaguaaaauucagaaguacaugaauuuuuguaguacuuuaauaggcauccugaaaaaaaaauguaggggagaaacuguuucauggccacgucuuggaaagaacaccuuucaaccaaguuacauuuuccuuuacuccuaacucuuuggcaacuuugguggccagccuaugaaacucaaugucucucuauuuauuuaaacacagaacucuuuuucuucaagauauccuggaauguguugcaagaaaccacuuugggacuauagaugaugacagacacuaucaccgacauuccuuccagccacacuggauccaggaaaccugugcuguuacagcuaaauguucuaaaaggauaaacaugaaagaaaugcacuagaaauaggaaaguaaccagguaccaagaacucuugcagagcaaaucaaucugcagcuauuuauuggcugcccagucugugaaaagcaccuaacuaauccagcugugcucuuggcaaacuauaaaagaagucauaaucuacuucaaggguucucugggauucguucaaguccuaacaccuugagaggcucugccaagaacuuagauagcaccacaggaguccugggaaugaugaacaagagacaaccaaauuuuccucuagugucaaggaaggacucacucaaugggguaugggcaaaauaagagucgaucucaaucgaggaucugucugugguugcaaagcuuugauaaugaaguuucccuccaucccacaggcaagagugacgccagaugccaggcacggucacaccugugauuccagcaguuagcagagagaggcaagaggacuuccaugugucccaaggccagccuggacaaccgcaugaagccauccacuaaucagaaaaaggacagagagaugguugguguuacguuuggcacacgaguaaauggccuagaaauacagaaauggaagucaaaccgccgaggauccugcggcggugaccucggggcucuggacgaagccacauuugagaucugacucuuaagcacuguucucacccuugcaagaaacugaaaaacauccgccuuucugcagugagaguaguagugcacuuccuuccagagaacuugcagauccaacuggcaucagcaucagccccguuugccugcacccaucucuuggcccccuuuuucagaagacaagauuugaggaauuuccacaagaagccacggcaugucuccuuuggcacaaacggugaaaccugaaacauggccugaagaggaagcugcagaaagaaccuuagggaagccagcugacauuugcauugcuuuaagguuuacugagcacuucucuguauacuuucaccacuucccaguauguggguaggacacucugugcuuuagaggugauggaggugagacagaaguaaucacggggcuuuuauguggagagcaaauuuggggaauuccccuacuucaaaccuuucauuugaugaguagagaauuagaugcacgggaauuuagugaguuguccaaacccucauaaccaguuacgaucaaagccaggauaggaaagaaggucucagugcacgggccauguaggaaucauauggacaggaagacuggccgucuggaagccaggcugcacuaggcccuuucuacugcucagcccugaguuuuucaaauggcagucuuaaagccccagaagugaugggcaggauggagucgggaggaagcgccugacugacguuaaaagugcuucagagacgguuccaagaaccugggcaagaagaccacggugugaccagaggcacagcacgguaagcagaugcagugugucagcacaguauauacccagaaggugcagugugucagcacgguauauacccagaagggcugagcagcuccgaagcuuugacuuccgcaguucggcucugaaagacuuucguggcaucuugucuuucauacagcuuguuugccaaaucaguccugcuacauaacaaguuagaaacgagcucaacucaggaugaggaaagccagaaaaaaacguuucccuggaaaauaaaauaaaauuuugccaccucuacaccuacacuugcucugacuuccgagcccacgcacaguccagcgccucuagcccuugcaguggucaguuggggaaccccauacuuuccugugcuuacuaccacuggugucgggcuccucccacugcaucucuggaggcuccauuuguguucuuuuggaggguucuuggccaggcuucacauaucugagaauuaacccucucuucucuccguuguguguuugagaacauuuagucgccauuauccucucuugccccucagacgccaaacaaggcuaauaggagccucggagagaaaugggagauuuuuuuuuuucguggcagucaaugagaguaacgaauggugcagcgucaugauucaaagucaacucuccuaggaaaugcagagaaagcuggaaaggggugguggggaggcucaagagaaaagggaugguacaccaaaggaauugaagcugauuaacagaguuaaucaaacuucuguuuaucuuggacagaaaauaaagucugugacaagaaaaaggggaaagccagaaaacgauauuguaacgcauauuucaugagucucugugccugugcaguuacauguugcaugcgugcauguggaugcuggagggcaaccucaaguggcaucagcaagaacacccuccaccuccuuugaggcaaggucuuucauuggccuagagcucaccaauuaggcuacagggccggccagcaagccccaguccuccugucuccaccucccuggugcugggagucagccacaaaucuccaugccaggcuuuguguaugagugcuggagauggaacuggaguccuugugcuagcaaagcaagcucuucccuggcuuaaccauccccagccccuagaucagacugacuccauggaaggugagaaacaggggaagggcauggacguggccuggugaagacagcuuggccagaauacaggagaacagaaccaaacccaaaagagugaucuugcucccaggcgagugcaggcaaccgccuggucgcaccaaaggcugcugccuuccucucuuuccccacaugaucuuuugcuuguggcuugugccucuucuuauguuugcaacaccacacacaccccuuucucuucuuccaaaaaucuagggggacgacuuccaaauagaaaaacuaggccuggcauuuuuaagccacaccuccagaaaaauccccagacucugcaacugagcauaaccagaaacgcaguuggcaguccuucaguacaaaggacaaagcuguccuccaaauaggacuuagcaggcaaugaguuccucugggaacuaugaaugcaaaggaaagaaaaauagcugcagaggggacaauauucuuacauacauaugugugucugucugucugucuguaucugugaguauaugucugugugugucuguaugucugugugugcaugucuguguguguaugugucugucuguaucugugagugugugucuaucuguaucugugacugugugucugucugugucuauaugucuguguguguauguaugugucucuauguguauguaucugugagucuguguguguauguauguauguauguauguguauguguguaucuauaucugugaguguguguaucuguauauaccugugugacuauaucugugagugugugucuaucuguauguguguguauguauguaucaguaugugugugugguauuuuuagauaguucucuuugaaggcaaggaaucuaggacaaugauuuauugaugcacuucaaaugguauaaaagaauucuaaauuuuaugcaaguuuaauuaugaauaugcauuugaugccccagcugcuuuauaauauuuuucuaaagacaaaaaaaaucacaucaccaaaauggucaagacuggggaaauauugugcucuaacauuugggucucuguucagggugagugauccaccaggaugcuucagggggagugcuccaucaggauguuucaagggaagugcucaccaggauacuucagggugagugcuccaccagaugauuccaggugagugcuccaccagaugauucaaggugaguguuccaccaggaugcuucagggggagugcuccaccaggaugcuucagggggagugcuccaccagcauguuucaggggagugcuccaucaucauggccuaccaugcuuuccucuccucuguagguucaaccaggagcagcccuaaauguuaguuaacuuucucagaagaaagcugcacccauagugagcaacucgccaagcugcuuaacaggguagagccugggcaacugugcagagguuggaauguuauagguccaaagauaacuugucccgggcuguuaaccccuuaaguggucauuuaucgccccccucugugugugaccgcacauccuugugacuuuuaguugaauuucuuuggaaugugcaaacaaugcccuugcuucccaccaacccauagcugagaaugcgccagacagcgugcgagaccuaaggcuugcaagggcuuuccuuucccuguaaccgccagccugaggaacucacuaacguauuugaaaaguaguuuaugaccuuuguuccgucagcauaaaaaaaaaaaaaaaaaaacuaccuggagcuggacaaugguggugcaagccacacuuggggcagaggcagcaugaccucugaguucaaggccagccuggucuacagagcaaguuccgggauaaccagggcuauacagagaaacauugucucgagacaaacaaaccaaaccaaaaacuaacuggaacuguucccauggaaacugguauuugcaguaaccuaaauuuguguucucgggucaugaucauauuuggcuccagaauacauuaucucuuauucccucugaggggagaaugaugcauuuauuuuacaccaucacaaagcaucuuuaaaggaaccccaucuuuacuaggacaaugauggagaauaggacaccccaauaguuauucugguuauguauggcagcuaucucuacucaaucaauaugcagcuaucucuacucaaucaauaugccagcaguagauaugaagucgccagaagucuucuaaacaaaaggcacagccacacaacucaugaauuuauuuaaaguccuugaaguucuuagggaggaacaucauuugauuccucugggaaugcgcucugccacguuccgugaguuucccgugacuuucuacaacccagugcagagugaacgccuugauccuggcccucuuugugcauguuuccuauuaacaccuuguggagcgcacccuggaaaacaccaacucaggagaaugcaguuugaugccguuuucagguccacaucagaggcuccuugugcaaguggccuuaggucuccauccuuaugaucuucaagaguuagagauggccuccugaugugggagcuagggaccaaagucagaucaucuggaagaccaguaugcaucucuccagacccccgaaauaaucucaaaguuggcagaugauauaagagucugcuucuaggccacccuuguucguguuuacacacauuuacaacugggaguuuagauggugguuuuugcuuacacaccuccuucucuuaagcaccuucuagagcagaggguucucaaccugggauuaguuuaccggggucaccuaagaccauuggaaaacacagauauuuauauuacaauucauaacagcagcaaaauuacaguuuugaaguagcaacaaaaauaaucuuauaaggagggucacagcauuaggcguuagaggccccaggaagaggcucagugggugagaguacuuguucuuuauccagaguuggauucccagcucccacaagacagcucacaacuagaugugacuccaguucccagggaucugagacucucuucugacuuccuuggauacccggcacacacguacacauacuuacacacagcacccaugaacacauacuaacacacaggcaaaacacucagacacguugaaaauaaaucuuaagacucuuuuagaaauauaaggcagguguuaaggcacuagaacugcauggugaauacuugugcucagagccacaaggugacucugacuggcuggcuaguggccacagacaccgauggagcugguuuauuggaggcuauauaacugcuuugaaaccaaaguuuuccaagcaugaucacaugaccuuaacagacaaaugugacuuucuccaaaagagcaguuguucccaaaaauauuguuacccucuagaaguagaucuccuaccacagagugcuaacucuaccucucuuuaaagaugccugagucacugacagcccugagcagcuuucccagggaacaccacaggccugggaagacguuuaaaaggccugugaaacggcuccagcucuugcacaaucaggagggaaguagccuggggugguacauuaaggccguguuugcuuucugaauccuaaguccaggaagccuuauaaaauuucugcaggcagagagaagggggaagaccuauuugaaaguagaggccacaggccucgagggagcagggccagcaacaagcuagaacuuguuccacggaacaaacuaguucccagccacagcagaggugguuuaugugaccugagagcuagggaggaccgcgugcccaagcaggccgugcuuggcacagccuccgccucauacaagaaaccuuuaaaaaaaaaaaaaaaaacaccaaucuuaucuucucugugcuccuuagccucaugaaaccuaaacagguggcuucccagaugaacuucgcucaacaaauaaaauccucacauugagcgaguuaccucacaugcagugccuccaucuccucuccugaaaacagagagaagcguggcaccuuucccacuagggccaaugcucaaauuaaaagaaaugauaucuguacgguucuuggugggaagccugauaucuuguaucacugaguaaauaauaauacuugguugauaucaguauuuacuucucgaauccugacugagccuccagagcugauauucaccaggcugagccaggguggacagguuccacgauucccuagcugccuguguagccucaugcuggccucuggacucagcuuuguguuuugacauugguucucccauuggaacuguggauuucugaaaggccagaucuuaaugcuuguaggcacuugccaauaaauguuugguaaaagagcaaauaaaugaagaaaacuucuauuuucuauauaagagcuauuggcagggguggggguuggggugucuccccuuaggguuucacuucuggguuuggcccagggcaucccugccauuugcugggccugagggagccauucagagaaaacuacugcaagcagcucacagcugaagccuuacuguguugugaacaugccaagagagggccuggggccuucucuccucuggagacucaccccaggaauggcaggaagcugaaguucuccagggcccccagccacacuugaucucaaacauucucaucaaguugacacgcccaguuggccugggcugaggcagaauugaauguucgggcucagcccagaggccagccgucuuccaacuagugagccugcaucacuggggugaggccugccucagaggaagagcugacaaaaauaaaaaugaggguggcaacaagcugcacaggaaguugugggucugggagcacaaacagaacacaguuguuuaggugacuugccacaagaagagcucaccgcguagcagacacagagccaaaccugaagucuauuugcauucaggaguuccuucauucaggaguaagccugaacacugcugucguuggguaggucuaggcucagggccaccucuaucagaaaguuggguugaccaucaacaagugaccuaagacucacuuuccuuaccugggagucacugggagaguuacagaaggcaugcauauacuaaauuuacauaaaaauauuuccaucauuacuaaacacugaaagugaaaagaagccagggucucgacaaucuuacuauagacauaacacuccucuacucgugcgugcacacacauacacacacaucaagcacauaugccacacuguacagacacauaugccacacacauguacaucauucacaacacaucuuccucuccaccucccucuccccccucuuccuccaccucccccucucucuguugagcuuugacacuuaugaagcaacaacuuuacgguucucccguugucuguuuguucccuaacuagaaacagauugucucccacucaaccgcuucuggaccacaguuccucuaaaugugggccugcugcucaugaugauuuuguuucucucuuuucuauccauagucaucagacacucuugugugggugcccucugcagcccuggccuuuucaauaguucacaagucuaggaaccgaggagauauuuaaaggaaaaaaaacucauagggacucugccacuuacuggcuacagcgugccuagcacgauacagugccucugugucuuugccaaacccagaaaaauaccgcgguuauccucuuuguacaacagauaaagaaacgaaggcuaagagguuaaaaaaaaaaaaacaaaaauaaaacagaacaacuugccuauucccacccaagcagugacaggcagggcugggaucuaagccaucuaucaacacugaguuuucugcuguuuucugcugccuugugacauaaaaccuaguucaagcccucaagcaaucccuuaucccuugcccugaauacagaccauuuuucuuucguauuuccacuuaggcuuugcuugguccaagcccuucaccccuccuucccuuugcugucuuggagugagagguucacaggcagaaaaggcuggagaccccccacuucccuugcccccuagcacgauggccaacacgaacuccucaccagaaaacaccacagccugcagacaaaggcugguguucauuuaccugcccacuuagucgucugugaaaagccccagcugggguagcugggguagcugggcugcuggaguagcugggguagcugggcugcuggaguagcugggauagcugggcugcuggaguagcugggguagcugggcugcugggguagcugggguaggcugcugggugaggcucagacaggcagcguucauaaacagcuucuccagccacauagcuggaggaauggacug

SEQ ID NO: 12256 - RNA, 15543 nt, Mus musculus
acacagggacuuuaugcucacuacuaggcagagcuguucaggcacacuccaacacauaauagucaccccaacacagcgacaugggcccugacuggauguaaguauaggcacgugaguguuaucacugaucagcuaccuugcccaagaugugcacugauaguuacccugguuucuaccagaucuugucggacacaaaggaacugcagaaggaaaucaacucucucucugggaagcucgaccggacauuugcagugacugaugagcuuguguucaagguauggagcaggcuggccuccgggaggguggaggcgggacugaguuguugccugccccucugugaguccuuuaggugcacuguugcuuggggccuagcuuugcucuguggaggaugaaggcaaaguacuaguaaaggguggucuuauaggggcauagaguaguggaaaagggggaauggcuugcugauaucucggagauccccuuugucuuaucaggaugcuaagaaggaugaugcuguucggaaagccuacaaguaccuagcugcccugcaugaggugaggggagccaugugccugguggguuggcuggagagggccagcauaggugcaagccuuguauucuugcugucuccagaauugcagucagcucauccagaccauugaggacacaggcacuaucaugagggaaguucgagaucuugaggagcaggugagaccugggacugguaaggggaauggagacaggccaggggauaguuccuuguuuugcgcugagagucuuugaaaccagacaacuaacagcuagaggcuuugccuucgugcccacugugccugggaccugaagcuagccaguagccuacucugagcccuggcuuuuagcuugcggcuccuaaugccucccagagcccauggcagaaguugcugcuuuagguggaguggagggaaggacauacccagaagcccagugaugggaaggaacaggcugcuguuacgggaauaggaggagcagggaggaguucaguagaggggcagccugcaggggcugaagaagugugcauccuguuuucuuagauugagacagagaugggcaagaagacuuugagcaaccuggagaagaucugugaggacuaccgagcccuucgccaggagaaugcuggccucuugggccggguccgagaggccuagagcccugauggaugucuccuaaccacaggcaggaauuuggggugcuggagacagugcugaggcaccuguucuagcacucucuuucauuugguauccgcuuucuccugcugggaucuuaaacccagcugucugcuuauauguucccauaucugaucagggugauuguccagcugaccacaguuuauuggaugggcacugggggccaggggccuuggaucccaaauaaaagagaaguucuucugugggccacgcuuaggcauggauuggggcuuguggguagggaacuggggucaguggcaagugagacgugggguacaucuuggagagucgguguguauucauggaacucaggagauagaguggaggggcugcauguguguacgugcacacgagcguguucugacaagcugugucugacuuguauuuugggcauugcuugaggcugcguaugaucaguuaugccugugugguuuggggggauguaauugugaagguuccagugcuguugcuguguaagggucuguauauacaccuaugugugauagugcccgugguuccagauguugugggugagugcuuuggggugugagucaguaggacugcagucaugugugacugcaugacuaacuuugaaaguucacgaauguaccaaggcaggcucuucauguuuuaggguuuggguugaguaaauauuaggauggugucugucaucuuucugcuuggcaguggccaaggcagauauguauagcugguugugagggcucuuugacuggaaaguucaucuuggggcuagguuggaacuaggggcuaggcugggauuggcaccccucucagcuguaaggcagaugauaugaucuaggagggcagcuagauagggagcagaggcccugauagcaggcacaucaucgcccgguuuccauagguacacguaggacuugccuccuugcccccacagccucagucucaugguuuuggcccccucccccgcccaccuuuucuugguuuugaggucaagggcagggauuggagcacuuguuggggcguuggcuccucuucuugcgaaacucaaauucaucuacgguccacacugcucccuucucgcucuccacucgcacaaagcacuugugcaggcucagguuguggcggauggcauucuguggaagggggaccgggaccccagucagggacaggguugacagucauccugagucugagacugaccugcuccuuccccacaugucuagccccaggcuaaccauccuuggagccaucccagcugccaguguguacagaggaacucaccuuccagguggcggggugguuucugaaguaggcgaacaugcgaguaaaccaaugguagauuucauugaguguccucugccucuccggggcuuccaggauggccuggaaguuggagucagguggaauaaggggcauguuccucaggguuguggcugagggagcagccuacucucggcccucugagcuaugauagcuuuguaauugugggucaaggggaaggagaaagaauagggugaggcaugaggucaagggugauguuagagauaggguggacaaaggaaaggguaguuuguaguguuacaguuugcuuugcacugaccuggcuugcaguaguuuuggguugagggcuagaucugaggugaagcuaucaagaaggaucacaucuuggggcuccucagagcugagguuuguuaaugggugaauucugcucuuggugcaauguaggaggcaagcacuccccaccacaacucccccccugccgcccaccagcugcugggccucuauugcccugcuuacccaucggauaaggguggcauaggugaaagggggucgcauauugugguacuugaaguaguccauguuguggaagaacucugcagaagguuggcauagaucagagccuuuggccuccucacccccuaccccaccuuugucugcaucaggaauccaaggucucaauuccuaccacuagcaccaaggggggagggacagucuaugcucacacauaguacuguuuacugaguacccgccguaagcugugucuucuuugcaguacuccugccaaauagcucuccucacuuuaaaaaggagucaaguaauuuguacaucaaaggcauguaagcagcucaaguggcauagccagccugacaccaaauaucuauggucccugguaaacucacaacccaggccugacaggugggagaggguugguuagcuugguugagugcaccugacuuccuggagguggggacggaagagagggcucuuuggacucacuuggccaggcuccucccucauggugacugaaugaaguagcagaugccaaauaggucaggccuggcuccaaucccccaaaacacggggcccaaggcuaugcauuuauaacaguugagggcuucuaagccuaauaaacucaggugcaguuuccucccagcucuuagugggggugaggggggugggggagcuccuuuguacccccuggcacugggguguggacuccacugaccugggaaggaacuauugccauggcuuccccagaggugccuccgcacugcaaacaggccgccgucuggagccucccgaggagcagaccaggccgggagcacacugcccugaguacugguggcuacgaugcagcaagagcucuuguccauugaggccugagggguugggaggggugugguaaucgagacacuuaagcuugucauuucauuguagccuuucaaacauuaguuuguauuuucuuauuaguuaaacuuguuuuuagacaauuuuguacauguauguaauacauacagaccacuuucacccuaucuccucccucaucgcuuaucuuccuucuucucauuccuuucccccuucauccaugucuauuuauuuuggucuuaaaauuauuauugccauuauuauuauuauugacagggucuuacuauguagcccugacuggccugcagcucucagagaugcacuuccucugccuccugaguguuugccuauucauuuucguuuugucugagacagucucacuauauaucucuaguuggccuugcaccuucuagccuaguucuaccucuggagugcuaggauuauaagugugugccaccacaucuggcuuccacuuuuuauuuuauguauauauauauauauauauauauauauuuuuuuuuucuuccagacaggguuucucuguguagucuuggcuguccuggagcucaguguauagaccaggcucuguagaccagacuggcuucgaacucacagagaucugccugcaucugccucccgaguucuaggauuaaaggcgugcgugcgccaccacacugagucuuccauuuuacuuuaaaaaaugauugcuugcuugguuggauauuuauguaggugggcucuugcucuguaguacaggcuagucuaacauguacuauguagcauguaguacaggcuagucuaacauguacuauguagcauguaguacaggcuagucuaacauguacuauguagcacaggaugggcugagauuacugccaagucagcuugcauuuuauuuuagguauacgggaguuuugccugcaugcaugucugggcaucgcaugugugccugguaccuguggaaggcagaaaagugcauuggauccacuggaacuggaguuagagauagcugugagcggcucugagggugcugggaaccaaacucugguccccugaaagagcagcaagcucucuuaaucccugagcuaucuguccaguuccccaaccccacuuuauuuuacaauuugcauuuccugauuuggucauauuucuaucugauuuguaugugugguguguguacacaugcugggauuacagauuuacagugcugcaucuggugugggugcuggcaucuaaacucagguccuuuuucugucagagguguucaagacaggguuucuccguguagcucuggcuguucuggaacuagcuuuauagaccaggcuggcuuccaacucacagagauccaccugccucugccucccaagugcugggaucaaaggcaugcgccgccgccaccaccacccagcaaaacucagguccuuauccuuguauggcaaucacuuuucccucucaaguuucuccccaaccguguuucuuuguguuuuagaagagucagggugucucuguguugaccaggcugguuuugaacuugaggguucaagugcuccuccuucagccucuccaguagccaggacuacaggugcaugccacuguguccaguaaggucaaugcuuuugagaagggcaccacccuauagucaauugcaggcucugguggagcucuguaaagcagcaucuuagaguacaggcaugagcaugcgaugaagccauagaugcuagggcuggggugagcaggggcagaauuggaauccccuagcaccaacugugaaccugggagcaucaacuaaaucuuccugaccuaaguuguccucauuugugcauuaggaugauggugguagcuaccucuguuauaguauaagacucauaucagccugagacuggguaugugaaauguguggucacacacuguucgauguucugagcuuaucuugaaauuugaacauaaggcccuccauuuuccuuuuuugcaguggcccugugaguucacugccuucuguaugugcccugaaaaggcagaaucauaauguuuuggaggucagaagguuuguaagcagaguaggcgugucuuuggaucuggcauauuaauuaggugggaauggucuguacagggcagggcuugcaugugagaagaagacauuugguccuuaugggcuccugucuugccccucagcaguugaagucugcugccucuggacuugggguacucaccacagauggagccuuggccagcgccaucuucccagccaggugggccugcauagcucccagcuucuccuuuuccagcuccagcuguggggauguacaccaaaguggggcuuccaccuggucguucucaggcacacuuuugcccaugccuucccucacaggguccucccucccauccuucuuucccgcagccacaccccgcagccacacccugcaggcauuaccugcugcuccagagacugcaccacuucucucuggaggaggcacugggccuugccuuucucauccaggagaugaucugcuuggcagugccugaguaaggagaagauuccauguagcugaccauggugggucaggccucuuggcuuaguguaucaguuagggacggccuagacccuuugggagauuucucuaugcucagugcucccccccccacccccuugcuugccuuaaacacaugugcuucagcaacucugggcugccaggccugagcuuauuuacccuuugagucuggccaaaaugcugggaugacguuagacaggagguaugcagggguauggcauuucaggugucaggcacagcccaugcaaaggccuggccacgcaaacacgcaccauugccaaaaguuaggggugacuagcaagauacagaaggggagggacagcagauagagagcagagaggcaagagcucuauagucaucuagaggaacagaaauuggaggaucaggaauguguuuugugugaggggaagcgggacaaagcaguuaggcgugugggcucuggaaccuggcugccuguguucauauucaagauucaucacuuagguccugugugagcuugauugacccuuaauucucuguggccuuagauccuucugcguguaacaggaagguaacuaugagcacauaccuuuauuauuaugucucuucauacaugcgagguaaacugggccuagagacccauaacuugcccaagaucacagagccagggagggauggagucugaaucuuuaugauucuuauuaucauccauugagaggauggugaguugagacgugaagccuagacagcagaacucuguggguagggucaggcuacucacuugagaaacucuucuggcuccucgaagaccuucucacaaccaggccacuugcagacuccauuugccagcaguggguaggauccuuggggugcagccaaaagguugcuggggaugggagaauaugggaugucagcagaggaauaggugcagggguggggugaggugugggcaggggccguuucuugccagcccugccaacucaccugucuuuccuggguguacccgagcgugggaaggugcagaguagagcuggcucccuggacacccauuccagacuggccacauugaucccuguggguagagacaggguacuucuggagcugcagguuagacucuacagcuuguuccagaaggccccuccccuuccugagccuugaagacucugucucauaguacucugcuguucccacagucaagggcuucugacauaacagccuaaagaugcccauugguaagugauggcauuuugacugauaauagcgauuugugguuuuuuuugcauucuaugucuucaagguucuaagucugauauuuuuuuuuuuggagguuggaguuuccgugacucuuaagacccuucuauaccuccauagggcuauaauucagaaaaguuuacauugcacaugcucaaagauuagagaacuuggagauacugugaagguguuaccagguggcaggccaggccgggccuugagggagaagaccccaguggcagcagaagguggugggaggcugaucauggcuggguuguccaguggacgcacuuggagcacaggggucugggcaugggcauccacaguggagagcuggggaacacauggaccauggcucagcggggcuuggggcucugcuccacagcuguccucuuuguucccuccucccagccugcuccgauuccauaccugaugcaugaaguguggucuguccuggagaagggccuguagguggggugagggaccuagucgggccccagacggugccaccaugacuaggggcacuguaggcagcuggagagagaagggagaugccaugagaugccaugagccucaucuuaauaguucugugucucauucauuagcucuuuacuaaagucucacacgguagcaacaauggaacuauccaguucacaucaguggaaucugaggcucguggagagugaauguaucaagguccaacaguuucaagggguagagcuggccccaacacuguuaccuucuugggccccagccaucucgucacagugggaugaggauacauggcuauguccauggaaucauaaggucuccuaucgggaugaggauugggagggguggggaaagccuugaaucucugaagccuggagaguggggauuuucuuggcccugcaauaucugcauaagucagacuugccugggacccauaaaccacuuccugugccccagcccccccccccccccccgccacaugccacaguaaaggucgacaccuauaggcccaaguaccccacccugcuuaccccauucugggccccgggccucaccugcagcugggaugguggcaggggguucaaggaagaagaggugugggccccacuucgcaggucccgaccuuggaagggucccccagagccccuggucccuagaaguucugagcccuugggugcagucuuccagcuuggcaagacuccuggggaugggccaagggccaaggaaggagccauaggcuuggcuggccuaggguugggcauuggguucuugucagaggcaggcugcagggauaacaguggaauggagucacaugcauuccagggguggugcaagauagccucauaacuacaccucuggucugucuuacauacauauaugcuacccugacagcaggaacacagauugauggauauauucuacacaugcacauguccagcaccucacuugcuuacauacaccauaccacucugucgugaauguggggugauggggaguugguuugugggacccuccaguacccccugcacucugugcaggccacauagucuuugcugauucuacuggggcuugucuuggacucucuucucaucuuuuuauuccaaugacuugggcauagccucacaagauucaguuggaugcugugagcaggaaggcuccagggaacugugcuagugggaaguguacugcaauagugaggcgagugguguugcugcuaccaaccuggauaacggcagaggagcugcugagaugugacugucuuccaagucucgucugaaggcagagucaggagaaguugccgggagcuuggauggaggagaugagagaaagggucaagaugaugucuagguuuuuggcagaagcagcuacaacaggagcauuacuggagauggaggguagaggauggaggagcagaguauacagugauagucagauguggcuaaaugcaaagguaagcaguagaggcagggaagacuugcagcugaauucaguacugcagagcucagggccacagcaugggucugucuucucuaagcuuucuucugucuuggaauuggcguggcaggugccaggaaaaaaagagggauaggguugcuugauugagggucccugggcgcuccucaaacuagcuccaaucucugccaagcuuggaaguccacuucuucccuuagccauacugcagucuucugauuuccucuucaaagcucuacauggugacccaggucccugugcugagccucacuaccuuacagucccuuaaaaguguggcuuucguuuuucaggauccuauacuuccagucagagagggaaccagaucuugaacugacuauagaauucuacccugauuuuaauuaagaggauagccagguucagaauucuauagucuucucauggccugggaccuccuuuucuuuuuagauaggguuucuuguagucuggaacuccuuauauacccaggcuguccuugaacuccuuguuucugcauucugaguacugggauuauaaaccaccauuucaggcugauacugccucauuuuucucuaggaaguauauauauguacauuuucccugcuguguuugugugugcaugugaauaugucauucuccguucuacuauauacuacauguguugggcauguagcuucugagaacagccugggggaagcacggaaggguuuuggaaggcaauugcaucuucuuugcuaucaugucuggggcuuaucagaguugagagauuuauaugagaaccuagguauuaagacuagugugucacgggcuaaaacauuagcaugaaaagaggagucugggucuguggaagcugagacuggcuuccuagaaccgugaugcgaugagcugaaagacugcaggcaggcagccaugaggugaugcuccuccaagaaagaacagcaaaggaaagcaucagagaugagaaggaggccaggacuuacaggaggaaucaacccugcugacgucuucaucuuggucuuauagccuccagaacgcuaacaugauaauucuaugcuauguaagucccccaguuugugauacuucauuacaguagcucaagcaaaugcggaucagguuuggugaguagaauuuuccacuauauuggcuuaacccauauggcuggaccauggucacuuuugaagugcucuuuauguuuggucagaacuuauaagaaaucuccuccuuaaauacuuguggaacuggugugacugugugaugcaucaguacauucucagaaagaggaccugaauuggauauggucugucuagugguacuagggaccuggagggcugggcuggccagccagcuuccugcacugucuguuggggcguuccuguuugacuguuucuuagaagcuguauggagguuguuucugggacauagaauauguuuuccuaucggggucuacaucugggcccuguugucacaaccugaacuuggccagauuuuucugccauugacgucauggcggccggaugcauugggcuucaucggcaacaaggaggaagagaagggggcagauaaucuaccccacagguuucguuccgagaaguggcuagucuauccuguagccggauaggcccagguagggugaugugggugcuagcggaugugguaggugacguccaucuggcuaccaugcaaaacccaaguucuaucgauucugucuuucuuggaugccagaggggcccaagguuggaugcuuggugaguauuaggcaggccucauggauauugagacccccuugagucuucaaaugcuguaguaacagaaacucagaacuguacgauaucauuucucaaagccaacggauuuuagaaucucaagaacacagacucuguagggugcauggauccaccuucuuacuguguguauugaugucccagagcccaaagaaaugggaaccaccuaaagccaggaagcuuaaaacuccauaaggccucuugcuggcucuggaaugucagccucccucccuccugagcuccauuaugacagaggauuggaaaacccucuacuguccugaucuggggucaggcuuugcccucuugggacaaaggggccuuccuguccaucucugagcccaguuugcccuucuagacugggaagaguaugugauggaggaaggcuggggucuuucuguccuccugucuaauuugggacaguaacaggagccaucuugcaaaguucguacauacagaaugcugagcaagugucuaugacugauaaauggucacuuacauauggcuccagacccgcucuccugggacaacuuuccccaaauuauaacauucuuccagauacagggacaagaggaagaagacauuuggccuggcccucauggaaagagcacaccaccaggcuuuuuggaagggccccagaaugguugucccaaggaaugcaguaugaacucugaggguucauacuuaacugauauuucuccaucguuacuaguguucuuugguccgcuaggacuucugacucauggggcccagaaccucacauagaccagagcuugugagauuuggccccaugcuaugguuauggacuggauccaacucaugaggauguagaagagggaagggcaccucaggucuccuguuaauggccuccuggguccugagagguaaacuaaggccugcaauguggaauugccaaagucaaggucccacugagaauucugagaucugcucuuggauuuaacucugacacaacaucucugugaggccugggggugggggcugcucaucucugagcccaguuugcccuucuagacuggggagggaagaguacgagguggaggaaggccagcaucuuucugucucguggcugggguaaaucuuauggagcuauauagccguauguauguaugguaugguaugagauauauauauugauauauauauauauauauauauauauauauauauauauauauauauauauauugagauauauauauauauaucauaugugugugaauacagauauagaagagauacagauagagaaauauauagagagaaacaugagauggaauaggaaucaagcucauagagagagacagugagagcaguuuagaggaaaagugacagagaaagaaugaacaagacagagacauauacagacagacagacaugcagagacagagagagagggagugagagaaaggacugaaaauaaucacuggccucuggcuggaggacugaugcugcuaggugccagagacacccauggcugguauugaauuguuuugcaaagcaacaucagaaaaauagugugggcuuuguacaagaauaaacacuaaggagcagauuagaguagaaaaccguggcagagacccaugcacagagggaauggaauuugugaugaacacaacauuucaacaugaggaacagugcaggacagauuaacaaaugauucugagacaauuaggggaaaauaaagugacuggguagauagcccacuuucccaccaauaccucccugcccacuugaaaugucgcugucaucagacgcucuagaauaauuuccagacccacuagagagauacguuuuaaugucuaucauuguuguuuggccuugugcugagcaccuaccaucauuaauaaaaauaauccucagaaagauccucugagguagguacuguuauaaucaucacaguacauacgaggaaauggagguacagagagguuaagagccuggguaaaauucacacagaugacuugaguugaggcuagguuguuccagacagucuggcucccauacccacacuuuugaccucugcaguaaauggaaaaaaugaagccauaaaggagacuggaagccaacauggggugaacaguuaucucauuuucaagugcaaaagacuuaaaacacaaaaccauacacagaagccccacaagaaaagaguaaucuaaagaccuaaaagacacaugcauuacaaagcacaauaaauagggaaaaaaagcaagugauugcccgccguggugguguaugucuucuaucccacuucucagaaggcagaggcagauggaugggucuuugugaguuugaggucagccuggucuauacagugaguuuuaggccagucagggcuauagagugagaccuugucucagaagaccccccccccccauacaaauagggcuggagagauggcuccauggguaagagcacugcugcucuuguagaggagguagcuucucauuuucaagugguaaaaggcuuuuaaacacaaaaccauagaaagaagccacauaagcgccagcacccacguaaccaucuguaacuccagucccaugagaucccacaccaucuucuggccucugugggcaccaggcacacauauggugcacaugcaggaagaacaugcaugcucauaaacuaaguaaaugaauacaauuaaaauacacauacacacaaaugaugaauuucagggaaauaugugucauauacauauagccaauaguuauuauccuuucuaaauuaagagcuauuagcaauuuugaaaaaucaugagcaauuuaguaggaugaagaaugugaucauaaaacucuagccuacagagcacaaauggucaguggucauuaaaaguaaccaaaaugcaaaauuuuaauacuugucauuuuucuuaugauggggaaggauuaaaaaugguaacacacaccuaaaauuaacuugaauagaaacaacagaaaauaagacaacguuuuggaaaagcaauuuguagagagggcaaaaccccuuaagauguacaccccuucuuccccagcuacuccauuuucaggauccauggagucagguauggaguuuuagaaucagaagaaacccaaauaucccaccaucagcacuuaauucagguaaucaaauucauggugaugugaggacagucacggcagacauaaaagaucacguguucguuauuuuaguaugcuacaaaaaugguaucgcuugaacagagcagaaacaaauccaaucuauagcacgauucuaauuuguuuaaaaaugcuaauagcaaacagugagaacucaccauauaccaggcacagugccacagcacuaaaccugcagagaccagcucacccucguccugaacugccugcucuccuugcacauggauucugcucacagucauauaguccuuugcuaaacuguggcugacugaggguguuaucuugcgugacacaagcagaaggucaguuaaaugcuaagacugaccugacagcucacaaaccuaagacacacagaacuaaugcccguucuuggaaaacagagcucuuaagccauuauuauuaagcgccaguuguguacaaauaucugcgcucaauaccgggugcaaaagcagcugaaggaagaugagccgagagucagagagcgggaggaaagaaagggacuguggcuggccaggcuggaagagacagacaggcauauagucagagccugggaaagagacagagacugggcacugauggaaggcagagacaggcaaagaagcagggggagacaggagaagaaauggaagacagcaggaggaaaagaaacaagagaugcacuucuaguuucuaguuauagcuggacagcaucuugaguugccuaaagcuccggcauuccuggagaccagcaguugauagacauauguuaaaaaaaaauccuguuuaucugugcaucaaacaaucaaaguacuucuuuuugccccugucuaaggaccaacugcuccaccuaucuggcauuuaggaugaaugguauuaguuuccaaaguccuuaccuggaguggcuggguguuuccagcuguacuggugggcuccugacacccacccucaauaccucucugccacuuucgccagcagagcugugucuggugggggagagcagggacacucgcucaccuuggugaaguggacugcuagagggggaucagcc

SEQ ID NO: 12257 - RNA, 4333 nt, Mus musculus
aguauaaaggaagcuuugaauccugagaacauuuauuuaauuuugcauagaguuucauaaaacacagucaaugagggaugucccauguuaccacguaacuucucaccaaaugacaauaaaaagaugucugugguaacuuggucggagagggaaaucuuauuacaagagaauugucaccuugacaugagacaagggucaauuugcuagacaaagaucuucaggcuacagagcagccacagcuacacacggcuuucuggugucgggucuucuugcuugauucggccacagccuccugggcccucugaaucucauggacaagcagggcaaaggcuuccuccacaccuugccgcgucuuggcugaggucuucaccaagggggcccccaacuugugagcaaggagggcugcggcagcaugagcaucuccagcaguggucaccaggucacacuuguugcccacuaguaccagaggcugcuuguggugagggguccagguggaccauaucugcugcaacugguccagagacgaggggucgucaagagcaaagacgcccagcacaccaucaccagaugccaagcacuggucacgcagagcccggugaauauccugcccagauguauccagaacauuuagaauguagccuccguugucccuggccacuuccuuccaguaggaaucuuggauaguggggucauggucuuucacgaagcauuggugagucaucuggauggugagagcacuuuuaccaacaccacuugcacccaccaccacugccuuguacucggguagcugccugccagcaucuuugcacugugcccaagccucgugacuuuccucuggagaucuggugcauggggugccggagcucagguccaagaugcuagacuuuguaggcaaagccauuccccagcagcucaaggaagagguguaaagagcaggugcugugaaggagaaaucaggugagacuggcuggaagaaaggagacuccccaggugccgcugaaucaacaugguuaaguuaaaaacucuucucuccuuacuuugguggugggggugggggguggggggauagacaagguccuaacccggaucucugccuugcuuggaacuuguccugcaggucagcugaccuuaaaguuucagcaaucccccugcuucugccuucccagagcuagaauuacaggugugugccaccaagccucgcuacccucuucuuuccuauagagcuagagggcaguuuuuccuuugacaagccuagcgaucaaacccccagucucuaguguuaagcuacuucuucagcaccaagcagggcuauuuuuuuucacgcaugcuuuuuaaaugacaaauaacuguuaggguuuuuguuuuguuuuguuuuuuuugagacaggguuucucuguauagcccuggcuguucuggaacucacucuguagaccaggcuggccucgaacucagaaauccgccugccucugccucccaagugcugggguuaaaggcgugcaccaccaacugcccggcuugucaaauaacuucuaaauugcauuuauuuugcauaggggaggguuagguuuggguugaugagggcaacuuaacccuuccagggguggggugguguaagcgugccauagcauuuguauguaggucaaaggacaagcuaugggaguaggggagucggguuugguggcaaacaccuuuaucucugaaccaucuugccuguccugggauuuuucaagugcucccauugauaugaacaugaauccuaugaaguccacccuuuuaggaugugugauucggugaacuguggauguucggcuauaguaacuaucacuauagccgaauuggaggaaguuuuuaaauuuuuaaacaucauuaucuccuggaaaaguaucucuaagucccuuagcaucuccacugcacaaggagagugagauuugguuucugaacuccaacuuggcacaguagcgccugucuggugauuggcugcuuggaacuuucccacccaagggguuuauguccuaaaagaauuacguagaaagauaauagaucaaggcugaagaugcaugcauggagcccugaguucgacucucagcgccucaaaaacagcaggguagcucacaucuauaguuccaggauucaagucagggaggaaagaucagaaguucaaggucacccuugguuauguaacaaguuggaagccagauccuaucucaaaggggggggaaaaggcaaaacaaaucagacagucuaguaaccaccucuuccgagcagggacauggagauacacaaaagguaaagcaagacuggaggugugggguuuaucuagaccgcuucucuagccugcauggaguuccgguuucaauccuuagucugacuuaacaucaggcauggggccagcaagauggcucaguggguaauaaugauaaagauacgaaauaaauuaaaauauuaaauauaauaaugauaauaacgauuauaauaaccuaaguucuuuugcuaaguuccaaggucaugcacagguuuauuccagcagagguaggugaaucucuguggguugcaggccagccagggcuacauacugagagagaccuuuacuaaaaaaaaaaaaaaaaaaaaaaaccaaaaaaacccaacaauagcaacuaaaaccucaaaacaacccugcccccaacaaaacuagucgcaacugcugugaaccgaucgcuuuguucuacauuuuauguucuauuccacacucuauaaucucacauuguuuggcaccagauaacaaguucucaaaauuggguauuuuauuauuuaaucuuagcuaacuuucuaaaaacucucccuguaugcagcccagaacaaaacagacucaacuccagaggccuucaagagagauucugguugaaaagagagacaauaaauaugauaaguaagcaaauuaucuugcauaguagaagaggguucggcacacagcaggugcucaauuuguguuagcuauuacuagcaagucauuaacucacugaaugcaccuccauauccuguuuucacuagaaaagggaaggggcucggagggaggagccgcaguucaggggcagguaguggguuccaggggucccgaggagauucggcaguguuuuggauagugaggcguggcggggguugggggaaggucucagguggagggauccucugaaagggccuccgagagugcuugcccgcacaagggugaggagagaagcggccagagaauagaacuuuggaguaccucagaguuuggggacaucgacagggaagagucuguggaggcucgaucagagaaagaacugggaugaccucagugaggaggccccggguagugaaagaauccaagggcgggucgaggguggcaguagagccggugaaaaggagagagaggucagauuccgauauacucuggaagcgaacagcucccuuucaagaucgaaaggacucuuaaauuugggaggagagcagcagcaaaucuggggaaugcuaugaugggagguggggauaaauauaagaaggucgccucccuaggguacuggcgguuaaggagaggcugagugaguccucgguauggccacacuaaaccgggaccggcuucaggcgggcaugguacagacaccacaaaaggcaccucagcuuucugcucgaguuacagaaccccuauguggagcacccccaaagagcucaagggagcuugagguuuugagcggcuuugagcuuugagcagcuugaaucagucuucuggacuugcaucucugacccaggaaggcaggagcccaggaaggcacacagaagcaggcugggcacauagggucaaagagagagggaaggguacggagucgcuccaaauaagagacccuguagcuuccuugggguuagcuuggacaacucgccuggucucugugguuuuccgugucagagucagguguaaagcucgggguuggagaaggggaaggguaacccuaaccuguuccuguguuccacuucagacucaaguuagaccgguggcccuagugcuccuuccuaccucaagaaaguccgcuucccgcucagcgcuagcacucaguuaagugaaccgagugcaaggcucacuccccucaugaggcagggauggggaaggcggagccccugucccuggaaucccgcgcugagaaagaugucugaucuaaggaacgccagagcccugcuuaccugugcucccaggaguagcagucugaugaggggcaguaggcggaucugaccggacaguuggggguuaggaugcucccuacccccagaggcagcagagggcggagaugugagcuucccccucccaccugcccgaccccug

SEQ ID NO: 12258 - RNA, 4333 nt, Mus musculus
caggggucgggcaggugggagggggaagcucacaucuccgcccucugcugccucuggggguagggagcauccuaacccccaacuguccggucagauccgccuacugccccucaucagacugcuacuccugggagcacagguaagcagggcucuggcguuccuuagaucagacaucuuucucagcgcgggauuccagggacaggggcuccgccuuccccaucccugccucaugaggggagugagccuugcacucgguucacuuaacugagugcuagcgcugagcgggaagcggacuuucuugagguaggaaggagcacuagggccaccggucuaacuugagucugaaguggaacacaggaacagguuaggguuacccuuccccuucuccaaccccgagcuuuacaccugacucugacacggaaaaccacagagaccaggcgaguuguccaagcuaaccccaaggaagcuacagggucucuuauuuggagcgacuccguacccuucccucucucuuugacccuaugugcccagccugcuucugugugccuuccugggcuccugccuuccugggucagagaugcaaguccagaagacugauucaagcugcucaaagcucaaagccgcucaaaaccucaagcucccuugagcucuuugggggugcuccacauagggguucuguaacucgagcagaaagcugaggugccuuuuguggugucuguaccaugcccgccugaagccggucccgguuuaguguggccauaccgaggacucacucagccucuccuuaaccgccaguacccuagggaggcgaccuucuuauauuuauccccaccucccaucauagcauuccccagauuugcugcugcucuccucccaaauuuaagaguccuuucgaucuugaaagggagcuguucgcuuccagaguauaucggaaucugaccucucucuccuuuucaccggcucuacugccacccucgacccgcccuuggauucuuucacuacccggggccuccucacugaggucaucccaguucuuucucugaucgagccuccacagacucuucccugucgauguccccaaacucugagguacuccaaaguucuauucucuggccgcuucucuccucacccuugugcgggcaagcacucucggaggcccuuucagaggaucccuccaccugagaccuucccccaacccccgccacgccucacuauccaaaacacugccgaaucuccucgggaccccuggaacccacuaccugccccugaacugcggcuccucccuccgagccccuucccuuuucuagugaaaacaggauauggaggugcauucagugaguuaaugacuugcuaguaauagcuaacacaaauugagcaccugcugugugccgaacccucuucuacuaugcaagauaauuugcuuacuuaucauauuuauugucucucuuuucaaccagaaucucucuugaaggccucuggaguugagucuguuuuguucugggcugcauacagggagaguuuuuagaaaguuagcuaagauuaaauaauaaaauacccaauuuugagaacuuguuaucuggugccaaacaaugugagauuauagaguguggaauagaacauaaaauguagaacaaagcgaucgguucacagcaguugcgacuaguuuuguugggggcaggguuguuuugagguuuuaguugcuauuguuggguuuuuuugguuuuuuuuuuuuuuuuuuuuuuuaguaaaggucucucucaguauguagcccuggcuggccugcaacccacagagauucaccuaccucugcuggaauaaaccugugcaugaccuuggaacuuagcaaaagaacuuagguuauuauaaucguuauuaucauuauuauauuuaauauuuuaauuuauuucguaucuuuaucauuauuacccacugagccaucuugcuggccccaugccugauguuaagucagacuaaggauugaaaccggaacuccaugcaggcuagagaagcggucuagauaaaccccacaccuccagucuugcuuuaccuuuuguguaucuccaugucccugcucggaagaggugguuacuagacugucugauuuguuuugccuuuuccccccccuuugagauaggaucuggcuuccaacuuguuacauaaccaagggugaccuugaacuucugaucuuuccucccugacuugaauccuggaacuauagaugugagcuacccugcuguuuuugaggcgcugagagucgaacucagggcuccaugcaugcaucuucagccuugaucuauuaucuuucuacguaauucuuuuaggacauaaaccccuugggugggaaaguuccaagcagccaaucaccagacaggcgcuacugugccaaguuggaguucagaaaccaaaucucacucuccuugugcaguggagaugcuaagggacuuagagauacuuuuccaggagauaaugauguuuaaaaauuuaaaaacuuccuccaauucggcuauagugauaguuacuauagccgaacauccacaguucaccgaaucacacauccuaaaaggguggacuucauaggauucauguucauaucaaugggagcacuugaaaaaucccaggacaggcaagaugguucagagauaaagguguuugccaccaaacccgacuccccuacucccauagcuuguccuuugaccuacauacaaaugcuauggcacgcuuacaccaccccaccccuggaaggguuaaguugcccucaucaacccaaaccuaacccuccccuaugcaaaauaaaugcaauuuagaaguuauuugacaagccgggcaguugguggugcacgccuuuaaccccagcacuugggaggcagaggcaggcggauuucugaguucgaggccagccuggucuacagagugaguuccagaacagccagggcuauacagagaaacccugucucaaaaaaaacaaaacaaaacaaaaacccuaacaguuauuugucauuuaaaaagcaugcgugaaaaaaaauagcccugcuuggugcugaagaaguagcuuaacacuagagacuggggguuugaucgcuaggcuugucaaaggaaaaacugcccucuagcucuauaggaaagaagaggguagcgaggcuugguggcacacaccuguaauucuagcucugggaaggcagaagcagggggauugcugaaacuuuaaggucagcugaccugcaggacaaguuccaagcaaggcagagauccggguuaggaccuugucuauccccccaccccccacccccaccaccaaaguaaggagagaagaguuuuuaacuuaaccauguugauucagcggcaccuggggagucuccuuucuuccagccagucucaccugauuucuccuucacagcaccugcucuuuacaccucuuccuugagcugcuggggaauggcuuugccuacaaagucuagcaucuuggaccugagcuccggcaccccaugcaccagaucuccagaggaaagucacgaggcuugggcacagugcaaagaugcuggcaggcagcuacccgaguacaaggcagugguggugggugcaagugguguugguaaaagugcucucaccauccagaugacucaccaaugcuucgugaaagaccaugaccccacuauccaagauuccuacuggaaggaaguggccagggacaacggaggcuacauucuaaauguucuggauacaucugggcaggauauucaccgggcucugcgugaccagugcuuggcaucuggugauggugugcugggcgucuuugcucuugacgaccccucgucucuggaccaguugcagcagauaugguccaccuggaccccucaccacaagcagccucugguacuagugggcaacaagugugaccuggugaccacugcuggagaugcucaugcugccgcagcccuccuugcucacaaguugggggcccccuuggugaagaccucagccaagacgcggcaagguguggaggaagccuuugcccugcuuguccaugagauucagagggcccaggaggcuguggccgaaucaagcaagaagacccgacaccagaaagccguguguagcuguggcugcucuguagccugaagaucuuugucuagcaaauugacccuugucucaugucaaggugacaauucucuuguaauaagauuucccucuccgaccaaguuaccacagacaucuuuuuauugucauuuggugagaaguuacgugguaacaugggacaucccucauugacuguguuuuaugaaacucuaugcaaaauuaaauaaauguucucaggauucaaagcuuccuuuauacu

SEQ ID NO: 12259 - RNA, 11922 nt, Mus musculus
ugguggugguagcggugugacaggugagggcaggcccgguaggguucggguuuuggagcggcugcgggacccggguaugaaguccagaccgaaagcucagcuccaagaugcuuccgucugaaucucagcguucucccgcccggaaccaaaggagugguuugaccagggcgagaccgucgucaucgaccgugggaguggauggaggagucggccugcaggcugcaguggugguuucgcuugcugcgcguggcagugcaccugcacagagcuugaagcccuuggggagggcgggacggagccaaauugggucuggggucuggggcuugggugcgaaauuccaaggugaauucuuaaaccccuuaaaaugucuaaugacguuuccucacgacguccaggagaugcagcucucucccaugguuccuuauugcccuucauauucuacgccaccuaggaagaugucugacgauuaccucauuaucccuaguucacccuaaucccuuuccaugauuucacagugcguuuacaccaguaaucuguuugugacccccaguaguuaucagguacaguuuuuggaaacccuucccccaaccucaccuccaucuucuucaucuggauaccauugucuuccuuugccuuuccucuugauaguguuuucugaugagccaucauugccacugcauuugauuuaguguguaauguggucuguuauccagcuguuuuucacagucuguagugacucuuauuacaucucucuuuagucuaggguauggcgaaccucuguggacucuagagggucuggugaccucuauuagcuaccugacaguaccuuugauucuaccauuagccuuauagcuuaugcucuggaauacccacagugccuuuuaaggucauugguacugucuucauuuccuucaaucuaaaaacaaggucugaugauccuccauuuuccuguccccugucugugucugauuacccauucucugaagcuaagacagccuguuuauuuccauugugugccugagaccugugauuuuucagugcaguacauaauggcuuccccauuaaucucuagagagucauguguucugcacuguccagaaccgugugcacugucuccucacugcagugagucucagaucuugguacucaacuaugacauaagcaauaggagauucucagcagagaaggguuaguaucauugggcugguucauaaaaagugggauuuagggaacagugggaacuuggagauggaauuuuauauguccucugccacucugcuuucaggcugucauuacuagaccucugaauuucuccucuguccucugcuaggaggccuauggcagcugcccaguccuaccucagcccaucuugaaaacaaucuuaggcaacauggaaccaccacgaggcccuccuguuaguggggcugagccaucucgggcaguuggcacugucaaaguguaccugccuaacaagcaacgcacaguggugagucacucaggcaguacuggcagggguuccagauagucguagugugggaucagaaggguggcgaggguuagggaaugaaugcugcagagggaaggaauaauuggcuaggguaccuauuggauacugaagaccccaaucucuacacacacacacacacaggugacuguccgggaaggcaugagugucuaugacucuuuggacaaggcccugaaggugcggggucucaaccaggacugcuguguggucuacaggcucaucaaaggguaaguauggaaaccccaugccauucacugggucccuacacaccuccuuucuucagugccaucuuauuccuccucauuugucuuggagucuuccacuaucugagguaacccaggugacaucuuucguuucccuucauugaccauuggaaggucugcaauucacuaugcacucagcccucaaguccucagucugucaccuuccagaguucaucuguuuuguucuuucaccauuucuugaagucacaagcucuuucuuuucucaugguccccauacaccauggaguugguggucuucauugaccuuucuauucuuuguuuguuuguuuguuuguuuuguuuguuuuuuuuuuuuuuuuuuuuugagacaggguuucucuguauagcccuggcuguccuggaacucacuuuguagaccaggcuggccucgaacucagaaauccacuugccucugccucccgagugcugggauuaaaggugugcgccaccacgccugccugaccuuucuauucuuguguuccuuggugccuuaauguuuuggauggaguuccuguuuucauuuuaccuguuucagugucucaggugcuggcuuacuacgccugagauguaguuucauuugccucucaccacaugcuuaagaucauggauuaaaucugggagugguggguauaccuguuagccuagcgcuugggcaauucaccuaauugcuugagccuguuuccucauguguaaagugggaguaaaaauagugacuaacuuuauuuuuuauuugaaauguuacccuuuuuauguguaugaguguuuugacugcaugcgugugcacuguguguguuccucacgccuauggaggccagaagaagguugaagaucccaccggaguuaaggaugguuaugagccacggugugagugcugggaacugaacccagguccucugaaagaaaagcaaguauucuuaacugcugagccaucaucucuccuguccaaaagugacuaacguagugagaauuaaacaugugggagagugguucguggaugggacugagaggaacuuugggaacuucccugucuacuguggucccaguguaucaucgcucucauucucucccauacuucuugcagaagaaagacagucacugccugggacacagccauugcgccucuggauggugaggagcucauuguggagguccuagaagaugugccacugaccaugcacaauuuuguaagucuaauggggauggugggggaggccacaguguggacagagagggccuucagucgggccugcacuucccugcuuuguggcugcagguacggaagacauucuucagccuggccuucugugacuucugccuuaaguuucuguuccauggauuccgcugccagaccuguggcuacaaguuccaccagcauuguuccuccaagguccccaccgucugcguugacaugaguaccaaccgccgacagugagcccagccugggguggcuugagggguggggaggacggaagccccagcacgagggcuuacagucagccaagcuauacucacagccuucuuguuuuacaccuuuaugcccucaagguucuaccacagcauccaggaucugucuggaggcuccaggcagcaggaggcucccucaaaucucucugugaaugagcugcuaaccccccagggucccagguagggaugucguagaugaaaggccagggggccagugaaagaaggauuggaggacccugagagauuauacuuucguuuauuuguuuacgugauaaauacuauugaguaccuacaaguguugaauaugggcaugggauugugggaucauugguaaggcacccagucacuccagguuucauuuuuuucaucugggaagaggggaugagauuuucccuaguggguucugaagaggauuaaggguugagauauuugcaaugcuuaaagcaagaucugauacagaguaaauaacaaguguuauucauuacaaguguauauauaaaaucaucuaguuuguucauuucuuccaguauaaccacaccccagucuuuucucuuugaaauaaauguuacuguaucagaaaguacuuuuauuucacuuauguuggauaugauagcauauaguuuugcauaauauauaaaaaguaagguuaauguauuauuauuuguaguuaugaguguauguguguugauuuaccugugaauuuaaucucaggauggugaaaguaacagaagaauguuuuucuguaagguauaauucaugggagguggaggcaagacgaucaauaguucaaggcuacccuccacuaaguagcaaguucaaggccagccugggcuacaugagacugucuuaaaacaguaaaaaagguguuuuguaacgugauauauguauaaucguuauaugauguguguaauguguauuacauaauauaauauguguauugaaaacguugccauuuuaauauagguaaugcucauuauuauaaaauaaauaauauauuugaaaaauacaugucauuaugauauguaauaaaaagucauaucuuacccuuucuccaacuaucuuuguccuucauuguuccuucuuuagaccuuucucccaauauuacccucucugagaacccacuccugacucccccagggacacuuucuaccuccuucauuugauuuuccucuuuuugugccuaucacugacaggcacauuauauauuugcuuuuuuauucuucugccucugcuaaaaacucuacaagggcaagagcuuuuuauuuaugguauccacaguuugaucuccucuguuucgaguugcaucuggcacacaggaggcacucaguaaauguuucuugggcagaugauuacuggucugaccaacagacauguacuguuugagugaacgcacauucagggugguggaguugggcuuucuuugcuuuuuaguuccuucugcagcgauuucauagccuuuucucuauuagccccuuuacccagcaacgugaccaggagcacuucucauucccugccccugccaaucccccacugcagcgcauccgcuccacaucuacuccuaacguccacauggucagcaccacagcucccauggacuccagccucaugcaggugggugucaaggaggugacaguggggagcauggagcauugcuuagagccauuacuauugccauauccucacuuugacuucugcucccaccuccuuccaguuuacugcucagagcuucagcaccgauggugagagaacccccaccccuuucugcacccugagcucucugccccaccaccccacuugccuccacucacagcauucuguacaaccacagcugcugguagagguggugauggagccccucgggguagcccuagcccagcuagugugucuucagggaggaaguccccacauuccaaguuaccuucagaacagcgggagcggaaguccuuggcagaugaaaagaaaaaagugguaugccauaggaaauccuugggggccaccauagccugagugcuaugacggaggguuguggguaggccccucugaugccacccaucuggcccacagaagaaccugggguaccgggacucaggcuauuacugggaggugccacccagugagguacagcuguugaagaggaucgggacaggcucuuuuggcacuguguuucgggggcguuggcauggcgauguagcugugaaagugcucaagguggcccaaccuaccgcugagcaggcccaggccuucaagaaugagaugcaggugcucaggugagguugcugugaauguaagugggacaggaugguggcaggcagcauuuaguguuugggaaaaagccaugcugggguacuuccuggguguguacucuauuugugccauguuggaaguauaaugaggcucaauuucucuccaagagaugacccuuucuccucugagcaaugggcugcagaugaggacaaugaugauggucuuucuuuggaugaacauugcuauuugcuggcugggaacuagaucuagccauaggaccuucccaugauuauuuaacacaugaagauuuuauguaauuccagcuccaggagugcucauauccguccuuccuuuugcugagucacugcuauuauacucauuguguugugggcuuguuguuaaucauaauuuuauacuuaaaauuuucuuugaugcaaacaacaauauuaauuauagucauauucuauauucccguuguguaguuauuauaauugauguaauuaagguaugaucaacacuauuaauucauucacacugaaaaaaccaggguggcaccauuuuagccacuacaguuacuauguagcauaguacuuugugccuuuauuuuauauaagcaagguuguauaggguguguguguguguguguaaccauauuaagcacauguaauaccacugagcuauacucccuguuaucaggaagguauaauuucugacaaucugaggaugcauauaugggcuuccccccucuuaucagauaaacacaauggaugccacaauaagaaaacuuauucucagcucaucucuguaaaguuugaugauuugaguaugcacuaauuugcauucuauuuaucuacuggcuucccacuauuaagaaucuuuaugcugcugaggucacuuagcaccaagacugacaaccugaguccauucagucccugggaccuauaugguagaaaagaacuggcuccugaaaguuguccucuguucuccacauguacacuguggcacacaugcucuauauacacagaugaucacagacaaaggaaucuucauauuugcugggaagauagcuccaucaguaaagugcuuaauauguuugugauugaguuuagauucccaucacccacauaaaaaguaaaaagcugggugcaguggugcacaccuguaauccuagcacugggaaagcagagacaagaguggauuacuggugcuuagccagucuaggcaguuggugaggucuagguuuaguuagagauucggucuccaaaaaugagguggagccgggcgugguggugcacaccuuuaaucccagcacuugggaggcagagacaggcggauuucugaguucgaggccagccuggucuacaaagugaguuccaggauagccagggcuacacagagaaacccugucucgaaaaaccaaaaaaaaaaaaaaaaaaaaaaaaaaaaaaaaaaaaacccaaagagguggaacacaaucaagggagauagauaauccaacaucaaccucuggcuucuccacccaugcacaugcacagucauguaugugugccacauacaaaacaauguggagagugauugaagaauacaccugacauugaccucuggucuccguuugugugcacagauguacauguacacgcauaccuguauauugccucugucuuugucugucucuguuucucucuuauacacacgcacacgcacacacacacacaaaucccuguguugagaauguuggugcaugccuguaaucuuaguacuugggagaaaucccuguguugagaaugauggugcaugccuguaaucuuaguacuugggaggcugaggcagaaggaacaacaguuugagaccagaacuggugugauaauguaguaaagugcuuaucauguaagcaagaagaccuauguuugaucucuagcacccauguaaaaggcuggguguggcagcacaggcuuacaagcucagcacuggagaaacacagauaggaagauuccagagguucaucagucuagacuaauuggcaugucccaggucccagugaaaaaucuccugccucaaaaccaguuuauaaaauaaugcaugaacaacucgaguagguccugaaaacaacauccuagguugaccucuggccuccacuuaagucuucauacacacguacuaacacauacauguauacuuucacacacagaaauacauagauuguucaaaaaaucuggaguaugugaugaaaccuagucucaaaaaaaaauuuuuuuugugguaguacacaugucuauacucuuagcacuugguaggcugaggaucaggaauuugaagccagccugcgauacauuaaacccuguuucaaaaaccaaaacuagagcugggcguugguggugcacaccuuuaaucccaguacucgggaggcagaggcaggcggauuucugaguuugaggccagccuggucuacagagugaguuccaggacagccaggacuacacagagaaacccugucucgaaacaacaacaacaaaaaccaaaccccaaaaaacccccuaguccuuguguguaaguauguauccucagugguagagcaugugcuuagcauaugaaagguuauguuccagcucaaguaucaaaacaagaagggaauguccuggugcucuguugucuucugugaucuaaauauuaucccuguuguuugcauuugcguacucaaacagugguuaauacuuaagaaugugguuuucucauaaacuauauuaaagagguuugcaugugacaguuuccaugaaguagacucagguacccagaaacaaacuggaaguuucagaauguuuacuguuuguccagcuguuuuaaggaccgcucagaccauuuguucacccuuugugacauccucagaaagccgcugcuguaaugauagcaguuguaugguuugggaacaagaggaccaaagugguuagaaguccucuucaagguuguacaaugagugacugguaaagguuuggguuguaacaugguuucggacucuagauucuuugccucuaagccucucagugauuaguaaacugucauccucccaugucacacaugucucuaugucuugagccucucucucucaguauugauaaagaagguuggcuuccuacuuugucaucuguaacauagccacugcuagguaugguggcuaaugcccaugaucccagagcuugcgagguugggucagaaggaucacugagagcuugcggccugcccaggcuacuuagcuccaggccagcuugguauacaacauaagacccuguuccaaagccauaaaaaaauaauaaaauaaaauagaauuuuguugaggacggucagaacaucaaccucuacucagcucccagaagcccaucaagucucacagauugcgaucugacaacauuuggcccugagcacccuugaagacaagguaagaucgcuuuuccuauugcugaguaaacacaugacacuuguucuauuucuugaccccuucccccaaccuacccucccugccuacaggaagacacggcaugucaacauuuugcuguucauggguuucaugacucggccgggguuugccaucaucacacaguggugugaggguuccagccucuaccaccaccuacauguggcugacacgcgcuuugacaugguccagcucauugauguggcccggcagacugcccagggcauggagugagccucacaucuuagagacuuggggaggugggagggauagcugaaauagucuccagacaauucacuacccacuuccaucuccacagcuaccuccacgccaagaacaucauucaucgagaccuaaaguccaacaguaucuaccugucccuggcugggacuggggguggguaguaaucagagugguaguuuaaagggaugauuugggggguaagauucuggaggugaagagggaagggccuauauccugugguuucuugccagguaacagagcuauaccugguaaagggccuuuuaaaugaaggaccuuuguuuaggagucagaugguucacguacuguuggguacucugcucaggugagauguaguaguuguagaugacauuacagugucccaggcaugauagcuuuaggugucauccaggagacuuguugguuuugggucacaauggaaccaagugggguccuaucagucguagauaguaugaaauggggguggcuucuggcaagagacauaacucacuagaacagggguucugagaaccauccaguaaggguaugaggcauagcuauugggauuccuuguaauggcccuugacccugcuggauaucuucuuacaugaggggcucacagucaagauuggugacuucggccuggccacagugaagacacgguggaguggggcacagcccuuagagcagcccucagggucugugcuauggaugguaaguugggccaggcuagauggggagcaaugggagauguggacuuuuggauugggacaugccaggcaaaguggggaugucuuugccaggugggaauaucuagacugcccauguuuuaccucacauggguggcacugagucauucucaguguaacuaucaggaucugauacuguggacuagucauuuuuugucccucauggucccccugcccugucuggccuaccuaaggcagcugaggugauccguaugcaggacccgaaccccuacagcuuccagucggaugucuaugccuaugguguugugcucuaugagcucaugaccggcucacugcccuacagccacauuggcagccgugaccaggugagccucauaacuuacccgcaguucucagggcuucacacucuagguccccucacuuguacagacaguagucuccccgcccuaagccuaggauuuuucugaaugaagaguccuggaaucugucuuuuagauaucuuauaucccauccuccucacacauccacaaaccccugagccagaacccuuaaaauccagauuucuuugacucccuauauucagaauguuccuagaccccaaacccuucagaagcccccugaacauucugaguguccaacacucaggcccuuugugcuucucaaauacccauagucacccugaauuuggggucuuggaauucauaacacucuaggucuuaaauucucacacaauucuccgaauuuaagaucuagaaccuucccuguucuuagauaccagguccagauaucaaguauuugagcuuugaguacuacauaaguaagucuacauagacuuauuuaugccccagacuccuacagaaauggaaguuucccccaagaaguagugcucugcauuuucccgaaucuuaguauuuucugagcuuaugccccuuaauaacuccagacuccuauuguucugggccauacacaccuacagucuuugacagccuuaauauaaaucccucucuuuuaucagcagaaaauccucccuaguccucagggacacagacuccucugggccuuaguacuagacaccucuaguccucaaaaauuaaccuaacauauauuuuaagauucauagaucccugggccucccagcucaaaccccaaaucaacccauuccuccccacacaccagaucaucuuuauggugggccguggcuaucugucuccggaccucagcaaaaucuucaguaauugccccaaagccaugaggcgccugcugacugacugccucaaguuccagcgggaggagcggccccuauuuccccaggugggcuggguaggagggcuggauaccuuggggagaugcacugugaguaaagagauagaggcagauauugaaugugaaccauguugaaagcuggggauuggggauauuggaguaucucugggacucuggacaccccucuucaucuccacccgcucccagauucuggccacgaucgagcuacugcagcggucacuccccaagauugagcggagugccuccgaacccuccuugcaccgcacccaggcugaugaguugccugcuugccuucucagcgcagcccgucuugugccuuagaccucacucccagcccaccagggagccaauuucagcauaccaugccaaggcacaccgaccuaccagccaauaacuguucugccucugccuugauacugccucaggauucccuaucccauacccugggaaauuugagggaccccaaaaacugaggucuccugcuuucuccauaauuuggucuccucuuggguuuggggauaguucuaauuuggagagcuguuuuaucuccaauggcugugacucagugcaaggauuccacucagaaccucuuucuaaaguuuuugccugaugugucuucacuggauuuugggguucccagcaccccauguagauuuggggguuucuuuuugucucccccacuauucaaggacucuccucuuuaccaagaagcacagaauucugcug

SEQ ID NO: 12260 - RNA, 11922 nt, Mus musculus
cagcagaauucugugcuucuugguaaagaggagaguccuugaauagugggggagacaaaaagaaacccccaaaucuacauggggugcugggaaccccaaaauccagugaagacacaucaggcaaaaacuuuagaaagagguucugaguggaauccuugcacugagucacagccauuggagauaaaacagcucuccaaauuagaacuauccccaaacccaagaggagaccaaauuauggagaaagcaggagaccucaguuuuuggggucccucaaauuucccaggguaugggauagggaauccugaggcaguaucaaggcagaggcagaacaguuauuggcugguaggucggugugccuuggcaugguaugcugaaauuggcucccuggugggcugggagugaggucuaaggcacaagacgggcugcgcugagaaggcaagcaggcaacucaucagccugggugcggugcaaggaggguucggaggcacuccgcucaaucuuggggagugaccgcugcaguagcucgaucguggccagaaucugggagcggguggagaugaagagggguguccagagucccagagauacuccaauauccccaauccccagcuuucaacaugguucacauucaauaucugccucuaucucuuuacucacagugcaucuccccaagguauccagcccuccuacccagcccaccuggggaaauaggggccgcuccucccgcuggaacuugaggcagucagucagcaggcgccucauggcuuuggggcaauuacugaagauuuugcugagguccggagacagauagccacggcccaccauaaagaugaucugguguguggggaggaauggguugauuugggguuugagcugggaggcccagggaucuaugaaucuuaaaauauauguuagguuaauuuuugaggacuagaggugucuaguacuaaggcccagaggagucugugucccugaggacuagggaggauuuucugcugauaaaagagagggauuuauauuaaggcugucaaagacuguagguguguauggcccagaacaauaggagucuggaguuauuaaggggcauaagcucagaaaauacuaagauucgggaaaaugcagagcacuacuucuugggggaaacuuccauuucuguaggagucuggggcauaaauaagucuauguagacuuacuuauguaguacucaaagcucaaauacuugauaucuggaccugguaucuaagaacagggaagguucuagaucuuaaauucggagaauugugugagaauuuaagaccuagaguguuaugaauuccaagaccccaaauucagggugacuauggguauuugagaagcacaaagggccugaguguuggacacucagaauguucagggggcuucugaaggguuuggggucuaggaacauucugaauauagggagucaaagaaaucuggauuuuaaggguucuggcucagggguuuguggaugugugaggaggaugggauauaagauaucuaaaagacagauuccaggacucuucauucagaaaaauccuaggcuuagggcggggagacuacugucuguacaagugaggggaccuagagugugaagcccugagaacugcggguaaguuaugaggcucaccuggucacggcugccaauguggcuguagggcagugagccggucaugagcucauagagcacaacaccauaggcauagacauccgacuggaagcuguagggguucggguccugcauacggaucaccucagcugccuuagguaggccagacagggcagggggaccaugagggacaaaaaaugacuaguccacaguaucagauccugauaguuacacugagaaugacucagugccacccaugugagguaaaacaugggcagucuagauauucccaccuggcaaagacauccccacuuugccuggcaugucccaauccaaaaguccacaucucccauugcuccccaucuagccuggcccaacuuaccauccauagcacagacccugagggcugcucuaagggcugugccccacuccaccgugucuucacuguggccaggccgaagucaccaaucuugacugugagccccucauguaagaagauauccagcagggucaagggccauuacaaggaaucccaauagcuaugccucauacccuuacuggaugguucucagaaccccuguucuagugaguuaugucucuugccagaagccacccccauuucauacuaucuacgacugauaggaccccacuugguuccauugugacccaaaaccaacaagucuccuggaugacaccuaaagcuaucaugccugggacacuguaaugucaucuacaacuacuacaucucaccugagcagaguacccaacaguacgugaaccaucugacuccuaaacaaagguccuucauuuaaaaggcccuuuaccagguauagcucuguuaccuggcaagaaaccacaggauauaggcccuucccucuucaccuccagaaucuuaccccccaaaucaucccuuuaaacuaccacucugauuacuacccacccccagucccagccagggacagguagauacuguuggacuuuaggucucgaugaaugauguucuuggcguggagguagcuguggagauggaaguggguagugaauugucuggagacuauuucagcuaucccucccaccuccccaagucucuaagaugugaggcucacuccaugcccugggcagucugccgggccacaucaaugagcuggaccaugucaaagcgcgugucagccacauguagguggugguagaggcuggaacccucacaccacugugugaugauggcaaaccccggccgagucaugaaacccaugaacagcaaaauguugacaugccgugucuuccuguaggcagggaggguagguugggggaaggggucaagaaauagaacaagugucauguguuuacucagcaauaggaaaagcgaucuuaccuugucuucaagggugcucagggccaaauguugucagaucgcaaucugugagacuugaugggcuucugggagcugaguagagguugauguucugaccguccucaacaaaauucuauuuuauuuuauuauuuuuuuauggcuuuggaacagggucuuauguuguauaccaagcuggccuggagcuaaguagccugggcaggccgcaagcucucagugauccuucugacccaaccucgcaagcucugggaucaugggcauuagccaccauaccuagcaguggcuauguuacagaugacaaaguaggaagccaaccuucuuuaucaauacugagagagagaggcucaagacauagagacaugugugacaugggaggaugacaguuuacuaaucacugagaggcuuagaggcaaagaaucuagaguccgaaaccauguuacaacccaaaccuuuaccagucacucauuguacaaccuugaagaggacuucuaaccacuuugguccucuuguucccaaaccauacaacugcuaucauuacagcagcggcuuucugaggaugucacaaagggugaacaaauggucugagcgguccuuaaaacagcuggacaaacaguaaacauucugaaacuuccaguuuguuucuggguaccugagucuacuucauggaaacugucacaugcaaaccucuuuaauauaguuuaugagaaaaccacauucuuaaguauuaaccacuguuugaguacgcaaaugcaaacaacagggauaauauuuagaucacagaagacaacagagcaccaggacauucccuucuuguuuugauacuugagcuggaacauaaccuuucauaugcuaagcacaugcucuaccacugaggauacauacuuacacacaaggacuaggggguuuuuugggguuugguuuuuguuguuguuguuucgagacaggguuucucuguguaguccuggcuguccuggaacucacucuguagaccaggcuggccucaaacucagaaauccgccugccucugccucccgaguacugggauuaaaggugugcaccaccaacgcccagcucuaguuuugguuuuugaaacaggguuuaauguaucgcaggcuggcuucaaauuccugauccucagccuaccaagugcuaagaguauagacauguguacuaccacaaaaaaaauuuuuuuuugagacuagguuucaucacauacuccagauuuuuugaacaaucuauguauuucugugugugaaaguauacauguauguguuaguacguguguaugaagacuuaaguggaggccagaggucaaccuaggauguuguuuucaggaccuacucgaguuguucaugcauuauuuuauaaacugguuuugaggcaggagauuuuucacugggaccugggacaugccaauuagucuagacugaugaaccucuggaaucuuccuaucuguguuucuccagugcugagcuuguaagccugugcugccacacccagccuuuuacaugggugcuagagaucaaacauaggucuucuugcuuacaugauaagcacuuuacuacauuaucacaccaguucuggucucaaacuguuguuccuucugccucagccucccaaguacuaagauuacaggcaugcaccaucauucucaacacagggauuucucccaaguacuaagauuacaggcaugcaccaacauucucaacacagggauuugugugugugugugcgugugcguguguauaagagagaaacagagacagacaaagacagaggcaauauacagguaugcguguacauguacaucugugcacacaaacggagaccagaggucaaugucagguguauucuucaaucacucuccacauuguuuuguauguggcacacauacaugacugugcaugugcauggguggagaagccagagguugauguuggauuaucuaucucccuugauuguguuccaccucuuuggguuuuuuuuuuuuuuuuuuuuuuuuuuuuuuuuuuuuugguuuuucgagacaggguuucucuguguagcccuggcuauccuggaacucacuuuguagaccaggcuggccucgaacucagaaauccgccugucucugccucccaagugcugggauuaaaggugugcaccaccacgcccggcuccaccucauuuuuggagaccgaaucucuaacuaaaccuagaccucaccaacugccuagacuggcuaagcaccaguaauccacucuugucucugcuuucccagugcuaggauuacaggugugcaccacugcacccagcuuuuuacuuuuuaugugggugaugggaaucuaaacucaaucacaaacauauuaagcacuuuacugauggagcuaucuucccagcaaauaugaagauuccuuugucugugaucaucuguguauauagagcaugugugccacaguguacauguggagaacagaggacaacuuucaggagccaguucuuuucuaccauauaggucccagggacugaauggacucagguugucagucuuggugcuaagugaccucagcagcauaaagauucuuaauagugggaagccaguagauaaauagaaugcaaauuagugcauacucaaaucaucaaacuuuacagagaugagcugagaauaaguuuucuuauuguggcauccauuguguuuaucugauaagaggggggaagcccauauaugcauccucagauugucagaaauuauaccuuccugauaacagggaguauagcucagugguauuacaugugcuuaauaugguuacacacacacacacacacccuauacaaccuugcuuauauaaaauaaaggcacaaaguacuaugcuacauaguaacuguaguggcuaaaauggugccacccugguuuuuucagugugaaugaauuaauaguguugaucauaccuuaauuacaucaauuauaauaacuacacaacgggaauauagaauaugacuauaauuaauauuguuguuugcaucaaagaaaauuuuaaguauaaaauuaugauuaacaacaagcccacaacacaaugaguauaauagcagugacucagcaaaaggaaggacggauaugagcacuccuggagcuggaauuacauaaaaucuucauguguuaaauaaucaugggaagguccuauggcuagaucuaguucccagccagcaaauagcaauguucauccaaagaaagaccaucaucauuguccucaucugcagcccauugcucagaggagaaagggucaucucuuggagagaaauugagccucauuauacuuccaacauggcacaaauagaguacacacccaggaaguaccccagcauggcuuuuucccaaacacuaaaugcugccugccaccauccugucccacuuacauucacagcaaccucaccugagcaccugcaucucauucuugaaggccugggccugcucagcgguagguugggccaccuugagcacuuucacagcuacaucgccaugccaacgcccccgaaacacagugccaaaagagccugucccgauccucuucaacagcuguaccucacuggguggcaccucccaguaauagccugagucccgguaccccagguucuucugugggccagauggguggcaucagaggggccuacccacaacccuccgucauagcacucaggcuaugguggcccccaaggauuuccuauggcauaccacuuuuuucuuuucaucugccaaggacuuccgcucccgcuguucugaagguaacuuggaauguggggacuuccucccugaagacacacuagcugggcuagggcuaccccgaggggcuccaucaccaccucuaccagcagcugugguuguacagaaugcugugaguggaggcaaguggggugguggggcagagagcucagggugcagaaagggguggggguucucucaccaucggugcugaagcucugagcaguaaacuggaaggaggugggagcagaagucaaagugaggauauggcaauaguaauggcucuaagcaaugcuccaugcuccccacugucaccuccuugacacccaccugcaugaggcuggaguccaugggagcuguggugcugaccauguggacguuaggaguagauguggagcggaugcgcugcagugggggauuggcaggggcagggaaugagaagugcuccuggucacguugcuggguaaaggggcuaauagagaaaaggcuaugaaaucgcugcagaaggaacuaaaaagcaaagaaagcccaacuccaccacccugaaugugcguucacucaaacaguacaugucuguuggucagaccaguaaucaucugcccaagaaacauuuacugagugccuccugugugccagaugcaacucgaaacagaggagaucaaacuguggauaccauaaauaaaaagcucuugcccuuguagaguuuuuagcagaggcagaagaauaaaaaagcaaauauauaaugugccugucagugauaggcacaaaaagaggaaaaucaaaugaaggagguagaaagugucccugggggagucaggaguggguucucagagaggguaauauugggagaaaggucuaaagaaggaacaaugaaggacaaagauaguuggagaaaggguaagauaugacuuuuuauuacauaucauaaugacauguauuuuucaaauauauuauuuauuuuauaauaaugagcauuaccuauauuaaaauggcaacguuuucaauacacauauuauauuauguaauacacauuacacacaucauauaacgauuauacauauaucacguuacaaaacaccuuuuuuacuguuuuaagacagucucauguagcccaggcuggccuugaacuugcuacuuaguggaggguagccuugaacuauugaucgucuugccuccaccucccaugaauuauaccuuacagaaaaacauucuucuguuacuuucaccauccugagauuaaauucacagguaaaucaacacacauacacucauaacuacaaauaauaauacauuaaccuuacuuuuuauauauuaugcaaaacuauaugcuaucauauccaacauaagugaaauaaaaguacuuucugauacaguaacauuuauuucaaagagaaaagacuggggugugguuauacuggaagaaaugaacaaacuagaugauuuuauauauacacuuguaaugaauaacacuuguuauuuacucuguaucagaucuugcuuuaagcauugcaaauaucucaacccuuaauccucuucagaacccacuagggaaaaucucauccccucuucccagaugaaaaaaaugaaaccuggagugacugggugccuuaccaaugaucccacaaucccaugcccauauucaacacuuguagguacucaauaguauuuaucacguaaacaaauaaacgaaaguauaaucucucaggguccuccaauccuucuuucacuggcccccuggccuuucaucuacgacaucccuaccugggacccugggggguuagcagcucauucacagagagauuugagggagccuccugcugccuggagccuccagacagauccuggaugcugugguagaaccuugagggcauaaagguguaaaacaagaaggcugugaguauagcuuggcugacuguaagcccucgugcuggggcuuccguccuccccaccccucaagccaccccaggcugggcucacugucggcgguugguacucaugucaacgcagacgguggggaccuuggaggaacaaugcugguggaacuuguagccacaggucuggcagcggaauccauggaacagaaacuuaaggcagaagucacagaaggccaggcugaagaaugucuuccguaccugcagccacaaagcagggaagugcaggcccgacugaaggcccucucuguccacacuguggccucccccaccauccccauuagacuuacaaaauugugcauggucaguggcacaucuucuaggaccuccacaaugagcuccucaccauccagaggcgcaauggcugugucccaggcagugacugucuuucuucugcaagaaguaugggagagaaugagagcgaugauacacugggaccacaguagacagggaaguucccaaaguuccucucagucccauccacgaaccacucucccacauguuuaauucucacuacguuagucacuuuuggacaggagagaugauggcucagcaguuaagaauacuugcuuuucuuucagaggaccuggguucaguucccagcacucacaccguggcucauaaccauccuuaacuccggugggaucuucaaccuucuucuggccuccauaggcgugaggaacacacacagugcacacgcaugcagucaaaacacucauacacauaaaaaggguaacauuucaaauaaaaaauaaaguuagucacuauuuuuacucccacuuuacacaugaggaaacaggcucaagcaauuaggugaauugcccaagcgcuaggcuaacagguauacccaccacucccagauuuaauccaugaucuuaagcauguggugagaggcaaaugaaacuacaucucaggcguaguaagccagcaccugagacacugaaacagguaaaaugaaaacaggaacuccauccaaaacauuaaggcaccaaggaacacaagaauagaaaggucaggcaggcgugguggcgcacaccuuuaaucccagcacucgggaggcagaggcaaguggauuucugaguucgaggccagccuggucuacaaagugaguuccaggacagccagggcuauacagagaaacccugucucaaaaaaaaaaaaaaaaaaaaacaaacaaaacaaacaaacaaacaaacaaagaauagaaaggucaaugaagaccaccaacuccaugguguauggggaccaugagaaaagaaagagcuugugacuucaagaaauggugaaagaacaaaacagaugaacucuggaaggugacagacugaggacuugagggcugagugcauagugaauugcagaccuuccaauggucaaugaagggaaacgaaagaugucaccuggguuaccucagauaguggaagacuccaagacaaaugaggaggaauaagauggcacugaagaaaggagguguguagggacccagugaauggcaugggguuuccauacuuacccuuugaugagccuguagaccacacagcaguccugguugagaccccgcaccuucagggccuuguccaaagagucauagacacucaugccuucccggacagucaccuguguguguguguguguagagauuggggucuucaguauccaauagguacccuagccaauuauuccuucccucugcagcauucauucccuaacccucgccacccuucugaucccacacuacgacuaucuggaaccccugccaguacugccugagugacucaccacugugcguugcuuguuaggcagguacacuuugacagugccaacugcccgagauggcucagccccacuaacaggagggccucguggugguuccauguugccuaagauuguuuucaagaugggcugagguaggacugggcagcugccauaggccuccuagcagaggacagaggagaaauucagaggucuaguaaugacagccugaaagcagaguggcagaggacauauaaaauuccaucuccaaguucccacuguucccuaaaucccacuuuuuaugaaccagcccaaugauacuaacccuucucugcugagaaucuccuauugcuuaugucauaguugaguaccaagaucugagacucacugcagugaggagacagugcacacgguucuggacagugcagaacacaugacucucuagagauuaauggggaagccauuauguacugcacugaaaaaucacaggucucaggcacacaauggaaauaaacaggcugucuuagcuucagagaauggguaaucagacacagacaggggacaggaaaauggaggaucaucagaccuuguuuuuagauugaaggaaaugaagacaguaccaaugaccuuaaaaggcacuguggguauuccagagcauaagcuauaaggcuaaugguagaaucaaagguacugucagguagcuaauagaggucaccagacccucuagaguccacagagguucgccauacccuagacuaaagagagauguaauaagagucacuacagacugugaaaaacagcuggauaacagaccacauuacacacuaaaucaaaugcaguggcaaugauggcucaucagaaaacacuaucaagaggaaaggcaaaggaagacaaugguauccagaugaagaagauggaggugagguugggggaaggguuuccaaaaacuguaccugauaacuacugggggucacaaacagauuacugguguaaacgcacugugaaaucauggaaagggauuagggugaacuagggauaaugagguaaucgucagacaucuuccuagguggcguagaauaugaagggcaauaaggaaccaugggagagagcugcaucuccuggacgucgugaggaaacgucauuagacauuuuaagggguuuaagaauucaccuuggaauuucgcacccaagccccagaccccagacccaauuuggcuccgucccgcccuccccaagggcuucaagcucugugcaggugcacugccacgcgcagcaagcgaaaccaccacugcagccugcaggccgacuccuccauccacucccacggucgaugacgacggucucgcccuggucaaaccacuccuuugguuccgggcgggagaacgcugagauucagacggaagcaucuuggagcugagcuuucggucuggacuucauacccgggucccgcagccgcuccaaaacccgaacccuaccgggccugcccucaccugucacaccgcuaccaccacca

SEQ ID NO: 12261 - RNA, 17207 nt, Mus musculus
ugagacaggguuucucuguguagcccuggcuguccuggaacuugcucuguagaccaggcugaccuugaacucugagaccuacuugcuucuccuuccccagugcugggauuaaagacgugugccucuaccaccuggcucacacaaucagcuucuuaaacauauaccuccaugacuuaauuucacacacaaaccauuucucaaaaccauuucucuacuaacagugugacuuuucaucuacaaaugguugggacuggagaaauggcccagucaauaaaacacuugcuuugcacaacccugugaauaaaggagucaacgugguaaaaggugaccguuugaucccuacaauacagguaaaaauuccaggcauagaaguacaugcuuguaaucccaagguagaaccagguagauccuugagacuugauggccagcaaguguaucccaacugguaaguuuaggcaaagaugagacccugucucaaaggaggggacaguguuccaguagacaacacaccacacauaagaccaugcauacacauguacaaaaauguuugcggucacacuucugaccugcgacacacauauuuaaaaucuuucgguuucucucaucacacugguuaccaaucagcagucuguaucagucucugacauaugccaucauuuugccucucucacagucaaucuuugccucgcccuuauuguucuucauauucguggcugucauggcuuauuuuggugacacaggagaaaaaaaaauaccaacagcuuucagcaacaccuuuaaaaauauauauuuacaggaacaauuccccauucucugggacucuuagaaaaaaagguccauuuuggggaagcaaaacaaguaguggagacgaguauagcaccgucccccaaaucaccaacccccaggucuucaggccuggucugggccagugcugacaggaggugagccugggagucuuuugauccaccuccuccagccuagauugauauaagacaggcuccaugucccccauuccucccucccaacuccagggacacuuaaaaggguccuuuguacccgccugcaggaaauuggggggcugggagggagccaaaaauacauguuugguauaaaaaauaaacacuuggggguggcaggaagaccgccuccaaaucccuuacuucccacccacccgccuacccacccaucugauauaggaagagauguuucccucuccccuauugaaaagccccauuuaaaaauagauuauacuaucaaaauggaagggggugggagacagagaccuggaguacuagcuggaggggccccccagacggggaccaccacccaaaaaaacccuccauugggagguaauaggcagggccccaggaaauuuggcagacaaaggaauggcuucucaggggggaagaacaacaaaaggaauaguccucccuggccaaaagguuacuugagaaaagaacaagcugacugagaagaagguuagggagguagcaauuccuauuuuaacaguguugauucccuggcuaccacucccaaaccauuaaaucguacaagggcucccuggacucagauacagccaggaauaauaaaacaaaacaagcuaguucuucaacccaugucgcaaaaugaagacagggcacccucaacuccccaagggcaggcugagaaauaaauaaauaaagguuccucucaagccaugcccugauugucuuguuuuaggaaaaaauggggaggaaaugggugagaugucuuacccacuccccuaaaaagguugggccagauucuucccaguggccuucaaaaaauaaauaaauaaaccgccccaccauugaaguaggagacguguaagggcagccacugggaggcuggcaaagaagaaagaaguugucuguuuuggguggaggaguuagugaaauauucacuuuuccaggaauauccaccccaccacaaucagagcuuaagucugucaguuuaacuauguuucuccuugagauggcuaacuggagaguucaggagcauagauggauggacuccaaaaaaggggugguggugguagucauggcuucuggggcccuggggagagcaccacgggggucgagaggccauccacacugauggaagggaugugcaccugugcgcugccacuggacggaaacugggggaagagacaaggagagguuaugggugaaccgugcuaguaacucuuaagcuuccaacagagcgggaggcaauccuaccuggaaggagagcuuggcuggacuacggggugcaauuggacucagagugcuccagaaauggaugcuagggggcagcgagcugggugucagcagcaccggggucuguagagacggaguggcaggaacucaagugaacaggugacaaguaugagaagauggaaagaaccuacuuucagcaccucuucauggaucuccuucagaguucuacaguuacuccucaaaaguucauaaaccuagaguauaacuacuaugaccaugccuaugacaucccucaaucauuacaccuaggagcucaguuccuguuacugagacuucgguaagacuauccaccagauucuauccaugcacugcucucaaaccuugugaccaccggaagaacucaacuucccagucuuagauuccaccaauauaccucacuagggaacccacuaugcaaaccccguggaaagcauuagggagucaggcugccacaaagaccuaagaccugcucuucuuaauuagccccaucacuucagcguaagcccaagaacagcuuguaaguuaccaguaccaaugccacucaucuaggcugccagcccuugcuccucugcaaggcacucaccaagguauguguggggagcagggauggcguuagcgcuggccccggugccugaagaccagagcuuguuccugauccuggaguccguucaggucccuggccacccagcaggcuugggcuaaguggaaguuccaggucccgaggcuuucggcccuucugcgguugggugaucucagugguggaaguggagaggccacacaccugggcuguguucucuguuaggauggcugggagccgagccagcaggccuucugaggcugagacuucugguucagcuuugacagcuucugaacugaagccuccagcccuugcagcuuccaauucuuccuuaggccccuccacuuugacuucugggggcuguggauggccaaaacuuggguccagacucaacucuucggauuucugguuuggggccucuggugggguuaggauaaccuggaaaaggggugugugcaaagggaaugcauaggauuguucauguguaaaaccuuucucugugggucauccaagaaugucucugggugagacucuagaguaucagugucauccaucuucauacccacauuaaucagaaacuuuggaaaugggcccaagcaacuuuaaggccacucucgugacuaugaugagugcuaaagcaugacaaucagcacauuagaugugacccuguaagggacuaauguacacauuagaugugacccuguaagggacuaauguacaaggagaggcauaacuuuccuaucuauuucucugagagaacuuguauccccucuuccgccucuauguccuauaccaggacaccuaucucuauucuaugaguucugugcuucauuucagaaugaugcauccuucuccaagcccuuuccuaaauuuccaaguuccaguacucaccugcaggggcagaccagccucuucugcuuccaaacaggcuucuaagggguuuggacuggugcuccugcucccugaggcgggugcugguacuccugcagggguaguguugggaagcacugaggcaggccgaggaggaauggguggcuguggcuguggcugcagggauuguauugugaagguagaauagaggcccgagcgcauguauucauuccggcugcuucgugcuaagccaccuuggccugucauuccugcacccuuugguguuccuggcuuuccaguggcaguguccccugggccugcauggacaguagcaggggccauggcuauggccgagguuacagacaccucaggcuggggugggcagucuucaguggagcacccugcaaccucuggguaggacacaaacuuguagacaaacuucuggccgcucaccuugcggaugauauucugagaagugaagaacagggugaauggagggucuugagggcuguuucucuucuccugaugucuuucuuuccacuugcuccuauuucacuccucucuuuuaggcuuguggagucuuuccaucugucuaugcuuuccuuucuuccccacucucugcaucccucugcaguuucaacuccuucucugggcuuccuuuaccaauucuuucuuuagugucccucccacccauuucccuucaagucuuuuucuguuauucaucuucaucagucuaauuccccuuuuuccacugacuacauuucaucagggaccaauuuaagggaaugggugagaucuaugaaccuggguuuaacagagucagguuuguuuuggaaauguuaacaggacugcaguaauaaaaugaaguaacugauacauguuggaagagacuaaacuaguauagaugaauagggagagaaauaccaagauugauacagagggcugacuguugugggaaggggaacugagggugacugacugauugugggguauaaguguaccauagcacauagacaggucagaggaggacaaauugcagaagaugguugucccuucuaguaugugggucccagggauugaacucagguucucaggcuuggcaacaagagccuuuaccugcuaagccaucgccuuggccagagcuaguggauuuuuaaaagcuagcgaugcugacauggagcagaaaaagcauguugguuauuuguuuuuguuaacuugacacaagccagagucauuuaagaagagaaaaaaaaaugccucuuucagauugucuuuaggcaagucaguaggcauuuuccugcuguagguggugcuuucccugggaaggugguccugggcuguguaaaagagguagcugaacaagcuaugaaaaacaagccaguaagcaguauuccuccauggacuuggcuucaguuccuguuuccagguuccuaucuugaccucccucaaugauggaccuugcuaagccaucucacuggaaagagagaguggauuuuucaagaugaaguaaagccuuuccuccucaaguaacuuuuggucaugguguuuauuacagcagcagaaagcacacuaugacagaaauuaguaccacacagggcuuacugcggugacagaccugagcguguuguuuuggaaagagcuguggcagcaucuggaacuuuugcuagcaucugaacguuuguucagagcuuuagaugagagaugccaagggaacuuggaagauaauucugauagcagugcagaugguggagggcuggcuugugaagguucagagggaagucugagagccccucagucucuauaggggucauuuaugugauauuuuguauuaagacucugguuucugguuaccacagaaccagaaggaucagcugugauuaacaagagaccagcaucccugaagugaaaucuugacuuuacugggacaaccgagaguaauuagcagaggcugacaaaaaaucagcugugaguagagaucagcaucacugaggugaaaucuuucaggaaguauuuucucagggucaguacacagaaccugugguccagaggagccaagaaugcauauuaugcugguagcuugaacuuggcaauguguaagaagagucuuccacaugguauuuggcauaaaagccucaugccaagggguuguggagagcagcugaggccugguacuuugaaaggcuaggagaagucacuggugaagaugaaaccucaguugcaauagaugcuccaggauugaaagggucauggagagaagcuggggcuugguaccauauaauaggguuggaaucccuguagagaggcuaagaggccaguggugagggugcauccucaguugcagugaagaccccagccuauuggagaagcaaagacugugggacaccacuuagaauggugaaaguaugauauggagcuagacucaggccaggagaugcaguuggugcagcuguagcaguggagcugcccaagcucucuggagccuaaaagaucaugagugagucccaggugccagaucuucaucugcagaucuugacacugcuacaguuuggucauguuuugaucugauuguaacuggcucuuuccucuuggaguaagaguaaauaagugcuuauuuuuuauuuuauaggagcugacaguugagagauacuagauauuuuagagacauugaaucuuugaaguuuuaaaaggacuuucaaaguuauacuauguuuuauuuugugauacugauauuaacaugagaucuuggggauaaauacaaaguuaacaauuauacuuuaacagugucaagaugacaaaaagagacaaauguccugguuagcuuuuugucaacuugauacaaacuacaguuaucuaggaagaaagaccuucaauuaagaaaguacugccaucagacugccuguaggcaagucugugggacauuuuacugauuagugauugaugugguaggggccagcauacuuagggugguaccacccuugggaauguggucaaggguaguauaaaaaaaaagcacacugagugacccaugggguagcaagccaguaugcagccuuccucuauggccucugcuuuagcuucugccuccagguuccugccuugaguucuucccuuggcuucccucaaugauggacugugacauggaaguagaagagaaacaaacccuuuccuuuugaucaucaugcuucugcuaacaagagaauacauuaggacagaaauaucacaaaagaggacaggugauguuuuauuauuaguaccauucuggauauuuaagcuaaaguacuaagaaaaugagguaacuggcaggaauuagagaagagaguaagaagcugguguaaccaugagggggauagcaagguuuguuugggugggucagaaaacaugguuuggacgguuucagggaugucuugguggucucgggacaaaacgaggcauuauuuuggagauuugaacugaaagaguaauguaugaaacuggaauauaugccauaaacuaccgaggacagaaagcacaggugagaacuauuuggggugguggcaugaagaauauggggcacuaggcauuuuggugaaugucuuaaugcuggccauaggggauccuuguauuuuacagaaaaugaaggaaaauggguaauuauuaauauuguuuugaagguuuacccugaagaaauaugaaauaauuagugcacauauuggugggaauacaaugcagaucugggagcuugagagaguaagaugagaaaaaucuaaaaauugagucccuguaagaugaugaacuaaagcaagugauauagauacugaggcgcugcucuagggaucuaagagggguggguaugagcuggcacuacaaacauuuuucuggagcauuuacuuaaaggcaaagauuuguaaucuuagcacucaggagacuaagcaagagaaaugcaaguuugaggccaucuucagcaacacaaagagagccugccucaaaaauaaaaacaaaacaaaacaagugauuaaagauauuggggguucuagaaaauggaguaaggaaacuuaguauuacaaugucgggaugauucugagucuaggaauaagaacauggauuuuucgguaguaagagaagauaaaguaacuaggggaaucuaacauuggucugaggauucugaaaaacacaccuauuaucuccaggcaugcagggaacuagaguauagggccaaaauuaguaaguuuuaauacugucuucaaaguuauagcuauacuaauugagacaacaaaaugaaauuucuaggccugaaguguaauuccagaaauuggggguagagacaggacagugaaacugaggccagcuuaggcuacauaguuaaguuccagacaaaucuagacuacauuauaagaccuugucucaaaaggaaaaaaaaaaaaacagaguuuuuccgacaguaauuucaaggguuugcaguccuggucuuugaggccauaccuuaucauaguaguaccgcaaggcccggcuaagcuugucguaauucauguuggucuuguucuugcgcaguccccauagccgggccaccuccucugcauccaccaacuugaacucaccaccaucccgugagguccaggagaugauguggccauuaccuuguucucucagaagcugcagcagaaacugccacagcgucacagauggguccaucacuagggaagcacucacgccauuccaggaguaccuggaagagagcaaaaaugauucguuucuuguuaccuugccuccacaucuguucccaaaucucacuacuauucccuaaacagucuccuaaacuucuucauguagcuuuggaugccccuuguauuuuacaugugugacaaaaaagaauuaaaggaaaaaauaugugaguauguccaugugacuauauguacacaugugugcuggugccaagagagaucagaagagggcaauggauucccuggagcuagaguucaggcaguuauaaacugcccaacaugggugcugggaacuggacucugcuucucugugagagcagcaagcauucuuuauauugagcccucaguccagccuugaugcaugugaaucuuuaggagccagagggaagacagaauacaacccgagccccaaagaguuccauauccuaguuauuggagucugugaccagguuaggcuacauagcauaaaugaauucugagaugaaauuaagauuacagaccuuaagauauagcaaucacucuggcuuuauuugaggucaaccacuguaugagcucuuuucaaagcagagaaaugaggcuaaaacagaguuuagggcagaauggcagaaggacuuucucugcuauuucuugauucuggagaaggcucuaagacaggaaaauugggcagcuccacaaaucuggaaugacccucagcuuaaagccaguaaggaaaucagcauuacaacuaaagggacaaccugaaugagcaggaaacaaaccucuucuagaaaggacuaaaaguccugcuagacuuuaaugcuagccuggcaagaucaguguugggcuucugucagaugauaaauuauauauuuuuuuaaaugacagagucuuacuauguagcccgggcuggucuugaacucuugccucagcuuccugaguacugggaauacagguauguaccaaugcaucuacagaaauguauaguuucaaugagaauaaauuauauagcgggacuagaaaacuaguguaauauccauaacuuaacucacauuaacucucucucucucucucucuccccuuuccuaucaacuuuucuaggaugugccuuuugguagcccuuugcaaguacuguucacuguacauggagcuccuuuccucuuugagcagucguccucuaaaaacgacgaagaggacccacugaaaaguccuuugcguuaugaagccuuccugaaucugaauacguacucuucucuguuccuugaucccccaauuuuucuaaccugggauuguuccuguacgguuuaagcguuuaaauuuuuuucuuuuugaugagcauauauuaauuauacauaguggguuucuauuauuuauacauaauggguuucauuauaacauuucuuuuucuuucuuuuuuuuuuuguuuuuguuuuuuucgagacaggguuucucuguguaguccuggcuguccuggaacucacuuuguagaccaggcuggccucgaacucagaaaucaacuugugucugucucccaagugcugggauuaaaggcgugcgccaucauuauaccauuucuaauauaaugacuuugauuaaauuucccuccauuaaccuaucccguuccccucccuucccacugauuaucuuccucuucccaacuaggcuucuuuguauauuaugacuuuuuugugauccaaugaauuuuaguagaguugcuuacaaggccauggugaagguuuguuuucaggaacauggacccugcaucacugaaguaaccauuaaaggccuuuagauccacaggaaaggaugaggccacaugaaucuucucucucucucucucucucucucucucucucucucuuuuugccauuguugcugcugcauugugauaggguauuauguaguucaagcuguccucaaguuccugaugcuauuguuuccauuucccaagugcugagauuacacacaccccagcaaacaaggcagcuacuucuuucuguagugcuagagaucaaauccagggacuuaugcauguuaaguacaagauuuaucacagagcuucacccggaacccaugccuuuuaauuucuuuuuauuuuuauuggauauuuuauauauuuacacuucaaauguuauccccauuuccaguuuucccucugggaacccccaucccauccucccucccccugcuucuaugagggugcuuccccaccccccaccccgccucuccacccuacacugggacauugagccuucucaggaccaagggucucuccucccauugaugcccgacaaggccauccuuugcuacauauguagcuggaaccaugggucccuccauguguacucuuugguuggugguuuagucccugggagcucugggggggucugguugguugauacuguuguucuuccuauggggcugcaaaccccuucagcuccuucaguccuuucucuagcuccuccauugagaacccugugcucaauccaaugguuggcuaugagccuuuuuaaaaacaaguauguauuuacucuuuaugugaagcacugcucuaagcagaaagccaucuugccuacugcacaaucaaccuaaacuguuagacuuuuaugguuuaaauccuggaucugcuaguuauuagcugugggauuuuggccaauucauuauacuuauuuuguauuacaaaucuucucaucugugaaacagggauaguaauauacuuaucuauagagaccauguaucauuauuauuaugugaauuuuaaauuuaacaugcuuggguuauaaacuuuacauaaauauuuucuaauuuguucacaaaucuuuuuuucugcuauuccuuaauccaaaacagucuaagaacgaaggcuucuuuuuaguucuuuuggcaacaaaacaugauuggaaagaaagcaaggcccauucugguuuuuauugaucuuugcuuaguaugacuguucauacauuuuggugcagcgaucuaaaagcagcuggugacagagcugguugaagguguuauguaacaugucauaugugcaccaugcuaccuuucuaaacugaaaaauucacaauucugaaauauaacuggucuaugggguuuuagauaaaggcaugggcuguuauuuuuauaggcacugacucacuuaucucucaucccaacucagaaaaauaggcauuuuuuuccuuuuggaaaggagauauucuuauuacaauaucacuaauuuuacacaagggaaaagauguccaagugacuucacuguugugacaguuccugcauuugacccaaguaucacccuucaggggucuaagugguuuuguuauuuauuuauuuuuagagacagggucuagauagcccaggaaagccucaaacuugccauccagcugaggaugaccuugaacuccuguuuuaccugcuuccacuucccuaguacugagauacuuggcaugggucaccaugaccaguuucaggagucugagcauuuaaccaccugcaucagauccuuuguguauauauuauggcuuccaauuuaguguuuuaugggauucccuaguguucaaaugaaugggucuguuucuugggccuucucuugggcucuuuuucuuuucuuuuauuauauuuuauuauuaucucuuagaagccuguucuguuccuuuccuuucuuuccuuccuguuuuuauuuugagacagggucuguauaguacuggauguccugaaacuagcaagauggccuuggccucagcgauccaccugccucugccuccugagauuugggauuaaaggcacuugcuaccacugccuggcuuuuuguuguuguuuuuuugagacagggccucuuggcugcccuggauuaaaggccuguaccacaccaugacuacccugcugccuguuuguuuucuaaugggaggggaggugggaaagaacugggaggaauacagaugggggcaaacuguaagauaucuauagguagauaucuauaccuauagauaucuuacaguuuauggggauagagagaaaucuauguucaauaaaaaaagcaaaacaaauuaucaccucauuagaaggauguucacuguucaccuguuauccuaccauuacccuuuccuauaaccaaacuggaacuaacacugaaccugcuuaagucccugcaaggaugggacuuaaucaaccagcuguccaccuggcucggauuguuggauuaaggauuaagaauaaaccuuuuaagguuuugaagaaccuaugauuuagauuuauagcuuuauucuuuaaucugcaugaaauuauaguaugauccucauaugucugagccaguucaagguucuuuuagcagaaacaguguuaggcagcuguccaaauuagagugccgagggacaguggaucagagucccgcccccgccccccccagcucuaagggacuaaauauucccaacaccagauucuuucagaggccuauagagugcagugugaccccuaguggcaaaaacaggcaauuucaccgccuccucugagcuaugccagaacccagcagcugagugaaaucugaucaacuacuagcuuaucaaagagacaggcugaauuugauugcugcuuuuuuuuuuucccacacaggccuuaccaggaauccuaguuaccugcccuucccagaaggcuuucuuuccacuccucaccucauucucugggugccuuaaaacagcuuaggacacaacagacaggagcccuugcauauuauaauccacacauucauagggcaguaagaaaugucucaaaaaaaaggaagaaaacaaaauaauaauacccuccaaaagguggacuguauuaugcuucccauuuugcagacaagugagugaaguguggagaaagauguuaaguaaccugccuaaggucucacccuuggaggagcugcuggaugcuggcagucaaacugagcaccccuagccaaucaaggccaguucucaaagaaaacauaaacaggcaagaucccagagugacaaguaggacacuucccugaagaagcgauguuugguggaggggagguagcaagucauauugauguccaugggaaggauaauucugauaaagagaaaagcauauauaaaagcucuaaagugucuaccugaggccauaauguuucuugccagguagaguuuuuccucugcacgauccaaugcauggaguaacuuguuuguucuugcaaaguuguucugugcugaucuucacagccucauacucugcccuguucugccugugugacuuugagcaaguuguucaaccucucuaugccuuguucuauaucuguaaaauaggguaucuuacucucaaaucaaaaaauacuuuuuaaaaaugaggacucaaugugucucuauauauguaaaguacuuagaaaacugucuguagcacaugcuagaaaugcaauaaacauuagcccuuagguuguauggcauccuucucccucccccuuaacuuucuguacgacuucaccaucuggcuuccauaauuucuaugaccuugacuucuaucccucccucucaacuuguuuccagucacacuggcuuuugaacaugguagccauaaucugggcuucagggucuuugcauugaguguucuuucugguacauucuuccuuuacacaauauggcuuacuccuuuguuucuuucaggccuuaacuuaugagucacauuuccaaguguagcaugccuugucucuaagaguucaaauaccuugauacucuaguccuauuugccccacuucaugucuguuccuuagccuuuguauaaugugguauuucauuuuaccuaucuauacagucugucucccucacuuuuaguaaugccugccugcuuucuauguacagggauuucugccuguuuugcuucucuauaucuccagcaucuacaauaagugccugguacucacuaggugcuuaguaaauagcuguuaaauauuuaaaaagucguaacugacaucuuaauuaauuccuacauucccuuuuuuaucugcacuccccuuggugaugucugggauacaauuuucauugucaguuuugugacagcaucucacucuguaguucagguuggucuggaauucgcuaugucacccaggcuaguuuuuauuuccuguaaauucucucuuggucuuccaugcuggaaauauauagccgugagccaucauucaucgucuagauacuacaccccccaaguuaauuugugcagcagauuauuccaagcaccuacuguacagagguauauuuuuacaugaagggcagauaaagccuguaaguucccauaggauguuuauucugaggaggauagacagauaucuauuuauauaagcuauauagcaugucuaaccaugacagaguauaaagggccaaagcaagcaggaaagagaucugaacccugcucgguauacaaaaucagauagucaaagagagguggguguugacuacuuugauacaaaaaaugauauuugaaaccuuuuuauguauauaccuuuauacauuauaucccaagcaccagugugacaaauacauguuuuacuaaaauuacacuacccaagaugcaaagacaugaaagcacucucugaaacaucuuuucuauuugugccuuuucauaucaccaacaucacauuuccuuuacgcucauuuuauucacaaaucaaaugacauucuuacaaauaucuuuaguguguucccugcacaggguagugaaaaaauuccuuuggguauggcaaguguacaguaccuugaaaguuaccauacagagaugugggaguaguguuaauggagaaagaagagcuaaugcaaaggcccugaggcuggccuguaccggcuguuuuugagaagcagugagguuagcauggcuauagcauggaucugaaauguggagaugaaagagauaaggucagugaggugacuuguuuaacccacacauuuuuuucacacuggaaaggcuauaguucugacucccccauuuuagcccaguacaggaagaaaguaguuaagucauucauguaaagucacaccacugcuaggacuugagcugauggguccugagaacagaguagaauggagacagcucuguugucagaaagaacagcagaaacaaaagcugggugauugaaacuaauuuggcuguuaaggaaugugcccucauaugggaugcaaugaggugagagaggggcaugucaaaaguguuccccuaucuaaguaguuauugggccaucugugaacccacaugcccuaguuuucucaguuaucugucucacagggcuaugaugaagacuggagacuauaagcaagcuggagacuauagaauacugccugguacacagcaaguguaaaguauaaaguuagauccgacugucauuagcaauaguaccacuacuauaguugagaacuauagcaaaguaaaaugccuaguggcuaagaguguuuaugagggcugggcagugguggcacacgccuuuaaucccagcgcuuggguggcagaggcaggcggauuucugaguucgaggccagcuuggucuacagagugaguuccaggacagccagggcuauacagagaaacccugucuugaaaaaaaaacaaaaaacaaaaacaaaacaaaaaacaaacaaacaaaaagagaguuuaugaggaacauggcauauauuaaaagucccuggguuuuacaaguacacaggacuuccuaggagaugggggcagagaagacugacccaauacauaggaggaggaggagggaaauaaaguacaaagccuaucuauccccuuuggggagggauugcaagcucugaggauuugagagacuguaaacacugggguggcagaaggcuucugaacagacucauucauuacaaaagugagaugugguuuaagcugauaccuauacaaccgcagagaagaaaagccaucacauaauaauuaauuaaagugaaggauaggacaaggccauagacugggcuguugaaaaugaaaauaaaaauugcaaagcaccaaacugacccacuguuaaaaggaagcagcucaaagacuggagucuacaaauaagggagaaaaguuagggcggugauaacuagaggaauaugaaugcaagcaugcaaacuaauucacaguaagaugggggcaaugggaggagguggauaaagucaugggcuuaugcacuggggacucaaggggggcaauaauguaaacuuagguggacucacuguugaacaaacaauggggugucuuaagugggaacagugccacagauugauucacuacaauaaacaugagggguucaguaaacaaagccacagaagguuccccuuaaauuugaggcuaggggaaauggaaacacuuuagacacagcuacgacuaaagggggacuggacaaugcaacagacugguuuccaauaaguggggguuggggagggcaagaccacggacgaguccauuaaguugggguggggaaaaucauaagcucacagacagauccauuauacagacagcaggauguuagcccacguucagaucuacuauaaagggcaaaaggagcaggcaaugcacacacaggggcaaucaguugaugguaguggagccaaauaccagcaggcugggccaaaccacaucccuugcgcgggggugaggauacguggggucauggacaggguccuccaccuugugggccugggcucaccugcgaguggcgcggcgguggcaguggcagcuccggggggcgggggcuccauacgaggccccaccgccccccaggccccgguuccaaggcggcggcggugguggcggcgacagcagaagcagcaaccagaagccgccccugcguuuccccaccgcucacgu

SEQ ID NO: 12262 - RNA, 17207 nt, Mus musculus
acgugagcgguggggaaacgcaggggcggcuucugguugcugcuucugcugucgccgccaccaccgccgccgccuuggaaccggggccuggggggcgguggggccucguauggagcccccgccccccggagcugccacugccaccgccgcgccacucgcaggugagcccaggcccacaagguggaggacccuguccaugaccccacguauccucacccccgcgcaagggaugugguuuggcccagccugcugguauuuggcuccacuaccaucaacugauugccccugugugugcauugccugcuccuuuugcccuuuauaguagaucugaacgugggcuaacauccugcugucuguauaauggaucugucugugagcuuaugauuuuccccaccccaacuuaauggacucguccguggucuugcccuccccaacccccacuuauuggaaaccagucuguugcauuguccagucccccuuuagucguagcugugucuaaaguguuuccauuuccccuagccucaaauuuaaggggaaccuucuguggcuuuguuuacugaaccccucauguuuauuguagugaaucaaucuguggcacuguucccacuuaagacaccccauuguuuguucaacagugaguccaccuaaguuuacauuauugccccccuugaguccccagugcauaagcccaugacuuuauccaccuccucccauugcccccaucuuacugugaauuaguuugcaugcuugcauucauauuccucuaguuaucaccgcccuaacuuuucucccuuauuuguagacuccagucuuugagcugcuuccuuuuaacagugggucaguuuggugcuuugcaauuuuuauuuucauuuucaacagcccagucuauggccuuguccuauccuucacuuuaauuaauuauuaugugauggcuuuucuucucugcgguuguauagguaucagcuuaaaccacaucucacuuuuguaaugaaugagucuguucagaagccuucugccaccccaguguuuacagucucucaaauccucagagcuugcaaucccuccccaaaggggauagauaggcuuuguacuuuauuucccuccuccuccuccuauguauugggucagucuucucugcccccaucuccuaggaaguccuguguacuuguaaaacccagggacuuuuaauauaugccauguuccucauaaacucucuuuuuguuuguuuguuuuuuguuuuguuuuuguuuuuuguuuuuuuuucaagacaggguuucucuguauagcccuggcuguccuggaacucacucuguagaccaagcuggccucgaacucagaaauccgccugccucugccacccaagcgcugggauuaaaggcgugugccaccacugcccagcccucauaaacacucuuagccacuaggcauuuuacuuugcuauaguucucaacuauaguagugguacuauugcuaaugacagucggaucuaacuuuauacuuuacacuugcuguguaccaggcaguauucuauagucuccagcuugcuuauagucuccagucuucaucauagcccugugagacagauaacugagaaaacuagggcauguggguucacagauggcccaauaacuacuuagauaggggaacacuuuugacaugccccucucucaccucauugcaucccauaugagggcacauuccuuaacagccaaauuaguuucaaucacccagcuuuuguuucugcuguucuuucugacaacagagcugucuccauucuacucuguucucaggacccaucagcucaaguccuagcaguggugugacuuuacaugaaugacuuaacuacuuucuuccuguacugggcuaaaaugggggagucagaacuauagccuuuccagugugaaaaaaauguguggguuaaacaagucaccucacugaccuuaucucuuucaucuccacauuucagauccaugcuauagccaugcuaaccucacugcuucucaaaaacagccgguacaggccagccucagggccuuugcauuagcucuucuuucuccauuaacacuacucccacaucucuguaugguaacuuucaagguacuguacacuugccauacccaaaggaauuuuuucacuacccugugcagggaacacacuaaagauauuuguaagaaugucauuugauuugugaauaaaaugagcguaaaggaaaugugauguuggugauaugaaaaggcacaaauagaaaagauguuucagagagugcuuucaugucuuugcaucuuggguaguguaauuuuaguaaaacauguauuugucacacuggugcuugggauauaauguauaaagguauauacauaaaaagguuucaaauaucauuuuuuguaucaaaguagucaacacccaccucucuuugacuaucugauuuuguauaccgagcaggguucagaucucuuuccugcuugcuuuggcccuuuauacucugucaugguuagacaugcuauauagcuuauauaaauagauaucugucuauccuccucagaauaaacauccuaugggaacuuacaggcuuuaucugcccuucauguaaaaauauaccucuguacaguaggugcuuggaauaaucugcugcacaaauuaacuugggggguguaguaucuagacgaugaaugauggcucacggcuauauauuuccagcauggaagaccaagagagaauuuacaggaaauaaaaacuagccugggugacauagcgaauuccagaccaaccugaacuacagagugagaugcugucacaaaacugacaaugaaaauuguaucccagacaucaccaaggggagugcagauaaaaaagggaauguaggaauuaauuaagaugucaguuacgacuuuuuaaauauuuaacagcuauuuacuaagcaccuagugaguaccaggcacuuauuguagaugcuggagauauagagaagcaaaacaggcagaaaucccuguacauagaaagcaggcaggcauuacuaaaagugagggagacagacuguauagauagguaaaaugaaauaccacauuauacaaaggcuaaggaacagacaugaaguggggcaaauaggacuagaguaucaagguauuugaacucuuagagacaaggcaugcuacacuuggaaaugugacucauaaguuaaggccugaaagaaacaaaggaguaagccauauuguguaaaggaagaauguaccagaaagaacacucaaugcaaagacccugaagcccagauuauggcuaccauguucaaaagccagugugacuggaaacaaguugagagggagggauagaagucaaggucauagaaauuauggaagccagauggugaagucguacagaaaguuaagggggagggagaaggaugccauacaaccuaagggcuaauguuuauugcauuucuagcaugugcuacagacaguuuucuaaguacuuuacauauauagagacacauugaguccucauuuuuaaaaaguauuuuuugauuugagaguaagauacccuauuuuacagauauagaacaaggcauagagagguugaacaacuugcucaaagucacacaggcagaacagggcagaguaugaggcugugaagaucagcacagaacaacuuugcaagaacaaacaaguuacuccaugcauuggaucgugcagaggaaaaacucuaccuggcaagaaacauuauggccucagguagacacuuuagagcuuuuauauaugcuuuucucuuuaucagaauuauccuucccauggacaucaauaugacuugcuaccuccccuccaccaaacaucgcuucuucagggaaguguccuacuugucacucugggaucuugccuguuuauguuuucuuugagaacuggccuugauuggcuaggggugcucaguuugacugccagcauccagcagcuccuccaagggugagaccuuaggcagguuacuuaacaucuuucuccacacuucacucacuugucugcaaaaugggaagcauaauacaguccaccuuuuggaggguauuauuauuuuguuuucuuccuuuuuuuugagacauuucuuacugcccuaugaauguguggauuauaauaugcaagggcuccugucuguuguguccuaagcuguuuuaaggcacccagagaaugaggugaggaguggaaagaaagccuucugggaagggcagguaacuaggauuccugguaaggccugugugggaaaaaaaaaaagcagcaaucaaauucagccugucucuuugauaagcuaguaguugaucagauuucacucagcugcuggguucuggcauagcucagaggaggcggugaaauugccuguuuuugccacuaggggucacacugcacucuauaggccucugaaagaaucugguguugggaauauuuagucccuuagagcuggggggggcgggggcgggacucugauccacugucccucggcacucuaauuuggacagcugccuaacacuguuucugcuaaaagaaccuugaacuggcucagacauaugaggaucauacuauaauuucaugcagauuaaagaauaaagcuauaaaucuaaaucauagguucuucaaaaccuuaaaagguuuauucuuaauccuuaauccaacaauccgagccagguggacagcugguugauuaagucccauccuugcagggacuuaagcagguucaguguuaguuccaguuugguuauaggaaaggguaaugguaggauaacaggugaacagugaacauccuucuaaugaggugauaauuuguuuugcuuuuuuuauugaacauagauuucucucuauccccauaaacuguaagauaucuauagguauagauaucuaccuauagauaucuuacaguuugcccccaucuguauuccucccaguucuuucccaccuccccucccauuagaaaacaaacaggcagcaggguagucauggugugguacaggccuuuaauccagggcagccaagaggcccugucucaaaaaaacaacaacaaaaagccaggcagugguagcaagugccuuuaaucccaaaucucaggaggcagaggcagguggaucgcugaggccaaggccaucuugcuaguuucaggacauccaguacuauacagacccugucucaaaauaaaaacaggaaggaaagaaaggaaaggaacagaacaggcuucuaagagauaauaauaaaauauaauaaaagaaaagaaaaagagcccaagagaaggcccaagaaacagacccauucauuugaacacuagggaaucccauaaaacacuaaauuggaagccauaauauauacacaaaggaucugaugcaggugguuaaaugcucagacuccugaaacuggucauggugacccaugccaaguaucucaguacuagggaaguggaagcagguaaaacaggaguucaaggucauccucagcuggauggcaaguuugaggcuuuccugggcuaucuagacccugucucuaaaaauaaauaaauaacaaaaccacuuagaccccugaagggugauacuugggucaaaugcaggaacugucacaacagugaagucacuuggacaucuuuucccuuguguaaaauuagugauauuguaauaagaauaucuccuuuccaaaaggaaaaaaaugccuauuuuucugaguugggaugagagauaagugagucagugccuauaaaaauaacagcccaugccuuuaucuaaaaccccauagaccaguuauauuucagaauugugaauuuuucaguuuagaaagguagcauggugcacauaugacauguuacauaacaccuucaaccagcucugucaccagcugcuuuuagaucgcugcaccaaaauguaugaacagucauacuaagcaaagaucaauaaaaaccagaaugggccuugcuuucuuuccaaucauguuuuguugccaaaagaacuaaaaagaagccuucguucuuagacuguuuuggauuaaggaauagcagaaaaaaagauuugugaacaaauuagaaaauauuuauguaaaguuuauaacccaagcauguuaaauuuaaaauucacauaauaauaaugauacauggucucuauagauaaguauauuacuaucccuguuucacagaugagaagauuuguaauacaaaauaaguauaaugaauuggccaaaaucccacagcuaauaacuagcagauccaggauuuaaaccauaaaagucuaacaguuuagguugauugugcaguaggcaagauggcuuucugcuuagagcagugcuucacauaaagaguaaauacauacuuguuuuuaaaaaggcucauagccaaccauuggauugagcacaggguucucaauggaggagcuagagaaaggacugaaggagcugaagggguuugcagccccauaggaagaacaacaguaucaaccaaccagacccccccagagcucccagggacuaaaccaccaaccaaagaguacacauggagggacccaugguuccagcuacauauguagcaaaggauggccuugucgggcaucaaugggaggagagacccuugguccugagaaggcucaaugucccaguguaggguggagaggcggggugggggguggggaagcacccucauagaagcagggggagggaggaugggauggggguucccagagggaaaacuggaaauggggauaacauuugaaguguaaauauauaaaauauccaauaaaaauaaaaagaaauuaaaaggcauggguuccgggugaagcucugugauaaaucuuguacuuaacaugcauaagucccuggauuugaucucuagcacuacagaaagaaguagcugccuuguuugcugggguguguguaaucucagcacuugggaaauggaaacaauagcaucaggaacuugaggacagcuugaacuacauaauacccuaucacaaugcagcagcaacaauggcaaaaagagagagagagagagagagagagagagagagagagaagauucauguggccucauccuuuccuguggaucuaaaggccuuuaaugguuacuucagugaugcaggguccauguuccugaaaacaaaccuucaccauggccuuguaagcaacucuacuaaaauucauuggaucacaaaaaagucauaauauacaaagaagccuaguugggaagaggaagauaaucagugggaagggaggggaacgggauagguuaauggagggaaauuuaaucaaagucauuauauuagaaaugguauaaugauggcgcacgccuuuaaucccagcacuugggagacagacacaaguugauuucugaguucgaggccagccuggucuacaaagugaguuccaggacagccaggacuacacagagaaacccugucucgaaaaaaacaaaaacaaaaaaaaaaagaaagaaaaagaaauguuauaaugaaacccauuauguauaaauaauagaaacccacuauguauaauuaauauaugcucaucaaaaagaaaaaaauuuaaacgcuuaaaccguacaggaacaaucccagguuagaaaaauugggggaucaaggaacagagaagaguacguauucagauucaggaaggcuucauaacgcaaaggacuuuucaguggguccucuucgucguuuuuagaggacgacugcucaaagaggaaaggagcuccauguacagugaacaguacuugcaaagggcuaccaaaaggcacauccuagaaaaguugauaggaaaggggagagagagagagagagagaguuaaugugaguuaaguuauggauauuacacuaguuuucuagucccgcuauauaauuuauucucauugaaacuauacauuucuguagaugcauugguacauaccuguauucccaguacucaggaagcugaggcaagaguucaagaccagcccgggcuacauaguaagacucugucauuuaaaaaaauauauaauuuaucaucugacagaagcccaacacugaucuugccaggcuagcauuaaagucuagcaggacuuuuaguccuuucuagaagagguuuguuuccugcucauucagguugucccuuuaguuguaaugcugauuuccuuacuggcuuuaagcugagggucauuccagauuuguggagcugcccaauuuuccugucuuagagccuucuccagaaucaagaaauagcagagaaaguccuucugccauucugcccuaaacucuguuuuagccucauuucucugcuuugaaaagagcucauacagugguugaccucaaauaaagccagagugauugcuauaucuuaaggucuguaaucuuaauuucaucucagaauucauuuaugcuauguagccuaaccuggucacagacuccaauaacuaggauauggaacucuuuggggcucggguuguauucugucuucccucuggcuccuaaagauucacaugcaucaaggcuggacugagggcucaauauaaagaaugcuugcugcucucacagagaagcagaguccaguucccagcacccauguugggcaguuuauaacugccugaacucuagcuccagggaauccauugcccucuucugaucucucuuggcaccagcacacauguguacauauagucacauggacauacucacauauuuuuuccuuuaauucuuuuuugucacacauguaaaauacaaggggcauccaaagcuacaugaagaaguuuaggagacuguuuagggaauaguagugagauuugggaacagauguggaggcaagguaacaagaaacgaaucauuuuugcucucuuccagguacuccuggaauggcgugagugcuucccuagugauggacccaucugugacgcuguggcaguuucugcugcagcuucugagagaacaagguaauggccacaucaucuccuggaccucacgggaugguggugaguucaaguugguggaugcagaggagguggcccggcuauggggacugcgcaagaacaagaccaacaugaauuacgacaagcuuagccgggccuugcgguacuacuaugauaagguauggccucaaagaccaggacugcaaacccuugaaauuacugucggaaaaacucuguuuuuuuuuuuuuccuuuugagacaaggucuuauaauguagucuagauuugucuggaacuuaacuauguagccuaagcuggccucaguuucacuguccugucucuacccccaauuucuggaauuacacuucaggccuagaaauuucauuuuguugucucaauuaguauagcuauaacuuugaagacaguauuaaaacuuacuaauuuuggcccuauacucuaguucccugcaugccuggagauaauagguguguuuuucagaauccucagaccaauguuagauuccccuaguuacuuuaucuucucuuacuaccgaaaaauccauguucuuauuccuagacucagaaucaucccgacauuguaauacuaaguuuccuuacuccauuuucuagaacccccaauaucuuuaaucacuuguuuuguuuuguuuuuauuuuugaggcaggcucucuuuguguugcugaagauggccucaaacuugcauuucucuugcuuagucuccugagugcuaagauuacaaaucuuugccuuuaaguaaaugcuccagaaaaauguuuguagugccagcucauacccaccccucuuagaucccuagagcagcgccucaguaucuauaucacuugcuuuaguucaucaucuuacagggacucaauuuuuagauuuuucucaucuuacucucucaagcucccagaucugcauuguauucccaccaauaugugcacuaauuauuucauauuucuucaggguaaaccuucaaaacaauauuaauaauuacccauuuuccuucauuuucuguaaaauacaaggauccccuauggccagcauuaagacauucaccaaaaugccuagugccccauauucuucaugccaccaccccaaauaguucucaccugugcuuucuguccucgguaguuuauggcauauauuccaguuucauacauuacucuuucaguucaaaucuccaaaauaaugccucguuuugucccgagaccaccaagacaucccugaaaccguccaaaccauguuuucugacccacccaaacaaaccuugcuaucccccucaugguuacaccagcuucuuacucucuucucuaauuccugccaguuaccucauuuucuuaguacuuuagcuuaaauauccagaaugguacuaauaauaaaacaucaccuguccucuuuugugauauuucuguccuaauguauucucuuguuagcagaagcaugaugaucaaaaggaaaggguuuguuucucuucuacuuccaugucacaguccaucauugagggaagccaagggaagaacucaaggcaggaaccuggaggcagaagcuaaagcagaggccauagaggaaggcugcauacuggcuugcuaccccaugggucacucagugugcuuuuuuuuuauacuacccuugaccacauucccaagggugguaccacccuaaguaugcuggccccuaccacaucaaucacuaaucaguaaaaugucccacagacuugccuacaggcagucugauggcaguacuuucuuaauugaaggucuuucuuccuagauaacuguaguuuguaucaaguugacaaaaagcuaaccaggacauuugucucuuuuugucaucuugacacuguuaaaguauaauuguuaacuuuguauuuauccccaagaucucauguuaauaucaguaucacaaaauaaaacauaguauaacuuugaaaguccuuuuaaaacuucaaagauucaaugucucuaaaauaucuaguaucucucaacugucagcuccuauaaaauaaaaaauaagcacuuauuuacucuuacuccaagaggaaagagccaguuacaaucagaucaaaacaugaccaaacuguagcagugucaagaucugcagaugaagaucuggcaccugggacucacucaugaucuuuuaggcuccagagagcuugggcagcuccacugcuacagcugcaccaacugcaucuccuggccugagucuagcuccauaucauacuuucaccauucuaaguggugucccacagucuuugcuucuccaauaggcuggggucuucacugcaacugaggaugcacccucaccacuggccucuuagccucucuacagggauuccaacccuauuauaugguaccaagccccagcuucucuccaugacccuuucaauccuggagcaucuauugcaacugagguuucaucuucaccagugacuucuccuagccuuucaaaguaccaggccucagcugcucuccacaaccccuuggcaugaggcuuuuaugccaaauaccauguggaagacucuucuuacacauugccaaguucaagcuaccagcauaauaugcauucuuggcuccucuggaccacagguucuguguacugacccugagaaaauacuuccugaaagauuucaccucagugaugcugaucucuacucacagcugauuuuuugucagccucugcuaauuacucucgguugucccaguaaagucaagauuucacuucagggaugcuggucucuuguuaaucacagcugauccuucugguucugugguaaccagaaaccagagucuuaauacaaaauaucacauaaaugaccccuauagagacugaggggcucucagacuucccucugaaccuucacaagccagcccuccaccaucugcacugcuaucagaauuaucuuccaaguucccuuggcaucucucaucuaaagcucugaacaaacguucagaugcuagcaaaaguuccagaugcugccacagcucuuuccaaaacaacacgcucaggucugucaccgcaguaagcccugugugguacuaauuucugucauagugugcuuucugcugcuguaauaaacaccaugaccaaaaguuacuugaggaggaaaggcuuuacuucaucuugaaaaauccacucucucuuuccagugagauggcuuagcaagguccaucauugagggaggucaagauaggaaccuggaaacaggaacugaagccaaguccauggaggaauacugcuuacuggcuuguuuuucauagcuuguucagcuaccucuuuuacacagcccaggaccaccuucccagggaaagcaccaccuacagcaggaaaaugccuacugacuugccuaaagacaaucugaaagaggcauuuuuuuuucucuucuuaaaugacucuggcuugugucaaguuaacaaaaacaaauaaccaacaugcuuuuucugcuccaugucagcaucgcuagcuuuuaaaaauccacuagcucuggccaaggcgauggcuuagcagguaaaggcucuuguugccaagccugagaaccugaguucaaucccugggacccacauacuagaagggacaaccaucuucugcaauuuguccuccucugaccugucuaugugcuaugguacacuuauaccccacaaucagucagucacccucaguuccccuucccacaacagucagcccucuguaucaaucuugguauuucucucccuauucaucuauacuaguuuagucucuuccaacauguaucaguuacuucauuuuauuacugcaguccuguuaacauuuccaaaacaaaccugacucuguuaaacccagguucauagaucucacccauucccuuaaauuggucccugaugaaauguagucaguggaaaaaggggaauuagacugaugaagaugaauaacagaaaaagacuugaagggaaaugggugggagggacacuaaagaaagaauugguaaaggaagcccagagaaggaguugaaacugcagagggaugcagagaguggggaagaaaggaaagcauagacagauggaaagacuccacaagccuaaaagagaggagugaaauaggagcaaguggaaagaaagacaucaggagaagagaaacagcccucaagacccuccauucacccuguucuucacuucucagaauaucauccgcaaggugagcggccagaaguuugucuacaaguuuguguccuacccagagguugcagggugcuccacugaagacugcccaccccagccugaggugucuguaaccucggccauagccauggccccugcuacuguccaugcaggcccaggggacacugccacuggaaagccaggaacaccaaagggugcaggaaugacaggccaagguggcuuagcacgaagcagccggaaugaauacaugcgcucgggccucuauucuaccuucacaauacaaucccugcagccacagccacagccacccauuccuccucggccugccucagugcuucccaacacuaccccugcaggaguaccagcacccgccucagggagcaggagcaccaguccaaaccccuuagaagccuguuuggaagcagaagaggcuggucugccccugcaggugaguacuggaacuuggaaauuuaggaaagggcuuggagaaggaugcaucauucugaaaugaagcacagaacucauagaauagagauagguguccugguauaggacauagaggcggaagaggggauacaaguucucucagagaaauagauaggaaaguuaugccucuccuuguacauuagucccuuacagggucacaucuaauguguacauuagucccuuacagggucacaucuaaugugcugauugucaugcuuuagcacucaucauagucacgagaguggccuuaaaguugcuugggcccauuuccaaaguuucugauuaauguggguaugaagauggaugacacugauacucuagagucucacccagagacauucuuggaugacccacagagaaagguuuuacacaugaacaauccuaugcauucccuuugcacacaccccuuuuccagguuauccuaaccccaccagaggccccaaaccagaaauccgaagaguugagucuggacccaaguuuuggccauccacagcccccagaagucaaaguggaggggccuaaggaagaauuggaagcugcaagggcuggaggcuucaguucagaagcugucaaagcugaaccagaagucucagccucagaaggccugcuggcucggcucccagccauccuaacagagaacacagcccagguguguggccucuccacuuccaccacugagaucacccaaccgcagaagggccgaaagccucgggaccuggaacuuccacuuagcccaagccugcuggguggccagggaccugaacggacuccaggaucaggaacaagcucuggucuucaggcaccggggccagcgcuaacgccaucccugcuccccacacauaccuuggugagugccuugcagaggagcaagggcuggcagccuagaugaguggcauugguacugguaacuuacaagcuguucuugggcuuacgcugaagugauggggcuaauuaagaagagcaggucuuaggucuuuguggcagccugacucccuaaugcuuuccacgggguuugcauaguggguucccuagugagguauauugguggaaucuaagacugggaaguugaguucuuccgguggucacaagguuugagagcagugcauggauagaaucugguggauagucuuaccgaagucucaguaacaggaacugagcuccuagguguaaugauugagggaugucauaggcauggucauaguaguuauacucuagguuuaugaacuuuugaggaguaacuguagaacucugaaggagauccaugaagaggugcugaaaguagguucuuuccaucuucucauacuugucaccuguucacuugaguuccugccacuccgucucuacagaccccggugcugcugacacccagcucgcugcccccuagcauccauuucuggagcacucugaguccaauugcaccccguaguccagccaagcucuccuuccagguaggauugccucccgcucuguuggaagcuuaagaguuacuagcacgguucacccauaaccucuccuugucucuucccccaguuuccguccaguggcagcgcacaggugcacaucccuuccaucaguguggauggccucucgacccccguggugcucuccccagggccccagaagccaugacuaccaccaccaccccuuuuuuggaguccauccaucuaugcuccugaacucuccaguuagccaucucaaggagaaacauaguuaaacugacagacuuaagcucugauuguggugggguggauauuccuggaaaagugaauauuucacuaacuccuccacccaaaacagacaacuucuuucuucuuugccagccucccaguggcugcccuuacacgucuccuacuucaaugguggggcgguuuauuuauuuauuuuuugaaggccacugggaagaaucuggcccaaccuuuuuaggggaguggguaagacaucucacccauuuccuccccauuuuuuccuaaaacaagacaaucagggcauggcuugagaggaaccuuuauuuauuuauuucucagccugcccuuggggaguugagggugcccugucuucauuuugcgacauggguugaagaacuagcuuguuuuguuuuauuauuccuggcuguaucugaguccagggagcccuuguacgauuuaaugguuugggagugguagccagggaaucaacacuguuaaaauaggaauugcuaccucccuaaccuucuucucagucagcuuguucuuuucucaaguaaccuuuuggccagggaggacuauuccuuuuguuguucuuccccccugagaagccauuccuuugucugccaaauuuccuggggcccugccuauuaccucccaauggaggguuuuuuuggguggugguccccgucuggggggccccuccagcuaguacuccaggucucugucucccacccccuuccauuuugauaguauaaucuauuuuuaaauggggcuuuucaauaggggagagggaaacaucucuuccuauaucagauggguggguaggcgggugggugggaaguaagggauuuggaggcggucuuccugccacccccaaguguuuauuuuuuauaccaaacauguauuuuuggcucccucccagccccccaauuuccugcaggcggguacaaaggacccuuuuaagugucccuggaguugggagggaggaaugggggacauggagccugucuuauaucaaucuaggcuggaggagguggaucaaaagacucccaggcucaccuccugucagcacuggcccagaccaggccugaagaccuggggguuggugauuugggggacggugcuauacucgucuccacuacuuguuuugcuuccccaaaauggaccuuuuuuucuaagagucccagagaauggggaauuguuccuguaaauauauauuuuuaaagguguugcugaaagcuguugguauuuuuuuuucuccugugucaccaaaauaagccaugacagccacgaauaugaagaacaauaagggcgaggcaaagauugacugugagagaggcaaaaugauggcauaugucagagacugauacagacugcugauugguaaccagugugaugagagaaaccgaaagauuuuaaauaugugugucgcaggucagaagugugaccgcaaacauuuuuguacauguguaugcauggucuuaugugugguguguugucuacuggaacacuguccccuccuuugagacagggucucaucuuugccuaaacuuaccaguugggauacacuugcuggccaucaagucucaaggaucuaccugguucuaccuugggauuacaagcauguacuucuaugccuggaauuuuuaccuguauuguagggaucaaacggucaccuuuuaccacguugacuccuuuauucacaggguugugcaaagcaaguguuuuauugacugggccauuucuccagucccaaccauuuguagaugaaaagucacacuguuaguagagaaaugguuuugagaaaugguuugugugugaaauuaagucauggagguauauguuuaagaagcugauugugugagccaggugguagaggcacacgucuuuaaucccagcacuggggaaggagaagcaaguaggucucagaguucaaggucagccuggucuacagagcaaguuccaggacagccagggcuacacagagaaacccugucuca

SEQ ID NO: 12263 - RNA, 10764 nt, Mus musculus
cgcgcgugcgagcacacacacauacacacacacacacgcacaaagcucucucgcuuugagcgcacuaacguggccgcuuucuuuguguggagcccucgagugggguugggacccggguccugucccggggagauggcacagcccauccugggccaugggagccugcagcccgccucagcugcuggcuuggcauccuuggagcucgacucaucgauggaccaguacgugcagauucgcauuuucaaaaucaucgugauuggggauuccaacgugggcaagaccugccugaccuuccgcuucugcggggguacuuucccagacaagacugaggccacuaucgguguggacuucagggagaagaccguggaaaucgagggcgagaagaucaaggugauccugcuggucagguccgggcagggaggaaccugggaggggguuuccgccugagguauauugcuagugauaauaaaugacuagcuuuggcugugucgccaccugccgagcucaagacccugggcacauccacaacccuuuuagcuucuuucaggggcccauccccaccuaacccaaauuuucuggcaagccagggugguugcauucuuacccuuugccccuaccugacagcuuuggccgggaaaagcagguuugaaauuguucucaauccuaaacgggagagacaccccugaacacagaaaggccugagacaucucugguccuaguuuugugggauggaucucaaagcacuuuacacauuuugagguccuuucuaccucuugggugccaauaggcugcaaaaaagaaaaaaaaaagucauccuggcuaagcccugugacauuagagagguugggaauaaauggagcaagaacacggcuuuauuuuagaaugcaguuuauacuugugaguagagcugacuugagauggagguggcauggagcaugguuaugucacaaagcccuuuuaaaggcugagacacagucaccugcuggcucuucauaaucucccaaaacuuguucuuugggggcagucccucccagaugcuugcugcuuuagaucgguuuggaugaagcuggugaaugaagagcccauuacucauucuacuggcauugucuucagaaggcuuguugggaaacacacaacaacuucucugagggucagggggaagugccuugacauaguuuacuaaauaggccaaguacaaauauuuuuguauguucauuuaguguagcgaaaguagaaacucgguaagacaggguaugucaguguguugggaggggguagcaggaagcgggguauggcaaggacagcuuugugugucauagaaagcuuguaagaagacaccgggguuacuaaacaccaaguccucuagacucauagcuggccuuugcuugagcaggacccccggggaagucagagaugaagguaaacuuguuggucaaacagcugaaggagacacaugcccuguccuguguucugagugacacagagugaaggacuggugaacuggagagaaugacaaaacaccccaaauugugcaagauuucuuggugaucaaaaugauugcauuuuaaaaugacuucagcaaacaagccaaagcacugugcuuuaggaagauggguggagagagaaggagagauucugggucugggagauaauagauucuuuugaacuucugaucuauuuuagcucuuuccaaucugaggcgacagggauggccuuuuaaagccaaugcggggaucugucuuuuuucuuuuucaaggacucuucauguugaauguuugcacaggucagggcuucuuccuugacggugccuaguuucuuuaauauauggcuauaagacauuggaaagucuaagacgugauuuuuuuauaaucaaaguagaaauaaaucaauggaugcauuuuaaaacaccuucagaaucauguuuaauguuaucauuuacuuaaaaucagcuauuacagugagcugaaguguuuccugggcuuaaaaguuggagcagcauauuaaaucccucugaaguuugagugguggggaaacagaagugcaugggagucuaggagggaagggagaugaagggggagaaagggaagaggagaaaugagggguaggaggugaacaguggauggaguuaucaaccaauggccuuggggagggcuuuaaaccauuaccccaccccacaccccacacccuacccccggcccuggccacaaccaccaccccuggacuuaaccuaacuaacuggcuuucaagucccugccaaauauccuagacuuuuuuuccccagagggcagagccugugacagugugacucacuggaaacagaucagcacaacaccccgugcagauaagugcuuaauauggguuuugaggggaagaugauauuucuaaaaggacaaagccuuguaacacaguucaaggaggaaccucugaggacaaauugggcaagaaaccucaguggagugugggaccugggacaugcugaccucacuccccuguaagcuguugaaucgcuaaggccaaagcuggcaggugagagaccagagugucuguggcaagauggcagaacauggcagcuggcaagaaaucaagaaggacguagauugugcuucaugcuuuuucugcaagaaaaaaaaguaccaaaacaugguuagggguagggguagggguagggguacgguuagccccauaguucagccagcuauaguaagcuaucagauuauaaguagaagcccuggcaggugagugguagagacuucucauuaucucuucuuaguucuagaguaguguauuaccucuuuuaggcuuucuccuuuguguccuccaaguggcacauaugacaaucucugcugggggauagaugcucgauguugcucuggccuccacaaauacauucacucgugggcacauacuuacacauaauucaaaauaauacaaacaaauagaaacuaaacaaaaaauuccauuuauugacugaacaaagcccaaggugaacauuuugauacaacaacccuaggaauuaagauuuuagaauauuuuuaauuuaaaaaaaucuacagugugugugugugugugggggggaggcauauguguuccacagagcauaguggaguucagaggacaacuugugggucccaaucuuucuuuccacccucugaguuuuacaguucauucgguugggugccaagugcugaaccaucuugccaggguaaaauugggauuuuuauuauucuccuuugacagaucaggaaacugaguuugagacagaugaaauaccuugcccaugggcacagcgaucuuuugucauugcuagcauuucaauugagauccagaguccauguucuauauacugagcucuacuacagaggacaauaucuaguccacuagauugggagugauacacuaccaaguagccagucuuauugugucuaggcugggacucaaggcuaugguccaaggaucaaggcgccuucaacuugucuccuucagguuuggggguaaaguucaguguuagaguguuuguuuagcauaugugaggccuuggguucagggucacuaaauaaguaaaaaagaauuuaaaaagaacucuauuuugccuguacucaggacgcucagcagagcacuccgaguuuacuuuucauaccaugacugucucacuguggucaugagaaugacagggguccagagauagaaacaaccuuaggggcaaauccccccuaauccaaagucauuuuagagauagggaacuggagcucagagaaagaaagugacuucccuaagaucaaucagacagugcaggcuuucuaaucccuuuuccggugcucuuucuggauuucacacugccaggcuuagaagacuacacaagucccaaguucauuuaacccagaagguugucugugcaagcagcauagugggacaccacauaggaaagcuggcagcuuuuccugaucaaucuaggaaagauggagacaucuuccaacucccaaaggaaggguggagcuucucuuaauaaccauuaugcauuauggaugugucaccuacggguuuagcuaagccauauugugucugucucagccuaaaagcauccgaaaccaaugaauaggguggguuggauaggcauuguugaaccauucuugguaaaauuacaagaaaguagcccucugccuaguuuggguacucccacaagccuagcacccccacugugggcuggccgugucuauaggcaggcauggcccagacugcagaguucuuccucucugcugaucacuggggaaaacaccuuccuguuuuauguuacuaagugcaaagaggcugagcucaguguugcuuacaagcugccugcagucagaaugacaccauagcugugggggcuccuaagccucuaucuucugucacccuaaugauuaauuauccgucacuguguguuccuuguuuucuucuccucccuuccucucccucuuccucccacccuuucucuucccccuuucccucccccccugucuaucuuugucucuguccuuuuuauugucaugugugucagguuaguauaccuguguaucuuagauacauaugggacaguccaguuaauugaaaaaaaauuuuuuaaacuuucuccauccaccaaagguuguaaaugcuucucuuuuuuugcacauaugccuucugccauuggcuuccaacaaaaggauacccaugguccauuuauagaaugaugccagcuaugucccuuaaggaaaaaaaauacuuaggucagcuaagagauuguauaggggauggagagcuugcugaagcuuaccaggcggauauaacucucagaaaaugguaaaaaggugcgguuucucuguggcagcucuccacacugugccccccaccccaaaccuuccaucuaucccucauuaaucugggcuuaucccaagccacucaugaaaaguugauacaucuuucucccugucacaccccacugguugcccuugcccuguuucagcuucuagagccaagugugcccgaaugagaaccaguagauccaaggcacaguacuaaaaguugcuguucuuucugacacaaugguagcaacuaauauccauugagcacgucccauuuuacaaacgcuguuucucauauaucaugucauuggauuguccuagcaagcagagaagcucauguucccacuauagagaugaggagagugagguccaacuaagaaaagacuauucauuuaccccucuacuaacuagaagucagaaugcugucuuuccagcugcacucagcugguuguccauguagauucaggguaguguuguguagauucauucagugucaggccugaaaggaagaaagacuguauacaguuggccuucucaucccaacuaacugagaauaaaacauuuagaaauaaaagcagggacugagggucuagcucuguuaggaaagugcuugugccucccaagugcuggucuuaaaggcaugugcuaccacuaccuggcauacagauuuuucuuauuccauaagcaauacguuguaucaaauauuuuaagagauuaugugcugggcagugguggcgcaugccuuuaaucccagcacaugggaggaagaggcagguggauuucugaguucgaggccagccuggucuacaaagugaguucgaggccagccugguguacaaagugaguuccaggacagccagggcuacgcagagaaaccuuguguccgaaaaacugagagagaggggggggaauauguaaacagcacaccauuuuauagaagccuuugagcuuugagcuuccgugauuuagacaucuggggguucugguaucuguccugggcagugucauagugucauacauagccaaggaaugccaccaaagcauaccuacacaauugcucuuacucucuucauuuuccagauggggaugcugaacaaaggacccaccacuagcacgggauuuggacagagauuugcauugcaguugguuugauugcacaguacccuacuggcccucugagaaugaugaggaucugagagugaugagaguagcuaaggggcaggccucugccauguccacugggaaaggaggaaggaggagagggagcaucuacuuucacuuccuagcaaggaugaaaggcaugugaggauguugaggacagggaaaccugcauccccugacacagagagcccauuccaucuguccagugagccugccuaauguauuucccuuucaaaggcacugaagcccuacugccuaguucuguuuucugcuggcuguagccugcuuccaggcuucagucucaucaugacgggggugggggugggucaaaacuuuggaugugguuucuauagaguggggagggagaaguaacuacccccgaauuaccaagccucugcacgaaaacuucaaggcuuucuuuguagcuuuggaaaggcagaggaggucuccagcagaggggcucucccuacaguucuggcaacuugagugguggacacaauuaggacgccaaggaaaagucgaacagccaaccuuacucagcuucaaacaccucgcacauucccacccguguuccugcagguauuuuuagaauccugagcucaugguguuaaagcaucugccacaugccugagggccguuaggaauucagcuucacucagaggcaagagugaagacgacuagagacugggggugggaacuggcgaucaggagccaaguggaaaugguauucuuggacuaggccucuuuucuucucccugaccuccaucccucuccccaucugccucgcuuucuuccuguuccaagcaccagagagauagaaggaauaauauauauauauauuuuuuuucugucucuucuuacagaaacaaauaagucuuugagaauuuuugguuucgcauguaaccaaagucagaugcuuucucugaaauggcucuggcagaucccugagccguccaguugcugggaguucuagugcucaggcuuuugaucaccaccaccucagugauguacaaucuaaggcugaaaaaugcugccaaguuuagucagcaagggaacagcaggacucguggacacagagcacacagauguauucuaaaugguaugauuagacccaaagugcaguuccuaaggaaagagaauugcagaaguuacacaagauuugcgggggggggggggggggggcuggagagaugacucaagagucgagagcucuggcuucucuucaaguggucugggguuucauucccaucacucacaugguggcugauaaccaucuguaacuccacuucagggaaucugccauucuuuuucugaccucugcaggcacugcaaugcaugugguguacacauucauacacauuagauauaaauacaugcaugcauacauaaauacauaaauaaagucuuuaaauauuaaaaaaaauguuugaaccagacaucaugguggcgcaugccuuuaaucccagcacuucggagaaagaggcagguugaucucugaguucaaggccagccucguuuacagagcguguuccaggacagccaaggcuacacagagaaauccugucucaaaaaauguccuuuuccccugccccaccccccaaauugacaaugauaguggaggcacaagcugaaucuucaagaaugaaugagauuggagacauccaaaaaccaaugacuacuagaguucacgaguagggagaugagagccugacccagggugcaugaaaauccaaauggaagcugaagaugguaagaaauugcagcacccuaauacuuagcaggcugagacagaaggacugaggccaagccaggcuauaugugagcuucugucaaagaaaaauucaaauagaagauguaaaaacaaacgcuucacuagaagaucuuggagggugaaagagagccuggacaaugaaaaccgauguccaggaugauggccuuauaagaucuucagucagcaaagagcuucgguuauauuccaaagauuauacucacugacugcuaauuccaaauaaagacuauaugcuucacuugaaaauuacaguagucaaauuaguggccauaaaaagaaagauuuuguuucuuucucuuuuuuuuauuuguuugucugucuguuuguuuuuguuuuuucaagacaggguuucucuguguagcccuggcuguccuggaacucacuuuguagaccaggcuggccucgaacucagaaauccgccugccucugccucccgagugcugggauuaaaggcgugugccaccaugcccggcucaagaauuuuguuucuuaacugagaauuuuauagggucuugagaucaucauuuugagcaugaaugucuguugucccagaccuugcauacauuacagaaaauaaaauuggacuugaauauauguugacucccagagucaucccccugggaauuaugucuguguaugugcugacugauaccagauuuuucucuucauaacuuggccuuuaucccaaaagcuaagaagcagaaaaaaauagaucagauuuaauuaucuuuuacauaacaaagaagugaauuuaaaaauaaauugaaaaacaaguaugguggcucgaacauauaauuccagccccagguuggcugagacaggaagaucaugaauuggaagucagccuagacuacauaaugagauuucauauaaauaaauaaauaaauaaacaaauaaauaaggcucaauggugaggauuuaaacacuaauuuugcuuuucugaugggaggaaaacaggcucucauacagcccaggcuggccuccaacuugcuuuguagcuuaagcuagcuggacucaguguuucuuguaaugcaaaaguuagguaagagguugcaugccuauaauucagaaaggucggguaguaggaucacuaguucgggacuaacuugaacuauauagcaaguuggaagccaguuugaacuauauacacauuaaggcccugucucaaaacaauagcagcaaagaaaacaaauauuuccuguauucgaauagcuauuaccauucugauauauauaauucuagacuuuucuacaaauauauuuauguuauauguuuuugaaaauugagacuaugucauaugaaacagauuugggauugguuaaaauuugaguacaccagcccugaaauguucuuuuaucuguuuucucuuucucacuuugucucucuggucuuuuaagacaggguuuugucauguagcccaggcuggucuugaacucucagcaaucuuuuugccuagcucuuacggauuacaggaauugcuguaguugcaggugugaacuggggcaagcauuccucugugugugugugugugugugugugugugugugugugugugugugcacacacgcccguaugcuauuccucucccagugaacauuguuuccuucaggagcaguaacgccgugaugaagauauuuucacaaaauuugagagcaucuuuucaaugccuuuuguauagauuccugaaagcaggauuauaagucuuaagagucguggacguuuuaaagauuauugauaaaauuaucauauugcccuccaggaaauuugacccacauggguauauuuuuaaaugauuuuuaaaggauuguuuuauguguaugaauguuuugcuugcauauaugugaagugcacuaugugcaugccccgggcuagccaaggucagaagagggcauccaaucccuugggacuguagguacaggcaguuaugaauuaguuaccuuaugggugcugggaaucaaacuugggaaccucuucaacaagugcuauuaacuaccgagucaucucuccagcucuuguguacuauuuuuauacuacaacccuuaaacuuuucacucaguauuuucauccagaaagaaaaaaaaacacuuagcaaacuauaaaacuacacucuggggucuauauugcuaagauaucgagaaguacuugcuauaucaggccuuguaaccaccuuuucuaauguuuuaaagaauaugcauuuguuugaguuuuuuuguuuguuuguuuuugagacaagguuuccucugugugagagcccuggcuguucuggaacucaguagaccaggcuggccuugaacucccagagauucauccaucucugccucuccgcugcuaggaugugccaccacuggccagcuccgacgaugcuuuuucucuuguuuccuuuucugauuuuacauaugggcuuuuguugcagguucaggugugggacacggcaggccaagaacgcuuccguaaaagcaugguugagcauuacuaccgcaacgugcaugccguggucuuugucuaugacgucaccaagaugaccuccuucaccaacuuaaaaauguggauccaggaaugcaacgggcaugcugugcccccacucguccccaaggugcuuguggguaacaagugugacuugagggaacagauccagguacccuccaacuuagcccugaaauuugcugacgcucauaacaugcucuuguuugagacaucagccaaggaccccaaagaaagccagaauguggagucgaucuucaugugccuggcuugccgacuuaaggcccagaaaucccucuuguaccgugaugccgagaggcagcaaggcaaggugcagaaacuggaguucucacaagaggcuaacgguaaagccuccuguccuuguugaagccaaauggugucaauauucgagaauuaccacuggaguuuuuccuuucccuuuuuucugugccugcauaauaccuacaccugcuuguuuccauacaaacuaauaucaaaauaaaauuuguauagauu

SEQ ID NO: 12264 - RNA, 14106 nt, Mus musculus
uuucuuaauuugauauaucaacauuuaauuaaauguuaauauuguccaaauuuauuauuacauaguuuccagucaacaaauuuguauuuuggccauuuucugcauauggacuaaguauaugcauuuuaaacuaauuaguauucauuucugaguuagucuaaucgacuaagcauuuuaauuuagggcauauuuuaguauuccucauacaaugucgaaauagcaacuaaggaaucaaguaaaugaaucuuuaauuucuguuuauguacuauaauauauaaucauguguuuaaugacuuccugcuuaaaaauuuaaguuagcaaaucuagaacaagauguaauaugccaauaaugaaauaauuaaagagacaagccuccauaauacagauaucuauuuuauuaaaaaaguuacaaacagguggacugcagggucgucuuacaaaaugacaagaaugaaaucuauuggaaaaaauuuacuuuuacaaaucuucauagguaauuguucaauguuuguacuuguuauucgagauuuuacuguucacugauaaaguuacaguacauuagauccaucauaauagguuacaugacuuuauuugcagagcccuacugcagugauuugaacaacuccuaaacagaugccauaauaaagacaagacauauauugcauuuaauauucauuucuuauccuaauaagcaacaugcaaucuauugaggaagcuaaaauaacuuuuggucccuuuucuuaaaaugugcuggagaaaccaccuuucaaaucccuuuccccugauuccugugauccuaagugaauccgagugaaauuugcugcugaggucaaugacaaugaacgcugugauagagagcgaggugacagaaggcgaagaagggaaggacagaaggauagccauggggaaaaaacuguauaaaaaucaaucugcagaaaauugaagccaucaugaauuauuugauuccuuuagaauuucacagggcuaauaaugaugagccacaagcacuuaagcuacucugaaggagcguuggguuuuaaagugcaaacucaaauuaaguauuuauuucacacaguuuguaaauaaggaacaaacauuucaguugccucucaccgucaaaucccaaauguaagaacacgagcucgcuuugagggaaucugaucaggaaucaaaugcaacacgauuuaaaaaaaggaaaucaaaguuuaaucaguuucuacucauuaauuaauggccaugcugaccaauaagucacaugaauguagauuucacuuuauuugaacaccacacacaauacaaauuuaaacuugccacacccuuccacaaaccaucacugcauauaauagagcuuuuuuugacaaaguuauugagcuauuauuauagaucaaaagcauaguuuugguuuuguuuuauuuagaagcauguucaaaugacuaaagcugggcuccuaaaaucgagagcuuuggugcaguaggugagcugcaguuacuaacuucugcaaauuaaaagcacacaaauaaaaccaaauaaaaccccaaacaaaauacugucaaacuuucacaauugaaaaauaauugcuagaaaaaaggauucgucaucaugauguuaaaagugaacaaaaagauuacucauuguaaguauuuuuucuuuuucuauaccugcguuauugguaaaauguucaaguauucagacaaaaugugcugauuagguaaacaacauggaaggcaauggcuauuagaaagcacauuugcaaaaauaaaacacagccagccagaggcucggcgcugcuuucccuccuguuacacagaucugucucuacuacgaacaugcuucuugaaaaagaacuaaaaagcaguugugauagugcaagaaaacauuaacaaauauugcuuuaaacuauuagucagaaagacaaauauuaagaacuagaaauuguacaugguuuuaucugaauucaguuuuacaugugcagaagucuaccagaugucaaugacaagccugaugggcaaagcugagcuaucucuguuuagguauacaauuaauuuaccauggacacaauaucccuuuucaaaggcauugcuaaguaggucauaacuaaguuuagaacuucacagaaagaaaaauguuacugcugcaauuuaaugcuguaaaugagauuaacacaugugaaggccuaauggaaucaaauacuuaacucuucaacuucaaguaaauguuguacagccaaccuccaauaucaccuguaacguucacaacucguuaauuaccaaaacugcacuugaagaaaagggauaguccaucgauacagguaaaaugugaucuuuaguuucuuuuuacaacacugccacacguaaacaaagucucaaaguauuaaccaaccauuuaaaggagaaagauuuuacaaauaggaugaagcauugguacgagguaauauacagaaguaaccauuuguuuaaggcucaauuuuuuuucuccauuauaucuuucuuuuaaaaggcauugaguagguaauacugaguuugaguaauaaauacaaguugagaaacugauuaacgaaaucaacuaacauuaaaauuaacccuuucauauuagccaucaauaagaacuuaaaaagcuauaaaaggacggauugauaaagaacagauuuaaauguaugguaaacgugcuaagcauuacugugaagguccguggaucuugagggccaaagaccuuaugcacuucauuagauguauggcaacaugcugugauagagacagguuuaccaaggcucaguucugcaacccagguuguaaaguucuccaaagcagcaucugugcaaauuuccucugaguuuguaaucugcaaguaagaccaaagacauuucaggaaaaccuacaaauauacaguagaacauuaacaaauaaccuuacaacaacaaacccaaaggaaugcauauauauauauuuacacacauaugcauauauauacauauacauacacacacacacacacacacacacacacacacacacacacacacacacggauggauggauggauagauagaugauagauggauggauauaaauagauagaugauggauauauggauguauggauggacagacagacagacagauaauagauggauggauaagugaauggaugcauacugcaggucacuagugugugaucaugggaucucgguggaauuucacuguguucucgccaucagcuuaaguaacaaaguaaauuacugcacagguccagaaaagucaucagaagcagaacuguaguaagacugaaccagagagaauacacugucucuguuaccacgugugcuauaauauuaugacacuugccauuuacacauaugugguauucaaaacagucauacugauugaaaugaucuuaccauagagaagcuggggcaaauggcgcuucacucugaacuggaucugucccuaugguaacuggaaauggugguagucuucaauggucacuaugaguuaccuuguuaguauacuacauuuuccagagcuuaguuuugugggaaugcagaauuauucagaguguagacacugcacaugcccuaugcuaaucugcucuuuuuuaugggcacccuugcaaucacaagaacuucuccuguuauagacgccucaguuucuguccuuaaagcugacagauuucugccuuccaucuaauaauggaggagaaaaaucuaucauucagacaaacauuauguccuucagcugugcugagucacaaauuggcuucuagaggaaugaaauuguguuuguuuaauguagaagauaaaaaauguuaucauauagccagaaacuaaagaaaagcaacuaugaaagcaugccaagugaagucagucuaagaucucaacaggcucuagcaaugucuauaaacacgucauuuuaauuucauuugacagcuacacuuguauuaguguucaaagagccugagagaauguguucccauuagcugcaacauagccaucauuacucugaaagaacuucccacucaucauuauugaaauccugccaccuaaacauauuacaaaaaucuucaucuuuaaaaacuaucauaaaagcuuugucuaguuaaaacuaagucuuaaugcggaaagcuaaguauuagacuaagguugaccaaguccaguuuccuuaucauuaaaacagcaagaaaaaugcuucccucacugacuugcuaucucuagucuauaagacagugugugaaaguacuucauaaaugaguauauaaugucagcaauugcuuucauuuccuuacuuauugauuuuuaggccacuaggaucauaucaucaauucuuuaauauccacacuaaggacacuccauauguagagacuuuucaagcuuagaauguauauaccuuuuuuuaaaaacuuauuuauuuacuauauguaaguacacuguagcugucuucagacacaccagaagagggcaucagaucucguuacggaugguugugagccaccaugugguugcugagauuuaaacucaagaccuuuggaagaacagucggagcucuuaaccacugagccaucucuccagcccuguauuuaccuuuuaaaccaaaacaguauuauguuauuuauaucuauaauacuagaauuuucacuagcuccuauuagacuuuccccaauuaauuuuaaacagccugcuauaaauucuaauuaauaauuuccaaaauaaauauacaagagcuugaauuuuucauauaugacuauaauauccuauugaauuuauaaaaugugacggcuuucuguaacauuaaagugauaaaguacuuacuuacuacaaaccggcuuucuaaucacagucuauaguaaauaaacuuacauauccaucacuuuuacccaaaagcccugaguaccauuuccucuauccacaugccugacgaugguacgccaguaaauucugagucacacuccacaauauuaacauugaacauacuuuuaaacaaaauaauaagggccacuuuuuaagacagcaauaaauuauuauucucugcagcaauggauccugaagcaaccucuuucauuaagcgaaaaggacagugucucauauuaguaauauucgagauggaacguguacaugucuugcucuccagugauaggaaaauguucaauuucuuaacacccucauucauuugcgagaaacccacuggcgaauccuugaaggcaggccgucagcugagcacguuuuccuucucaggccaccacacugagccaugcuugcugcaaagcugggaccugcugcuuuccugccauacacaucauaagguaaugcuuacacugucagccagccaacaaaucguacuucugccagcuuguacucacauuugcacuaaacuauuugguuuuuaauauuuuucuaacaaaauuaugagacuaaaaauuagaaacaaacaauaguucaaacuuucucucaguaaaugaaaauggaucucccaagagagccagcuaguacaccaaaguaccaaacacagaccugaaagaacaaagaucauuauuuaugccagccugcagaaaaugggagauucuugauucaggacaaaacacaucauuucaugaggcagcagacugccugggaaguuaacaaagaacugugaggggcuuagcaguuugugaaugucuuuuuagaguuaauagcuuuuacaauuuuaaacacuaccauaauuucuaucuuuuuagcaaauauagaugugcaaccagcuccuuccuuccuuccuuucuuccuuccuuucucucucucucuuucuuucuuucucucucucucuuucuuucucuuucucucucucucucucucucucucucucucucucuuucuuucuuucuuucuuucuuucuuucuuucuuucuuucuaguuugaaacagaugaaauucuggagauuuaagcaaggagcguuccuaaaagaugaacuucuccuuauauuuguacuuggcauuuccauauuugagcucaguauuagugcuauugacgcgcugcuaugugaagaggcaagguauuuuguuggugcugcuguuaccuauguugcuucauuuaucuuaauuuguaugaagcuuauuaaaggcacuggaauaggaugacuaaaucauuaaaaguacucauucucucccauuaaacacagagagcaaaagaugaauccaugucagagaugucuugaauggagguagaaccauucuggaagagaagcaaacaugcucgauguauacgaugaacccagagucaaagggaaggacuuauauuuuucuuauggccuagagcuagacugucaaguguuuaacaugaugaauucaauucuaacaucucaaauacugucaccauguccagugacaugguaauaguguguggccaacgaugugauucuaauugcuaacuuugaaucagaccaaguaaaacacuguuccccacaacugaaaguaguacuuucugaaacugauauucccaauacuguggcuaauccaaggcauuugugcauaugguuuugauuggaugcauuuuccaacaacugacagaacuucaauuucucuuaguuacauuaucuucugacuuguccaacuccaacgagaagcaaucccaggaggcgaacuguuccaguaggaagacuagaaugcuuccucaguggcccuucuccaacuccaugaugcaauuuuuguuaauucuacugaugguucauucuaagccagagagguaauggaguaaaacugaucaucgcacaugcaauucauucuacaauaaaagccuacucuugagguuggaggaagcaauuaaagagggaaaagauacacggagggagucuuucuacugagacacauccacacccagugcaggucuaauuggugccccaauuuacccugaagugucaaacugauaaccuugugggagucagagaagggcugguaagaaucaaggguguuaggaaaggcaagcagcugucugucacuugcacuucaggucugcuauagacccucagguccucugcuccaaugcaugcuucucccuaggucacauccuccucuccucucuggcacccaaggauaaauaggggacugucucuccacuuaaagugcauacuaauaaggcaggacgaaagacagaugcaccuaagggcacuccacuuucuacaacacacauccagcccaggcuucuacucacacaguacugucuaacuuggauaugaaaaugccagcauuuuaugguacauaaugugauuucaucuugaggauuuucauugcacauuugcugaacuaucauaucuaguggggaaaaaacaggaaaaaaaauucagaaacuguucucgguccacauuuuguauuaagagagagagagagagagagccagccagccuugaaaauucuaauccauccuacuccaucuaagaaauaauaaguccagcuagaauaaaaucccauucauagaugucuuagccuuccaggagccuuuguuaccaucccgggcauucugcugccacaugaaaugacgugcuagucuugaaucaagaaucucuccuuuuucuucaggcugacauauauaaugaacuggggcugacauaaauaaugaccuuuguucuuucauuuugcuuccugguguuugguacccauaugaaccauuuacucuacuugggagaaccuauuccauccauaacaugcugaggaaaacauuagaaaaauuuacagaccuucaggccauagcaaaggacaccauucucucuuuuguaaauuuuuucccuuguaacauucauuaauacuggacugaaacauaggacugccucaaacaucauuuuuaaaaacuccauuugugaaaagguuagacccaauuaucacauaagggauaacuuuaaugcauaucuuccuucuuugggggaaauggauagaacauuuaacgguuuuauuaugacucaucuucaaauucuuucuguuuagaaaaaaacaaaaacaaaaauacccccuaccuucccugccucagcaccacacccauguuucaaggcuugacucaaaugguacccaguucccaggcuacuuaacucacugguucuuaaccaggggccauuccaaucccaugcccauggggacuucugucgaucucuagagaaaauaaauuuuaucauaaguggaggaucggaacauaauaucagaccuacuggguagcuaccacguauguugcucaacauuuauaguccuaaacagaggacagcucucaacaacaaaagcccagaguacugagaauuucuguucuuuccuuccucucaauucccacacugcucugaucuucuucuuuuauaguugguuauuaaggaaacagccauucuucucaauagcauuacacucaaacaguacacugucgauugaaauaacagccgccagauauaggagcuacugacuugggaacuaaaacaaggggaagaacacagagcuagauuuuuaugaaacuauggcugcccagucacaguucuacaaagcacuugcaagaaagaagccacuucuggccacuaaggaaaucaggaugguggcuggcucuaaaaaaucugccacacuuccuaauuuacaguaaaaugacugccaguaggaggguaaaaggggaagaaacaaucccaagccaggcccugaagcagguguugggcaacagaguagugacccaaauuaaagaguguuaggaaagaaacgugaggaauucccaggagccauucucagaacacuaauaaaugucccccucacuuaaacacagccaaugaucagcagcaaccauggucuuucugucuuaaguacuauuauuucaaacuucauacaaaguccuuuucuaagacgccagacaaacccuucucaagucaccuuuacuagucgaaguuugaucgucaguuuagaucuggaacugacagccuucagggcuccaugacucauagagacucacaaucuaucacauacuguucaggugacagugaggaaggacgagcacaaacuccacuagccucagguuacagacccacauaccuauaacuucuaucugauuugggcuuagaaaaaaaaaaaucuguauauggugcacacuguucuaaaagauccuucagaaaucugacugauuaaguauuuuauuucaggugcuacaccuucagccugaugcuuuguuuacaagaacaacaacaaaaauaucaagcaaaagcuacacguucuacaaagucaccuaauaaaauauguaauuucuggcauuaauuauaucuaaguuuaguauguuaaucaacaagaagcaugaauacaguugucuugauauauuuaauccaucccaugcacacauauaucccuguaaguaauggaaaaacugaaaucaugagaguauacaaggagaaacaagcucaagaccucauugauaaugaaaacuacuuguaaaaaagcuguagaaacaauccaauucccaacaggaggaaaagccuacucucuggguguaggagacuaaguuugcuuuuauccuccuuuccuauauuaaugucaagaagaaacauuuuaugggauuugguuaauuuguauaaggaugauaaaacucaaaguacauauauuuaugucaucugcucaauuaucagugugagagaagcagaauuuaaugguaaagauacuaucagcauacaaaacuuguucaaaccugaaauugguuuaugauuuaaaagacagauuaugggaucaagaauguaggacucaauugucaucuacauaucacauaaaccugcuccuaccucaaaaacuacacugcaugggugacacuaucagcaauauauaagcuaaacuacagucccagcauuggcuuuauaaaacaacagauguagguagacagaguaaaugaguuugcaucaauguucucagaugguaaaggaugaugagcaaaaccauuuugaauaaagcacuguugucauccuucauuuucaaagaugacacuaccugacaagaguccuugucuagaaagauaaauuagggacccugcguccuuucucuaggcagcacaaauaaagccagaccuuugguuaggaaucaugucuaugaucugaaaugccuguugccauuggcaaagcugcuucuagucuggaggucagcccuggcucaaagaggucacuuucauccugauacugucuuccuacucuggcauucacugugguuuucuuaaucuuccacaguauugguuguuuauauuauuaucuaaguguuagucucugagacuauuaucggauuacauuccagcugaaaagaucaagauaugcauacaaucaucucaugcuaaaugcucaauagcucaaaguuuuacagacccuuauuuucuugaaaucucauuuuaaaaacauacuaucauuugauggaaggugugaaggcucgugguuguucucaauuccauuauuuauuaagccaaggagaaaugaucucugugcucccgauggggucuucagacccaucgcagaggguuuaaccagcuuuucacgucaucagaaggaagugaagguacuugguuauuaccagaggucacuucaguuccccgagggcaagguacagaugaacuugauuaaauaaucauucuguucaaccaaauacuugagugauuagaaaauuggucauuucaauuauaguggcucucuugcccagaauauaaaaauacuaagccguaccauaaaaucauucaucauccugugaaauuauuauugaaugcucgccugugcaucuuggacauuaagagggcuaaccaggggaaagauguacuguggauugaagcaucccuccaaauguuaucaaguaaggcugagaagaaaaacuacaaagucgcuccuucaaaauguaagucucaucaauggcaauacacaccauuucuuaccuuuguucugcuuaucugcauauuaaaaacuuuucugcacugaauugagaugguuuuaugcugagaaaaaaaauguuauuuuaaaaauacagaaauuuaaggugguaucaaauguaugaguguauuaccaucaaccagcuuuuuaauuuuauacuugaucaaaaccaaaagagcccuugguccauagagucccaccacuaaccugcucgguauggccauggcugagguuuucuuuuuuacuggacaacacaaguuguacaacacugaucuugcuucucgggcagggaugaauaguucauuugccugacgaucucagcaaaaaguucauccaccauugauuuacuuuuugcugacguuuccaugaaaggacagccccauucuugagccagagcucugccuucggaagacauaaccucucucucugguuccagauccacuuuguuucccacuaggaugagugggacuuucucguaucucuucacucucacaaucugaucucucauuggcuugauauccuagugaagcaaucacaaagggaaagaacacaauuagacuuuugcauuaccacagcugacaccuuucaaaaucagaaaaaucacuacuuggugacucuacaaagcuaaagucacaucuggaaauaaagacaacaguagcauuuuccccuggugacaugggaacgagauggguugcacuagcugugccuuuugcaucagaaauauaaaacucaagcugugcaccaaccuuaagacuccucuaaccccacccccaccuucagucuacuucgauuaaagaaucauguccccaaauaugaacauacacauguuuggccagcccccuaaaccugccuguugucaccauuccuuguaccaccuguuaucccagcacaggacugcagcauggauggaacuccuagucauuuaacaagagggcuuaagggaaagugguuuaaagacaaggggaaaaggagagagggagagggagagagagagagagaggcagaaagagacagagacagacaccacucgaugcuuagaaauccaguuuuaagauucauagacauaaauaucucauuuuacauugguuacuaagugcuuagcguuguaauagcaaacaacugugguaacagugaacucagcccaagaaggucaaggcaucaggggucugggugagaagucagacauggcuucuuccauguuugcuugccuucugauuuguccacacauauauugcaugggaauaacuguaguucauuacuaaagaucacagcauuagcuauguuucaguaacaucaauuuccgcagagaaugguuuugauauaggaauuuuauaggguuagccagcauugcuuuuuuuuuuccuguauguguccuguaacuuaaagaguugccuuauauauaaauauauauauauuugacuaauuacaguaaacaaaacauucauacacaggucaaauauaccaauucaaucuugucugaacuguuaagcugcuuuucuggguuuccuuauggaacaacaaguguaccuaagcacaccaacuuuugccucaaaggaacccgagucucugcugaaauaaugucagaguuccauacuccguacuuauggcuauaacagaagaggauacaguggaaaugguaugaaacaccuuugaaaagaccagaagagucugcugaaugaaaaacaaaucuuucgaggaucccuuagaaggaaaauaccugucaaauaauacccucagcacuucugggggaaaugcuuuaugcuacuuuuguuuggaaugugagucuaccuagcauguucuuuggagucauuugcccagaacuuauacucuuuacaaagaaguucuugaaguuguuguauaagguuaccagaaaaauucauacauagcacuuuaacuucaacucccaaagaaugugaaacuagcacauuacucuggcuaaggcacuuaauauuucuuaaguaagcaacauuaagugcauaccuuuaaaugcagaaaaaaaauccguuuccuaaaucaauggaggucaauauaacgggucaauauaaggucauuuauuuucaaggaauaaauagcaacaauuagugcaucucuuaaaauaacguuaacuucagucuaguucccggugagggauggagggauuuucugaagcaacuggaccagauccagguuggcuaccccacugggcuaagaaaucugcguucccagucccacauauuuuucuguaaguauaggcuacgauggcagaaacgauauggcucgacgggagaaaaggagagucauccuugcuuucuguggguuaggaauccuagguacuagucuuuuagagcagcaacuuccccuuucggcugcauuccccuaagaaaaaugccaagaaagcaggccuagcccgcauuuugcaccacugagauuuaggcuucaagcugaggaccuuaggagcuaggagagcagggggaaggaaaagcaggcacacagguuuuagcucaguguacgagagaauggacuucaaacaauuucgcccagcccaccgugcuccgcacuugagguuaucuacggaagguuuugugaacacguuaaucgauacuuguugaagugaauaaacaacuucagguuguaccguagggcuaaaaauacucaggcugaccuauuuccuuuucacuuuucuuuuccuuaaaaauaacuuuaaaauauuugucgaugucuguuacuuuagcacucucuacagaaacaauccagggcuuuuccauaccaugccaaacuuucaaaagccaaacacgcucauuaacgcacagcucaagcaaaugagaaguacauguaggauuaccacacccccuucaaagaaauuacaagacuugguuugauuaccugaaaagacuguugauuaaccaaacuauacaccaggaugaaaccuuggccguucuugauguacagaucucucauggaggcaaacugcucgguuccugcgguguccaggauuuccaguacugacggggaagaguccacuucgaucucuuugcgguagaaaucuucaaugguggggucauauuucucaaugaaagucccggugacaaacugcacggugagggcagauuugccaaccccuccgcucccuaacaccacuaccuuguauucccucaugagucucaccuucaccaacuccuuacccaagggggggaaaaaauaacaccccgcuagcugcgcugcggcaaggccaggcggaaggugggcggaaaugugcgaacuggggaggagagugcg

SEQ ID NO: 12265 - RNA, 13696 nt, Mus musculus
cgcgcccccgaaauggccgcuaacagucaagguaaaggcgggagcacgcgcgcaagggccagggguggaaucaccuuugucgcuuagagugaaguacugcugguugcaugcugagucgcuugcuggguuccucccuccccagggagcuucaauagcaccuggauagggcagcgcggagacuuuucuggcggguguucugggaucuggccaaggucauacuuaagcuggcuuuugaguuacccagggauguuaucucugccuagcucuucuagccuuucagugccgccccuaccgaggugucccuagggagauccaguuacuguucucagaagcgaucuggcucccugacaggaguguuuuugucucuuacugccucucaaacaccuacaguccucauuuucauugguacuuuccuaauugauuguuuugaaaacaguaggagauauagucggcccacucaaaauaaaaucccaguggagcacuuuuuuucuuucuuuuuguccguuuucuuuucuuuucuuuaguuacguuaagucagucaauucauuaagcucacagucauuacacuugaugcaauugcugagcagaauaccuagaaauuucugagaaaucuugucuuacauaauuguagugcuuacaauaauuaucguuguuuuccugggccuauagacaaggcuuguaaauguuguuuaccaguguuuaaugagcggacucuaauuguuauccaucccaucucacccaccaucaacagauaauuugguguaguccagucuggccucaaacucagcuauccuuguguuucagccucuagagugcguggaacuauacccaacuaaaucccacuuuugacuagagccauacguugaauguauuguauaugguuuuuaaauauauauauaugaauaucuagugcuucuaacacuauugaaaggacuugcuuuguacuguggaguuaccugaguaccuugauaggaaaaugauauaauaguauauguaaauguauuucuauacuucuuauucaacuaauuuuguguauacuuaggucaauucaacauccucucucucucucucucucucucucucucucucucucucucucuguuuuuugagacaggguuucuuuguguagcccugucuguccuggaacucaaucuauagaccaggcuggccucaaacuaagaaauccgccugccucugccgggcaugcaccaccacugccuggcuuuuucuucuucuuuuuuuuuuuauuagauauuuucuuuauuuacauuuaaaauguuauccccuuuccugguuuccccucugaaaacccccuaucccauccccccuuccccugcucaccaacccacccacucucucuuccugguccuggcauuccccuacacuggggcaucuagcccucacaggaccaagggccucuccucucauugaugacagacaaggccauccucugcuacauaugcagcuggagccaugucccuccauguguacucuuugguuggugguuuagucccugggaguacugguugguucauauuguuguuccuccuaugggccugcaagcuccuucagcuccuucgguccuuucucuagcucuuccauugggggauccugugcucaguccaauauuuggucaagagcauccaccucuguauuugucaggcacuggcagagccucucaggagacaguuauaucaggcuccugucagcaagcacuuuuuggcaucgacaauaaugucuggaucaaugcaacaucuuauugaauacuauagccuuuugaaucuugaacuuagccaggcaguguuggcacucaccuuuaauuccagcacuggggaggcagggguggguggaucccugugagcuugagaccagucugguuaauucuggggcuccacagagaaacuuuguuucacugcucccagccccaaaaaccuuuaauuuagguggcucuaaauuauacuguaguuuugaaaguuugaacacucuuaaacuuucuuccuaaguuuuuuuuguuuuuguuuuuguuuuuuuguuuuuuuggguuuuuuuuuuuuugccguuuaucauauagaagauugacuuuucucauauggucuguuuucagugggacuuugauauucccaucccaguaagaauuggaauauauauucucucuucuuuaaucuggaugggaacuacucuaggccaguuuagugguagcaaaauucaauagcuucugaggccagaacuuaaaaugaugacaguuuuuucuagguccuugaccuuuccuucacuugagacagucaccucuuaaacuuagcuucaaugguauuaaggaaguccacucuagccucugagaaaaauagucuguauaugcaacuguagacuuuuuagauuauuauuuauuauuauauuauuccagacccugcccuguaaguuuucuagcugaagccucagauaucacaaaaugacagagaagccuuaauggugugauugaauuccacaugcacagaaccaaccagagauaauagacaaaauaacuuuguuucaugauguuugagcaauuuguuguacagcuauuauaacuucaacacuauuuuugguucuuugccugucuauauacauuuuaaaaucccuuaacccagugguuuucaaccuuccuaaugcuaugccccuuuaaugcaguuuaucauguuguagaaacaccaagcauagaauuguuuuguugcuacuucauaauuguaauuuugcuacuauuauaaauuguaauguacauaucugauaugcaggguagcugauguuuaaccccaaaggagucuggauacacauguugagaaccacugccuuaaccuguaaaggacauuuugguuuugcuaaggauuauauaauaaugagaaugaacaucuuaauauugaaacucagguaggaaucuagcucacaggcuuagcuuuuuaauccccuuaaauuuaggaggggagugcucuauaguuuaucauuuuuuucuuuugccugcuaauauuuagaaagcaccugcuuaauuuuauauauauauaaaguuuuacaagauaauuuagguauuguuuuguacaauagcauucauuuagauagcagccuggauauucauucaaguacucuucauucccuuguucauuucuagaguucuacuuagcauuucuugguugaguuacaucaguuugccucuugaauguuauuucucucuuauucugguaaucuucuuggacuccaauuauauaugugugaaauauucugaaaauuuuugcuuuguuuaauuuuauaaaaauuauuuauuuauguauuuauuuauuuaauaauguauaugaguacacuguaguuguguucagacacaccagaagagggcaucagaucccauuacagaugguugugagccaccaugugguuucuaggaauugaauucaggacuucuagaagaacagccagugcucuuaacugcugagccaucucuccagccccucauguaauuucuugaucauuucugauucugccucuauuuucuauucuuuuuuuaaaaugacaauucuuggguuuuucuuuuguuuguaaacagucuuacaugcugaguuuuuaacauuuguuaucuuaaugcaguauguuuccaaggaagaaggauuggacauaguagguaaauccaagaugaucuuuguucaaaccaggcauuauacuuuuuuuuccccuuugguuuuuugagacaggguuucucuguguagcccuggcuauccuggaacuuacucuguagaccaggcuggccucgaacucagaaauccaccugccucugccucccaagugcuggaauuaaaggcugcaccacuacugcgccaccacugccugggacauuauacauuuuguuagcuuguuucccauuccaaagcuuuguuuccugauuacaaaaugggauuaauaaguaguaccuaucuuuuccugugcauuuaauuaaauaguuuguuacuaaguacauugucuaguaaaaagcacccggucaaauauuguuuacuuauucauuggagaucuauauaauacagaaaauugguuuguagguggcuccuaaagaggggaauuuaaaaauacauauuuagaaugcuuuuauuccauagcacuguuuuucccuaugucaguucaauuguuuuuaaauuugagaggaaaaacaauagcagacuaagccuaaguuuucaaggugcuacaauacauauauucaaauuuauuuauuuuagucagaauuucuaaaauuccaauccagaauuucagagauauuuuacuauuuaaaauaguuaccugucugcuuuaaaaaucucuuaaucuuguuaggaauaguggaaaacuauuaugaaaguaaauauuuucuuauuuucuuaguucuuuuuuuaguuuuuuauuugcauauacuaaucauacaccaugauggauuuuauuaugauuuuuauacauuuauacaauguguuuuaaucauauuuacuuuuguccuucccuauuccuucugauccccuucaauuguugucuugucuucacuauacuuuuuuuugaugacccauugaguuucauuaggcuuauuuauaggaacaugugugagagauuguuuacuagcccauaggcaccuuaccauaccacugaagaaaaugucuacuccuuuggcaguaaccaguaacuacauaucuucauucuuuuauaggaaacuuugauggaaaauuugaagcacuggaucuugcagaauuaacuaaaaaacaaccaugguggcguaagcuguuugggcaggaaucugggccaucagcugaaaaauauaguguagcaacccagcugguaauuggggguguuacuggaugguaaguaguguuaaagauuuguaguuuuuugugccugauuuaguagcauaguuauagaaacugucuacucuaauuaaugaaaacacacugacuuuacugaaauuguucaauauguaguggaccaucaaauuaaaguacuauuugauauuuaugcauguacugucagguccaaaagaaacuucacccccccccaaaagacacuccaaauauccagaaauaagcucaaccuggacuauaagaggauuucuggugguuagaugaaaagucaacauuccuuaagaacuuuugaaagauucucuucugucaaaaggagucauucccuuaucucuggaaaaagagauauauggcucuccaauuaacacauaucagcauauuaagguccaugcuaguuuucaggcucccuaaagucccuauucacaaguacuuguuauacauuucaaagcccuagcauuggacuuucucuccucacagcuacucacacuucauauaaccuggcuauucucuccuaagaugcccauguccagacugcugacuauguguaauuuacuccucuuucugcucuggacucuuccagauaccucuggcugcucucucucucauaucuacaauaaaaaucacccccuuaacuguaccauggaaugucuggugccaaaaaccuugcauauaggcaggcacuauuuaaagcuuauauauagguaucucaucuccuucuuaaaaugacuugguaauuguaauaucuauguccauuuuguagaaauugaggcucagaaaguuuaucuagauucuaggucaaggcaacauaguaagugguagauuaagauguuaaccauuuauauuagcugugccagauguuaauguugcaguuuucauuuguugauguguauaaaauguuuagagccaauucagugagugaguaaugaauucaucaaucucagaaaguccguuugaaaaauguuauuguaaugcaaauacacagaacagcuaucuauaaggaauaguuggagaacaaauucccauauaacaaccacugaggcuaaaaaauauggcuagugucccccagaacucuaaaaguuguuggggaguugcuucuuuacuuaauuuuaauaauuuagugcagucaauuugguuuugaacuuuggauaaacacaaucacuaugaauucuuuugauuauugcuucuuuguuguuguuuuguuuuucugagacaggauuuauuuguaguucuggguguccuagaacucauacuauauaacagguuggccucaaacucacagagacccacccaccucugcuucccgagugcugggauuaaagacauacacuagcacugccuggcuugauucuugcuuuuaaaaauguuuucuguauucaaccauaucauaugaagcucuagcuucuucauugucauuuguauuuagaauuccacuguacuaauauaccauaggauauuuucccaguugaccauuuucaauuuuuaaauaauguagacaaugaugauaugaaauuauuaugcaaauuuccuauugugaauggguacauuacuuccuuggugucuguaccuaguagucacuaaauuauuggguguauacgucuuuaccuucaugagauagugucaggcugaugccuaaaagugguuacauugccaccaaggaccaaguguuucuguuacacuacauccuugaccauauuuguuguugccauacugguaauuucuugcuagccuuuacaaguaguguuuuucucauugagauuuuguuugcauuuuuuccaaguagggguaaaaacugaaggcuuuuauauguauuuauuuacuacuuagacuugucuuuuauuaaauuccauguuuucccccucugaaauugucauuuuuuguaguauucauuuuuaagaguuuugaguguguguguguguauguuguguguguauguugguuuuguuuuguuuaguuuuguuuugcaauggagucuuuggcucagcaaugaagaaacuuagcagggccaggccuggcaaacaugguaaugcccucuuccuucucccauguaaaccauagauuacauccuuagugcuagccaucaaggucucuucccuuauuuggacauguucuuaugcuagacgcauuccucagggaugcaaucuaugugagagggaaggggaaagggcaagaugcugccaguaccauguuugguaggccugagucugagaagucccuucaagcaugguucagaacuugugauccuccuaucucugugucccaagugcuguuguauacacagauauuuauauuaugacucauaacaguagcaaaaugacaguuaugaaguaucaaugaaaauaauguuauaguugggggucagcacaacaugaggagcuguaguaaagggucgcagcauuaggaaggcugagagccacugcguuaggaugauuccuagaacucagagcuguuuuacucacaguuacaacuucauaacaaaaucaggcaagaaaagauacacacaggacagcagccagaagaaacacauaaauggauuuucuacuugucuuuuauagagucuucuauauaaaguggauuucuuguauauaacuuauagauagauuuuacuuuuuuaaagcacccaguuuuauauggauuugaccuuuaguccucaugcuuacacaguaaguacuuuguucacuacacuaucuccucagccuccuucucuuaaaauuccaguuugaaauaucuuccuuaaaaagaaaaaaaaagaacuaucuuccuuuugaagagaguguuuagacucuuuguguauaauuucuugaggcagggucucucuacauagcccuagcuaucuggaacucucuauguagaccacacuggccucugccuccugaaugaaugucaagauuaaagacaugcauuacuauggccagcuugcauauacacuuuuuguugacaagcuucauauagggugguacaugcauguauucuugguauaugcaaggggccuaguuaaaaaaaaaaaaacccgaaauggaugcuccaugguuagaagugggaagaaauuuuuauuguggauaagagagagaaagaacauccaaggccaucugaaaaaguccagagccaagagaaaaagaaucagacuggacauagccauaucugcaaaacaagggagaauagcagggaauagcaagagauagaguagugggaaugguagugagagaacaguggaaauagugagaauucgggggaggggguaccuggucuauacagagaauaaagugggucugggggaaaggaaaccuguuaacugaaacaaacucgggguuugggguagggguggaggugaaaugggcuaggaugcuaauguggacuuugaaauguauaauggguacucaugaauagggacucuaggagccuagaggcuaacaugagcuucuguuucuauacauuguaagaaggagcuaaaucauuucaaaguaaguaggauauuguuagaaguuugugcuugugugcaucugacagcgugucacguccgaucuugguuugguuucauaggugcacugguuucguauuccagaagguuggaaaauuggcugcaacagcuguaggagguggauucuuucuccuucagguuugucuguuaaguuuuucuagguguuuggaaauucuaccugcucauuaacauauugugagaaauuguagccuuggauauauuacauuaaaauauaauguaauuguuuuugugugcuauuuuucaaugcuacuaaucauuugagugaaaucuuaauuccuagucacauuuuauuucauguuuauacuguuaagagccaccacgugguugcugagaaucaaacuuggauucuuuggaagaguagcuagugucuuaaccacugaacuaucucuccggcuaauuuuuuuuuucuuauugacuucuauaacaacuucacuguuuauaagugcuaauguuuuacuuuacauauacauguguucucuaauuuauuuggguaacuaauugguugaugguguuauggauaacccuaauuuaucagaaacaacauacuugaaucgauuuuauucuguccacauuuccaugaaaaauuauuuacauugaacuuacuacuuuggcuuucauuuuaacaucuuauuuuuaaauuuuauguaaaacuuuguaaaacucaguguauacauuaaaugauugccaacaguugaagacaguucuuuauuucuauuaccaaauauggaacauugaauguaguauguacauuuugcccaaaagucacaaaaauaacuaauuucuccaauaauguaagucaaaagaguuuugauuaccuauuugcaagauuuaucuugacaaaaagaaaugccaaagaccauguuccuuauuacuuuuuuauuacuguuaaauuuguagcuggcaaaccauacuggauacaucaaaguugacuggcaaagaguagaaaaagacaugaagaaagccaaagagcaguugaaaauucguaagaauaagcaaauaccaacugaggucaagagcaaagcugaggagguaagacuuguuuuguucagauuuaauauaugaaaaguacaggcaguuuuguguagaaaacaggauauauaauuaucuuagcaguauaaaaagcuuuaugauaacaaagaacuuggagcagugagacaaaaacuauauucuaugucacucuuagaauaucauuacuguaaaaacaauuugcaugggacaaggucucauuauauaacccaggcuggccuaaaauuccugcuucaaccucuuaagugcuaggauaacauguaugugcuaccuaguguauuucaugaaggcacuuuaaaaauguauuuuauuuuauuuuuuaucuguauguauuuuugccuauauguauaucuguauacguacagauacaaguguguaccuguggugcuuguaggggcaauaagagggcaucagaucaggggcuggagagauggcucagcaguuaagagcacugacugcucuucuaggguucccaaguucaauucccagccaccacauaguggcucacaaccaucuguaaugggaugcaguacccucuuuuggugugucugaugggugcaacaguguacucacauaaauaaaauaaguaaaucuuuuaaaaaagggcaucagaucucauggaacaacaguuaccaauggcuaugagcugucaugugggugcugagaauugaaccugggucuucugucuuuccagccucuuguaaagcuuaguaauugaaauauuugaugaccuuugucaguaaaugagaauacaaaggaaaugaagauaguaguuguacuuaacuaguucuuauaagaguggggguaccacaguuguugggguguacugccaaugugaacauuuugaauuacauuuuaucucugugccugcucaucuuugaaauagccaaacuguuuguucugcacaugauuaguagaaaugcuuagauuauagauugguagccuuuuucugaagauaaccagaugguaaauauuuucaguuuuugaguuauggucucuaucacaacaaccugacuuccucauauagagugaaaauagccauaaaugauauauguccuccacacacaugaaugcgcauucauauauacauacuccucagauaaacauaugaaaauauaaguaauuuuuaaaagauuuuucuuuaguagaccucuguuugaggaaauauuaagggcugcaguggaagugaaacaaggagacauaauguccuagauucauuuuguuucuggaauaaaguauucugaccaaaagcaacuuaagggaggaaaggguugauccagcuuacaauucuaggcuucaggccaucauugaggggaagucaaggcaggaacuuggacagcuaaucacauuaauccuaaauugagagcagagagaaacaaguggaucuuugcugucugcuuucucucccacacagcauuuccucugaccaaguaaucaauucaucgccaaagaccaugcggcaagaauuacagagaauguucuuggcugguuggcagacaggcuucugcucaccuagcuuuuuuguacaguucaugucuagggaauggugcugcccacaguauuguaggccauccuauaguagccaacaaucaggacagucccuuacaacaugcccaggucaauaugaucuaggucagugguuuucauccuuccuaaugcuguaacccuuuaauauaauuccucauauugucgugaccccccaaucauaaaauuauuuucauugcuacuucauaacuguaauuuugcuauuguuaugaauuauaaugcaaauuaucuauguuuucaaaugcucuuaggcaacccaagaaccacagguugaaaaacacugaaauagaaauucucuucucagauaauaguugguugugucaaguugacaguuuaagcuaacuaggauaucuagauacagagguagugaagagacacuguguacuuugcauaauggugcaaggaggauggacggagagugaugggaauguaacagugcaaauggcuuacaucguuggaaagugcuuaacuucaagaacugauuuggccuggccuggggauauggcuuaguggguaaagugauugccaugcaagucugaagaccacaguuuuggauuccuagcacucaugugaggccaggugggugagguggucugcuuucagucccagggcuauggcaagaaucaccagagcaagcuggcuagccugcaucguaaucucuagguccagcaagagauccugccucaguauauaauguaagugaaccaggaagacaccuaucaaucuuggcccuucauacguaugugcacauauucauauauauguauguacaauaaauaaacacauuacacacacaccacauaaugcaaaaacaaaaagaaaugauuaggucagaauguuggauauguauuauuucauauuucuccugaaguagucaggagaauaauaaaaugauaagauagccauacagaaugccuauccauguauguacuaaaccuuagaugaauaggaaguuuuguaguaaaguaacuuaguaucaaaucuucuguuuuucagguuguaucauuuguaaagaagaauguucuagugacuggaggauuuuuuggaggcuuucugcuuggcauggcauccuaagaacuucacuucauuguucuauuuuuauaguuguuuguuucuugccagcagcuucuacacuccaacauaggacaaucggcacuccucuuccucaucuucuccugugccuuccucccuguuguagcaaaucugaauggcuuuaauaggcuucuccuggugcaaggucuucucaggccuucucaauuuaacacguuggaagagacaguagguguuaacucuuccaguacccuccuuacuugguugguguguagcuuaacaagaauguuccuuuuccccuauguaagauccuuuuccaaacucaauuuguuaccuuauuacauguuacaugaaaaggaaccaaauacauuugccuuuaagcaugaaaaaauuuugguaucuugguguaugcuuucuuuuuaaauugguuuuaggcuauagaaagagagguauuuauacuuacuauaauuauguugccaaaauggcaguguaaguaccaacacuaaaaauauuaaaugaacuucugcaaacaaugcaugaaguaauauaaguauuauauaugguaggugggucuuuauggaaaccagcuguaagaacuucaugaaauacaacauuuaagcaagaauuugaaauguauuucuuuuacauacgaguacucuaucugcauguucaacucugugccaaaucccauuacagaugguuguaagccaccaugugguugcugggaauuggacuuaggaccacuugaagagcaaccagugcucuuaacugcugagcaucucuccagucccuuaagcaaaaauuuuaaagagauguuccaggcauucagaauaagaauagcauauguguaauaaauuauuuucaucaaaugcaaucuccaucagaaauauugcuuaauauaaaaauccauguauacuuuacauuauuccauaauagcuauuaccaugagcucaacuccaacuacaaaagcaucuuccagaaguuaagucuucuaucaucuucauuauacccacagggcuuacugcuuaauagauuucaaauauuuuugaauauauuaauuguauaaagaaagcuucccguuaaagguuagguuuaccucaaaugaauucuuagauauguagaugauccuuugugcaauaguauauuuuuaaggucauacauuaagcauaauuacuuuuuugacauaccuuaacauugacauacuuuugaaaauugaaacuaccaguggauguguaaaacuaauuaggauucaccuauuugcauuuccucacuacguuuugauuuuauuugagccaauauaaguuauucuacuuguaauacauauuaaucaucuuuccuuacaugguaguauaaccagccuugguauauauuuuucucaaaaauuugaagaugauuuuucacuauuuacuguggaaacauaaagagaguacagugauuuccccaaguauccauugcuugccuauagcaaucauguaauuguauuuuuuaucaauuauuauaauauaccugccauuuuauuguuugccauauguauucaauacuaaaaaucuaaauauuuuuuuguuuuaaaacuuuaaaaaagggcuggagagauggcuuagccauuaaaggcuaggcucacaaccaaaaguauaaaacuuuuaaaaaaaucauaauaccuuuuuauuacagaaaaauuaauaaugguuaaugucaaaaccaugcaguauuuaaaauccucuuuguauguacaauauauuuauugacaccugug

SEQ ID NO: 12266 - RNA, 6148 nt, Mus musculus
ucacaugaucaaccauuuuacuaaauacaagcauauuuucauucacauacagcuaaauaaagaauuuuucacauuucauuacaguguacaacaaauugaggcaaaguauacaguacauuuuguucuggaauauaagacaaucuaauccaacaugcaguugugaucguuguuacaguuaaucuuuucuuuaccuauguaguaaaauagcuucuaaugcauuauccuuaguauuuuaugaacaccugauuuuuucacauuuauugucuaaaacccacuuauugcagugacaacagcacugaauucuacuaaaaggauuuuugagauuuuuuuaaaacuuauggaagaagucaaguucagccaccucugcugcauuuaugcuggguacuuugaaacccacuuuuaaaagccaggaauggcaaaguauauaauguauuuucgucaagaaaacuguagaccuguuuuauuucuaccccugcccccuugagucaacaagagucuaaucaacucuuauuuauccacuggauaauccuggguuuuagaacaaucuagacauguguaucauuguugaaauuuuguguuaacccacaaaaaagguuguauuugccuucuacaaccaagaaucuggcaauuuaaaauacgugaaaugauuauagaaugaaugaucauuuaucugcaauugauaaugugaauugguccaaaaugacuuguuuauacaaguuggagcaaagguggcuaaacaaccuuucauaauuuuuauuauuuggguuauuuuagcugaaacaaauucccagauucacacauauucauucugaacucgaacaggauauugcaaauauaauuugccauucuuucuaccacaauguauauaugagaaacuugacucuaaucagaauaguuuucuuacugucaaaaguauggcuuuugccuagcugaacuggcuacaauccaaaaagaaauuuaaagcaucacuucuuuuuaagaagauaaugaauuuuucaucucagccauucuaauuugcugaugugguuagcugucuguucaccugagaauuaagagcugacucucucggguagacaggagcccaauguagguacauagcagacagguagucaaggucauugugaggugaguacuuuauccccaacccacuccccauuguuguauuugguuccuuuuaauaaaauauucauaguguuugugagaagaacauuuauaacccauacaguuuuaauguguuuucaguugugcaguuaaucccuuauuuaaugcccucuugucaauaauaccugaguggccuuuaccuuuuauucauuucuagauuccugcaagauuauagcugagcuguaaaacaaggaaaacauauucuaucauguagagaauauuuauuuauagucacaugucuccaaagguuaauaaauuaaucacuuauucauaugaauaaugauccagugaaaaaagcuagguaucagguaggcuugguucuugcuuucuuauuauguaaaaugggaucaaaaaucucacaguccuauuauggugaucaaaugagugaaauaaauuaauaugaauaauuuuuaaggauuccaagacuacguguugagccaauacucagaauagaaccaaugaccaagggcuugacuuaggguuuuuguuuguugacaaucucuguguugucguugucagguaucugaagaagcaagcaguauacuuacuucgggauuaugguucccugaugcagugaaaguccagguaugauuagaggggaaauaauguggccuuugaguuacaguguuuccuuuuucuccuuacaugaucauuuuacauggaagaauuucuuucacauaguuggcaacuuuaucaugccaguguacacuuuucucaaaugugauaacaacaauaugugaaugacuucccuuuucauauucacagcaguuuuacuagaaugcuagaccuugaaagagcuuuaccaaauaguugauucauaugggcuuuucauuuuacaguugaacuguuagaaguggcuugauguguuuguauaaaacccagcacacaucuggcacgguauuaucauugaauaaguugauaucauacucuuuuuuuuuucaguuaucuuaauuguccccaauugauacuugauuucuuucuauauguuucuuuauggucaccaugucugaaaaguuguaauaccaaggaacuguuuaucugucuguagguguuuuccuggaaccuaacuuucaaauacccagacccuuaauaugugguccacaaagggcacacagagcagccauugcugagccuggcccacaaaacaaggucugguccagccccugucagcaauuuagucccucagucacagcacccaggcucccuaucuacccacacaugagccugucagagauccaggccuaggaagaaggcucauuuauuauccaaacguugaguucucuucagucacauaaggauucuauuuauuuugauaacuuuuaaguucaagugggagaguauguuuugaaaauggaaggguuaacuagcacaaacaucuccucucugauuugauaaccucuucugaagaaugaacaacauuugguacaaauccacucuucaccccuucccaacccuccuggauuguaaucuccccccuuuuaaccagcucauauaugucucuugucaggucugugaaggcuuucuccacauuaauggcaucucgggcugacgucucaauguacuucaugccguaugcagcagccaguuucucggccucguggcgagucacuugccucuguguauccaggucacacuugugacccaccagaacaaauacaauuugguagggcugaacguguacuuuggucucuucuaaccacucauggacauucuggaaggaccugcgguugguaaugucaaauaagagaagaccaccuacugaauuccuguaguaggcgcgagugauggaucuaaaacacaagaaagaaguaaagaauaaaguucgugcucaaacuccuucacuccaacgaacucaguguauucuaguguuccugauuccugacaguccuuuaguaaauacaaaugcagucuauaacaauaaugacaaguuuucaacugaguaaaauguuaagaaugcucgugaacuuucagguauuuucccuugaauuuauuauaauugauaaccccugaaaauaucuugcaaaauauuucauuuuucuauuuaucauuaaccuguuuuguguuuguuuguucccguuauugcuauuuuuuucuagcaggggucaucaaucaaucucuucugugaggaaaaagacaaucuugcuuuguauuuccuaagccacuugggaaugagaaugggaaaauggggaugguaaaauguucugaggcagggcuagagaaauggugcaguaguuaagagcgcuauuugcucucccagaggaccugaacuuaauuuccagcacacacauggcagcucacaacugucuuuaauuccagcuucugaggaucugacauccucucuugaccugcauagucaccagccacucaugugguucacaaacauauauguaggcaaaacucuauacacauaaaauaaaacaacauauuuaauauuguucuggagaaaauccuuccaucuguauucacugacaaaauucaaagaggcugacugaggaggcacuagcugggagaaucugccaaaauagugaaaguguuccaaugaaguuauauuauuauuuugaaucauguaauuagguuauuuuagccuacuuguacauuuauuguacuucuuaaacagaagaaacaucacauauuuuaguuucuugaguugacgaaccuuauuacaaacauauaauguguuuugcuuaagaauguagaaucucaugaaaggauguagaauaacuugccuauauaaucacuugcuuuagacuacugcaauuuuugaaaucuauuuuuaggauuucugucuucuugagaggguaugauaaauaauagcugaaaauguaugggaaaauggcucaguguuaaugugggggaaaugucuagggaauuacagcccaagcuagaagaugauauggguaggccuuacaaauaaguucaggucucuagaaccagggauauuagcccugggaaauggauauucauaauuucuuuauguuugaagauuaauggggaaugauaauuguauuggaaaaugcuccaauuugugaaaauguugauuugagaaaucaaugagcaguguauccaagcucuagaauauauuuaugcauuagugguuuguauuuagcacagaagauaucaaaguauuuuaaucauaguguaaaguuauauagaacuagacacugacccuaaauuaaaaaaaaacauaaaaauacaaaugacauauuggggaaauagcucacaacauacaugacauaaaaggguuaauguucuuuuuguuagacagaaguccaggcuggccuucaacuacuuaucguucucuugccucagccuucagagggcuggaauuauagggcuaugccaccacuguugguguugggauaaucuguaaaguaguccuacaaaucaauacuauauaauacauaauaaauaguaaauaugaacaagccauucauacagagaucccagcaaacauauauaagagaccuuucuuuauucaugagaacuuauauaaaguauuugccagagcuuuguacaagugggaaguuagaggcaacuuaauuaccuaacuaguaucuucugcguccaacuaauguucaguggagaaugagucaguguuuaugaacugaguccuuuugcucugguuccuccuguucuaccuuacuuuaguucaaacuguucucuacaaaguuuuuauuaguuuguuuucugucacuuauguuuuauuuaugcuuuucccuauucugggcauuuccuaucuuuacuugggcuucaucuucuccggucucuccucuguauucauacaugaaauuacaaauaaauacuacaaaggaagagcaaaggauugugaaagaaaaauaaacaugcugaaugauuaugugcccagugguacaguagggaguggcauauaaauacaaacaacaaaacacucuuuuguguguugccucuguuucuguuucuucugaccaugcuaguacugaaguuccaagaagucaggggcucugacuauuuacuuuauauggaauucucuuaugugaguaaccucauacuauuucuucagaaaugauuccacccucuggcaacugacuguaugaugguuacaagacagucaauuaaucagucuccauuuccuuuauauuagggcauauucauucucucugugucucugucucucccucugucuuuucuuccccacaaauauaaacggauauauagaaagaagucaauauacaucuaccuaccuauagcuuucaguuauguuaaaaugacuuggauuuuuuuaaacuaugaaucauagggucugauuuugaugaauuauacagugaucaauuucaaguuauuuauuagcuaccaaaagcagauugauggaguugugguucaaauaaugugauaaugaauggccuucuccugccugggcgguucuuuccugcaucgaacucaaagguagcucaaagugggcuugaaaagccccagacagacccuuguuugucacccuggcagcaucgcgaaaagaaccgggaaguccucuuuccccagggacugaauaagccccaaagacccucccacugcucgcgcgggcccguggugcacucccaccugaaccucucuugacccgcuguaucccagaucuggagcuugaugcguuuuccuggcucgaucuccaccaaacgggagaaaaaaucuacccccacggugggaucugaaaccugagcaaagcggcccucggugaagcggcggaucaggcaggacuugcccaccguggaaucgccgaugacaaugagccggaacugguacagccagauggccuccauggcaguggccuggcaggacucuucggcccgggccuggggaggcgggagggggcgccccaccaaggccuuagcacagaucaacccguuucuagaucggccgcgagaacaucacuggccugguagccugaagcaagguaggcccaggcgcugggggaacgaagggauggaugcugcgcucgcaaaggugaugaaauggc

SEQ ID NO: 12267 - RNA, 6148 nt, Mus musculus
gccauuucaucaccuuugcgagcgcagcauccaucccuucguucccccagcgccugggccuaccuugcuucaggcuaccaggccagugauguucucgcggccgaucuagaaacggguugaucugugcuaaggccuugguggggcgcccccucccgccuccccaggcccgggccgaagaguccugccaggccacugccauggaggccaucuggcuguaccaguuccggcucauugucaucggcgauuccacggugggcaaguccugccugauccgccgcuucaccgagggccgcuuugcucagguuucagaucccaccguggggguagauuuuuucucccguuugguggagaucgagccaggaaaacgcaucaagcuccagaucugggauacagcgggucaagagagguucaggugggagugcaccacgggcccgcgcgagcagugggagggucuuuggggcuuauucagucccuggggaaagaggacuucccgguucuuuucgcgaugcugccagggugacaaacaagggucugucuggggcuuuucaagcccacuuugagcuaccuuugaguucgaugcaggaaagaaccgcccaggcaggagaaggccauucauuaucacauuauuugaaccacaacuccaucaaucugcuuuugguagcuaauaaauaacuugaaauugaucacuguauaauucaucaaaaucagacccuaugauucauaguuuaaaaaaauccaagucauuuuaacauaacugaaagcuauagguagguagauguauauugacuucuuucuauauauccguuuauauuuguggggaagaaaagacagagggagagacagagacacagagagaaugaauaugcccuaauauaaaggaaauggagacugauuaauugacugucuuguaaccaucauacagucaguugccagaggguggaaucauuucugaagaaauaguaugagguuacucacauaagagaauuccauauaaaguaaauagucagagccccugacuucuuggaacuucaguacuagcauggucagaagaaacagaaacagaggcaacacacaaaagaguguuuuguuguuuguauuuauaugccacucccuacuguaccacugggcacauaaucauucagcauguuuauuuuucuuucacaauccuuugcucuuccuuuguaguauuuauuuguaauuucauguaugaauacagaggagagaccggagaagaugaagcccaaguaaagauaggaaaugcccagaauagggaaaagcauaaauaaaacauaagugacagaaaacaaacuaauaaaaacuuuguagagaacaguuugaacuaaaguaagguagaacaggaggaaccagagcaaaaggacucaguucauaaacacugacucauucuccacugaacauuaguuggacgcagaagauacuaguuagguaauuaaguugccucuaacuucccacuuguacaaagcucuggcaaauacuuuauauaaguucucaugaauaaagaaaggucucuuauauauguuugcugggaucucuguaugaauggcuuguucauauuuacuauuuauuauguauuauauaguauugauuuguaggacuacuuuacagauuaucccaacaccaacagugguggcauagcccuauaauuccagcccucugaaggcugaggcaagagaacgauaaguaguugaaggccagccuggacuucugucuaacaaaaagaacauuaacccuuuuaugucauguauguugugagcuauuuccccaauaugucauuuguauuuuuauguuuuuuuuuaauuuagggucagugucuaguucuauauaacuuuacacuaugauuaaaauacuuugauaucuucugugcuaaauacaaaccacuaaugcauaaauauauucuagagcuuggauacacugcucauugauuucucaaaucaacauuuucacaaauuggagcauuuuccaauacaauuaucauuccccauuaaucuucaaacauaaagaaauuaugaauauccauuucccagggcuaauaucccugguucuagagaccugaacuuauuuguaaggccuacccauaucaucuucuagcuugggcuguaauucccuagacauuucccccacauuaacacugagccauuuucccauacauuuucagcuauuauuuaucauacccucucaagaagacagaaauccuaaaaauagauuucaaaaauugcaguagucuaaagcaagugauuauauaggcaaguuauucuacauccuuucaugagauucuacauucuuaagcaaaacacauuauauguuuguaauaagguucgucaacucaagaaacuaaaauaugugauguuucuucuguuuaagaaguacaauaaauguacaaguaggcuaaaauaaccuaauuacaugauucaaaauaauaauauaacuucauuggaacacuuucacuauuuuggcagauucucccagcuagugccuccucagucagccucuuugaauuuugucagugaauacagauggaaggauuuucuccagaacaauauuaaauauguuguuuuauuuuauguguauagaguuuugccuacauauauguuugugaaccacaugaguggcuggugacuaugcaggucaagagaggaugucagauccucagaagcuggaauuaaagacaguugugagcugccaugugugugcuggaaauuaaguucagguccucugggagagcaaauagcgcucuuaacuacugcaccauuucucuagcccugccucagaacauuuuaccauccccauuuucccauucucauucccaaguggcuuaggaaauacaaagcaagauugucuuuuuccucacagaagagauugauugaugaccccugcuagaaaaaaauagcaauaacgggaacaaacaaacacaaaacagguuaaugauaaauagaaaaaugaaauauuuugcaagauauuuucagggguuaucaauuauaauaaauucaagggaaaauaccugaaaguucacgagcauucuuaacauuuuacucaguugaaaacuugucauuauuguuauagacugcauuuguauuuacuaaaggacugucaggaaucaggaacacuagaauacacugaguucguuggagugaaggaguuugagcacgaacuuuauucuuuacuucuuucuuguguuuuagauccaucacucgcgccuacuacaggaauucaguagguggucuucucuuauuugacauuaccaaccgcagguccuuccagaauguccaugagugguuagaagagaccaaaguacacguucagcccuaccaaauuguauuuguucuggugggucacaagugugaccuggauacacagaggcaagugacucgccacgaggccgagaaacuggcugcugcauacggcaugaaguacauugagacgucagcccgagaugccauuaauguggagaaagccuucacagaccugacaagagacauauaugagcugguuaaaaggggggagauuacaauccaggaggguugggaaggggugaagaguggauuuguaccaaauguuguucauucuucagaagagguuaucaaaucagagaggagauguuugugcuaguuaacccuuccauuuucaaaacauacucucccacuugaacuuaaaaguuaucaaaauaaauagaauccuuaugugacugaagagaacucaacguuuggauaauaaaugagccuucuuccuaggccuggaucucugacaggcucauguguggguagauagggagccugggugcugugacugagggacuaaauugcugacaggggcuggaccagaccuuguuuugugggccaggcucagcaauggcugcucugugugcccuuuguggaccacauauuaagggucuggguauuugaaaguuagguuccaggaaaacaccuacagacagauaaacaguuccuugguauuacaacuuuucagacauggugaccauaaagaaacauauagaaagaaaucaaguaucaauuggggacaauuaagauaacugaaaaaaaaaagaguaugauaucaacuuauucaaugauaauaccgugccagaugugugcuggguuuuauacaaacacaucaagccacuucuaacaguucaacuguaaaaugaaaagcccauaugaaucaacuauuugguaaagcucuuucaaggucuagcauucuaguaaaacugcugugaauaugaaaagggaagucauucacauauuguuguuaucacauuugagaaaaguguacacuggcaugauaaaguugccaacuaugugaaagaaauucuuccauguaaaaugaucauguaaggagaaaaaggaaacacuguaacucaaaggccacauuauuuccccucuaaucauaccuggacuuucacugcaucagggaaccauaaucccgaaguaaguauacugcuugcuucuucagauaccugacaacgacaacacagagauugucaacaaacaaaaacccuaagucaagcccuuggucauugguucuauucugaguauuggcucaacacguagucuuggaauccuuaaaaauuauucauauuaauuuauuucacucauuugaucaccauaauaggacugugagauuuuugaucccauuuuacauaauaagaaagcaagaaccaagccuaccugauaccuagcuuuuuucacuggaucauuauucauaugaauaagugauuaauuuauuaaccuuuggagacaugugacuauaaauaaauauucucuacaugauagaauauguuuuccuuguuuuacagcucagcuauaaucuugcaggaaucuagaaaugaauaaaagguaaaggccacucagguauuauugacaagagggcauuaaauaagggauuaacugcacaacugaaaacacauuaaaacuguauggguuauaaauguucuucucacaaacacuaugaauauuuuauuaaaaggaaccaaauacaacaauggggaguggguuggggauaaaguacucaccucacaaugaccuugacuaccugucugcuauguaccuacauugggcuccugucuacccgagagagucagcucuuaauucucaggugaacagacagcuaaccacaucagcaaauuagaauggcugagaugaaaaauucauuaucuucuuaaaaagaagugaugcuuuaaauuucuuuuuggauuguagccaguucagcuaggcaaaagccauacuuuugacaguaagaaaacuauucugauuagagucaaguuucucauauauacauugugguagaaagaauggcaaauuauauuugcaauauccuguucgaguucagaaugaauaugugugaaucugggaauuuguuucagcuaaaauaacccaaauaauaaaaauuaugaaagguuguuuagccaccuuugcuccaacuuguauaaacaagucauuuuggaccaauucacauuaucaauugcagauaaaugaucauucauucuauaaucauuucacguauuuuaaauugccagauucuugguuguagaaggcaaauacaaccuuuuuuguggguuaacacaaaauuucaacaaugauacacaugucuagauuguucuaaaacccaggauuauccaguggauaaauaagaguugauuagacucuuguugacucaagggggcagggguagaaauaaaacaggucuacaguuuucuugacgaaaauacauuauauacuuugccauuccuggcuuuuaaaaguggguuucaaaguacccagcauaaaugcagcagagguggcugaacuugacuucuuccauaaguuuuaaaaaaaucucaaaaauccuuuuaguagaauucagugcuguugucacugcaauaaguggguuuuagacaauaaaugugaaaaaaucagguguucauaaaauacuaaggauaaugcauuagaagcuauuuuacuacauagguaaagaaaagauuaacuguaacaacgaucacaacugcauguuggauuagauugucuuauauuccagaacaaaauguacuguauacuuugccucaauuuguuguacacuguaaugaaaugugaaaaauucuuuauuuagcuguaugugaaugaaaauaugcuuguauuuaguaaaaugguugaucauguga

SEQ ID NO: 12268 - RNA, 60915 nt, Mus musculus
gccgagucgacaauaacaaaccccacggcggccgcgacccagcccugccaagcucucagugccucggccggcggacucggguccccgcgcggagccgaggggccggagcagcggcugcgcccgacucccauccuuccgggccucgccggguacucggcggcugggcgccgacgguugugucgguuggcggcgccgcaggggcgguugauagccgccgccgaggccagggcggcggcagaagauggugcggagggccgccggcuguguugcugccgcgggcggaggaggcgcugccggguaagugccgccccugcucccaucuggcggcgggcuuggcccggccgcucagcaccugacggguucgccggagcgucuggcggcgccggcucggagggucgccgcggcaguccuacggggacccugaggcccgcuggccgcugacaggaucgcgggagcggcaggacgccggugcucacccgaggccugaaucgcggccuccgucuccagggcucggugcacuggagugucgggcucgggaaaccggagaggguuugggccagggccggagugcccugacgggaggaaccuagaggugaugccuuugucccgaccccggagugcaagcaucgguguaaaguuacuccuuggaaugacucagccucgcucgccccgcagauggauuuggggugggggcuuaugggaguaccaaaacuugguacaaaugacagcuuucgaacgugcugucaguacuuucucuacagagugguggaugugcuauggugacuguuuaugguuucguaauccugucccuuccgucaugagucuuuaaaaugugaucauuccaugaacugguacauaggacugaugccacggaacacucguggacucacuuauugauagagucccugcaagacauucaguugggugcggauguugacaagucuauuaugagcguuaaaauuuauacauuuugcuaaccauuuucuguaaagaauuggugagacuuacuuaucugaggguuugcaaagcuagcaagcaguuuagaagcagccuaaaaaugaaccaaucuguguuccuagucaaauguugguacuguauuucaguaggugguuuuucuuuuugggggaggggaucuauaaauggacuuguuaugugugaaauauuuuauuuagucuuauuaccaaauacaacgcaaaucaucgcuuuccaauuaaguuuuuguuauguuuuuuagcauuuauaucuguuuuaaacguuagccaaggcuuagaagguagcugcuauauucaucucaacauuccaggaggcugagacagaaagauggcuuuaaguuauuugaguuacucaguaaguuaagguggucuugggaaucauagcgagaacaugucuugaaaaaagaaaaacaaaauaaaugguauuuacauaguuaugccaugggugugucaggcccauaauguagcauuuacauugauaaaucuuauuaauguaauugguuaguggacuuaggcaaaauuuaaaaauuuuguuuuauuuugaguuagggaagacaaugaagcagcccucugccuggagagaagaggguucucuugggguggggggagauggagggaacaggcagcacucuuuauggcaaacaucaggguuugaaugcacagcagauugacuuuacacauagaucuguaaaagccaaaggacaaaagaugaaaggacuggugucucccccaguuguuuuuguuuauuuguuuuguuucuugccuuguuaguguguacugcuaggacuaaaacucaguuuccagcaugcucuguaagguguaauaucccugagccacuguuagaccugagaggaaaauguuucaacgacuaccugauuaagagagcuuugcuuagagguguacauuguaguugagguugaccuucagcucuuggcccccuuuugccaagacuugacacaucucagaguaagcugugguaaguauucauuagugaugccuugguaauuaauuauucagcagcaggcaaacuccagucucuuaucauucagaagaaaagugagaacauaagugaacauagaagcaagccaagauuaagaagugugugucucuauuggaggguggguuugaaauuuuggauaaggugucuuauugucuugagaauuuaagaagcuaugucuacuugacaaaaggacccauuuggagguaugagagagagaagaaauaaaaaauauggaaggcucugauuaaaggcauauuccaugagagguuacugaagauagaaugccaggauugagggguaguaguaggaagaggcauucuguagacauucaaguuuuuuuguuuguuugguuuuuguuuuuugcuuuuuuuuuuuuuuucucgagucaggguuucucuguggcuguccuggaacucacucuguagaccaggcuguccucgaacucagaaauccgccugccucccaagugcugggauuaaaggcgugcgccacuaugcccggcuaacauucaaguuuuaugcauaguaauuuuuuuugguuuuuuuuuuuuguuuguuuguuuguuuuucaagacaggguuucucuguauggccccggcuguccuggaacucacuuuguagaccaggguggccuugaacucagaaauccaccugccucugccucgagugcugggauuauaggcgugugccaccacaccgagcuguaguuuuuuuuuuuuguuuuuuuuuaaaauggcucauggacccugcauguguaaaggcacagaguugagugucagucgauauagcaagucugggaaacaguugaacucgaaucuguuccucacauguugauugaucuuacaaaguacaccuguaaauaacacugaacuagaguaacauauaucucauauguguguguuuagauaacccuugggcauuuuaaagaaggaaaaaugaccaauaucaauugcugguuuagaaaggagguuagagaagcagauuguggcauguuggguuaugcaauguacuuuuuagauaaaaucauaguacuuagcacauuucucuagaauucuuuuugcauuauggaccuaggaagcguaguuugcuuaucauaaaacugauuauugucuaagguccuaaaagcauuacuuuuccuuuuuacccuucuguuaaguuuagugagucugcaagugugugcagaacuugaguggucauaaggagacuuaguaguuucagcuuucucagauguuuaaugagugcccuuaagauuacugauuuuugcuggauuuaauucuaauauuauugacuuguaauuaugaaaacaaaaacguagugaucuguuuucauuguuugagacaucaguuuuuccuucacuauccauauaaaaauuggucaguagcugcccaaagaauauguauccagauuauaauucacuacuauucuguucuucccauagccuuuggugacagcaaaugacauuugauacugcccuguguuuauagucuuggucugauagaguaaaagcuaauucaguauuauagguaauuuggguuuuguuucauaguuaauauacacuguaaaguaaaauauacaauuagaaaauguucucuaaagucauggauuuuauauaguuuugaugaauuagauaugaugccagaauguuagugccguaguguaaaauuauuuuuauauuaugcaguucagguaagauacaugauaguauguauggcauuaugguggaaacaaaacugaauaucauuacuuguucuuuaaucuucacaaguacuguggcaaauugacucauaaaauaaauguaaucuuuaaauauuugggggcuugaaauguaucagcaguuaagagcacucacuucuccagaggaccccaguucaguuccagcacucacuuuauauugcucaccaccugcuguaaguccagcucuagagagauccaacaccaucuguagaacgaaggagagagacagucacaaaccgagacuuuuuuuggggggggguauuuuccuuauuuacauuucaaauguuaucaccuuucccaguuccuccccuuucuggaaacacccuaucccauccucccuucuauguggguguucauccacccacucccaccucccuugcccucuggggcaucuaucaagccuucauaggaccaagggaccucuccucccacugaugcaugacaagccaccuucugcuacauaugcaggaggagccauguguacuccuuuguugaugcuuauucucugggagcucgggggucuagcugguugauaauguugugcuuccuauaggguugcaaaccccuucaacuccuccaggccguuuucugacucuucuauuagggaccccaagcccaguucaaagguuggcugugagcaucugccucuguauuuguaaggaggcucuaacaaggcuucucaggcgacagucaucagacagacacucuuaacuauguagaccuggcugaccucaguauuauaaaaccagauuauuguguauaugaaugugccuacucuacuacugaauuccauuucugauuuaaaaguauuucuguucuguuuugguuacaagcauguuauauuaguuaucuccguguaaugcuuaccugagcaugcuuaccuagugucagagaaggcaaacacuuaagauaugaaccuuuaugaaacagauuuucuuugugaagaagauggcaguccuacuguuuucuccugguagcuguauauggggugaucuaauuugcagaggcugacacccaguuguuggucugggccaccuaaaaggugguacaccugauuugcagagacugacacccaguucguuuuuugguuuguuuguuuguuuagauuuauuuauuuuauguauaugaguacacuguagcuguauagaugguuguagccuucaugugguuguugggaauugaauuuagcacuuuggcuugcucagugccuacuugcucuggcccaaagauuuauuuauuauuauaaauaaguacacuguagcugucuucagaugcacaggaagaggacaucagaucucauuauagauuguuguaaaaccccauguuguugcugggauuugaacucaggaccuucggaauaacagucaguguucuuacccuuugagccaccucaccagcccugacacccaguucuuggucugggcaacccauauggccuuuguggugaauguuauuuucauugaugcagaaaccagucaucaucacucagagugguagaauugcuaagaacugcaguuugcagaauuagaaaugagauaaaauuacuucaaauugcuuuucuccaugaggccuuuaguuugcuuucuuuaguaacuuccagaucuugugcucuauuaaacuugaaaacaacuugaaaguauuuauauuccuagcacccaguaccacgccuggauuauuuagaucucccccauuccuacccccaccccauguauucggagucugaguguuuacuuugaaaaucuugaaaaccuugaaauguaagaaagccaauucugagguuuucguaauuuagaaaguuggugguaaggcuagagggaugggccuuauuaucacagugguaauuuuucaagaggaauuuuaaaauuaccucaguugaaaaguuggcuggacauuaaaauaauuuugaaacaaauucucacuaugaagcuuuggcugguuuggaacuuguuacguagaccagucuggccuccaucucugggauuuuacuaccucuacauccuuggugcugggauuaaaggugugcagguguguacugccauaccugacaaagcaagaugaauuuuuuucugagaugauuucugauuauuuuguauaaacauggaaguuaaacaucacccauauauucuguauaaauguaaugggaucauuuuuaauuuaaaaauuuuuguuuuagauuguuuuauauggcauuggauacccuggaauuggaguuguggagaguuaggaauugccauauggauguuggaaacauugaaagaacaaguguucuuagcagcuaagccaucuauccaccucuucccuccaucguuuauagccaacuaaaugggaaggaccaccuaaauuccugggcuacacacccagcucagaaauaauguuaggaccauauuuggacuuuaaaaauuuagauaagcagagauuggaggagcaauuuuuuaccuggccuagaaaugcaaaggguugguauaguuuucuucaugugugggagccuuggaugauacuucuggaaaaaggaaccggggugaauuaugaagcuauuaaacauugaagcuuaauacccaccacuuuuagugauuuuauuuuaaauacacuccaggacacuguaaaggauucuaauguacauuauugcucuccuccuuaccaacucuguaaauguaucauuuucaguuugaagaucauaaacugagauguuaagguauugagucccagugaaguagauagaaucuuagauagggauaaaucuuguuccaaacccugccuuucuaggugaauuaugugccagaguugucaagcucauauauguauugggguugccaacuuguuuugguuuuguuuuguuuuucgagauaggguuucucuguguagcccuggcuguccuggaacucacucuguagaggcugaccucgaaucuaccugccucugucucccaagugcugggaucaaaggcgugcacuaccacgcaggcccggcugggguugccaacuaaaggaaguaagugggaucauguagguugccuucucuggaauugucuuuacuuauuuugcagaaagacucagugaaaaggaagaaaaaccugccuugaagaaagcaggguuuagcuaacauuauaguacaugaaugguagcugcagagaagccagggaaagacaaugagaagcagaauuugaggccaccugguaggaauguugaaggaguggaauagaaagguaaaagagaauuugcagucuaaagguucugccaugacguccuaaaagaaacaauggacagaauuaaacagaaaugaguuuggauaccaggagaaugauaguuuugucuacaauaaaaugaaaguaaagauuuaaaggaaaagcagcaaauugaaaauuggacuuuuuggcugaguauggaguucagcaguuuaugugucuugguuuuuuucuuuuucuuuguuuuagacagggucucauguagcucagcuuggccuuaaacucacugagaauaaccuugaaguuaugaucaaucaucuugucuccaguucccaaguguuaugguuacugggguaugccgcaccuggcuucuacaauguuugggagugaacccagaaauuucucuauacucaccuggccaagcucuuuacacagucagccuuuugaaggcaguuacacugugaugcucagguguacuucugugucucuaccaaugagcauacaaguccugaaucuacaugguguaauguucaccugacauacagccuccuaugaguuuuaaucuacuacaguguaaauguuuguaaacaguuccuagaaugaacugcugagggaauuauaacuggaagacuauauauaguaauagcacacuugcuugccuacuaauuuuuaucucuaguucuaaacuuuuaguacuguuaccugaggucaaaguucaaguauguaccaacauaccugcucaucuuuuauaaaaacuuauuuuuauuuuguguauagguguuuugccugcauuauuacaaacaugccaggugccuucagaggggagaagcugugucagauccccuuggagucacagauggcucugagccuuauugugggugcuaagaaucaccugaguauccucuagagacguaacaagugcucuuaacugaugagccaucucuucugcaccccaacuccuaguuauugaccaccugccuaaguccugucauuaguuucuagucaauaacacaaaauuauauuucacugagaaaacacuagagagaaauaccaaaacaugucagucaugcuuauccuagugaauuuuagaauuucaauuggaggagagaaaaguuuuuuuuuuuuuuuuuuuuuuuucuccaaaagauaguacuaggaugauguagcaccugugugaccccagcauacaggaauucaaauauccuggaguauguggauggccugaacuaugcagccaaaucuuaucucaaaacaaaaacaaaaaaacaaaaaagccaggcgugguggcacacgccuuuaaucccagcacuugggaggcagaggcagguggauuucugaguuugaggccagccuggucuacagagugaguuccaagacagccagggcuacacagagaaacccugucuugaaaaaccaaaaaacaaaaauaucaggaugugcauacuaaacuuaaaaaugagaacuacuaagguggcacaagacacuguuuuagcauucagauugccacuaacuauuauguguugaaaagguaacaaacaaugcacauuggcuuuuucccucauucuuguuccuuccccuuucuuaucuuuuuucucuugagaccaaaaaaaaaaagucagucucauguacuccaggaagacugacuuggaaccccuaauccuccugucuuugcggucuguaccacccgccauaccuauucuacuggcagcaauguaaguuuaacucuuaaagagacuuaaccugcacuguguacuaaaaaugcacaaagaacugcuugucuguuuuagagucucaggguagucagucucaaauucaauugaccccccugacucugucuucuaaggaugcuauuaaguguaugcucguacaccugcugcuugauuuauuuuuuugggggggugauuguuugcuugcuugaugagauagggucucuauguagcccuagcuguccugaaauucacuacguuguucuguuucaccuugucuccccuaaauggucacucauauuuacuccuuuaauuuuuaucuuuagggagacagaagaauaaaaacagaugacucagaaaaccuauagucaagcucugcccuacuauaugaccuugauuggauucaucuaccaguucuuugauuugauaaguaaagaccuauuucccaagaaauaaucuucauauggagcaauguccguaucaauucagaccuaucucauacucagaaauaguacucgcuaauguaaaaucuuuccaacugcaaaucccauuguucaaacaugucuaaauguauucuucuuuucccuuguuuuggggauugaguccaugggaacauuuccccaagaauaaagaaaaaaaaugacuuuuuuuaaugcuaguucugaaaauuaaaugcaacaaacaaguuuaguucauagaagcaacucauggaauuaaggauuuuuacauaaauuaagggcagauguaaaaaaugaauaaugagcaaucccaaaguuacaaguuaauaguuuaguuucguguguguguguugaggucagaggaugccauccucucucaccaugcggucagcuacuauagguggugcauuuacuuccugagcugucuugccaggcugcaguuguuuuaggaguuaguugugcucagugaggauacugaguuucuaauuggaguugguuuuauguaugcagauuucugguuuugguuaauugaagcguuuguugugggcuuacaguuugagugggugagaccauaacagagagcaugacagcaggcagccaugcauggcaccagaauuuuacauucuaguguacaagccugagggagaaaguugccauuuuuaaaaaucaugccuucuuuguguguauucuugucuuuuccuucuuaggauaacauuugcauacguccuuucuugauauuuagucauuuuguauguugaggucuuuuuuuuuuuuuaaaggauuuuuaaaaaagauuuuuauucauuuauuauuagaaguaagacacuguagcugucuucagaugcaccagaagaaggcgucagauuccauuacgggugguugugagccaccaugugguugcugggauuugaacucaggaccuuuggaagagcagucaguguugagccaucucaccugcccccgagaucuuuuuuuauauaaauuuuuaaaaaagauuuauuucuguauuguauauaaguacacuguagcugucuucagacacaccaagaagggcaucagaucucauugcaaauggugcugaguccugugcacauuaagagguucuaagcauaugugauugggauauuauuuugcuuuagacuuuuaaauucagcaacuuuuaauaccccccuuagaaaccacaauguugaauguucagugaguuuacccaauucuaaaguuagaaaaggcucugaagacugccucuacccuggagacagacugcaagcauagugauucgcagacccucaccucaaacuccugaugagcaccuuuuguggaauagcucacaaacuuagaaaagcacuguacuuaacuacaacuuuuaugcaaauuaaaaucaggcuguugcuuauagaguugaaacccuacagcuuccgaagucggccugcucacuuuagucaaagcaucauaccuuuccuuuuucugucaugcuuugagcauguucucccuagcauuuuggaguucacuuuucuaaagcuuccuacuugguuccauggcuccuugucugccuugaagcugacuuccaugcucgguuagcuuaaauggcauagccuuuuucuuuccuuccucuuccaagcagcuacugacauuuacuugcuacugugagauuuuuuuuuuuucuuuucaaaaaaaaaaaaaaaaaaaagagggguaaguagaauuuagaauuuggaaaggauccaaauuuggagccugggacuguucucuuacugucaucuucaggcuguaauacuuucuggugucaggaggucuuuaguuccuuucgucauuaguuauuugaagcccauuagaugucaaaucccuggggccuagagauuauuugauagauggugaagacagaaagcagaccuuucagaagaggaugguucuucaccacaaaggugcacaaagcuguuuugcugccuugcuuuuacugaugcuaugaaaaauacauauccugcaaagggcuauagucaguguugauacuaacauuuccagauuaaucucccccauaccccuguaguugaacuaggacaucggcaagcauucuacuacugagcuguuccucugaaaauguuuuauuuuguuuuguuuuuaaauaguacuagauauugaauauaagaccuggcugugcuggaauugcaaguguguaagugccaacuuuccuaguugcagcugcuguuugguugaaauuauguagcaaacugacuuggguucagccccuggaauuuuuauuuguuguauuucuaacuccaagcaggcuaagugccuucugaaucuucauuugcaaauagaaaacagcaguacuauuaccuuacauguugugauaaaugacgcaguguauauaaagcuauuuaguauacugauuguaacaggcuuggugagaacagugacugcuaacuuucuguaccaugcauguucuuggaugugacaacaaauacagguggagccuuauuaugugucuugguuucucuguuguucuugggcaggacuuuguuagcugccguuauuuggugugaggagaaugagggugcaaauucaagagggagcuucugagugaagcugccaaucuuggaacucacaguagugauccuaagugacuccucacagcugccagucaguggaugaaagcacaggcuuccauagcuaaggagcucagggaugcuucucaauagaucuuuaguagcuucuagacuugagcuaaguagcaaaugugguacacagacauaccccuaccucauuuuauacguguguguguguguguguguguguguguguguguguguagccuugccuaaucuuuaagauggcccuaacaguggaguuuuuuuuguuuuuguuuuuuuuuuuccucuaaugauugaaguucacaguaguuuagaggcuauguuuauccuggucacugcauacuuauacucuaauauagugcuugauguauuuagugggugucuuaguaacuuuuuguuuguuuguuuguuuuuuugcugugaagagagaccaugacuaaggcaacuuuuauaaaggaaaacauuucauuggggcugacauauaguaucagaagauuaguccauuaucaugacgggaagcauggaggcuugcaggcagacauggugcggggagcccagauuucuauaucuuaaucugugggcagcagaaggagacugccacgcagguuauagcuugaucauaggagaccucuaagcccaccccaccacaggaacacacuuccuccaccuagaccacaucuaauccaacaaggccacaccucccaauagugccagucccugugggccaagcauucagacacaagcaacuauaggggccaaaccacuagauuagggacucugugaaugagucuuauuggcagucaaagaugguaugaaauauaaagaagugaauuauuacaggggaggauaugauaguguaaauggauauauggccugaggaauguggguugguaaaggcagcaaguuuguaauauauauacuccaguaacugaaauauuggaauguucaaggcaggacuagugaugugucucgguaaucccagugcuuggagcaugaggcaaguuuaaggcuaguuuggacugaguaaugagacuauuucucaacaucaaaccaacaaaaauugaguguuuugauguagcaguuuuacuuuuuuuguuguuuguuuguuuuucgagacaggguuucucuauaucccuggcuauccuggaacacacuuuguagaccaggcuggccucaaacucagaaacccaccugccucugccucccaagugcugggauuaaaggcguacaccaccaccgcccgguguaguuuuacuucuuaaaaauuaaucuuuuagaaauaauucugaauacaagaagugaauauauucugugacauuaaacuuuggaggcuaauaaguaaaaauuguggagccuugaauggaaauauuuuguuaggcauuaguacuucaggcuaugaagcauucaugauaauuuggugauuuuugucuuuagugaagcauuauaggucugcauuacaguuguagauucaguaaauauguaggcagaaaaacuggaccagauagagaacuguuauuauagauggcaguuuuaaaggaaaagaaugauuauguuguuuugacacugaauuauuucucuagaauuauuucucuauaaugauuuugaaauuucucuuuuccaguucucugaguuucaccaguaaugccacucaguugccaauaucaagcaagcgcauauaagacacuuguaaucuuuuaagaaaaguaguacuucucuucacaguaucuggcgguaagucauacuuaagccuuuauaacuguguuuuugauccauugacaucauaguuuuaaaaccuuuauuuaccuuuccuuaagagaaaauuuuauuuuaugacucagaagggaagaacauaaaccaugcuaaucucagagguuaauuuuaucaauuuuauuugucuauaggauuucuaccaccugcuucuuaaaaacaaauaaugaaggaaaaaaaaaaaccuaagaucuuacggucuagucgugguccuucauuaugaaguguucacaaaugacuuuuuaaauugagcaaguuaauggcagaguaccuuuaaauaauuucauuucgagauccauauucaauuuauaguuagugguagaaggugauuuuuguuuuuaaggauguguuuauuuuuauuucuggguauaaguguuuuccugcauguaugucugugccuggcgcauucaggggcuagaagagaacauuggaucuucuggaacuaaaauuacugcuaguugugagucacuauguaagugcuggguauugaaccuggauucuauaagagcugcaguagugucaggcgugguggcgcacgccuuauaaucccagcacuugggaggcagaggcaggcagauuucugaguucgaagcuagccuggucuacagagugaguuccaggacagccagggcuauacagcgaaacccugucucaaaaaaaaauaaaaaaauaaaaaaaagagcugcaguggucuuaaccacugggccaucuguccagucccuggcugcuggcuuuuuugggguaggaaaaggguuaguuuuuuuuguagaguagucuagcucauuaaagagacagaauacagacuaagcagcaaccaaguaggaggaaggucugugugugugugugugugugugugugugugugugugugguauuucuuuaacuugaaaucaauagcucuucucuguuucugggcaggggaugugcacacaguucaugggauauauauauuauauauauaguccuguauccuggaguggaggcaagaguuggaugucauuugucuugcucuaucucucuucugacuuauuuucuugagacacaauccuccucuaaaccuggagcuagguugggaccugcaaguuccagugagcuuucaguguuuuccuuucacauuauuuggauucucagcuuucccaugaccugcccuacuguuuauauggguccuugggauuugaacucuauccucuugauuaagcagcgaguacuuuugacccguggaaacaucuucuuagccuaauaauggccaauuaauuguaguuuuauuugcucccugaaacaagaaggcagagcagugccuuuggaguuuuuguuuugagauuaaaaucacugcuucuuggacuggccuggaauuuaauauguagcccaggcuggcuuugaacuccaagccaucauccugccucagccuccugaguacugggauaacaaacagguaagugcuccugcccucaauauacacauacacacuguuuuauguuguuuacuccucuguuaaagauucaaucuagaccuuuuuugucuacugcauucaaaucaauuacuccguugaauuucuccuccagcccccuagccccuggcaauuuuuaauucagaguauagaaaacaagaaauuauacacauuacuuuucuaaugguaggccuguuuucguccugcacaaaagcugucuguaagguguagaacuguuaauacuuuucacuagccucauucaaaacaaaacaaaacaaaacaaaacaugaguugcuugcauaguccaauauaguuaucuuaaaaucaacagacauuuuauuuuuuguuguauaguaagacuguucuaucauagugaugaagguauucaaccguauucugaaaugguucccuuuguuuuuucacuuaggaucaacacuggagggugaggugucagcuuccagaaagaucaucaugaaguuauauguguuucugguuaacaccggaaccacgcugacauuugacacugagcuaacugugcaaacgugaguuauauugcacuuauccuuugguuuuccaacuuaaugaaaaaaauuacuuuauuuuaagaaaauauucuaccaugauaaaaccaagugcaaucugaauuuaaucccaaagcccaagccgaaaggacaguuuaaugacuugugcucuuguaauggaagguuagggaaucccucuggacagacggucuagccuaguuuggugaaauucaaaacugacagacacugucuucaaggacguaaaucuucccaaggacaacacuuccugagggagauuucaugugaucucaugugcacauguaaccacacacauaugcacacacacaaaauaugcauuugcauacacauacaaacguuuuuuaaaguucugcuucuuaaacagaauggggcuagggaguuggcuuagcaacuaaagaccaguugcuguugaagagaauacaauuugagucccagcacccauauggcagcucacaaccaucugaaucuucaauuucagggaauccagugcccucuucugaccucugcagcaccaggcacauguaguacacaaugaacauaaaaauaauaaaaccaaaucuaauuuuaaauaauuaauuaaaaaacuuacuuaauuuaagggaaaaacguaaccaauauauaugaaaaaaaauagcaagcugggaauguuaaacacaaguuuuguccccccacucaccuuggagguagacagaaauccaaguuucaugacaaucagggauacuuagugaaacuuugucucaaaaaacaguagccauauaguaaaucucaaaucguaguguauuuucuuacucaucauacauaauugaugauaaaaugcuaaaauuaauuucuauaaauugugcuuucucauuuuugcauaacuguuauucacaauuuuaaaaggguaauucuaaacuaaaaguuuauuagagcaguaggcaucacuuugcuauuuuugguaauuuuuguauuacauuuuauuugugugugguguguguguguguguguguguuuauguuuacgcuugcacaugcaaaagagcauguguggaaacuuagaggacaauuugugcaaauugaguuaucuuuaucaucuagaucuuggggauuaaauucaggucaucaagcuugacaguaaaguaaguuucuuuauccacugagccaucuuguccauuuguuguuuuuacucuugugugaauuaagucaauggguuugauuugcuuauuaaugagagaauaaaacaaauggacuauuuuuaccuaauuuagugaagcucauuucuagucauuuucuauuugguuaggauaucaaauauuugaauauucucauaacuuuauaaaguauaaagguuaguucucagggcaaggaaaaauuaauuugaguucucauaggaaaaagaaacaaguaguuacauaccacuuucaaggcuauuuacuuuauuguaacgauucaauagcacugcagaguaaucucauacugaaauuauuacaaauaauuugaauaauuucuauuuagaaaauagcaguaagauagcuagaaagauggcucaucaauuaagagcacuguugcucuugcagaggaccuaggguaugugaugcuggcuucugggcacaaaacacacacacacacacacacacacacacacacacacacacacacacgcacacaugcacggaaagcacugauaugcaaacuaaaaaggcuucccccccccccauguuuguugguuuuuaguuuuaaaugguacugagguugggagagggcuucaugaagucucugagaaucuauaauuaguuugugaguacuggaggcagaaagauauuuuccuuaguaguggcucuacuaaguugcuuauacuccuguauauaaaccccuacccaugcucuuaaaguaaccccaguuaaaccuuaaaaagaaagaucagcaugagaguagaagaaagauggcaaguagcuggaaagaggaaggagacuaaugagaguauaagggagauaacagaaaaagagagaauauaaaauuugggaaaauguugaauguaacauuaauuaauauguguuauuaauauguguaauuaauaugugcuaauaaaacgcuuuuuaaaaauggcacuuaaaggagcuggagaguuagcuuuggaaguuuuugcuaugcgagcaugaggacuugaguuuggaagcccaaugccugacguuucaaugugugccuguaaccuccagagccuggagagacagaugaauccauaggccuugcucuacaaucaaucuagccaaauagugagcuuuagguucaauaggaaaccccaucucaaaaugugguggaaagcaauggaggaggacauucagcauuaaccucccaugucuacaugcaggcacaggugaacauacccaguauaugccaaguacacauaaaugcacaauuauuuaguuucaugcaugguguaggcuuaugaguguuggucauguguguagaugugucaugucuuacucuguuacccccauccuuucuuuucaccauugagguaggagcuuucauugaaucuagagcuuucugauuuggcuagccugccuagucaauacaucccaggggucuggagguaucugaauguccccuugcuacccuagaacugggguuacagacuuggaccagcacacugccuuuauaugagucaugggaauuuaaacucaaggccuuuugcuuguacagguagcacuuuaucgccccagcugucuugaauucacguuuuaaauacauucauuuuguuuguuuguuuuuauuuuucguuuuuuugaguuuuuuguuuguuuguuuuuuguuuugguuuuuuugagacaggguuuccucuguauagcccuggcuguccuggaacucaaucuguagaccaggccggccucgaacucagaaauccgccugccucugccucugccucccaaguacugagauuaaaggcaugcaccaugacugcccggccaauccauucauuuuuguugaugcaguuuuucuucuagaagaauguuuucucauuaacuaagcccaggcuugccuugaacuugcccaggauccuucuagaauuuuuuuuaaagauuuauuuauauuaugaauaugacuacaguauugcuguguucagacacaccagaagagggcaucagaucucauuacagaugguugugagccaccauaugguugcugggaauugaacucaggaccucugguagagcagucagugcucuuaaccgcugagccaucucuccagccccucuucuagaauuuuaacauguggcuauaggaauuuuuuuugaagcaauuuuuacauggcuuagauuuacuguacuuucuauaauguauuguaaaaaucuuaaacacaaacucuguguuuaaauauacauguauguucguuuauaccuuucaccauuauuuaaaaccccccaaaauaauuuuguaugcugccuguauuuuauggguucacuuuuagauaugaaaaacauaugcagccgggcgguggcagugcacaccuuuaaucccagcacuugggagguagaggcagguggauuucugaguucaaggccagccuggucuacaaaaguugaguuccaggacagccagggcuacacagagaaacccugucucaauaaaacaaaaacaaaacaaaacaaaacaaaaaaaaaaaaaaaaccauaggcauuuaauucauuuaauucacagccaguugauugugguaucuaauuuaaaaaacaggaaacuuuuacuacuaucuuuuugagaaaagccuuagaaugaaauucaguagucuaaggguguguguuuguguguguguguguguguguguguguguguuaugaaguguuuuuauaaagguacuacaaauauguaauaacuggauuuuauuuuucuaaguguggcugaucuuaagcaugccauucaaagcaaauacaagauugcuauucagcaccagguucugguggucaauggaggagaaugcauggcugcagaucgaagaguguguacuuacagcgcugggacgguaggugucaaagauccucuacugcauagucugcuuucuuagcagaugggagcaggggcuuuguuuuuguauuaagggcaauacacaaguucaccauuuauaacacuuacauuuuugucauuucugcauuuuuugauauaggacacaaauccaauuuuucuuuuuaauaaagaaaugaucuuaugugaccgugcaccugcuauuccuaaagcuaccuuuucaacagaaaaugacauggaaauaaaaguugaagagucucuuaugaugccugcaguuuuccacacuguugcuucaaggacacagcuugcagugguaugauauaaacaauuccuuuaacuaauugcuucuaaaagcauuccaaucuagauagcagagaagucaaaauuaagcauagauaacaugaaaaauacuccccuuacaguuuuuuuguuuuuuuuuuuaauuaugugugcacuugucaaagaacaacgaguggcaguagguucucaguauaguuuuaggaauuaacuugucuacuugguagugugugccuuucccuaauaccugucucauaggccucuuuauaacaucguccucuacuuaagagucggguugaggguuguggcuauagguugaucauaguuuaagaacaugcacuguucuuccagaggaccugaguuuggauuccaggauccauuuugggugaugcacaacugucugaaauuccagcucuaguguaucugaugucucaaacuuccauagaaccuguacuuauuugguguacacacauauacaauuaaaacuaguaaaaaucuuuauauuuuauaauuaauauacuaaguuuuagauaaggaagaaacauguuucuuagaagcugugaaguagcccaguuuauguuuuccuuuagaaggguaacguucagcacaguuucaguguuggucgcuaaagcguaggagugcguuuagauguguuauauaaugcuggacaagauucuuguggcaggcaaacgggcgagcacaauuugcacauugcagucagaguggcacauugguuuauuggaagcagauggggauguaugcugaggaagcugcuguucagccuaccuaauagggagccacagacuuuuauuugguuuucuuggaguagguuaaccuuuugauauuuguccauauauuuauuagucauggacuuuaaagaugcuuuucuucuuguccacaagcaaucucacuuugugauuggcugguaguaggaagugacuuaacccaggauugcuggguccauuuuguugcuguugucaucaucauguagacuuggaaguucuugagucagccugagacccucuuggugguggcaucaaggaaaaaaauucagagggauuauacuuaaguauuaaggaucauacugugggcugggugguaguggcgcaaugcauacuuuaaaucucaauacucagaaagaaggcagagaaagguagauuucuaugaggccagccuggauuacaaagcacguacuaaguuccaaaacagccguggcuacacacacacacacacgcacacacacacacacacacacacacacacacgcacgcacgcacgcacacacacacucucacacacacacacgcacgcacacacacagacacacacacacacacagacacacacacacacucacacauacacacacacgcgcacacauacacacacacacacacacacacacacacagacccugucuugaaaaaaaaaaggaggggguuaugcgugagcugagaugauuucuuuauuguagauaaaaacauauuaaaaaauuauauaguuggguccgagagauggcucagugguugagagcacugguugaucuucccgaggacccgggcucaguucccaguucccagcacccacauggcaacucacaacuaucuguaacucuuaagaucugacacccuugaacauguauacaugcagacaaaacaccaaugcauauaaaauaaaaguaaaaguaaauaguugaaaugagaguaaggaacauuaguauugaaacucaaaauaccaggcauugcuauucuuaaaacaagaauaaagacauuuuagaaaccucuucauucuuuggggucuugugcacuuuuauguaggggaaauuuuuuaucacuuuuaaagguaauuuuuagauaccuuagcagcuuagguaacuuaccuuuguuaaaggaaauuggucagauguuuucuuacuuguagaacugagauaaauuucuccacuccugugacuauagauauuuucugaauauuuuuugauguuguugguuuuuguagggguggguguguguguguguguguguguguguguguguguguguguguguguguguuucauaauacaggguuucucuguuuagcccuguuuguccuggaacucccaguguagacuaagcuggcccugaacucagagaucacccugcuucuguccaccaagugggauuaaaaaaaugcaccaccacacaacuaucuucugaauaucuuuauuuugugcuguuuuauguccucauuucuaauuuuuaucauaucuauuacauguauuauauuuauauuuauuauauguauugauucagcaaaugucauguuugaucccugagucuguuuguucacugauacuuuucuuucuucauuuugcccaguaauaguagguucaacuaggccuuguaagcuuccagccauggacucaucaccaggcauggggaaggggggggagcguuucacaggcauguuucacauucuucacaggcaugcauguguuuucuucugugaaacgagccuuaaauuagaaagugauuaauuaccccaguaacauuuugcaucuaaauuuucauugauguuguaagaucaguauucuuacccaguaaucauagcaguucacagaguuuccagcuggguaagaauguugcugucuccuaccccucuacaguugcuugaauagcaacuucuaguacuaugagagucagccaacagagaagcuuccuggucacuacuaucuuuucuucuuuuuuuuuuuuuggaugaaugugugagcugucuucagcuguaggguccuagaguccuaccacaaauucucauggacaacuaagagcagugauaaccuauauuguguuuuugugggggcuggcccccuggcacacuccuccacugacauauuaauauacauauccuauaugcagugcuauguuuuauaauaguaacuugcucucuuucugucaguuucccugacacauauuggaugugucuaacuacguguguuccucauacuuuugccuauuuaauguuaguauuacacgugugcaccaccaugguggcccacaguaaaaucugauugauuuuugguagcauuuugugagauuuguagcccuuucuucucuuucucuuuuccccucuagauuauuuguuauuaaguaguuauauuuuuacauuugcuauuuuuuccacuuaauuacuucccugcauuuggaaaacuucuuucuuaauuuauguccauauucucuuuguaccuucguauuuggucugaacuugugaaaguggucacuuuaacagaguguuauuuguuuucggcaggagcagaauuuuuugugacagggaacuucuuuuuuuuuuuuuuuuucagaaaucucccacauauugcuuuuuaguuugcacuugauacuucauucuuuauaauugaauuccaaucaucuguucuuagaaaucauuugauucuugaguggucaguuagaaagaccuugcuggugaagcaugaagcauugccuccucaacgccuguacaaaaaacugggaaugauggcgugugcuaauccuaaucccagggaugggcagccaguagacagaagugucacugaggcuagcuggccaccagcccagcuccaggcacagaccuugauuugaaggaaucaaauggaaaguggauacccagcaucuuuuuaacgcuuccaaguucauauauguauaacauauacauagcauaacacauacauagauacacacaaacacacagguuuuuuauauuuaaggacuccuacaauuggaagaugauaagguauuuucaaucuuucauguuugacaaaaauguuugugaaaauguauguuugcauuucaaacauacauacggaccauugcuuucuuuuauuauuuuccuuuuucauucucaaacaggaaauguaugacguugccaagaagcucugcucuuucugugaagggcuuguccaugaugaacaucuucagcaccaaggcugggcugcaaucauggccaaucuggaggacuguucaaauucauaccaaaaacuucuuuucaaguuugaaaguauuuauucugauuaucuucaauccauagaagacaucaaguuaaaacuuacucaguauguuuaucauuaugugaauguuuaaaaugccuuuaucaauacuuuucuagucccuggauauugguuggaggcuguguuuauuuaaauaaguauuuuuagucucuuaaagcauuuuuauuauaauuaucauuauuauuauuuuuuguguaaguacagggauguguguuucagagugcuuacauaaaaguaagagggcaacuuuuugauguugguucucuccuccggcugugggauucaggcucuuccuguuacccacucagccaucucucugacccaucuuuacagucacacuuuaauuguguucuugguuucuguuguucaaucuaucuaagaaucucuuccuagcuuuugcccaauugagaaaauauaaaugggggacagggaagaccagaacucacugacauggaaaacuuagguccuuuacauuuaaaucaagugucguugaguuuuggaaggaaagugcuaaaauaauguauaauuaauaugcaagugaacaauacuucaaccuuagaauaucuaguaaaugcuauauaaaugcuaguauauguacuuuucagauuuuguauuuagguuuuuggguuuuuggggggguuuuuguuuuguuuguuuguuuuucugucuucuuugaauuuaccuuagaggugauagcauguguauucuuuccuuuccuuaauuuuucuuuucuuuuuuuuuuuuuaagugaugcuugggaacucaaccgucgcccuuuccuguuucauacaagcaauuuugcaccccaacccccaugacuccuuuuccucaguuguuuuaauauuguagauugacuauuuuaagacaaguuuugcuccuuaguucuagacuucagaagaaauauugguaggaaagagaaugaauaauaaguaauaguaaaagaaucauuuuaauuguuuauuacaauaaccuuucccacuaccuaucuuggagagggaguccuucugaucauaucaauuuacuuuaaggaccugaaucuauuaacauucaguuuuaugauaucuuaaagauuacauauuuuccuccauauucuuuagcagcuaaacucucuuaguccauuuuugauauaguuaguauaagaguuauccuaaggcuaaaauucuuaauuuaauccuauauuuuuaauauauuaaauauauuugauugugauaaagccaauuacagugugagugacugcuauggucagucuucauaaauuuuaauguuuuuuaauuaauagguuguauuugaaacaaauuugaaagucagugucuacuucuuuaguauaaucuagcuagcuuugcuuuaaauuuguauuuuaacguuagugaucgccucucuacuaagcuguacuuuuaacuggcuaauaaaggagcuuauaugugaauaaagacauggagcagugguaaggcugguauuuugaaguacagugugauuucguuggaugauaguagaacacacucguuuuacugacucauguuuuguaucuuaaguuuaggaacugcuguuucaguaauggccaagauuccacuauuggagugccuaaccagacauaguuacagggaauguuugggaagaccggauucuuugaaugaacaugaaggcucagagaaagcugagaugaaaagaucuacugaacuggugcucucuccugauaugccuagaacaacgaacacauccuugguaaccucauuucacaagucaauggagcauguagcuccagaucccaccgguacugaacguggcaaagaacuuagggaaucuugucaaaguacuguccagcaagaagaagcuucaguggaugcuaaagacagugaucugccuuuuuuuaauguuucuuuguuagacuggauaaauguucaagauagacccaaugauguggaaucucuggucaggaagugcuuugauucuaugagcaggguaaguugugugugcgugcgugcgcaugcgugaggaugauuaacagcagaaccugcguuggaguuuggagacuugaucaaauuaucuguaaccaugcuuuugaguugauuauaaauuugggaagauuauuugagcguaaauuuuuagugcaguucaaaggguuugcauuaauagauuuugagugguucaagaauaaaucacuacaaauuaaaaaauauuuuugaacauuuccauuauuuggaaaguggucuuuuugcaguaagcaccucccuacaugagaaucuuaaacuauucaucuccuuaagaauucaucagcaagacauugggcuuucaguuacaacucuagaaguaaacccaggauaaaugucucuucauauuugcucuguaaauugauaaaaagcauuugcaucagaaagaaaauugcuuuagugacacaaaaauacuaauguuuugaagauuucaguugucagaauacgaaggacuuugcuuaaagggguacuuaguuugaaaauagcuuuaguccuugauucauucaaucuugaaaaaacaaaacaccugaauauuuggucuaggauaccuggaacagcaugugccuaccuuauuuaaguuauaaguaaaaugagaacuuuaagaccuuggcuuccuaauauguucagcaucuuuguccuugauaacaucugauagaugauaauuuaauuguuuaaggcacuugccccagcaaaaauugucaaaugaaugaaagugagccuaguauuucugcuuaaauacuaauaucuuaguaucugaaacauccauuuaugaaugcaugauuaaccauauaacaguggucacaguaaccagugccauuuuuauaauaacaacuguccuggaauucagaauaguuuugcauaaaaccuguugcuugcuagggaaguacucuacuacuguuguaucuucugaacuauauaagcagaguuaacuuucccgggcugacuuugaacucaacuguguaguccaguuaagucuuuuuacaauccuucugccccagccuuuugaguaccugggacuauguaggacuugcuaccagauccaccacgagacguuuugugaugagugagugcuguuuaucucauagagguaguuuugauugccagcaguauaauaaacaaaaggugcuuagauuuauuuuuguuugcauuuuuuauucuauuuagagcccuuaguuucauagauuaguccaauuucuguuguuucauaguguauauuuauaauguauagugugaacucccauaacugccucaggaaaugaguugggacauaauuuuuuuuggaauuuaauguuuguaauuucugaauuccauaccagacacuucugguuuaugcuuuauaaaguucuuaucaaucugaaucccuaauuuuuauauuuguuuggacugcuagauaauuucauaguaguuuugcuugcaacccaguuuuuauuuuuacauaauauucuauaauuauugauuuuuuuguagacuuccauuucacaaaucaaagaggauuuauuuuuugaguauuucuuuuauuuauucauuuauuuuuuaauucgguauuuucuucauuuacauuucaaaugcuaucccaaaagucccccaugcccuuauuuuuuuauuuuuauucauauauauguauguguuucugugggugccuucagagaccagaagaaggcaugacaucuauagagauagauauacacauggcuuugugcaucuugaugcggugcuaggaaccaaacuugagucuucugcaauagaauugugucuuuuuuuuaaaaauuuuuuuauuauuuaaauguauuuuauacaucaaacauauuuauuuugagagucaaauaauacauaaaaaauuguucaucuuaauucauauccuuucauacccuaaaaauaucauuaaugaauauuuaauauuauccauaaccgaggauucuauaucuaauguucaauacugaauuguuucaaaacauacaaaauauucucuuggggcuaagcauaguaaaauaucauaaaauauuaaaaaugaaucauugagaacuauauucaaaagcccuuacaugauaaccugacauagugggagacuauuuaaaacacauuauauauuuguguacauugucuaacaaucaguuuacuuaaaaaagauuaucacuguuucuaggagaaaaauuauuuuaucagugaguauauuuuaaaaaauuuaaaauagcaaaaacucuuugaaguuaaacauuaagaaaaugcuaauuucaaacacuugagaaaaauuaccaauaauacuucuaugaugauuuuaauauuuucaacuguuauagucuuugggaaaauggaauaaaauuauccacaaaauauuaaauaaauuuuuaugacacuaagguuuuuuuuaggaauuauguuaaagauaaauccauuguuuuucucuuccugaccauuguucacaucacuugaauuaucauccuguuuuauccuucccuaaccuuauauaaagggccuagucaaauuccuccuuuacacaucagaacgacagucaaaaagaccccgaucagcaagaugauuccauggguaaaggagaucugaguaugauguuugaguccuagauggcugcaggagggaauugauucucauaaguuguccuuugaccuguauguauaugucauggcuucugagagcucacaaucgugcccacacacauguguauguauuuacauguguuugcacauauacaaaaugaacacaguugaagaauaacuuagaggaugccuacaugcugcuauuggcagguauucagaaccccugcugaggcaggaaggcugaacuaguuuuccuccauugaagguugagcuuaggaucugacaagguggcccaguaggucaaagccugaaacuucauuuuaacccccaggacucauugugaaaggagagaaggcauuuacucaugcccuuuuacccaccaaggcucuagguuuaggugaggagauaguagaguauaccacaguuccaggagccuuuaaugaaacaaggucauuuaauaucugugaccaguuuuacuagaaaacaggcaccaccaagcgcaucauguaguuaaauuuuacacuacaaacacguagaacuaaagucagaggacaggaaaaauuaacuauuaagacaucucauugaccaaaccauuuccuuucaauagagauuaaguuuaagcuuucugucccauuuguuaaggaaaaaccuugccuuuuuaaagaaugggaucuugcugaguugccuaugcuggccugaacuuuugguuuaauucuaccuugcuucuugaguucugaauuacaaacauaugccaaacauaccuggcuauggaagaugcuuugagagaagaugaguugaugaguuacuaccaaagaguggguuugucauuagcuccacuuuauauguccuugaugacuuugaaaauaacauucuuagggauacugagaauuguuuaaauugguugagaguuaugauuacugaaguuauuauggucuugacuuuuauauugugauuuguuuaacaccaguuguuuaggaugggguucauccuauuaaucuuccuuugcuaguauaacuuuauuuccugugcauuuuucuguaucauuuucuauauccuuuguaucuuagucuguaucuaguuacugugaaauauaguuaaaacuauuuccagaagauuuuacucauauauguuuccuucucauuuagcuugacccaaagauuauucaaccauuuauguuagaaugccaucaaacuauugccaaacuugauaaucagaauaugaaagccauuaaagggcuugaagaucggcuguaugccuuggaccagaugauugcuagcuguagccggcugguaaaugaacagaaagagcuugcucagguaucguguuuaugaccacuugauuucuagcucccagaggcaagcagcugaauuucauuuugugcuagugucccucuccucauucccuccccuucuuccucccgcuugucacacuugauggacuggaguuuuccuguuuagcccaggcugucuuccuacuuaagugcuguggucucugcuugguaguuauauguuuuuuauucuuugugauguugauguuuuaugugcuuauuuuuaauaaaaaaccacaaauauuauaaaaguuuaagauagcuuaaauuuuguguuuccaugacauuuuaaagaauuuguuugcuuuuggcuuguguuuguguuaauuauuuuaguaaagcuuucaagcuacauauuguuguaaguuggcuuucuguccuuggaauagccauuucuuuuuaccccccacccgccuuuaaugggagauaggaauuuuaggaaucuaaaugaaaagugguuccuugucaguuuuucucuugagagcuuaugucauuuuccuucccaaagggauuuuuagcuaaucagaugagagcugaaaacuugaaggaugcaucuguguuaccugaucugugucugagucaugcaaaucaacuaaugauuauguugcaaaaccacagaaaacuguuggauauuaaacagaagugcaccacugccaaacaagagcuagcaaacaaucuccacgucagacugaaguaagagauuccgucagacuucaguuuuuguguuuuuaaucuucccaguaauaacaguaauuucauugaaaugcauauugaugaacucuaggguuagacuuuauagagccuugaucuucauagcuuaccuacaaaugacuuuuagcaaauguggaaaacaaugaaucuuuuucuauaggugguguuguuuugugaugcuucaugcugaucaagauggagaaaaacugcaggcacugcuccgccuuguaauagagcuguuagaaagagucagaauuguugaggcucuuaguacaguuccucagauguauugccuagcuguuguugagguuguaagaagaaaaauguucauuaaacacuacagagagguaagcaauucuaauuauuuaauuauauauuaacauucauaauugguauauuuuauuaacauaaauguuccucuucuaagugggcuggugcuuuagucaaagacggaaaacaacuauaugaagcugaaaagucaaaaagggaauccuuugggaaauuauuuaguaaguauuaauuuauuuacccuuuuccuucuuuauuuuuuggccuuuagguaauuucuaaaauaaccauguuccugguuucuuuguacagggaaguccuuuuuaagaaaucgucuguuuaaaggacuggacuccuggccuuccucauuuuguguauguauuuuuuuuuuucuaacuaggacuaaauuucuuuuuuuuuuuuuuaaggacuaaauuucuauauuauaaaaccuuauuuuuucaggguuagaagcauuuaucagaaacagauuaaguugugagugauaaaaucuaaaaucucccauauauacuuccugaucaccuucaaauucauggucuuuuaaaaauccauuuaccaacgguuuauauguauauauguguauauuuaaauauuccuagauauagucugaaucuguauaaugcuacauguauguauauuuacagaguugaccauuuggcacugggcaaugauuagugugcucacccugggaaaccucucuugcuuccagcuacucaguugucuguaguucuuuguguagggaugaggcuuugugggcucuuucccaugcagcuuaaugugcucguuaguguccuccuuguuuagcucauguucagguggucauguuggugagacuuugugguuguagcuucugauguuacuagaagacaaagucucugaacaaucuuucuguccccuuuucaguguuccuugacucuagugcuuccuugaguguuguagauguaucguuugguacuggcuuccucaacucuucauauugauugguuuucauuuuuuguagucucuguugcaaaagagaagauuccuugguggaggguaaaaauguguacgucuacguggguauaaggacagauauucaaagauuguuauggauuaagcugauuaaguuagugguuguauauucuccuacaguaaucuugauuucacuagugcugaauaguuaguuagguuugcaguacugacauggucucuuuucuguugagcaagucuuaaguucaguuagagagcuuuugcuuacugccaaggugugagguuuuuuuguuuuguuuuguuuuuuggguuuuuuuuuuuuuuaagacaggguuucucaguauagucuggcuguccuggaacucacuuuguagaccaggcuggccucgaacucagaaauccaccugccucugccucccgagugcugggauuaaaggcgugcgccaccacacccagcaaaggugugaguucuuuaccacuacucauccaagagcucagaguaggcuggcaucaucaguggcaguuuuauauuuuuuucuguuuuucauuuuaucuuuuuguagucuuccuucugucuguugcuguuucaucccauugucuccaugccgcuucauuauuugagucagaguagcuugagucuucaguaaaucuuccuuaaaauuaaacaugaaaaugccaucugauagauuauaaaggcagcuagcuggguuuauuaauuuuuuuaaauggaaaaaacauguuucaugaucaaagaaauuuaggaaaugguauguccuuccaccauauuaaguugucaaucucaaacagguuucugcaugguaguauuucuuaagaaugcacaguuguaacuagaauuuacauacucauuuaucaaugaaccuauuuuaugaagauuauccugacauauuuaaaucuucuugacuagugauuaagauaaucagaguuacuuuuaaacgguaccaauucuugccaguauuauaaaaaaauaauuaguaggucuuuacaauucauuuuucauuuagaauuaaaguuugaauucuucaaaaugagaggagcaaagaaaaaaaauucucccuaaagugcaccaacaaaguuuacuauagaggcauuuugugaccauucugcaagucaagggaaaauuggagaauaauguauuuaguguugauggaauacuagaauuucugucaaauggugcuaagacaaaaaggaaagaacaaguuuauuaguuaccaccaagaagcucaguuuccagacuagugugcccuggcauauuugcauggucuuuugcuuaagucuauuaauuaguauccucucuuaauugugaagagaucauuugauauguuuuuggcagucucuuauaguggauuuaauuaucucaagaaaucauaaauucauccuuuguauugguaaacuuuuuuuuccauuuauagacucagaagccucgaaaauuugacugugaacuuccagauauaucauuaaaagauuuacaguuucuucaaucauuuuguccuucagaagugcagccauuccucagguaacagccacgaauacuuuugaauugaauugaucuuaaaaugaugaaaguuaugauuugcuuucuaauggcuucccuagcuuguuauacuguuuuuguuguuguuguuguuuuguuuuuuaaugaguguacaagcuucuuucacuuugcuucuccaugcuuaagaaggacugacuaugcuguucauuguuuuuaagagaaugaaacaauauguuugcaguuuguuagaaacuaaaaaucugucauucuuuuucaggguccccuuacuuugugacuuugaaccucuacaccagcauguacuugcccuacauaauuugguaaaagcagcacaaaguuuggaugaaaugucacagacuauuacagaucuccuaaaugaacaaaaggcaaauuaguuguuuuaaauauuuuuaugaauauaagauguuugcacuguuacagauuuuaagacuuuaacucuguguuucagguauccacaagucaggcauccccacagucagcugcuucuccaagaauagaaaguacaacaggcauuacaaccacuaccucaccaaaaacuccuccuccacuaacuguucaggacaccuuauguccggcagugugucccuuagaagaauuaucuccagauaguaucgaugcucauacauuugauuucgaaaccaucucccauccaaacacagaacaaccuguucaccaagcuucuauagacuuggauucauuagcagaaagcccugagucugacuuuaugucugcugugaaugaguuugugauagaagaaaauuuaucgucuccaaacccuauaagugauccacaaaguccagaaaugaugguggagucacuuuacucuucagucaucaaugcaauagauaguaggcguaugcaagacacaaguacacguggaaacgagggcuuuggggaucgggcugcucuacauguccagcuggagaaaugcagagcugcugcacaagacucucacagcaguauacaaaccaucaaggacgaucugugccauuucagaacauuuguacaaaaagaacagugugacuuagcaaauuauuuaaaauguacagcuguagaaauaagaaauauuauugaaaaaguaaaauguucucuagaaauaacacuaaaggaaaagcaucagcaagaacuccaaucuuuaaaaauugaguaugaauguaaacuugaugcucuaguaaaagacagugaagaaaauguaaauaaaauuuuaaaauugaaagaaaauuuaguaucccuugaagaggcuuuacaaaauaaagacaaugaauucacuucgauuaaacaugaaaaggaugcuauugucugugugcagcaagaaaaggaucagaaguuguuagagauggaaaagauaaugcauacucaacauugugaaauuaaagaacugaagcagucacgagagauggcauuagaagaccugaaaaagcugcaugaugaaaaaaucgagucauugagagcugaauuucagugcuuagaacaaaaucaccugaaggaauuagaggacacacugcacaucaggcacacacaggaguuugagaaaguuaugacagaccacaauaugucuuuggagaaauuaaaaaaagaaaaucagcaaagaauugaccagaugcuagaaucucaugccucaacuauucaggaaaaagagcaacagcugcaggaguugaaacucaaaguuucugacuugucagacaugagauguaaguuagagguugaacuugcacuaaaggaagcagaaacagaugagauaaagaucuuguuggaagagagcagaacacagcagaaggaaaugcugaagucuuuacuugaacaagagaccgaaaacuuaagaacagaaauaaguaaacuaaaccaaaaaauucaugauaauaaugagaguuaccagguggguuugucagaguuaagagcuuuaaugacaauugaaaaagaucagugcauuucagaguuaaucaguagacaugaagaagaaucuaauauacuuaaggcugaauuagacaauguuacaucuuugcaucgccaagcauaugaaauagaaaaaaaacugaaagaacaaauaguugaauugcagacuagauugaacucagaauugagugcucuugaaaaacagaaagaugaaaaaauaacccaacaagaagagaaguaugaagcacuuauccagaaccuugagaaagacaaggagagacuggucaagaaccacgagcaagacaaagaacacuuaauucaggagcuuaauuuugaaaaaaacaaagcuguucaaacugcacuagaugaauuuaagguggagagagaacuuguugagaaagaguuauuagaaaaaguuaaacaucuugagaaucaaauagccaaaacguaaguauuaaguuuagaauguaauuuacuauuucagacguauguguuaauuauaauaccuugauugguugcuuuucugggauauuuucaaaaagugaaaaaaauuagaauaauauuuauuacaaacaugaaaauaacauuaugcaaauuuauuauugcuggagcuaggugugauagcuuauaccuguaauccaaguacuugggaggcugaggcaggaggauugcuuuggagccaauccugggcuacagagugaacuaguuuuaggcuagacuuugccuuaagaagaaaacaacaaaucaguuucagaaaaauguuuuaaaacacgugauuuguaccuuuacuaaauuuuucaguugaaacugcuuuucuuuucguuauuguuuuagaguuaugucgaugggaauauacagaaugguccucacuauugcuuuccugauacuacaauuucauuuuuguuuucucugguuggaaaacuaauguuuuuaaauuccauacuuuuugcuuguguguuuuuuacuuaauuuuuguaaugucugauuuuguuguuguuguuguuguuuuguuaccacagauggguuugguauuuucauuuggcgguaggauuuuacacagugugguaaucuauuguuuaguccuaccauuaguucucagcgugaauauuguauugugcgugcauauauguguguguguauguauguauguauguuucugccuguguuguaaugcugauuuuaaaauagcucuuuuuguauuugugugaagugagagccuuguggaaauagaacuugaagacaaaauguaaaaacgcuguaaugacugaaaaagcucauuaaagaacuggaugguaaacugguaauagccgaauauauuaaggaauuauugcaguggcuaugcuauaaaacugaguuuaguucuuaguacagcauggacuaguucaaguuuauucuagguaacaggaucaggaucaguagaucgagccuuauaaagacaaagcaaucaaaugaaaggaaauuuuagccuuuccaacugaccuuccaagauucuuguucauagcaagguagagugauaagaaaccaagaguaggagaugaagaauuugauccaauauugagagagaucagauuguaggagugggaaauuuucuccaaacugacuuacaaacgucaugcuacagcugagcaauacaagcuuugacaagaauacuugucaagguuggagucuaaagggccuaaaagagacugacuaauguuuagugagacuuugucaagcucuaagugaaauaucaagacauccucugaaguacccaccaaaguugauucuccauggcucacuggaaagcugccacaguacucaagaaccuuuuaaaagcagcaaauacuggcuuaaucuacaacauaaaaugaguaguucucaguuaccugugaggaauuuuuugugagacgaccggcuacaaccacuucuggagaauaggacgggggcucucuugucucccaaaccuugaagguguucuuuuauuggcauauuugaagcucuucaagggauuuggggaaauguagaaucucugccuugaaguauguaugagauugcaaaagaguugguagcaguguugugggggagcacagucuagcauuguacccuguuuuaaacuuaguagucagaugucaauauuucuuuauucauauuaaaauaaauaaauaaaaacacuucaaauaauaucauuuguuucacaugaugcaacuuuugucccacauaugccugagauuuccuuacccucucuauuuucaaagguaagacucaaauugcuguuauuguauccuuccuugauagaacauuuguccccuuuuuguuuuguucaaaucacugccauucuguagguuaaaagcugaaaagaaaauagagcauaacuaccguuguuuuaccuuacuucauaaacuguaaaaguagaagaaggaauuauaaaaccuuaagaagcaucaaagaaaacuuacaaaaagccauuaaaaaauaaaugccuuaggguggguagauuuaauuacuagccuuuauuucuguaauuacucuugcaacugauacugagauauauauauauauaucaguugcaaggguaaauauauauauauauauauauauauauauauauauauauauacaugcaugcagcuuccuucuauuaucuacuccauucauuaucuuagccgguucuuuguguggugguuacuuuuccugacaggcacgacccaaaucuuuguaaggagacuaccauuuacuucuauauuacaguugccaaaaugguuuuguuuugguuuuuuuuuuuuuuuguuuuguuuuuuuguuuguuuugguuuuucgagacaggguuucucuguguagcccuagcuguccuggaacucacuuuguagaccaggcuggccucgaacucagaaaucugccugccucugccucccaagugcugggaucaaaggcaugcgccaccauguccggugccaaaaaguuuuuaauuuaacuuuuuaaaaaguaucuaaacccagaguuuuguacaugcuaggcaaguacaccacugagcuauaauucuacucuuaggugguauaguuuuucauuaguuuucuuuuuuuuuccauuuuuuauuagguauuuagcucauuuacauuuccaaugcuauaccaaaagucccccauacccaccgacccccacuccccaacccacccacucccccuuuuugguccuggcguuccccuguacuggggcauauaaaguuugcaaguccaaugggccucucuuuccagugauggccgacuaggccaucuuuugauacauaugcagcuagagacaagagcuccgggguacugguuaguucauauuguuguuccaccuauaggguugcagauuccuuuagcuccuugggugcuuucucuagcuccuccauugggagcccugugauccauccauuagcugacugugagcauccacuucuguguuugcuaggccccagcauagucucacaagagacagcuauaucuggguccuuucgauaaaaucuugcuaguguaugcaauggugucagcguuuggaagcugauuaugggguggaucccuggauauggcagucucuacaugguccauccuuucgucucagcuccaaacuuugucucuguaacuccuuccauggguguuuuguucccaauucuaagaaggggcauaguguccacacuucagucuucauucuucuugaguuucauguguuuagcaaauuguaucuuauaucuuggguauccuagguuuggggcuaauauccacuuaucagugaguacauauugugugaauuucuuugugaauguguuaccucacucaggaugaugcccuccagguccauccauuuggcuaggaauuucauaaauucauucuuuuuaauagcugaguaguacuccauuguguagauguaccacauuuucuguauccauuccucuguugaggggcaucuggguucuuuccagcuucuggcuauuauaaauaaggcugcuaugaacauaguggagcauguguucuucuuaccaguuggggcaucuucuggauauaugcccaggagagguauugcuggauccuccgguaguacuauguccaauuuucugaggaaccgccagacugauuuccagagugguuguacaagccugcaaucccaccaacaauggaggaguguuccucuuucuccacauccacgccagcaucugcugucaccugaauuuuuaaucuuagccauucugacuggugugagguggaaucucgggguuguuuugauuugcauuucccugaugauuaaggauguugaacauuuuuucaggugcuucucugccauucgguauuccucaggugagaauucuucaguucugagccccauuuuuuaaugggguuauuugauuuucugaagcccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccacuuaucgauucucgaucuuacagcagaagccauugcuguucuguucaggaauuuuuccccugugcccauaucuucaaggcuuuuccccacuuucuccucuauaaguuucagugucucugguuuuauguggaguuccuuaauccacuuagauaugaccuuaguacaaggagauaggaauggaucaauuugaauucuucuacaugauaaccgacaguugugccagcacuauuuguugaaaacucagucuucuuuccacuggaugguuuuagcucccuugucaaagaucaagugaccauagguguguggguucauuucugggucuucaauucuauuccauuggucuacuugucugucgcuauaccaguaccaugcaguuuguaucacaauugcucuguaguaaagcuuuaggucaggcauggugauuccacuagagguucuuuuauccuucagaagaguuuuugcuauccuagguuuuuugguuuuguccccucuauuacucgacaugguaguguaccuagagucaucccagaaaaacugugauguauuaauaauuuuucuguccuuauucuacuagacaguaugaaauuaaaccagcuauauagcagauaacauuuuuacuuacugguucagugggcucaauggccaauuaauaacauaauuuuaaaaaugcuaggggaaagggucauacauguauuaugccauguguagauaucacauguguagauauguuugacacaagccucuuuuauuuacauucacuacuaaauacucagaauaguuauccugcaagccuccaaggauucuuauauuucuacuucucauguuaccaguaguaugcuuggauuacagagguaugcuaccacacuugguuuuauauaguuucugggggauuccuaccuaagucagcaugcaugcuuauguggcaaguacucuacccacggggcagucucacuuacccucaagaauugcuuccuguagaaguaaauuacuucuaaguaagcauaggcaaaauuucuguugcuuuucuuuggaauaauauuuguaccaauuuugaguucugcuauugugacauaacuggaagaauugucgcaaaauggucuuaggcucagagcucuacgacauuuggacuuuaccacauccacgcaaaauggcccucuuauacuaugaaucuaaaguauuccuuaaguugccuugcucagggugcuuuaucacagcaacagaaaaguaacuaauauagacaguacucuaugcaaaacagccauggucucucauaguaauuuaggagauuauuguaguaagguuuuuagucuauacagggaccaaguagagcacuugaugauaaacuuggcaaaaggaaaauacugauucccuaucuauagggucugaauuaugauuuuccuauggcaugcugcagauuucuauguauuguucauuucuguuagccacacuucagauaucuacucggguauguggucuaaggguuaaagaagcuuauaugcuaaucuaaaccuuauaaaagaguggauuuugcuuuguucccugaacaaguagacagucuugguaaauguuuuuuguaaauggcccaaaacaacauacuuaggcagggauguguuacuuccaagauucagaggcuugcccaggggccuggagaagagagcucaguggguaagagcacugacugcucuuccgaagguccucaguucaaaucccagcaaccacaugguggcucacaaccaucuguauugagaucugacacacucuaaacacucuucuggugugucugaagacagcuagagucuacuuauauaauaauagaccuuuuuuuuugagaaaaaaaaagaaaaagucuugcaagcaauaccuuuucccuuucagagggaauacagacacugcugacuaacccaaaauauccauagccuuuguacaaggccugcauaugucuugcccaaucaagagaucuuauaauuguaaauucacccuacaagucagguuuagccagccaucgccauuaaguguguuagaucaguaagacaagcaucucuggcaacucgaccuggaggaggggagcauuaauuacacaagucuucaaagacaaugaaguauaaaaacccuuugucauuaauaguaaacugcuguggcaucugugcagcaaggucagcuucuaaucaagauucaaagccacacauuuaaugccugcuaaagagauauuaauaaaauuugcagauugauuuauggcauggauccacaagcuggaaucuaggaaucuguccaucuuuauaacauguguauugucucuccuguuacauacaugcacccccagcuuccccaucuuuuccuuaauuucaggagcaucauggcacaugaucccucuucuaauguggaaggaaagugcccuugcuuuuuaacacaguggcuacuuacuaccauuuaccuuauuucaucucaccaggucgauauuccuaccucuccugacuuguagagugaguuuacucugauaggaugucuugagagggcacauuuauauuuuauuacaagacuauauuaguuacuuucuuugccuacuuuguauguuaaucuuugccuuagauauuuguguauagagacauuauauaaagaguucauaauaucuuugcugccaggcaucccuuguaugacuugagauauugauccugcaggugugggggcuucugauaacagcuuuauugcaaugugccaugcacauucuuguauuuguuuucagugacugcuuuugaaaaguugacuagaacagagaucauuagguuaacacuuuuauugucuguaccauaacaagauuuggguucuuguuccuauacuaauagcuuaugucuaccacauugggugcauucuccaucuuaucuugccauguuuuugccaaaaucaauuugaguaauuggugaauguaaaccuccuuugguuacauuuuuaacguacuuggauaccugguuugaaagucacgguaggucuggaagcagcugaauucuguggcagaaucuugugaagaaucugaguuuagagaauggaaccgcaucccuuugaaagagaagacuccugugcuguacggaacagcagcuccucaguauuuacaaaggcaucugagacgugccccaaagcccaagucaucgguccuuucauaaaaguuguguggaaugcccugaucuacauguguuuuacuuuaccacuacguuauaacuaguuauaacuaagcucaguaugguugcacuuaaacagaaccacuuaaccuuagccaguaugcauuuaaguuugaauuucaaugugccccuuuauaucaccacuacuacuccuuugccauuucacaacuuuuugcuucccccaagccaagaaaugguaguuuagaaaaagaaaacugaacaaaaguugguuauuauagcaacuguuacuguuucauuacuguguuaguuaacucuuccaucucaagaggucuuaggcuuuauuuuuuaccccuuuagccuuuuccucauugugcaauauaccuguacuaaucacuuuuugguucaggggaucauaggcacuuuucagagaggcugagugugauagauugcuugacuagaacucucuccucuaccauugucaucucaguccagcauuuauuccgaaacacagugauacaaagacuuaaaaaaacaauuagagaugauagguauuugccccugugcauucacacccucagucacacaauuugaaugauacuguuucauucuuaguaauacaaaccucagcugcuuauuugcuacauguucuuuuccuucuauauaguaucauucagaaagcauuuuguuuacaguaaaauuugaaugugugacuguuggcaguuguagccccacuucagugcauuccauacaauguuccccuugauuaucuaaccuucuauauucuaaauuauugcuauguacccuccagcugcacaggcaggucuuugguaacuguacuagcuaauuaggauuaccucucagcccugccuaugccuaguuuaauucauuguuacaguccugaguccuuuguguuucucauuagcaccuccuguaugcagcucugcauacuagcuuugauaaagcuuaaacuugcacagcaacuuucuuucagccccaagaagaaacaaacccuucaucuuuuaaugcaguguuauaugaaauagaagaucacaaccuguuugcacucauaaaucagacuguugcuuaaaugcuuaaugaaggaggaauauuugucugcguguugaaguuuggguuagcuuuaucuguaaguuuggguguauggguaaagguucccagugaucuucugcacaaucucaauugcuagcguaguaauugcacauugccaccauaauuauaauagaaaacuaggcacgagcauaaaaaccauaaacuuuuuaacuaacccuguuuauaauuugcaccucucuuccaaaaacauuccagugucuuuuaaaaucaaccaaaugcacacugaaaguuuauuuucuaauagcaacacaacagccucuaauugagauugagacaagagccuugccaugcggccaggcucuccugacacuaugugaaccccaccgcugauauggguaagaaagcuugcagugcugggaugaaccaccaugccugguuugguucaauaccucaaaggcaauauuuuaggaaucuuugaaagguugaaagcaaauuaagaucuaagauuacauggcgaccuccaguugaaccagcaucauuuguugaaaaugcuaucuuuuuuccucuggaugguuuuggcagcuuugucaaugaucaagugaccauaacuguagguuuuuuucugggucuucaauuccauugcucuaccuguuuguuuaucacuguugcucuguaguucagcuuugaggucagggauggugauucucccagaaguucuuuuauuguugagaagaguuuuucugcuauccugagauuuuguuaugcuaggugaauuugagauuugcucuaucauugugaagaauugaguuggaauuuugauggggauuguguugaaucuguagauugguuuugauaagguggccauuuuuacuauguuaaucuugccaauccaucuucaauuuuucuucagagacccgaaguucuugucauacagaucuuuuacuugcuugcuuagagucacaccuagauauuuuauauugugacuaugaauggugguguuucccuaauuucuuucucauccuguuuaucauauguauaaaagauuuguuucaguuaauuuuauauccaccuacuuugcugaaguuguuuaucagguuuaggaguucucuaguggaauuuuuggggucacuuaaguauacuaucauauccucugcaaauagugauauuuugacuucuuccuuuccaauuuguagcccuuugaccaccuauuauugucugauugcucuagcuaaaacuuccaguacucuaucaaauagauagggagagagaggacagccuugucuagucccugauuuuagugagauugcuucaagauucucuccauuuaguuugauguuggcuaccgguuugcuguagauugcuuuuauuaugguuagguaugggccuugaauuccugaucuuuccaagacuuuuuaacaugaagggauauugaauuuucucaaaugguuuuucagcaucuaauaaaaugaucauguggguuuuuuuuuucuuugaguuuguuuauguaguggacuacauuaauggauuacuauccuugcaucccuggguuaaagccuacuuggucgugguaaaugaucucuuugauguguucuuggauuccauuuguuuauugagaauuuuugcaucaguauucauaagugaaauuggucugaaauucuuuguugggucuuugugauuuagguaucagcuuaggcuuuauagaaugaaauagaaaguguuccuucuauuucuguuuuguggauuggaggcccuuggucauguggaggcuugaugccccagaguagaggaaugcuagaguggcgaggcgggaguggauggguaagagggggagcacccucauagaggcaaagggcaggagggauuugaugggguguugagguugggagaccucgaagggggacagcauuugaaauguaaauaaauaaaauaaccaauaaggaaauaaaaaagauuacagauuacuaaccaguguguagucauucacccgggcuggcuugugcuucacuuggccauucucuucugcucccuugcuuacacgacugccaagguugacuaaagugaaucaguuuaagaauacauagauuuucuuuguauggagaauucauuuuuagcuucauauuauuuaccacuaggcaucaaauugagccaaaaucuauuuuauggauagcaaacugucucuaaaaaguugccagguauguguuuucucuucaauucauagggauagaaaagaugaauauugaagugcccauugguuucauaggugcaaauggaagcccugauuaugccacauuuguugcugucaucagucauguuacuucagaucuuacauacuucauuguuuaccuucagucagaaagacaggcuucaugaaugcagaaauucauuucucauuaucuuggguuucugggagguaaauaaccuaagucugauauuugauauauauuugauuuucucuuacuguuuuuuaaaaaugucuuuucaauuuuuaaguccugccuuugagucagccagagaagauucuucaagcuuaguugcggaacuucaagagaaacuucaagaagaaaaagcuaaguuucuggaacaacuugaagaacaagagaaaagaaagaaugaggaaaugcaaaaugucagaaccucuuugauugcugagcagcagguguguuugagaucugaggaagcuugauagaaacuagcugagcuaguucucugcaguugaggguucuuguuuccauuauuugaccuucuuuuuuuuuaagauuuguuuauuauuauaacuaaguacacuguaucugucuucagacacaccaaaaaagggcgucagaucucauuucagaugguugugagccaccauaugguugcugggauuugaacucaggaccuuuggaagagcagucagagcucuuaagcacugagccaucucuccagcccuuauuugaccuucuuaauguuugaucuuuuccauaauaaaugcauuuauucuaaaaagaaaacuuguaacagugucacaggaauguaguuagcacuuuauguaugaauuaucaauucacauagaccugaaaucugcuuuugagaauuacaguguccuuggcacaacuuaguucacauguaauugggcuuuucucugcaauucucacuguggucuuuuauaaaaacacacucaauuucagauucccauaaugaauuaggaucugaauuaacugaauucaaaacccagaagcuaaaaacuuauccuaaagcuccaguuugcuuguuauaaguugugauuaucgccaggcagugguggcacaugcacuuggaaggcagaggcaggcggauuucugaguucgaggccagccuggucuacagagugaguuccaggacagcucgaacuacacagagaaacccugucucaaaaaaaaaaaaaaaaauacaaaaaaauauugugauuaucuuaauccauucauauuacagaaauagcauaguucaugaagauaaucaaugguuaauguacuuuuacaugugcuaauuuucuauuuguaaacagaaauuaccuaguaguaagcugcauugguaacauucccucuuuuuucugcaaaaaaaaaaaaaaaaaaaaagguuuuuuuuuuuuucaaauucuaagucccuucaaguauucuugguagccugaaacuuuuacuuuguucuuuguuguuagauuuuugucugaaacugucaaaugauuuuccuguuaaaucugucuguugccauuuauggauuucuaaaagguuuuggguaaaugcuaagcaaauuaaagaaucauguuagaucauucucucacguaaguauuuguuauauuuuaaugaauggauauguuuaaugaguauaaaugaaauguuuaacaaauuuaaucuccuuuguuaauuaaaaugcaguuaaaauuaccaguugucugucagaucccucuaggcaauugaauaugugaacuucaugcagugggugaaaccuggggaguaauaagugucaucgcuauggaggccccgagggcauugcacauguucaaauaagaggaagauaaccacacgcuaguaugguaaucaagagcuagccaaagaucaaagauuucagaggaaagaaaguuucccaaagaaaacgucauguauccaacagcacucuauuaacagcacuguugaucauuuaacuuccuucucgaaaaugucaggcauuugccuuucugacaauauaaacaaggagaaaauuuuguuuucaaguacugaguucaaacaaagaaaauaauaaccuuuacuggaauacauaccauuugcuuagucaugugacuccauaaauguaccucagaaaagaauacauuacagucuuauuuccauagcauugucuccuaaguguaugcagcugauugacuauuacuacuguuguuucagaccaacuuuaacacagucuuaacaagagagaaaaugaggaaagaaaacauaauaaaugaucuuagugauaagcuaaaaaguacaaugcagcagcaagagcgggauaaagguuaguguugucuuaauaugauuuuaaaaauacuuggaaguguuuucaguauguaaugugucuuugccuuuggggucuuagauuugauagagucgcucucugaggaccgagcucguuugcuugaagagaagaagcagcuugaagaggaagugaguaaacuccgcacuagcaguuuucuuuccucagcaccuguggcugcagccccagagcucuauggugcgugugcaccugagcucccaggggagccagagagaucagucauggagacggcagaugaaggaagacuggauuccgcaauggagacaagcaugaugucuguccaguaaguaggcuuauuuuccauucaguucaccagaggcuuuuauauucagcagugcuugacacuggugucauuagucuauaauccuaacaggaggaucacaaguuaaagcucucuuuggguaacaaugaacucaaagcaauuuagcugaggcuggcucaaaauuuaaaaaaaaaaagucuguacugcuauuccauuaaauuauaaaauucuaaagaaaggagguauuuuuaacuuuacuaauuguucuuagcccauauaaaaguaauuuuaaaaggaguguagaaacauguuaagagaaugugguaauuaaaauucauaaaugacagaaauuaauccagaguggaaagugaccucuggagggaaauaaacccagcugucuucuauguacaggagaggcaguuaaaacaaaucaauauaggaagcccaguauaagguauaaaguaugacacgcaucuaauaucuucaaccugauauuggugggguaggggccagaggcaagcagaucuucagagcucauucuccagcuauucuagaagaauuaaugagcucagggucagugauaaaacucaaaaaagguagcaagcagucucaacgaagacuccugauguugaccugguuuucacacauauguacacaucuauacaaacacaugcauagaccacacaaccacaccaaaacaaaaauuaaaaaugacaaucaauuuucccaacuuuuguuaauaacaaaaagaugaguuuguacaauuggaaauuuuaacacaucuuuauucagauguauagcuauugaugccucuaagaaggauacauauguaugaacacugguauauaaguagaaauuggacuauucuagaguaaacaaggaucuaaaaccaaguauaaucuauguaauauucugagagagcuauauaaccucauauacauuucuuucaaaauuaauuauggaaaacaguguuuacuaucugagaaaguaugaauuuuauaaaaauuaucucuaaguaaaaacaaaguuuuguuuauagucucaacaagugucuaagucugaacacagauaaucagcuguucugauaaauauaggcuaccuuugaaaauuaguacaggcucuuuacucuaucuaacuugucgagacuggccucaaacucagagaucugccugccucugcuucccaaaugcugggauuagccaccaugcccggcuaagcuuguugaugaauguacaauucaggguguacauucugugaaaaugcuuaagccuuacaaacaaccauucuuucacuuuuagagaaaacauguuaucugaagagaagcagaggaucaugcuccuagaacgggugagcagacucucugugaaguacuugcuuuauaugaugacucuggggaaaacauuuauaugccuuuuguuuuaaagacauugcauuuugacuugcauuuaugaauuaagacuuuaugauuaauuugagagggccugucauuuguguuccuaguagcugaauaauuguaggaucaggucucacuauguaacuucuucagugauugacaucuccagaaagcaaaaaggacuuauuuuauaaaguuuuacuuaauaacagcucagaaaacagcaauauaauaucaguaagaauuucaacacauuuauuuuuuuaaaaaguagauuuuuuuuaaaaaaugagcaagaauauaaaaauauuaagauugcuguaaugaaauuuuuaauaauauuaauugaaauaaggaaaggaccuucaguugcauaagaauuguguacauacacccacagaaacacacauggaucacacaaauacaccaaaaauaaaaagguaaguauuuggcaauuuuuauuaauuaaaaguacuuugaaaacagaaugaacccucaauggcuaguuucauucaucuauucaugacuauuuuuaccagugucuuuguuguauaccaguuuagaaaauaauccagagacaaacuguccaguuuaacucaaauauauuagccauuuucuuccuguuuugugauuaacaccuuaggaucagacaaguuguaacaauauguugcaaaugcagguuguaccucugaacuagcauauuugggugggauaaaugcagcauuuauuguguguuuauaaauuacacagcuaaugacaagauuugaaaacuuuaaagaaucaaguuuuaggacaauauauucaguguucucauucucacuaaaauguuuagugaucagaauggcuacaauagacucucuagacauguacuccuuuugaagaugagaaccuugcuaaucauccaaggauaaaucacaggucuguuuuuuccuuguagacauugcaguugaaagaagaagaaaacaagcgguuaaaucaaagacuggugaguucuuuugguuauaucucuuuuuuaaaacuuuuguauuuugguguagacaucauguaccugaaggauuucuaauuuuguuuuuacacuuacuaagaagagaauggagcaugugugccaucauagugucaguauggauucagaggacaaaguaaguuuuuugccaccaugugugccugggcauugaacucaggucaccaggcuugguggcaccugcuuuuaaucuguuaugucaucuuucuagcccagaaugugugugguuuauucauacucguguuaaggcguauuguacauuagccaucacuggcucucaagugauggaauuuggucagaguugcuauuuugacugauuguagaauuaccuguucugcauuuuuuguagauuuauuuuguguauaugaauguuuugccugcauauauuuaugugcaacuugugagugcauguggauacuugggaucggucgcaugaacgcuggaacugaacaccaauccuccauaagagcagcaaaugcucuuaaccacugugcccagaucuuguuuuuuguuuuuuuguuuuguuuuguuuuguuuuguuuuuguuuuuacuugaaaaucguguauuguacuaagaauuugacaaaguagacugacuaccuuacuuugacacuuagagaaaaaaaaaagaaaauauagucuuuauuuuuaaggaacuacuauuucuugggauuccauaauuaugcauauaaucuuuguauguuuaauucagugaguuagugcuuuguaaucuuuugaaaauuuacauuuacucuggugaauuuugaaagugaagauaaaugguuguguccugacuugugucuuuuuuuuuuuaauuccuccagcaccccacuuuagaggcauucauguuuuaauagagcaauuacuuaauuucccccuaaaucagauugaauuccuagcaccuaaaauauuauuuucugauaauugcauauuucaaaggagacauaguuucaggcuuauguuuagugguuuuaaaaaaaggagaaauacuuuucaugcagcuacccauauaucacagucaauguguggagguaaaaggucaaauuuugacauagguucucucauuccacuauagucccaaggacugaauuuaugaauauagaucaccaggguuuaugcuacaaagacuucuauuauauauuuuauauuuuuccuuucuaaacuugcuauguuuguucaaaaaacucuucauaaugauucagaacaaaguuucugcugggcuuuuuugugauuuccuuugucuguguaauuaauauaaaucugcuuaccuuagccucagcuagacucuucagacaagggcaaaaaucaaccucguucuucaccaaaaucgcacaaaaacaaucucuaggccacauauugaaauccucuugggccaggucuguacaguucaaaucacucucaguuacaaaguuuuuuuuuuuuuuuuuaauauuccuauuagaauagccaauuaagccccacuuaaagauauccacugcuuuccaaacacaaaacccccaaaucuacauucuuccaaacaaaagcaccgucaggccuaucauagcaauaccccacuccugguaccaacuucuguuuuaguuaggguuuuauugcugugaacagacaccaugaccaaggcaacucuuagaaggacaacauuguauuggagcuggcuuacagguucagagguucaguccauuaucaagaugagagcaugggaacauccaggcaggcauggugcaggaggagcugagaauucuacauuuucaucugaaagcugcuagcugaguacugacuuucaggcagcuaggaugagggucuuaaugcccacguccacagugacacaccuauuccaauaaggcuaccccuccaaauagugccacucccugggccaagcauauucaaaccaugacaccaacugagccauuucacuggccccugcaauugauuauuuuuaauaaggaacagugagccgaguguagugacacacaucauuaaucccagcacucaggaggcagaaagaggguagaugucuaugaguucagggccagccuaguuuacagggaguuccaggacagccagggcuacauagacccugucucaaaaauguacaaacaaauaggagcagugaagcaucccucucuauuuucuuuuucuguuuguuuguuuugugacaggauaucucuaguuggcaaggaaugcauaguccuaccuucagagugugaugauuccagcuaggcauaugccaucauuuauugccagccucuguuuuauuccuuugccuuuacacaaacuaaaauuagguguuuuauacugguaguauuacuaauuaagaaggcuuuaaagaagaguggccuauuccaaaugacaucaccuaauacauuuuuuuauggagaguccccaagggaauaugagcccuauuuggcuaagauuuuuaguaauauuuuguuguuuuugcuuucauauagggcagucggguucaagaagcauuucaaaacugcuuuuuucuagcaccuagaauaguggaaccagagaaguagagaugcuccugugugacccagagagcuagcacaugcagcuguguccagagaagggugcauucccacacauuuacugucuuuacacagaagcauugacauguuuuucuccaagcguagcugguuuuuguagagugagcuuuuagaaugucugaauaaaauugaacauguguuaaaaaugacuuaacuucacugguaggauauaugucacuuuccuggguaauuuaaucaaaucuuugaaaggcacuaggccuucuuagauaauucuauuaccaguuccuuagauaauucuauugccuuuguacaaaauaguguuuggaauggaguggaugaaauuuaauauacaaauuuagauuucaguguugaauugaugaauguaaauaagaaugucuguaaauuguggauguacauacauguggucucuucaccuugaacacagauuaaaacauguauaacagcagaacuuucugaugaguaugguacugugugugcagcuaaugcaugauucaacuuuuuugucucagaugucucagaguuuguccucagucucuucaaggcauucugaaaaaauagccauuagagaguaaguaucucguuuuuauuuuguguguuuuacaucaaauuguuaaugaaaauguguuguagucaccaugauuauuagauccaugcucauuggccaagugccuugugcauaaugauaagaugauuggaaagcaagguuuuucacuguucuccuggagcuuugggacuguauucugagucaccccauuagaguucuaucauucacacaaaaggccaggaagcuuuucuugacacuagcuaauaugucagcugaguguccauccuuagcuucuucguccucacuucagaucggaagaucuugauuuuaggucgcuaugcuuuguuucuccauuuuauguuuuuuaugugcuauaaauuuauuguauaauuugaaaauuucaucagucaaacaguuuaacauuauagcuuuccuggaccaaauuaccucauagaaguuguugucuuccccgagcuuguuuggcaggagcuuuggaauaauaaagaaaagcaucauugcagcucagugaacccauguugugcaaaaacuauugaacuugacacacuugguuuucuuaagacaagagucuuaccauguagcccauucuggccugccacacaccguuuucuugccuugcuuccucgaaugcuaggguuaaagggguggaucacaguaccugguuucuggauuaaguauuugagaagacccuuauuuuauguauaguagauuuuuguuauuaauugguuugaaggauuuuuguuuguuuuguuugauuugucuaggguuuuuguuguuguuguuuuaacaaaucucagauauccuuguuuaucuucccuaacugaugauaggauaggauagaauagguaggauggcugucugcuuagccagcuguguauuaaaaucauuagucuucuagagaccagugaauuaaucuuacugcuuccaaagauccuuuacuuccuuuuaauauauuaggcuuuggcguucagucaguguacagugcuuaccccauaauuguagcagcauuuaaaacucuucccagacugcucguggcauccacauguagucccaguacugagaaagugaaggcaagaggcaaagucaaaggcuauuccauauagcaaaugucuaaaagaggaaagggaaaaaggcuucauaguggaaaaaggcuuucuaguugacuuugucagccggagaacggagcacauaaacugacucugagguuggucuucagaacguguaaagauuuugagcacaguuugagagguggacacuaguuaaguguacauguagguagguguaaauguuuccuccucugcuguugaaggucuguauugagccuuuguaaggccagauucagcacaugguguagccgccagcagccacggguuccugguuccugagaggaaagauggggcuuuggaugggaaaggcugugagagaaauaacaagccaagacgaagauuucugaucaaggccaauguuuacuuacgaguuugagcuuaugaaaggggcggggagggggcccaucccccaccauggcaggaucgcugcuuugucaguauagugucagaacaggcucagccucucugcagguaguggugucuuggagaaaagcugcagauguggcaggacaggagacuuuaccuaggucagaagacuccaccaacuguggcaagccaggucugagcagccugcucaaggcugggggaagggcacaacaaugauuugauucaguugcuuuuucuuuugaaaugaagaguaucacauuuaagaauugaaauuccagaaauguuucuugguguaaaaugaaagauugggggaaaaaaugaacuggcauuuuuucuacugcacgcaagcaguggguauagaacccccaaacagugagccaacuggauagucucaaguuuguagcauguaauuaacgaaugcuaagacaauaaccuacuucuccuuaguuuucaggugggagauuugguucucaucauccuagaugagcggcacgacaauuauguauuguuuacuguuaguccuacuuuauauuuucugcacucagagucucuuccugcccuggaucucaaaccaggugagggagguaagugcgcauacacuuguaaguacuaaucuugaguggaagacacguauucccuccuguugucauuaggaaaggcugccuuuucaaaaaaugaaaucuggggcuggugagauggcucagcaguucuggaggucaugaguucaaauccuagcaaccacaugguggcuuacaaccauccguaaugacaaacaaauaaaaaauggagcaagccgagccaacgcaagaggcagaagggaaaggggugggaaaugaaaaauuaaaaagaauaauaauaaaauuuaaaaaaugaagucuacauuaucuaccuauuuuuaugaacuuaauugauaauuauaaauuuggcuguaauauucuacaauagaucaacugcucacacugcauauauauucaaacaugauauaaccuaguaauugcaaaauuacuaucaaaauuuugauguucauuuuguugguaauuaauauaugcuuauuuacugaaagaucuuaccaguguuuuucagaugaguaguuuaaguagugccuuuccuguacuaguuaugauuuguuuuccuaucuuguucauuuguucauugauucaucaucaucauuauuguuuuauggaguuuuauuuuguagaaacugagcuuuguucaucaugcugaguaacaaugcccauuauuuauuagcucauuaaagaguucaaagagaagagaauagcuauucuggaauuuuuagacuaaguaaaacugcuuagaaaauuaguuuaccccaagccaagugugguggaacaggccuuuaauuccaguacucugucuccucagaugcagucagacguaggcccugaaaagaagagggaaaucaguuuccucacaugaucugauggucaaaccccauucaugggcuagggcacugucacuugaccaccccgucauggcuuuugauggauggccuauuuagaaugucugugugacagcaguuauauagccaugaaaagugaaaagauaaauuuguuuucagaaauagguagcauuuuucuuauuguauauuuuuggauuuuugacacagucucauauaucccauaccaguugcaaacugucgugcauccgugguugaucuagaacuccugguucaucucccuguaccuauccacugcuauguuuccaguuauagagcacuaugccccaauucaucugcccucuagccuuguuccuguuucacuuguuuccuguauuuauuuaagggguguuuguuuuucacaguuuggggaucaaagcuagugucuugugucucuaaauuuuaucccagcucuuuacauuuuuagaugaaaaugaugcaaacccacguauuuacucagacuugccuguuaacauuuuaccuuauuucuauuauuucuuauguuuuucuaaacauguacacuacuaaaguaaugaauuuuaaaaccaagugcuugucuucucauugguguucucaguuccugcccaggaagcccacuucuagacuucauuugauucuuacuauuaacugcucacugaguccaaguuguguguguguugcugcugcugugcuaggcacugguuacagcuuccuucacacacugaccgacugccagccacucagaagucuggagguugucauucguuccuucaguagguggcaguguugagucaguuauugguucaucacuuagauuacuaguguuccgugaaugaguauuuuaaaaagcacacauauuuauauauuggaacacaccauggauauuuuuucuucaauaaauaauuuggauuuuacugguuuuuaaagugauuaaacauucuuuugagaacaccauuauuguuuugauucuaaaguucuuuuuuucaugaaugaacuuugaaaauauauuaccaauuuauuagcuucaggugcaucuagaagacccuggguccuugggaaaguaauggaaaaggaauacugucaagccaaaaagguaagaguuaacccuguaauaguacacuuagggguuuuaguauauggaaauaguuacuaguguuuucugauuucuguucaccuagagcuugaauuuuauuaaauugaguuuaacccagaaacuuaguaaauauugcuauuaucuuuagauagaaguagguuuccaacaguucauccgccuauaaaggagaacaggcaguguaacucauguugaaggcacuagaagcaacaaugagcuugauuuguaugguuggccuguacucauuuuuauacgcuacagcauugauuaaauuaaaaaugcucucaagucuuuauuuggaggcuaaaacgaaacugacaagccaggauuggugguauaccucugaccagagcacuugaagccaaggcagggauggaaggaucuauugaguuccuagucauccugggcuaugaauauaugcacauguuauccaagccuuuguaaggcaggggaaggagggaugcuacacauuugaagccagucuugucuacauagugaaugccagggcauccaggguauauagcuagacuauaguagacagggaaggggggauaacuacaccauccuccccacccccaacacucauuaauauuaguuuauucucauuuggucgggagccuaucuuuuauaguuugguacagaguagagacuccaccuccucuucaauacucuagcaguaagcagugugcuagaaggguacuuguaauuuguuucauucauucagugacuccuuuucucuuuccuucuuuuuuuuuuuuuuuuuuuuuccauuuuuuauuagguauuuagcuccuuuacauuuccaaugcuauaccaaaagucccccuuacccacccacccccacuccccuacccacccacucccccccuuuggcccuggcguuccccuguaccggggcacacaaagucugcguguccaaugggccucucuuuccagugauggccgacuaggccaucuuuugauacauaugcagcuagagucaagagcucagggguacugguuaguucauaauguuguuccaccuauaggguugaagaucccuuuagcuccuuggguacuuucucuagcuccuccauugggagcccugugauccauccauuagcugacugugagcauccacuucuguguuugcuaggccccggcauagucucacaagagacagcuacaucuggguccuuucgauaaaaucuugcuaguauaugcaauggugucagcguuuggaugcugauuaugggguggaucccuggauauggcagucucuacaugguccauccuuucaucucagcuccaaacuuuguuucuguaacuccuuccauggguguuuuguucccacuucuaaggaggggcauaguguccacacuucagucuucauuuuucuugaguuucauguguucucuuuccuucuuaggcacaaaacagauuuaaaguuccuuuggggacaaaguuuuacagagugaaagcugugucauggaauaagaaaguauagccacagaagaaaucucuacaucucauaccauuuuugauuuguccuccagugcugauaaacuacucuaaaaacagcuggccauuguuggguuuuuuuuuguuguuuguuuguuuguuuguuuuuacaaaagucaacauaacaauauacuucauugguggacugcacuuaccuuuuaaguggcuacaucuuaggaacaauaaauuuauuaaaauucuuggcugaaucaaaaugguuuuguuuuguuuccacccaaauaacuagaaauucggaccaaaauagauguuuuccaagggcagagccugcacuguggcuugugacuagccucauuaguugccuguuaauaaacauuagcugaauaguuaccaguguuguuaccagcauuuguccucuugugaauucaagaguccucgcacucuuuaacauguucuuuauaaaauguauaaacccuuccaaacuauuuaaagaggaguguuauugcaugcagauaaucauaauuuugaguuugccucagaagacuacuaaagcaaauuuguucauuuuuuuuuaaaaaaaugcccuuuaauguuucaaaaaaaaauaacaguguaauuugacugacuuuaagaucagccauaaauaaugagcagucuucaaaagcacuuuucacacagaucaucugggcuccagggaggaagagucugugccacugauguuuucaagugcaggacucacucaaaccucucagcaucuuaggacuguuucaaguaaucauauugaugaacucguaauucaugguugaccuucagaagaagauauucauuguauauuaacauuuagaggucauuuaaauaacaaaagucuguauuguaaaggaccuguacaauuuuaagacaauaaagaauugaaaguguaaaugugugugccuuuuaaagguuacauuuuaaauauauugcgugauuucugggaaaggugaaaaaaauguucuguaucaaagagaaaccuguuuauuaaaaaauguuguuuguauccuauguaacagggugaagugguguucuguggaacagaaccauguaaacucaagguuuaaaagcuggcacugaacaaagauauugaaguagcuaggcuaguugauuggaaagaguuucuucaggguuguuguuagcaguaauaaaugauucuuuuucagaaauauuuaauuucuccauaaaaauaaguuggauauuuuuauaaauauguaaucuaauagaaugaaaauggaauaaacauaguguauagaauaccuaauucaaaaacauauuaaugaauaaacgaacaaaugauu

SEQ ID NO: 12269 - RNA, 60915 nt, Mus musculus
aaucauuuguucguuuauucauuaauauguuuuugaauuagguauucuauacacuauguuuauuccauuuucauucuauuagauuacauauuuauaaaaauauccaacuuauuuuuauggagaaauuaaauauuucugaaaaagaaucauuuauuacugcuaacaacaacccugaagaaacucuuuccaaucaacuagccuagcuacuucaauaucuuuguucagugccagcuuuuaaaccuugaguuuacaugguucuguuccacagaacaccacuucacccuguuacauaggauacaaacaacauuuuuuaauaaacagguuucucuuugauacagaacauuuuuuucaccuuucccagaaaucacgcaauauauuuaaaauguaaccuuuaaaaggcacacacauuuacacuuucaauucuuuauugucuuaaaauuguacagguccuuuacaauacagacuuuuguuauuuaaaugaccucuaaauguuaauauacaaugaauaucuucuucugaaggucaaccaugaauuacgaguucaucaauaugauuacuugaaacaguccuaagaugcugagagguuugagugaguccugcacuugaaaacaucaguggcacagacucuuccucccuggagcccagaugaucugugugaaaagugcuuuugaagacugcucauuauuuauggcugaucuuaaagucagucaaauuacacuguuauuuuuuuuugaaacauuaaagggcauuuuuuuaaaaaaaaaugaacaaauuugcuuuaguagucuucugaggcaaacucaaaauuaugauuaucugcaugcaauaacacuccucuuuaaauaguuuggaaggguuuauacauuuuauaaagaacauguuaaagagugcgaggacucuugaauucacaagaggacaaaugcugguaacaacacugguaacuauucagcuaauguuuauuaacaggcaacuaaugaggcuagucacaagccacagugcaggcucugcccuuggaaaacaucuauuuugguccgaauuucuaguuauuuggguggaaacaaaacaaaaccauuuugauucagccaagaauuuuaauaaauuuauuguuccuaagauguagccacuuaaaagguaagugcaguccaccaaugaaguauauuguuauguugacuuuuguaaaaacaaacaaacaaacaaacaacaaaaaaaaacccaacaauggccagcuguuuuuagaguaguuuaucagcacuggaggacaaaucaaaaaugguaugagauguagagauuucuucuguggcuauacuuucuuauuccaugacacagcuuucacucuguaaaacuuuguccccaaaggaacuuuaaaucuguuuugugccuaagaaggaaagagaacacaugaaacucaagaaaaaugaagacugaaguguggacacuaugccccuccuuagaagugggaacaaaacacccauggaaggaguuacagaaacaaaguuuggagcugagaugaaaggauggaccauguagagacugccauauccagggauccaccccauaaucagcauccaaacgcugacaccauugcauauacuagcaagauuuuaucgaaaggacccagauguagcugucucuugugagacuaugccggggccuagcaaacacagaaguggaugcucacagucagcuaauggauggaucacagggcucccaauggaggagcuagagaaaguacccaaggagcuaaagggaucuucaacccuauagguggaacaacauuaugaacuaaccaguaccccugagcucuugacucuagcugcauauguaucaaaagauggccuagucggccaucacuggaaagagaggcccauuggacacgcagacuuugugugccccgguacaggggaacgccagggccaaagggggggaguggguggguaggggaguggggguggguggguaagggggacuuuugguauagcauuggaaauguaaaggagcuaaauaccuaauaaaaaauggaaaaaaaaaaaaaaaaaaaaagaaggaaagagaaaaggagucacugaaugaaugaaacaaauuacaaguacccuucuagcacacugcuuacugcuagaguauugaagaggagguggagucucuacucuguaccaaacuauaaaagauaggcucccgaccaaaugagaauaaacuaauauuaaugaguguuggggguggggaggaugguguaguuauccccccuucccugucuacuauagucuagcuauauacccuggaugcccuggcauucacuauguagacaagacuggcuucaaauguguagcaucccuccuuccccugccuuacaaaggcuuggauaacaugugcauauauucauagcccaggaugacuaggaacucaauagauccuuccaucccugccuuggcuucaagugcucuggucagagguauaccaccaauccuggcuugucaguuucguuuuagccuccaaauaaagacuugagagcauuuuuaauuuaaucaaugcuguagcguauaaaaaugaguacaggccaaccauacaaaucaagcucauuguugcuucuagugccuucaacaugaguuacacugccuguucuccuuuauaggcggaugaacuguuggaaaccuacuucuaucuaaagauaauagcaauauuuacuaaguuucuggguuaaacucaauuuaauaaaauucaagcucuaggugaacagaaaucagaaaacacuaguaacuauuuccauauacuaaaaccccuaaguguacuauuacaggguuaacucuuaccuuuuuggcuugacaguauuccuuuuccauuacuuucccaaggacccagggucuucuagaugcaccugaagcuaauaaauugguaauauauuuucaaaguucauucaugaaaaaaagaacuuuagaaucaaaacaauaaugguguucucaaaagaauguuuaaucacuuuaaaaaccaguaaaauccaaauuauuuauugaagaaaaaauauccaugguguguuccaauauauaaauaugugugcuuuuuaaaauacucauucacggaacacuaguaaucuaagugaugaaccaauaacugacucaacacugccaccuacugaaggaacgaaugacaaccuccagacuucugaguggcuggcagucggucagugugugaaggaagcuguaaccagugccuagcacagcagcagcaacacacacacaacuuggacucagugagcaguuaauaguaagaaucaaaugaagucuagaagugggcuuccugggcaggaacugagaacaccaaugagaagacaagcacuugguuuuaaaauucauuacuuuaguaguguacauguuuagaaaaacauaagaaauaauagaaauaagguaaaauguuaacaggcaagucugaguaaauacguggguuugcaucauuuucaucuaaaaauguaaagagcugggauaaaauuuagagacacaagacacuagcuuugauccccaaacugugaaaaacaaacaccccuuaaauaaauacaggaaacaagugaaacaggaacaaggcuagagggcagaugaauuggggcauagugcucuauaacuggaaacauagcaguggauagguacagggagaugaaccaggaguucuagaucaaccacggaugcacgacaguuugcaacugguaugggauauaugagacugugucaaaaauccaaaaauauacaauaagaaaaaugcuaccuauuucugaaaacaaauuuaucuuuucacuuuucauggcuauauaacugcugucacacagacauucuaaauaggccauccaucaaaagccaugacgggguggucaagugacagugcccuagcccaugaaugggguuugaccaucagaucaugugaggaaacugauuucccucuucuuuucagggccuacgucugacugcaucugaggagacagaguacuggaauuaaaggccuguuccaccacacuuggcuugggguaaacuaauuuucuaagcaguuuuacuuagucuaaaaauuccagaauagcuauucucuucucuuugaacucuuuaaugagcuaauaaauaaugggcauuguuacucagcaugaugaacaaagcucaguuucuacaaaauaaaacuccauaaaacaauaaugaugaugaugaaucaaugaacaaaugaacaagauaggaaaacaaaucauaacuaguacaggaaaggcacuacuuaaacuacucaucugaaaaacacugguaagaucuuucaguaaauaagcauauauuaauuaccaacaaaaugaacaucaaaauuuugauaguaauuuugcaauuacuagguuauaucauguuugaauauauaugcagugugagcaguugaucuauuguagaauauuacagccaaauuuauaauuaucaauuaaguucauaaaaauagguagauaauguagacuucauuuuuuaaauuuuauuauuauucuuuuuaauuuuucauuucccaccccuuucccuucugccucuugcguuggcucggcuugcuccauuuuuuauuuguuugucauuacggaugguuguaagccaccaugugguugcuaggauuugaacucaugaccuccagaacugcugagccaucucaccagccccagauuucauuuuuugaaaaggcagccuuuccuaaugacaacaggagggaauacgugucuuccacucaagauuaguacuuacaaguguaugcgcacuuaccucccucaccugguuugagauccagggcaggaagagacucugagugcagaaaauauaaaguaggacuaacaguaaacaauacauaauugucgugccgcucaucuaggaugaugagaaccaaaucucccaccugaaaacuaaggagaaguagguuauugucuuagcauucguuaauuacaugcuacaaacuugagacuauccaguuggcucacuguuuggggguucuauacccacugcuugcgugcaguagaaaaaaugccaguucauuuuuucccccaaucuuucauuuuacaccaagaaacauuucuggaauuucaauucuuaaaugugauacucuucauuucaaaagaaaaagcaacugaaucaaaucauuguugugcccuucccccagccuugagcaggcugcucagaccuggcuugccacaguugguggagucuucugaccuagguaaagucuccuguccugccacaucugcagcuuuucuccaagacaccacuaccugcagagaggcugagccuguucugacacuauacugacaaagcagcgauccugccauggugggggaugggcccccuccccgccccuuucauaagcucaaacucguaaguaaacauuggccuugaucagaaaucuucgucuuggcuuguuauuucucucacagccuuucccauccaaagccccaucuuuccucucaggaaccaggaacccguggcugcuggcggcuacaccaugugcugaaucuggccuuacaaaggcucaauacagaccuucaacagcagaggaggaaacauuuacaccuaccuacauguacacuuaacuaguguccaccucucaaacugugcucaaaaucuuuacacguucugaagaccaaccucagagucaguuuaugugcuccguucuccggcugacaaagucaacuagaaagccuuuuuccacuaugaagccuuuuucccuuuccucuuuuagacauuugcuauauggaauagccuuugacuuugccucuugccuucacuuucucaguacugggacuacauguggaugccacgagcagucugggaagaguuuuaaaugcugcuacaauuaugggguaagcacuguacacugacugaacgccaaagccuaauauauuaaaaggaaguaaaggaucuuuggaagcaguaagauuaauucacuggucucuagaagacuaaugauuuuaauacacagcuggcuaagcagacagccauccuaccuauucuauccuauccuaucaucaguuagggaagauaaacaaggauaucugagauuuguuaaaacaacaacaacaaaaacccuagacaaaucaaacaaaacaaacaaaaauccuucaaaccaauuaauaacaaaaaucuacuauacauaaaauaagggucuucucaaauacuuaauccagaaaccagguacugugauccaccccuuuaacccuagcauucgaggaagcaaggcaagaaaacgguguguggcaggccagaaugggcuacaugguaagacucuugucuuaagaaaaccaagugugucaaguucaauaguuuuugcacaacauggguucacugagcugcaaugaugcuuuucuuuauuauuccaaagcuccugccaaacaagcucggggaagacaacaacuucuaugagguaauuugguccaggaaagcuauaauguuaaacuguuugacugaugaaauuuucaaauuauacaauaaauuuauagcacauaaaaaacauaaaauggagaaacaaagcauagcgaccuaaaaucaagaucuuccgaucugaagugaggacgaagaagcuaaggauggacacucagcugacauauuagcuagugucaagaaaagcuuccuggccuuuugugugaaugauagaacucuaauggggugacucagaauacagucccaaagcuccaggagaacagugaaaaaccuugcuuuccaaucaucuuaucauuaugcacaaggcacuuggccaaugagcauggaucuaauaaucauggugacuacaacacauuuucauuaacaauuugauguaaaacacacaaaauaaaaacgagauacuuacucucuaauggcuauuuuuucagaaugccuugaagagacugaggacaaacucugagacaucugagacaaaaaaguugaaucaugcauuagcugcacacacaguaccauacucaucagaaaguucugcuguuauacauguuuuaaucuguguucaaggugaagagaccacauguauguacauccacaauuuacagacauucuuauuuacauucaucaauucaacacugaaaucuaaauuuguauauuaaauuucauccacuccauuccaaacacuauuuuguacaaaggcaauagaauuaucuaaggaacugguaauagaauuaucuaagaaggccuagugccuuucaaagauuugauuaaauuacccaggaaagugacauauauccuaccagugaaguuaagucauuuuuaacacauguucaauuuuauucagacauucuaaaagcucacucuacaaaaaccagcuacgcuuggagaaaaacaugucaaugcuucuguguaaagacaguaaaugugugggaaugcacccuucucuggacacagcugcaugugcuagcucucugggucacacaggagcaucucuacuucucugguuccacuauucuaggugcuagaaaaaagcaguuuugaaaugcuucuugaacccgacugcccuauaugaaagcaaaaacaacaaaauauuacuaaaaaucuuagccaaauagggcucauauucccuuggggacucuccauaaaaaaauguauuaggugaugucauuuggaauaggccacucuucuuuaaagccuucuuaauuaguaauacuaccaguauaaaacaccuaauuuuaguuuguguaaaggcaaaggaauaaaacagaggcuggcaauaaaugauggcauaugccuagcuggaaucaucacacucugaagguaggacuaugcauuccuugccaacuagagauauccugucacaaaacaaacaaacagaaaaagaaaauagagagggaugcuucacugcuccuauuuguuuguacauuuuugagacagggucuauguagcccuggcuguccuggaacucccuguaaacuaggcuggcccugaacucauagacaucuacccucuuucugccuccugagugcugggauuaaugaugugugucacuacacucggcucacuguuccuuauuaaaaauaaucaauugcaggggccagugaaauggcucaguuggugucaugguuugaauaugcuuggcccagggaguggcacuauuuggagggguagccuuauuggaauaggugugucacuguggacgugggcauuaagacccucauccuagcugccugaaagucaguacucagcuagcagcuuucagaugaaaauguagaauucucagcuccuccugcaccaugccugccuggauguucccaugcucucaucuugauaauggacugaaccucugaaccuguaagccagcuccaauacaauguuguccuucuaagaguugccuuggucauggugucuguucacagcaauaaaacccuaacuaaaacagaaguugguaccaggagugggguauugcuaugauaggccugacggugcuuuuguuuggaagaauguagauuuggggguuuuguguuuggaaagcaguggauaucuuuaaguggggcuuaauuggcuauucuaauaggaauauuaaaaaaaaaaaaaaaaacuuuguaacugagagugauuugaacuguacagaccuggcccaagaggauuucaauauguggccuagagauuguuuuugugcgauuuuggugaagaacgagguugauuuuugcccuugucugaagagucuagcugaggcuaagguaagcagauuuauauuaauuacacagacaaaggaaaucacaaaaaagcccagcagaaacuuuguucugaaucauuaugaagaguuuuuugaacaaacauagcaaguuuagaaaggaaaaauauaaaauauauaauagaagucuuuguagcauaaacccuggugaucuauauucauaaauucaguccuugggacuauaguggaaugagagaaccuaugucaaaauuugaccuuuuaccuccacacauugacugugauauauggguagcugcaugaaaaguauuucuccuuuuuuuaaaaccacuaaacauaagccugaaacuaugucuccuuugaaauaugcaauuaucagaaaauaauauuuuaggugcuaggaauucaaucugauuuagggggaaauuaaguaauugcucuauuaaaacaugaaugccucuaaaguggggugcuggaggaauuaaaaaaaaaaagacacaagucaggacacaaccauuuaucuucacuuucaaaauucaccagaguaaauguaaauuuucaaaagauuacaaagcacuaacucacugaauuaaacauacaaagauuauaugcauaauuauggaaucccaagaaauaguaguuccuuaaaaauaaagacuauauuuucuuuuuuuuuucucuaagugucaaaguaagguagucagucuacuuugucaaauucuuaguacaauacacgauuuucaaguaaaaacaaaaacaaaacaaaacaaaacaaaacaaaaaaacaaaaaacaagaucugggcacagugguuaagagcauuugcugcucuuauggaggauugguguucaguuccagcguucaugcgaccgaucccaaguauccacaugcacucacaaguugcacauaaauauaugcaggcaaaacauucauauacacaaaauaaaucuacaaaaaaugcagaacagguaauucuacaaucagucaaaauagcaacucugaccaaauuccaucacuugagagccagugauggcuaauguacaauacgccuuaacacgaguaugaauaaaccacacacauucugggcuagaaagaugacauaacagauuaaaagcaggugccaccaagccuggugaccugaguucaaugcccaggcacacaugguggcaaaaaacuuacuuuguccucugaauccauacugacacuaugauggcacacaugcuccauucucuucuuaguaaguguaaaaacaaaauuagaaauccuucagguacaugaugucuacaccaaaauacaaaaguuuuaaaaaagagauauaaccaaaagaacucaccagucuuugauuuaaccgcuuguuuucuucuucuuucaacugcaaugucuacaaggaaaaaacagaccugugauuuauccuuggaugauuagcaagguucucaucuucaaaaggaguacaugucuagagagucuauuguagccauucugaucacuaaacauuuuagugagaaugagaacacugaauauauuguccuaaaacuugauucuuuaaaguuuucaaaucuugucauuagcuguguaauuuauaaacacacaauaaaugcugcauuuaucccacccaaauaugcuaguucagagguacaaccugcauuugcaacauauuguuacaacuugucugauccuaagguguuaaucacaaaacaggaagaaaauggcuaauauauuugaguuaaacuggacaguuugucucuggauuauuuucuaaacugguauacaacaaagacacugguaaaaauagucaugaauagaugaaugaaacuagccauugaggguucauucuguuuucaaaguacuuuuaauuaauaaaaauugccaaauacuuaccuuuuuauuuuugguguauuugugugauccauguguguuucuguggguguauguacacaauucuuaugcaacugaagguccuuuccuuauuucaauuaauauuauuaaaaauuucauuacagcaaucuuaauauuuuuauauucuugcucauuuuuuaaaaaaaaucuacuuuuuaaaaaaauaaauguguugaaauucuuacugauauuauauugcuguuuucugagcuguuauuaaguaaaacuuuauaaaauaaguccuuuuugcuuucuggagaugucaaucacugaagaaguuacauagugagaccugauccuacaauuauucagcuacuaggaacacaaaugacaggcccucucaaauuaaucauaaagucuuaauucauaaaugcaagucaaaaugcaaugucuuuaaaacaaaaggcauauaaauguuuuccccagagucaucauauaaagcaaguacuucacagagagucugcucacccguucuaggagcaugauccucugcuucucuucagauaacauguuuucucuaaaagugaaagaaugguuguuuguaaggcuuaagcauuuucacagaauguacacccugaauuguacauucaucaacaagcuuagccgggcaugguggcuaaucccagcauuugggaagcagaggcaggcagaucucugaguuugaggccagucucgacaaguuagauagaguaaagagccuguacuaauuuucaaagguagccuauauuuaucagaacagcugauuaucuguguucagacuuagacacuuguugagacuauaaacaaaacuuuguuuuuacuuagagauaauuuuuauaaaauucauacuuucucagauaguaaacacuguuuuccauaauuaauuuugaaagaaauguauaugagguuauauagcucucucagaauauuacauagauuauacuugguuuuagauccuuguuuacucuagaauaguccaauuucuacuuauauaccaguguucauacauauguauccuucuuagaggcaucaauagcuauacaucugaauaaagauguguuaaaauuuccaauuguacaaacucaucuuuuuguuauuaacaaaaguugggaaaauugauugucauuuuuaauuuuuguuuuggugugguuguguggucuaugcauguguuuguauagauguguacauaugugugaaaaccaggucaacaucaggagucuucguugagacugcuugcuaccuuuuuugaguuuuaucacugacccugagcucauuaauucuucuagaauagcuggagaaugagcucugaagaucugcuugccucuggccccuaccccaccaauaucagguugaagauauuagaugcgugucauacuuuauaccuuauacugggcuuccuauauugauuuguuuuaacugccucuccuguacauagaagacagcuggguuuauuucccuccagaggucacuuuccacucuggauuaauuucugucauuuaugaauuuuaauuaccacauucucuuaacauguuucuacacuccuuuuaaaauuacuuuuauaugggcuaagaacaauuaguaaaguuaaaaauaccuccuuucuuuagaauuuuauaauuuaauggaauagcaguacagacuuuuuuuuuuuaaauuuugagccagccucagcuaaauugcuuugaguucauuguuacccaaagagagcuuuaacuugugauccuccuguuaggauuauagacuaaugacaccagugucaagcacugcugaauauaaaagccucuggugaacugaauggaaaauaagccuacuuacuggacagacaucaugcuugucuccauugcggaauccagucuuccuucaucugccgucuccaugacugaucucucuggcuccccugggagcucaggugcacacgcaccauagagcucuggggcugcagccacaggugcugaggaaagaaaacugcuagugcggaguuuacucacuuccucuucaagcugcuucuucucuucaagcaaacgagcucgguccucagagagcgacucuaucaaaucuaagaccccaaaggcaaagacacauuacauacugaaaacacuuccaaguauuuuuaaaaucauauuaagacaacacuaaccuuuaucccgcucuugcugcugcauuguacuuuuuagcuuaucacuaagaucauuuauuauguuuucuuuccucauuuucucucuuguuaagacuguguuaaaguuggucugaaacaacaguaguaauagucaaucagcugcauacacuuaggagacaaugcuauggaaauaagacuguaauguauucuuuucugagguacauuuauggagucacaugacuaagcaaaugguauguauuccaguaaagguuauuauuuucuuuguuugaacucaguacuugaaaacaaaauuuucuccuuguuuauauugucagaaaggcaaaugccugacauuuucgagaaggaaguuaaaugaucaacagugcuguuaauagagugcuguuggauacaugacguuuucuuugggaaacuuucuuuccucugaaaucuuugaucuuuggcuagcucuugauuaccauacuagcgugugguuaucuuccucuuauuugaacaugugcaaugcccucggggccuccauagcgaugacacuuauuacuccccagguuucacccacugcaugaaguucacauauucaauugccuagagggaucugacagacaacugguaauuuuaacugcauuuuaauuaacaaaggagauuaaauuuguuaaacauuucauuuauacucauuaaacauauccauucauuaaaauauaacaaauacuuacgugagagaaugaucuaacaugauucuuuaauuugcuuagcauuuacccaaaaccuuuuagaaauccauaaauggcaacagacagauuuaacaggaaaaucauuugacaguuucagacaaaaaucuaacaacaaagaacaaaguaaaaguuucaggcuaccaagaauacuugaagggacuuagaauuugaaaaaaaaaaaaaccuuuuuuuuuuuuuuuuuuuuugcagaaaaaagagggaauguuaccaaugcagcuuacuacuagguaauuucuguuuacaaauagaaaauuagcacauguaaaaguacauuaaccauugauuaucuucaugaacuaugcuauuucuguaauaugaauggauuaagauaaucacaauauuuuuuuguauuuuuuuuuuuuuuuuugagacaggguuucucuguguaguucgagcuguccuggaacucacucuguagaccaggcuggccucgaacucagaaauccgccugccucugccuuccaagugcaugugccaccacugccuggcgauaaucacaacuuauaacaagcaaacuggagcuuuaggauaaguuuuuagcuucuggguuuugaauucaguuaauucagauccuaauucauuaugggaaucugaaauugaguguguuuuuauaaaagaccacagugagaauugcagagaaaagcccaauuacaugugaacuaaguugugccaaggacacuguaauucucaaaagcagauuucaggucuaugugaauugauaauucauacauaaagugcuaacuacauuccugugacacuguuacaaguuuucuuuuuagaauaaaugcauuuauuauggaaaagaucaaacauuaagaaggucaaauaagggcuggagagauggcucagugcuuaagagcucugacugcucuuccaaagguccugaguucaaaucccagcaaccauaugguggcucacaaccaucugaaaugagaucugacgcccuuuuuuggugugucugaagacagauacaguguacuuaguuauaauaauaaacaaaucuuaaaaaaaaagaaggucaaauaauggaaacaagaacccucaacugcagagaacuagcucagcuaguuucuaucaagcuuccucagaucucaaacacaccugcugcucagcaaucaaagagguucugacauuuugcauuuccucauucuuucuuuucucuuguucuucaaguuguuccagaaacuuagcuuuuucuucuugaaguuucucuugaaguuccgcaacuaagcuugaagaaucuucucuggcugacucaaaggcaggacuuaaaaauugaaaagacauuuuuaaaaaacaguaagagaaaaucaaauauauaucaaauaucagacuuagguuauuuaccucccagaaacccaagauaaugagaaaugaauuucugcauucaugaagccugucuuucugacugaagguaaacaaugaaguauguaagaucugaaguaacaugacugaugacagcaacaaauguggcauaaucagggcuuccauuugcaccuaugaaaccaaugggcacuucaauauucaucuuuucuaucccuaugaauugaagagaaaacacauaccuggcaacuuuuuagagacaguuugcuauccauaaaauagauuuuggcucaauuugaugccuagugguaaauaauaugaagcuaaaaaugaauucuccauacaaagaaaaucuauguauucuuaaacugauucacuuuagucaaccuuggcagucguguaagcaagggagcagaagagaauggccaagugaagcacaagccagcccgggugaaugacuacacacugguuaguaaucuguaaucuuuuuuauuuccuuauugguuauuuuauuuauuuacauuucaaaugcugucccccuucgaggucucccaaccucaacaccccaucaaaucccuccugcccuuugccucuaugagggugcucccccucuuacccauccacucccgccucgccacucuagcauuccucuacucuggggcaucaagccuccacaugaccaagggccuccaauccacaaaacagaaauagaaggaacacuuucuauuucauucuauaaagccuaagcugauaccuaaaucacaaagacccaacaaagaauuucagaccaauuucacuuaugaauacugaugcaaaaauucucaauaaacaaauggaauccaagaacacaucaaagagaucauuuaccacgaccaaguaggcuuuaacccagggaugcaaggauaguaauccauuaauguaguccacuacauaaacaaacucaaagaaaaaaaaaacccacaugaucauuuuauuagaugcugaaaaaccauuugagaaaauucaauaucccuucauguuaaaaagucuuggaaagaucaggaauucaaggcccauaccuaaccauaauaaaagcaaucuacagcaaaccgguagccaacaucaaacuaaauggagagaaucuugaagcaaucucacuaaaaucagggacuagacaaggcuguccucucucucccuaucuauuugauagaguacuggaaguuuuagcuagagcaaucagacaauaauagguggucaaagggcuacaaauuggaaaggaagaagucaaaauaucacuauuugcagaggauaugauaguauacuuaagugaccccaaaaauuccacuagagaacuccuaaaccugauaaacaacuucagcaaaguagguggauauaaaauuaacugaaacaaaucuuuuauacauaugauaaacaggaugagaaagaaauuagggaaacaccaccauucauagucacaauauaaaauaucuaggugugacucuaagcaagcaaguaaaagaucuguaugacaagaacuucgggucucugaagaaaaauugaagauggauuggcaagauuaacauaguaaaaauggccaccuuaucaaaaccaaucuacagauucaacacaauccccaucaaaauuccaacucaauucuucacaaugauagagcaaaucucaaauucaccuagcauaacaaaaucucaggauagcagaaaaacucuucucaacaauaaaagaacuucugggagaaucaccaucccugaccucaaagcugaacuacagagcaacagugauaaacaaacagguagagcaauggaauugaagacccagaaaaaaaccuacaguuauggucacuugaucauugacaaagcugccaaaaccauccagaggaaaaaagauagcauuuucaacaaaugaugcugguucaacuggaggucgccauguaaucuuagaucuuaauuugcuuucaaccuuucaaagauuccuaaaauauugccuuugagguauugaaccaaaccaggcauggugguucaucccagcacugcaagcuuucuuacccauaucagcggugggguucacauagugucaggagagccuggccgcauggcaaggcucuugucucaaucucaauuagaggcuguuguguugcuauuagaaaauaaacuuucagugugcauuugguugauuuuaaaagacacuggaauguuuuuggaagagaggugcaaauuauaaacaggguuaguuaaaaaguuuaugguuuuuaugcucgugccuaguuuucuauuauaauuaugguggcaaugugcaauuacuacgcuagcaauugagauugugcagaagaucacugggaaccuuuacccauacacccaaacuuacagauaaagcuaacccaaacuucaacacgcagacaaauauuccuccuucauuaagcauuuaagcaacagucugauuuaugagugcaaacagguugugaucuucuauuucauauaacacugcauuaaaagaugaaggguuuguuucuucuuggggcugaaagaaaguugcugugcaaguuuaagcuuuaucaaagcuaguaugcagagcugcauacaggaggugcuaaugagaaacacaaaggacucaggacuguaacaaugaauuaaacuaggcauaggcagggcugagagguaauccuaauuagcuaguacaguuaccaaagaccugccugugcagcuggaggguacauagcaauaauuuagaauauagaagguuagauaaucaaggggaacauuguauggaaugcacugaaguggggcuacaacugccaacagucacacauucaaauuuuacuguaaacaaaaugcuuucugaaugauacuauauagaaggaaaagaacauguagcaaauaagcagcugagguuuguauuacuaagaaugaaacaguaucauucaaauugugugacugagggugugaaugcacaggggcaaauaccuaucaucucuaauuguuuuuuuaagucuuuguaucacuguguuucggaauaaaugcuggacugagaugacaaugguagaggagagaguucuagucaagcaaucuaucacacucagccucucugaaaagugccuaugauccccugaaccaaaaagugauuaguacagguauauugcacaaugaggaaaaggcuaaagggguaaaaaauaaagccuaagaccucuugagauggaagaguuaacuaacacaguaaugaaacaguaacaguugcuauaauaaccaacuuuuguucaguuuucuuuuucuaaacuaccauuucuuggcuugggggaagcaaaaaguugugaaauggcaaaggaguaguaguggugauauaaaggggcacauugaaauucaaacuuaaaugcauacuggcuaagguuaagugguucuguuuaagugcaaccauacugagcuuaguuauaacuaguuauaacguagugguaaaguaaaacacauguagaucagggcauuccacacaacuuuuaugaaaggaccgaugacuugggcuuuggggcacgucucagaugccuuuguaaauacugaggagcugcuguuccguacagcacaggagucuucucuuucaaagggaugcgguuccauucucuaaacucagauucuucacaagauucugccacagaauucagcugcuuccagaccuaccgugacuuucaaaccagguauccaaguacguuaaaaauguaaccaaaggagguuuacauucaccaauuacucaaauugauuuuggcaaaaacauggcaagauaagauggagaaugcacccaaugugguagacauaagcuauuaguauaggaacaagaacccaaaucuuguuaugguacagacaauaaaaguguuaaccuaaugaucucuguucuagucaacuuuucaaaagcagucacugaaaacaaauacaagaaugugcauggcacauugcaauaaagcuguuaucagaagcccccacaccugcaggaucaauaucucaagucauacaagggaugccuggcagcaaagauauuaugaacucuuuauauaaugucucuauacacaaauaucuaaggcaaagauuaacauacaaaguaggcaaagaaaguaacuaauauagucuuguaauaaaauauaaaugugcccucucaagacauccuaucagaguaaacucacucuacaagucaggagagguaggaauaucgaccuggugagaugaaauaagguaaaugguaguaaguagccacuguguuaaaaagcaagggcacuuuccuuccacauuagaagagggaucaugugccaugaugcuccugaaauuaaggaaaagauggggaagcugggggugcauguauguaacaggagagacaauacacauguuauaaagauggacagauuccuagauuccagcuuguggauccaugccauaaaucaaucugcaaauuuuauuaauaucucuuuagcaggcauuaaauguguggcuuugaaucuugauuagaagcugaccuugcugcacagaugccacagcaguuuacuauuaaugacaaaggguuuuuauacuucauugucuuugaagacuuguguaauuaaugcuccccuccuccaggucgaguugccagagaugcuugucuuacugaucuaacacacuuaauggcgauggcuggcuaaaccugacuuguagggugaauuuacaauuauaagaucucuugauugggcaagacauaugcaggccuuguacaaaggcuauggauauuuuggguuagucagcagugucuguauucccucugaaagggaaaagguauugcuugcaagacuuuuucuuuuuuuuucucaaaaaaaaaggucuauuauuauauaaguagacucuagcugucuucagacacaccagaagaguguuuagagugugucagaucucaauacagaugguugugagccaccaugugguugcugggauuugaacugaggaccuucggaagagcagucagugcucuuacccacugagcucucuucuccaggccccugggcaagccucugaaucuuggaaguaacacaucccugccuaaguauguuguuuugggccauuuacaaaaaacauuuaccaagacugucuacuuguucagggaacaaagcaaaauccacucuuuuauaagguuuagauuagcauauaagcuucuuuaacccuuagaccacauacccgaguagauaucugaaguguggcuaacagaaaugaacaauacauagaaaucugcagcaugccauaggaaaaucauaauucagacccuauagauagggaaucaguauuuuccuuuugccaaguuuaucaucaagugcucuacuuggucccuguauagacuaaaaaccuuacuacaauaaucuccuaaauuacuaugagagaccauggcuguuuugcauagaguacugucuauauuaguuacuuuucuguugcugugauaaagcacccugagcaaggcaacuuaaggaauacuuuagauucauaguauaagagggccauuuugcguggaugugguaaaguccaaaugucguagagcucugagccuaagaccauuuugcgacaauucuuccaguuaugucacaauagcagaacucaaaauugguacaaauauuauuccaaagaaaagcaacagaaauuuugccuaugcuuacuuagaaguaauuuacuucuacaggaagcaauucuugaggguaagugagacugccccguggguagaguacuugccacauaagcaugcaugcugacuuagguaggaaucccccagaaacuauauaaaaccaagugugguagcauaccucuguaauccaagcauacuacugguaacaugagaaguagaaauauaagaauccuuggaggcuugcaggauaacuauucugaguauuuaguagugaauguaaauaaaagaggcuugugucaaacauaucuacacaugugauaucuacacauggcauaauacauguaugacccuuuccccuagcauuuuuaaaauuauguuauuaauuggccauugagcccacugaaccaguaaguaaaaauguuaucugcuauauagcugguuuaauuucauacugucuaguagaauaaggacagaaaaauuauuaauacaucacaguuuuucugggaugacucuagguacacuaccaugucgaguaauagaggggacaaaaccaaaaaaccuaggauagcaaaaacucuucugaaggauaaaagaaccucuaguggaaucaccaugccugaccuaaagcuuuacuacagagcaauugugauacaaacugcaugguacugguauagcgacagacaaguagaccaauggaauagaauugaagacccagaaaugaacccacacaccuauggucacuugaucuuugacaagggagcuaaaaccauccaguggaaagaagacugaguuuucaacaaauagugcuggcacaacugucgguuaucauguagaagaauucaaauugauccauuccuaucuccuuguacuaaggucauaucuaaguggauuaaggaacuccacauaaaaccagagacacugaaacuuauagaggagaaaguggggaaaagccuugaagauaugggcacaggggaaaaauuccugaacagaacagcaauggcuucugcuguaagaucgagaaucgauaagugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaaggugggcuucagaaaaucaaauaaccccauuaaaaaauggggcucagaacugaagaauucucaccugaggaauaccgaauggcagagaagcaccugaaaaaauguucaacauccuuaaucaucagggaaaugcaaaucaaaacaaccccgagauuccaccucacaccagucagaauggcuaagauuaaaaauucaggugacagcagaugcuggcguggauguggagaaagaggaacacuccuccauuguuggugggauugcaggcuuguacaaccacucuggaaaucagucuggcgguuccucagaaaauuggacauaguacuaccggaggauccagcaauaccucuccugggcauauauccagaagaugccccaacugguaagaagaacacaugcuccacuauguucauagcagccuuauuuauaauagccagaagcuggaaagaacccagaugccccucaacagaggaauggauacagaaaaugugguacaucuacacaauggaguacuacucagcuauuaaaaagaaugaauuuaugaaauuccuagccaaauggauggaccuggagggcaucauccugagugagguaacacauucacaaagaaauucacacaauauguacucacugauaaguggauauuagccccaaaccuaggauacccaagauauaagauacaauuugcuaaacacaugaaacucaagaagaaugaagacugaaguguggacacuaugccccuucuuagaauugggaacaaaacacccauggaaggaguuacagagacaaaguuuggagcugagacgaaaggauggaccauguagagacugccauauccagggauccaccccauaaucagcuuccaaacgcugacaccauugcauacacuagcaagauuuuaucgaaaggacccagauauagcugucucuugugagacuaugcuggggccuagcaaacacagaaguggaugcucacagucagcuaauggauggaucacagggcucccaauggaggagcuagagaaagcacccaaggagcuaaaggaaucugcaacccuauagguggaacaacaauaugaacuaaccaguaccccggagcucuugucucuagcugcauauguaucaaaagauggccuagucggccaucacuggaaagagaggcccauuggacuugcaaacuuuauaugccccaguacaggggaacgccaggaccaaaaagggggaguggguggguuggggagugggggucgguggguaugggggacuuuugguauagcauuggaaauguaaaugagcuaaauaccuaauaaaaaauggaaaaaaaaagaaaacuaaugaaaaacuauaccaccuaagaguagaauuauagcucagugguguacuugccuagcauguacaaaacucuggguuuagauacuuuuuaaaaaguuaaauuaaaaacuuuuuggcaccggacaugguggcgcaugccuuugaucccagcacuugggaggcagaggcaggcagauuucugaguucgaggccagccuggucuacaaagugaguuccaggacagcuagggcuacacagagaaacccugucucgaaaaaccaaaacaaacaaaaaaacaaaacaaaaaaaaaaaaaaaccaaaacaaaaccauuuuggcaacuguaauauagaaguaaaugguagucuccuuacaaagauuugggucgugccugucaggaaaaguaaccaccacacaaagaaccggcuaagauaaugaauggaguagauaauagaaggaagcugcaugcauguauauauauauauauauauauauauauauauauauauauauuuacccuugcaacugauauauauauauauaucucaguaucaguugcaagaguaauuacagaaauaaaggcuaguaauuaaaucuacccacccuaaggcauuuauuuuuuaauggcuuuuuguaaguuuucuuugaugcuucuuaagguuuuauaauuccuucuucuacuuuuacaguuuaugaaguaagguaaaacaacgguaguuaugcucuauuuucuuuucagcuuuuaaccuacagaauggcagugauuugaacaaaacaaaaaggggacaaauguucuaucaaggaaggauacaauaacagcaauuugagucuuaccuuugaaaauagagaggguaaggaaaucucaggcauaugugggacaaaaguugcaucaugugaaacaaaugauauuauuugaaguguuuuuauuuauuuauuuuaauaugaauaaagaaauauugacaucugacuacuaaguuuaaaacaggguacaaugcuagacugugcucccccacaacacugcuaccaacucuuuugcaaucucauacauacuucaaggcagagauucuacauuuccccaaaucccuugaagagcuucaaauaugccaauaaaagaacaccuucaagguuugggagacaagagagcccccguccuauucuccagaagugguuguagccggucgucucacaaaaaauuccucacagguaacugagaacuacucauuuuauguuguagauuaagccaguauuugcugcuuuuaaaagguucuugaguacuguggcagcuuuccagugagccauggagaaucaacuuugguggguacuucagaggaugucuugauauuucacuuagagcuugacaaagucucacuaaacauuagucagucucuuuuaggcccuuuagacuccaaccuugacaaguauucuugucaaagcuuguauugcucagcuguagcaugacguuuguaagucaguuuggagaaaauuucccacuccuacaaucugaucucucucaauauuggaucaaauucuucaucuccuacucuugguuucuuaucacucuaccuugcuaugaacaagaaucuuggaaggucaguuggaaaggcuaaaauuuccuuucauuugauugcuuugucuuuauaaggcucgaucuacugauccugauccuguuaccuagaauaaacuugaacuaguccaugcuguacuaagaacuaaacucaguuuuauagcauagccacugcaauaauuccuuaauauauucggcuauuaccaguuuaccauccaguucuuuaaugagcuuuuucagucauuacagcguuuuuacauuuugucuucaaguucuauuuccacaaggcucucacuucacacaaauacaaaaagagcuauuuuaaaaucagcauuacaacacaggcagaaacauacauacauacauacacacacacauauaugcacgcacaauacaauauucacgcugagaacuaaugguaggacuaaacaauagauuaccacacuguguaaaauccuaccgccaaaugaaaauaccaaacccaucugugguaacaaaacaacaacaacaacaacaaaaucagacauuacaaaaauuaaguaaaaaacacacaagcaaaaaguauggaauuuaaaaacauuaguuuuccaaccagagaaaacaaaaaugaaauuguaguaucaggaaagcaauagugaggaccauucuguauauucccaucgacauaacucuaaaacaauaacgaaaagaaaagcaguuucaacugaaaaauuuaguaaagguacaaaucacguguuuuaaaacauuuuucugaaacugauuuguuguuuucuucuuaaggcaaagucuagccuaaaacuaguucacucuguagcccaggauuggcuccaaagcaauccuccugccucagccucccaaguacuuggauuacagguauaagcuaucacaccuagcuccagcaauaauaaauuugcauaauguuauuuucauguuuguaauaaauauuauucuaauuuuuuucacuuuuugaaaauaucccagaaaagcaaccaaucaagguauuauaauuaacacauacgucugaaauaguaaauuacauucuaaacuuaauacuuacguuuuggcuauuugauucucaagauguuuaacuuuuucuaauaacucuuucucaacaaguucucucuccaccuuaaauucaucuagugcaguuugaacagcuuuguuuuuuucaaaauuaagcuccugaauuaaguguucuuugucuugcucgugguucuugaccagucucuccuugucuuucucaagguucuggauaagugcuucauacuucucuucuuguuggguuauuuuuucaucuuucuguuuuucaagagcacucaauucugaguucaaucuagucugcaauucaacuauuuguucuuucaguuuuuuuucuauuucauaugcuuggcgaugcaaagauguaacauugucuaauucagccuuaaguauauuagauucuucuucaugucuacugauuaacucugaaaugcacugaucuuuuucaauugucauuaaagcucuuaacucugacaaacccaccugguaacucucauuauuaucaugaauuuuuugguuuaguuuacuuauuucuguucuuaaguuuucggucucuuguucaaguaaagacuucagcauuuccuucugcuguguucugcucucuuccaacaagaucuuuaucucaucuguuucugcuuccuuuagugcaaguucaaccucuaacuuacaucucaugucugacaagucagaaacuuugaguuucaacuccugcagcuguugcucuuuuuccugaauaguugaggcaugagauucuagcaucuggucaauucuuugcugauuuucuuuuuuuaauuucuccaaagacauauuguggucugucauaacuuucucaaacuccugugugugccugaugugcaguguguccucuaauuccuucaggugauuuuguucuaagcacugaaauucagcucucaaugacucgauuuuuucaucaugcagcuuuuucaggucuucuaaugccaucucucgugacugcuucaguucuuuaauuucacaauguugaguaugcauuaucuuuuccaucucuaacaacuucugauccuuuucuugcugcacacagacaauagcauccuuuucauguuuaaucgaagugaauucauugucuuuauuuuguaaagccucuucaagggauacuaaauuuucuuucaauuuuaaaauuuuauuuacauuuucuucacugucuuuuacuagagcaucaaguuuacauucauacucaauuuuuaaagauuggaguucuugcugaugcuuuuccuuuaguguuauuucuagagaacauuuuacuuuuucaauaauauuucuuauuucuacagcuguacauuuuaaauaauuugcuaagucacacuguucuuuuuguacaaauguucugaaauggcacagaucguccuugaugguuuguauacugcugugagagucuugugcagcagcucugcauuucuccagcuggacauguagagcagcccgauccccaaagcccucguuuccacguguacuugugucuugcauacgccuacuaucuauugcauugaugacugaagaguaaagugacuccaccaucauuucuggacuuuguggaucacuuauaggguuuggagacgauaaauuuucuucuaucacaaacucauucacagcagacauaaagucagacucagggcuuucugcuaaugaauccaagucuauagaagcuuggugaacagguuguucuguguuuggaugggagaugguuucgaaaucaaauguaugagcaucgauacuaucuggagauaauucuucuaagggacacacugccggacauaagguguccugaacaguuaguggaggaggaguuuuuggugagguagugguuguaaugccuguuguacuuucuauucuuggagaagcagcugacuguggggaugccugacuuguggauaccugaaacacagaguuaaagucuuaaaaucuguaacagugcaaacaucuuauauucauaaaaauauuuaaaacaacuaauuugccuuuuguucauuuaggagaucuguaauagucugugacauuucauccaaacuuugugcugcuuuuaccaaauuauguagggcaaguacaugcugguguagagguucaaagucacaaaguaaggggacccugaaaaagaaugacagauuuuuaguuucuaacaaacugcaaacauauuguuucauucucuuaaaaacaaugaacagcauagucaguccuucuuaagcauggagaagcaaagugaaagaagcuuguacacucauuaaaaaacaaaacaacaacaacaacaaaaacaguauaacaagcuagggaagccauuagaaagcaaaucauaacuuucaucauuuuaagaucaauucaauucaaaaguauucguggcuguuaccugaggaauggcugcacuucugaaggacaaaaugauugaagaaacuguaaaucuuuuaaugauauaucuggaaguucacagucaaauuuucgaggcuucugagucuauaaauggaaaaaaaaguuuaccaauacaaaggaugaauuuaugauuucuugagauaauuaaauccacuauaagagacugccaaaaacauaucaaaugaucucuucacaauuaagagaggauacuaauuaauagacuuaagcaaaagaccaugcaaauaugccagggcacacuagucuggaaacugagcuucuuggugguaacuaauaaacuuguucuuuccuuuuugucuuagcaccauuugacagaaauucuaguauuccaucaacacuaaauacauuauucuccaauuuucccuugacuugcagaauggucacaaaaugccucuauaguaaacuuuguuggugcacuuuagggagaauuuuuuuucuuugcuccucucauuuugaagaauucaaacuuuaauucuaaaugaaaaaugaauuguaaagaccuacuaauuauuuuuuuauaauacuggcaagaauugguaccguuuaaaaguaacucugauuaucuuaaucacuagucaagaagauuuaaauaugucaggauaaucuucauaaaauagguucauugauaaaugaguauguaaauucuaguuacaacugugcauucuuaagaaauacuaccaugcagaaaccuguuugagauugacaacuuaauaugguggaaggacauaccauuuccuaaauuucuuugaucaugaaacauguuuuuuccauuuaaaaaaauuaauaaacccagcuagcugccuuuauaaucuaucagauggcauuuucauguuuaauuuuaaggaagauuuacugaagacucaagcuacucugacucaaauaaugaagcggcauggagacaaugggaugaaacagcaacagacagaaggaagacuacaaaaagauaaaaugaaaaacagaaaaaaauauaaaacugccacugaugaugccagccuacucugagcucuuggaugaguagugguaaagaacucacaccuuugcugggugugguggcgcacgccuuuaaucccagcacucgggaggcagaggcagguggauuucugaguucgaggccagccuggucuacaaagugaguuccaggacagccagacuauacugagaaacccugucuuaaaaaaaaaaaaaacccaaaaaacaaaacaaaacaaaaaaaccucacaccuuggcaguaagcaaaagcucucuaacugaacuuaagacuugcucaacagaaaagagaccaugucaguacugcaaaccuaacuaacuauucagcacuagugaaaucaagauuacuguaggagaauauacaaccacuaacuuaaucagcuuaauccauaacaaucuuugaauaucuguccuuauacccacguagacguacacauuuuuacccuccaccaaggaaucuucucuuuugcaacagagacuacaaaaaaugaaaaccaaucaauaugaagaguugaggaagccaguaccaaacgauacaucuacaacacucaaggaagcacuagagucaaggaacacugaaaaggggacagaaagauuguucagagacuuugucuucuaguaacaucagaagcuacaaccacaaagucucaccaacaugaccaccugaacaugagcuaaacaaggaggacacuaacgagcacauuaagcugcaugggaaagagcccacaaagccucaucccuacacaaagaacuacagacaacugaguagcuggaagcaagagagguuucccagggugagcacacuaaucauugcccagugccaaauggucaacucuguaaauauacauacauguagcauuauacagauucagacuauaucuaggaauauuuaaauauacacauauauacauauaaaccguugguaaauggauuuuuaaaagaccaugaauuugaaggugaucaggaaguauauaugggagauuuuagauuuuaucacucacaacuuaaucuguuucugauaaaugcuucuaacccugaaaaaauaagguuuuauaauauagaaauuuaguccuuaaaaaaaaaaaaaagaaauuuaguccuaguuagaaaaaaaaaaauacauacacaaaaugaggaaggccaggaguccaguccuuuaaacagacgauuucuuaaaaaggacuucccuguacaaagaaaccaggaacaugguuauuuuagaaauuaccuaaaggccaaaaaauaaagaaggaaaaggguaaauaaauuaauacuuacuaaauaauuucccaaaggauucccuuuuugacuuuucagcuucauauaguuguuuuccgucuuugacuaaagcaccagcccacuuagaagaggaacauuuauguuaauaaaauauaccaauuaugaauguuaauauauaauuaaauaauuagaauugcuuaccucucuguaguguuuaaugaacauuuuucuucuuacaaccucaacaacagcuaggcaauacaucugaggaacuguacuaagagccucaacaauucugacucuuucuaacagcucuauuacaaggcggagcagugccugcaguuuuucuccaucuugaucagcaugaagcaucacaaaacaacaccaccuauagaaaaagauucauuguuuuccacauuugcuaaaagucauuuguagguaagcuaugaagaucaaggcucuauaaagucuaacccuagaguucaucaauaugcauuucaaugaaauuacuguuauuacugggaagauuaaaaacacaaaaacugaagucugacggaaucucuuacuucagucugacguggagauuguuugcuagcucuuguuuggcaguggugcacuucuguuuaauauccaacaguuuucugugguuuugcaacauaaucauuaguugauuugcaugacucagacacagaucagguaacacagaugcauccuucaaguuuucagcucucaucugauuagcuaaaaaucccuuugggaaggaaaaugacauaagcucucaagagaaaaacugacaaggaaccacuuuucauuuagauuccuaaaauuccuaucucccauuaaaggcgggugggggguaaaaagaaauggcuauuccaaggacagaaagccaacuuacaacaauauguagcuugaaagcuuuacuaaaauaauuaacacaaacacaagccaaaagcaaacaaauucuuuaaaaugucauggaaacacaaaauuuaagcuaucuuaaacuuuuauaauauuugugguuuuuuauuaaaaauaagcacauaaaacaucaacaucacaaagaauaaaaaacauauaacuaccaagcagagaccacagcacuuaaguaggaagacagccugggcuaaacaggaaaacuccaguccaucaagugugacaagcgggaggaagaaggggagggaaugaggagagggacacuagcacaaaaugaaauucagcugcuugccucugggagcuagaaaucaaguggucauaaacacgauaccugagcaagcucuuucuguucauuuaccagccggcuacagcuagcaaucaucugguccaaggcauacagccgaucuucaagcccuuuaauggcuuucauauucugauuaucaaguuuggcaauaguuugauggcauucuaacauaaaugguugaauaaucuuugggucaagcuaaaugagaaggaaacauauaugaguaaaaucuucuggaaauaguuuuaacuauauuucacaguaacuagauacagacuaagauacaaaggauauagaaaaugauacagaaaaaugcacaggaaauaaaguuauacuagcaaaggaagauuaauaggaugaaccccauccuaaacaacugguguuaaacaaaucacaauauaaaagucaagaccauaauaacuucaguaaucauaacucucaaccaauuuaaacaauucucaguaucccuaagaauguuauuuucaaagucaucaaggacauauaaaguggagcuaaugacaaacccacucuuugguaguaacucaucaacucaucuucucucaaagcaucuuccauagccagguauguuuggcauauguuuguaauucagaacucaagaagcaagguagaauuaaaccaaaaguucaggccagcauaggcaacucagcaagaucccauucuuuaaaaaggcaagguuuuuccuuaacaaaugggacagaaagcuuaaacuuaaucucuauugaaaggaaaugguuuggucaaugagaugucuuaauaguuaauuuuuccuguccucugacuuuaguucuacguguuuguaguguaaaauuuaacuacaugaugcgcuugguggugccuguuuucuaguaaaacuggucacagauauuaaaugaccuuguuucauuaaaggcuccuggaacugugguauacucuacuaucuccucaccuaaaccuagagccuugguggguaaaagggcaugaguaaaugccuucucuccuuucacaaugaguccuggggguuaaaaugaaguuucaggcuuugaccuacugggccaccuugucagauccuaagcucaaccuucaauggaggaaaacuaguucagccuuccugccucagcagggguucugaauaccugccaauagcagcauguaggcauccucuaaguuauucuucaacuguguucauuuuguauaugugcaaacacauguaaauacauacacaugugugugggcacgauugugagcucucagaagccaugacauauacauacaggucaaaggacaacuuaugagaaucaauucccuccugcagccaucuaggacucaaacaucauacucagaucuccuuuacccauggaaucaucuugcugaucggggucuuuuugacugucguucugauguguaaaggaggaauuugacuaggcccuuuauauaagguuagggaaggauaaaacaggaugauaauucaagugaugugaacaauggucaggaagagaaaaacaauggauuuaucuuuaacauaauuccuaaaaaaaaccuuagugucauaaaaauuuauuuaauauuuuguggauaauuuuauuccauuuucccaaagacuauaacaguugaaaauauuaaaaucaucauagaaguauuauugguaauuuuucucaaguguuugaaauuagcauuuucuuaauguuuaacuucaaagaguuuuugcuauuuuaaauuuuuuaaaauauacucacugauaaaauaauuuuucuccuagaaacagugauaaucuuuuuuaaguaaacugauuguuagacaauguacacaaauauauaauguguuuuaaauagucucccacuaugucagguuaucauguaagggcuuuugaauauaguucucaaugauucauuuuuaauauuuuaugauauuuuacuaugcuuagccccaagagaauauuuuguauguuuugaaacaauucaguauugaacauuagauauagaauccucgguuauggauaauauuaaauauucauuaaugauauuuuuaggguaugaaaggauaugaauuaagaugaacaauuuuuuauguauuauuugacucucaaaauaaauauguuugauguauaaaauacauuuaaauaauaaaaaaauuuuuaaaaaaaagacacaauucuauugcagaagacucaaguuugguuccuagcaccgcaucaagaugcacaaagccauguguauaucuaucucuauagaugucaugccuucuucuggucucugaaggcacccacagaaacacauacauauauaugaauaaaaauaaaaaaauaagggcaugggggacuuuugggauagcauuugaaauguaaaugaagaaaauaccgaauuaaaaaauaaaugaauaaauaaaagaaauacucaaaaaauaaauccucuuugauuugugaaauggaagucuacaaaaaaaucaauaauuauagaauauuauguaaaaauaaaaacuggguugcaagcaaaacuacuaugaaauuaucuagcaguccaaacaaauauaaaaauuagggauucagauugauaagaacuuuauaaagcauaaaccagaagugucugguauggaauucagaaauuacaaacauuaaauuccaaaaaaaauuaugucccaacucauuuccugaggcaguuaugggaguucacacuauacauuauaaauauacacuaugaaacaacagaaauuggacuaaucuaugaaacuaagggcucuaaauagaauaaaaaaugcaaacaaaaauaaaucuaagcaccuuuuguuuauuauacugcuggcaaucaaaacuaccucuaugagauaaacagcacucacucaucacaaaacgucucgugguggaucugguagcaaguccuacauagucccagguacucaaaaggcuggggcagaaggauuguaaaaagacuuaacuggacuacacaguugaguucaaagucagcccgggaaaguuaacucugcuuauauaguucagaagauacaacaguaguagaguacuucccuagcaagcaacagguuuuaugcaaaacuauucugaauuccaggacaguuguuauuauaaaaauggcacugguuacugugaccacuguuauaugguuaaucaugcauucauaaauggauguuucagauacuaagauauuaguauuuaagcagaaauacuaggcucacuuucauucauuugacaauuuuugcuggggcaagugccuuaaacaauuaaauuaucaucuaucagauguuaucaaggacaaagaugcugaacauauuaggaagccaaggucuuaaaguucucauuuuacuuauaacuuaaauaagguaggcacaugcuguuccagguauccuagaccaaauauucagguguuuuguuuuuucaagauugaaugaaucaaggacuaaagcuauuuucaaacuaaguaccccuuuaagcaaaguccuucguauucugacaacugaaaucuucaaaacauuaguauuuuugugucacuaaagcaauuuucuuucugaugcaaaugcuuuuuaucaauuuacagagcaaauaugaagagacauuuauccuggguuuacuucuagaguuguaacugaaagcccaaugucuugcugaugaauucuuaaggagaugaauaguuuaagauucucauguagggaggugcuuacugcaaaaagaccacuuuccaaauaauggaaauguucaaaaauauuuuuuaauuuguagugauuuauucuugaaccacucaaaaucuauuaaugcaaacccuuugaacugcacuaaaaauuuacgcucaaauaaucuucccaaauuuauaaucaacucaaaagcaugguuacagauaauuugaucaagucuccaaacuccaacgcagguucugcuguuaaucauccucacgcaugcgcacgcacgcacacacaacuuacccugcucauagaaucaaagcacuuccugaccagagauuccacaucauugggucuaucuugaacauuuauccagucuaacaaagaaacauuaaaaaaaggcagaucacugucuuuagcauccacugaagcuucuucuugcuggacaguacuuugacaagauucccuaaguucuuugccacguucaguaccggugggaucuggagcuacaugcuccauugacuugugaaaugagguuaccaaggauguguucguuguucuaggcauaucaggagagagcaccaguucaguagaucuuuucaucucagcuuucucugagccuucauguucauucaaagaauccggucuucccaaacauucccuguaacuaugucugguuaggcacuccaauaguggaaucuuggccauuacugaaacagcaguuccuaaacuuaagauacaaaacaugagucaguaaaacgaguguguucuacuaucauccaacgaaaucacacuguacuucaaaauaccagccuuaccacugcuccaugucuuuauucacauauaagcuccuuuauuagccaguuaaaaguacagcuuaguagagaggcgaucacuaacguuaaaauacaaauuuaaagcaaagcuagcuagauuauacuaaagaaguagacacugacuuucaaauuuguuucaaauacaaccuauuaauuaaaaaacauuaaaauuuaugaagacugaccauagcagucacucacacuguaauuggcuuuaucacaaucaaauauauuuaauauauuaaaaauauaggauuaaauuaagaauuuuagccuuaggauaacucuuauacuaacuauaucaaaaauggacuaagagaguuuagcugcuaaagaauauggaggaaaauauguaaucuuuaagauaucauaaaacugaauguuaauagauucagguccuuaaaguaaauugauaugaucagaaggacucccucuccaagauagguagugggaaagguuauuguaauaaacaauuaaaaugauucuuuuacuauuacuuauuauucauucucuuuccuaccaauauuucuucugaagucuagaacuaaggagcaaaacuugucuuaaaauagucaaucuacaauauuaaaacaacugaggaaaaggagucauggggguuggggugcaaaauugcuuguaugaaacaggaaagggcgacgguugaguucccaagcaucacuuaaaaaaaaaaaaagaaaagaaaaauuaaggaaaggaaagaauacacaugcuaucaccucuaagguaaauucaaagaagacagaaaaacaaacaaacaaaacaaaaacccccccaaaaacccaaaaaccuaaauacaaaaucugaaaaguacauauacuagcauuuauauagcauuuacuagauauucuaagguugaaguauuguucacuugcauauuaauuauacauuauuuuagcacuuuccuuccaaaacucaacgacacuugauuuaaauguaaaggaccuaaguuuuccaugucagugaguucuggucuucccugucccccauuuauauuuucucaauugggcaaaagcuaggaagagauucuuagauagauugaacaacagaaaccaagaacacaauuaaagugugacuguaaagaugggucagagagauggcugaguggguaacaggaagagccugaaucccacagccggaggagagaaccaacaucaaaaaguugcccucuuacuuuuauguaagcacucugaaacacacaucccuguacuuacacaaaaaauaauaauaaugauaauuauaauaaaaaugcuuuaagagacuaaaaauacuuauuuaaauaaacacagccuccaaccaauauccagggacuagaaaaguauugauaaaggcauuuuaaacauucacauaaugauaaacauacugaguaaguuuuaacuugaugucuucuauggauugaagauaaucagaauaaauacuuucaaacuugaaaagaaguuuuugguaugaauuugaacaguccuccagauuggccaugauugcagcccagccuuggugcugaagauguucaucauggacaagcccuucacagaaagagcagagcuucuuggcaacgucauacauuuccuguuugagaaugaaaaaggaaaauaauaaaagaaagcaaugguccguauguauguuugaaaugcaaacauacauuuucacaaacauuuuugucaaacaugaaagauugaaaauaccuuaucaucuuccaauuguaggaguccuuaaauauaaaaaaccuguguguuuguguguaucuauguauguguuaugcuauguauauguuauacauauaugaacuuggaagcguuaaaaagaugcuggguauccacuuuccauuugauuccuucaaaucaaggucugugccuggagcugggcugguggccagcuagccucagugacacuucugucuacuggcugcccaucccugggauuaggauuagcacacgccaucauucccaguuuuuuguacaggcguugaggaggcaaugcuucaugcuucaccagcaaggucuuucuaacugaccacucaagaaucaaaugauuucuaagaacagaugauuggaauucaauuauaaagaaugaaguaucaagugcaaacuaaaaagcaauaugugggagauuucugaaaaaaaaaaaaaaaaagaaguucccugucacaaaaaauucugcuccugccgaaaacaaauaacacucuguuaaagugaccacuuucacaaguucagaccaaauacgaagguacaaagagaauauggacauaaauuaagaaagaaguuuuccaaaugcagggaaguaauuaaguggaaaaaauagcaaauguaaaaauauaacuacuuaauaacaaauaaucuagaggggaaaagagaaagagaagaaagggcuacaaaucucacaaaaugcuaccaaaaaucaaucagauuuuacugugggccaccaugguggugcacacguguaauacuaacauuaaauaggcaaaaguaugaggaacacacguaguuagacacauccaauaugugucagggaaacugacagaaagagagcaaguuacuauuauaaaacauagcacugcauauaggauauguauauuaauaugucaguggaggagugugccagggggccagcccccacaaaaacacaauauagguuaucacugcucuuaguuguccaugagaauuugugguaggacucuaggacccuacagcugaagacagcucacacauucauccaaaaaaaaaaaaagaagaaaagauaguagugaccaggaagcuucucuguuggcugacucucauaguacuagaaguugcuauucaagcaacuguagagggguaggagacagcaacauucuuacccagcuggaaacucugugaacugcuaugauuacuggguaagaauacugaucuuacaacaucaaugaaaauuuagaugcaaaauguuacugggguaauuaaucacuuucuaauuuaaggcucguuucacagaagaaaacacaugcaugccugugaagaaugugaaacaugccugugaaacgcuccccccccuuccccaugccuggugaugaguccauggcuggaagcuuacaaggccuaguugaaccuacuauuacugggcaaaaugaagaaagaaaaguaucagugaacaaacagacucagggaucaaacaugacauuugcugaaucaauacauauaauaaauauaaauauaauacauguaauagauaugauaaaaauuagaaaugaggacauaaaacagcacaaaauaaagauauucagaagauaguugugugguggugcauuuuuuuaaucccacuugguggacagaagcagggugaucucugaguucagggccagcuuagucuacacugggaguuccaggacaaacagggcuaaacagagaaacccuguauuaugaaacacacacacacacacacacacacacacacacacacacacacacacacacccaccccuacaaaaaccaacaacaucaaaaaauauucagaaaauaucuauagucacaggaguggagaaauuuaucucaguucuacaaguaagaaaacaucugaccaauuuccuuuaacaaagguaaguuaccuaagcugcuaagguaucuaaaaauuaccuuuaaaagugauaaaaaauuuccccuacauaaaagugcacaagaccccaaagaaugaagagguuucuaaaaugucuuuauucuuguuuuaagaauagcaaugccugguauuuugaguuucaauacuaauguuccuuacucucauuucaacuauuuacuuuuacuuuuauuuuauaugcauugguguuuugucugcauguauacauguucaagggugucagaucuuaagaguuacagauaguugugaguugccaugugggugcugggaacugggaacugagcccggguccucgggaagaucaaccagugcucucaaccacugagccaucucucggacccaacuauauaauuuuuuaauauguuuuuaucuacaauaaagaaaucaucucagcucacgcauaacccccuccuuuuuuuuuucaagacagggucuguguguguguguguguguguguguguguaugugugcgcguguguguguaugugugagugugugugugugucugugugugugugugugucugugugugugcgugcgugugugugugugagagugugugugugcgugcgugcgugcgugugugugugugugugugugugugugugugcguguguguguguguguagccacggcuguuuuggaacuuaguacgugcuuuguaauccaggcuggccucauagaaaucuaccuuucucugccuucuuucugaguauugagauuuaaaguaugcauugcgccacuaccacccagcccacaguaugauccuuaauacuuaaguauaaucccucugaauuuuuuuccuugaugccaccaccaagagggucucaggcugacucaagaacuuccaagucuacaugaugaugacaacagcaacaaaauggacccagcaauccuggguuaagucacuuccuacuaccagccaaucacaaagugagauugcuuguggacaagaagaaaagcaucuuuaaaguccaugacuaauaaauauauggacaaauaucaaaagguuaaccuacuccaagaaaaccaaauaaaagucuguggcucccuauuagguaggcugaacagcagcuuccucagcauacauccccaucugcuuccaauaaaccaaugugccacucugacugcaaugugcaaauugugcucgcccguuugccugccacaagaaucuuguccagcauuauauaacacaucuaaacgcacuccuacgcuuuagcgaccaacacugaaacugugcugaacguuacccuucuaaaggaaaacauaaacugggcuacuucacagcuucuaagaaacauguuucuuccuuaucuaaaacuuaguauauuaauuauaaaauauaaagauuuuuacuaguuuuaauuguauauguguguacaccaaauaaguacagguucuauggaaguuugagacaucagauacacuagagcuggaauuucagacaguugugcaucacccaaaauggauccuggaauccaaacucagguccucuggaagaacagugcauguucuuaaacuaugaucaaccuauagccacaacccucaacccgacucuuaaguagaggacgauguuauaaagaggccuaugagacagguauuagggaaaggcacacacuaccaaguagacaaguuaauuccuaaaacuauacugagaaccuacugccacucguuguucuuugacaagugcacacauaauuaaaaaaaaaaacaaaaaaacuguaaggggaguauuuuucauguuaucuaugcuuaauuuugacuucucugcuaucuagauuggaaugcuuuuagaagcaauuaguuaaaggaauuguuuauaucauaccacugcaagcuguguccuugaagcaacaguguggaaaacugcaggcaucauaagagacucuucaacuuuuauuuccaugucauuuucuguugaaaagguagcuuuaggaauagcaggugcacggucacauaagaucauuucuuuauuaaaaagaaaaauuggauuuguguccuauaucaaaaaaugcagaaaugacaaaaauguaaguguuauaaauggugaacuuguguauugcccuuaauacaaaaacaaagccccugcucccaucugcuaagaaagcagacuaugcaguagaggaucuuugacaccuaccgucccagcgcuguaaguacacacucuucgaucugcagccaugcauucuccuccauugaccaccagaaccuggugcugaauagcaaucuuguauuugcuuugaauggcaugcuuaagaucagccacacuuagaaaaauaaaauccaguuauuacauauuuguaguaccuuuauaaaaacacuucauaacacacacacacacacacacacacacacacaaacacacacccuuagacuacugaauuucauucuaaggcuuuucucaaaaagauaguaguaaaaguuuccuguuuuuuaaauuagauaccacaaucaacuggcugugaauuaaaugaauuaaaugccuaugguuuuuuuuuuuuuuuuguuuuguuuuguuuuguuuuuguuuuauugagacaggguuucucuguguagcccuggcuguccuggaacucaacuuuuguagaccaggcuggccuugaacucagaaauccaccugccucuaccucccaagugcugggauuaaaggugugcacugccaccgcccggcugcauauguuuuucauaucuaaaagugaacccauaaaauacaggcagcauacaaaauuauuuugggggguuuuaaauaauggugaaagguauaaacgaacauacauguauauuuaaacacagaguuuguguuuaagauuuuuacaauacauuauagaaaguacaguaaaucuaagccauguaaaaauugcuucaaaaaaaauuccuauagccacauguuaaaauucuagaagaggggcuggagagauggcucagcgguuaagagcacugacugcucuaccagagguccugaguucaauucccagcaaccauaugguggcucacaaccaucuguaaugagaucugaugcccucuucuggugugucugaacacagcaauacuguagucauauucauaauauaaauaaaucuuuaaaaaaaauucuagaaggauccugggcaaguucaaggcaagccugggcuuaguuaaugagaaaacauucuucuagaagaaaaacugcaucaacaaaaaugaauggauuggccgggcagucauggugcaugccuuuaaucucaguacuugggaggcagaggcagaggcaggcggauuucugaguucgaggccggccuggucuacagauugaguuccaggacagccagggcuauacagaggaaacccugucucaaaaaaaccaaaacaaaaaacaaacaaacaaaaaacucaaaaaaacgaaaaauaaaaacaaacaaacaaaaugaauguauuuaaaacgugaauucaagacagcuggggcgauaaagugcuaccuguacaagcaaaaggccuugaguuuaaauucccaugacucauauaaaggcagugugcugguccaagucuguaaccccaguucuaggguagcaaggggacauucagauaccuccagaccccugggauguauugacuaggcaggcuagccaaaucagaaagcucuagauucaaugaaagcuccuaccucaauggugaaaagaaaggauggggguaacagaguaagacaugacacaucuacacacaugaccaacacucauaagccuacaccaugcaugaaacuaaauaauugugcauuuauguguacuuggcauauacuggguauguucaccugugccugcauguagacaugggagguuaaugcugaauguccuccuccauugcuuuccaccacauuuugagaugggguuuccuauugaaccuaaagcucacuauuuggcuagauugauuguagagcaaggccuauggauucaucugucucuccaggcucuggagguuacaggcacacauugaaacgucaggcauugggcuuccaaacucaaguccucaugcucgcauagcaaaaacuuccaaagcuaacucuccagcuccuuuaagugccauuuuuaaaaagcguuuuauuagcacauauuaauuacacauauuaauaacacauauuaauuaauguuacauucaacauuuucccaaauuuuauauucucucuuuuucuguuaucucccuuauacucucauuagucuccuuccucuuuccagcuacuugccaucuuucuucuacucucaugcugaucuuucuuuuuaagguuuaacugggguuacuuuaagagcauggguagggguuuauauacaggaguauaagcaacuuaguagagccacuacuaaggaaaauaucuuucugccuccaguacucacaaacuaauuauagauucucagagacuucaugaagcccucucccaaccucaguaccauuuaaaacuaaaaaccaacaaacaugggggggggggaagccuuuuuaguuugcauaucagugcuuuccgugcaugugugcguguguguguguguguguguguguguguguguguguguguguguguuuugugcccagaagccagcaucacauacccuagguccucugcaagagcaacagugcucuuaauugaugagccaucuuucuagcuaucuuacugcuauuuucuaaauagaaauuauucaaauuauuuguaauaauuucaguaugagauuacucugcagugcuauugaaucguuacaauaaaguaaauagccuugaaagugguauguaacuacuuguuucuuuuuccuaugagaacucaaauuaauuuuuccuugcccugagaacuaaccuuuauacuuuauaaaguuaugagaauauucaaauauuugauauccuaaccaaauagaaaaugacuagaaaugagcuucacuaaauuagguaaaaauaguccauuuguuuuauucucucauuaauaagcaaaucaaacccauugacuuaauucacacaagaguaaaaacaacaaauggacaagauggcucaguggauaaagaaacuuacuuuacugucaagcuugaugaccugaauuuaauccccaagaucuagaugauaaagauaacucaauuugcacaaauuguccucuaaguuuccacacaugcucuuuugcaugugcaagcguaaacauaaacacacacacacacacacacaccacacacaaauaaaauguaauacaaaaauuaccaaaaauagcaaagugaugccuacugcucuaauaaacuuuuaguuuagaauuacccuuuuaaaauugugaauaacaguuaugcaaaaaugagaaagcacaauuuauagaaauuaauuuuagcauuuuaucaucaauuauguaugaugaguaagaaaauacacuacgauuugagauuuacuauauggcuacuguuuuuugagacaaaguuucacuaaguaucccugauugucaugaaacuuggauuucugucuaccuccaaggugaguggggggacaaaacuuguguuuaacauucccagcuugcuauuuuuuuucauauauauugguuacguuuuucccuuaaauuaaguaaguuuuuuaauuaauuauuuaaaauuagauuugguuuuauuauuuuuauguucauuguguacuacaugugccuggugcugcagaggucagaagagggcacuggauucccugaaauugaagauucagaugguugugagcugccauaugggugcugggacucaaauuguauucucuucaacagcaacuggucuuuaguugcuaagccaacucccuagccccauucuguuuaagaagcagaacuuuaaaaaacguuuguauguguaugcaaaugcauauuuugugugugugcauaugugugugguuacaugugcacaugagaucacaugaaaucucccucaggaaguguuguccuugggaagauuuacguccuugaagacagugucugucaguuuugaauuucaccaaacuaggcuagaccgucuguccagagggauucccuaaccuuccauuacaagagcacaagucauuaaacuguccuuucggcuugggcuuugggauuaaauucagauugcacuugguuuuaucaugguagaauauuuucuuaaaauaaaguaauuuuuuucauuaaguuggaaaaccaaaggauaagugcaauauaacucacguuugcacaguuagcucagugucaaaugucagcgugguuccgguguuaaccagaaacacauauaacuucaugaugaucuuucuggaagcugacaccucacccuccaguguugauccuaagugaaaaaacaaagggaaccauuucagaauacgguugaauaccuucaucacuaugauagaacagucuuacuauacaacaaaaaauaaaaugucuguugauuuuaagauaacuauauuggacuaugcaagcaacucauguuuuguuuuguuuuguuuuguuuugaaugaggcuagugaaaaguauuaacaguucuacaccuuacagacagcuuuugugcaggacgaaaacaggccuaccauuagaaaaguaauguguauaauuucuuguuuucuauacucugaauuaaaaauugccaggggcuagggggcuggaggagaaauucaacggaguaauugauuugaaugcaguagacaaaaaaggucuagauugaaucuuuaacagaggaguaaacaacauaaaacaguguguauguguauauugagggcaggagcacuuaccuguuuguuaucccaguacucaggaggcugaggcaggaugauggcuuggaguucaaagccagccugggcuacauauuaaauuccaggccaguccaagaagcagugauuuuaaucucaaaacaaaaacuccaaaggcacugcucugccuucuuguuucagggagcaaauaaaacuacaauuaauuggccauuauuaggcuaagaagauguuuccacgggucaaaaguacucgcugcuuaaucaagaggauagaguucaaaucccaaggacccauauaaacaguagggcaggucaugggaaagcugagaauccaaauaaugugaaaggaaaacacugaaagcucacuggaacuugcaggucccaaccuagcuccagguuuagaggaggauugugucucaagaaaauaagucagaagagagauagagcaagacaaaugacauccaacucuugccuccacuccaggauacaggacuauauauauaauauauauaucccaugaacugugugcacauccccugcccagaaacagagaagagcuauugauuucaaguuaaagaaauaccacacacacacacacacacacacacacacacacacacagaccuuccuccuacuugguugcugcuuagucuguauucugucucuuuaaugagcuagacuacucuacaaaaaaaacuaacccuuuuccuaccccaaaaaagccagcagccagggacuggacagauggcccagugguuaagaccacugcagcucuuuuuuuuauuuuuuuauuuuuuuuugagacaggguuucgcuguauagcccuggcuguccuggaacucacucuguagaccaggcuagcuucgaacucagaaaucugccugccucugccucccaagugcugggauuauaaggcgugcgccaccacgccugacacuacugcagcucuuauagaauccagguucaauacccagcacuuacauagugacucacaacuagcaguaauuuuaguuccagaagauccaauguucucuucuagccccugaaugcgccaggcacagacauacaugcaggaaaacacuuauacccagaaauaaaaauaaacacauccuuaaaaacaaaaaucaccuucuaccacuaacuauaaauugaauauggaucucgaaaugaaauuauuuaaagguacucugccauuaacuugcucaauuuaaaaagucauuugugaacacuucauaaugaaggaccacgacuagaccguaagaucuuagguuuuuuuuuuuccuucauuauuuguuuuuaagaagcaggugguagaaauccuauagacaaauaaaauugauaaaauuaaccucugagauuagcaugguuuauguucuucccuucugagucauaaaauaaaauuuucucuuaaggaaagguaaauaaagguuuuaaaacuaugaugucaauggaucaaaaacacaguuauaaaggcuuaaguaugacuuaccgccagauacugugaagagaaguacuacuuuucuuaaaagauuacaagugucuuauaugcgcuugcuugauauuggcaacugaguggcauuacuggugaaacucagagaacuggaaaagagaaauuucaaaaucauuauagagaaauaauucuagagaaauaauucagugucaaaacaacauaaucauucuuuuccuuuaaaacugccaucuauaauaacaguucucuaucugguccaguuuuucugccuacauauuuacugaaucuacaacuguaaugcagaccuauaaugcuucacuaaagacaaaaaucaccaaauuaucaugaaugcuucauagccugaaguacuaaugccuaacaaaauauuuccauucaaggcuccacaauuuuuacuuauuagccuccaaaguuuaaugucacagaauauauucacuucuuguauucagaauuauuucuaaaagauuaauuuuuaagaaguaaaacuacaccgggcgguggugguguacgccuuuaaucccagcacuugggaggcagaggcagguggguuucugaguuugaggccagccuggucuacaaaguguguuccaggauagccagggauauagagaaacccugucucgaaaaacaaacaaacaacaaaaaaaguaaaacugcuacaucaaaacacucaauuuuuguugguuugauguugagaaauagucucauuacucaguccaaacuagccuuaaacuugccucaugcuccaagcacugggauuaccgagacacaucacuaguccugccuugaacauuccaauauuucaguuacuggaguauauauauuacaaacuugcugccuuuaccaacccacauuccucaggccauauauccauuuacacuaucauauccuccccuguaauaauucacuucuuuauauuucauaccaucuuugacugccaauaagacucauucacagagucccuaaucuagugguuuggccccuauaguugcuugugucugaaugcuuggcccacagggacuggcacuauugggagguguggccuuguuggauuagauguggucuagguggaggaaguguguuccugugguggggugggcuuagaggucuccuaugaucaagcuauaaccugcguggcagucuccuucugcugcccacagauuaagauauagaaaucugggcuccccgcaccaugucugccugcaagccuccaugcuucccgucaugauaauggacuaaucuucugauacuauaugucagccccaaugaaauguuuuccuuuauaaaaguugccuuagucauggucucucuucacagcaaaaaaacaaacaaacaaacaaaaaguuacuaagacacccacuaaauacaucaagcacuauauuagaguauaaguaugcagugaccaggauaaacauagccucuaaacuacugugaacuucaaucauuagaggaaaaaaaaaaacaaaaacaaaaaaaacuccacuguuagggccaucuuaaagauuaggcaaggcuacacacacacacacacacacacacacacacacacacacguauaaaaugagguagggguaugucuguguaccacauuugcuacuuagcucaagucuagaagcuacuaaagaucuauugagaagcaucccugagcuccuuagcuauggaagccugugcuuucauccacugacuggcagcugugaggagucacuuaggaucacuacugugaguuccaagauuggcagcuucacucagaagcucccucuugaauuugcacccucauucuccucacaccaaauaacggcagcuaacaaaguccugcccaagaacaacagagaaaccaagacacauaauaaggcuccaccuguauuuguugucacauccaagaacaugcaugguacagaaaguuagcagucacuguucucaccaagccuguuacaaucaguauacuaaauagcuuuauauacacugcgucauuuaucacaacauguaagguaauaguacugcuguuuucuauuugcaaaugaagauucagaaggcacuuagccugcuuggaguuagaaauacaacaaauaaaaauuccaggggcugaacccaagucaguuugcuacauaauuucaaccaaacagcagcugcaacuaggaaaguuggcacuuacacacuugcaauuccagcacagccaggucuuauauucaauaucuaguacuauuuaaaaacaaaacaaaauaaaacauuuucagaggaacagcucaguaguagaaugcuugccgauguccuaguucaacuacagggguaugggggagauuaaucuggaaauguuaguaucaacacugacuauagcccuuugcaggauauguauuuuucauagcaucaguaaaagcaaggcagcaaaacagcuuugugcaccuuuguggugaagaaccauccucuucugaaaggucugcuuucugucuucaccaucuaucaaauaaucucuaggccccagggauuugacaucuaaugggcuucaaauaacuaaugacgaaaggaacuaaagaccuccugacaccagaaaguauuacagccugaagaugacaguaagagaacagucccaggcuccaaauuuggauccuuuccaaauucuaaauucuacuuaccccucuuuuuuuuuuuuuuuuuuuugaaaagaaaaaaaaaaaaucucacaguagcaaguaaaugucaguagcugcuuggaagaggaaggaaagaaaaaggcuaugccauuuaagcuaaccgagcauggaagucagcuucaaggcagacaaggagccauggaaccaaguaggaagcuuuagaaaagugaacuccaaaaugcuagggagaacaugcucaaagcaugacagaaaaaggaaagguaugaugcuuugacuaaagugagcaggccgacuucggaagcuguaggguuucaacucuauaagcaacagccugauuuuaauuugcauaaaaguuguaguuaaguacagugcuuuucuaaguuugugagcuauuccacaaaaggugcucaucaggaguuugaggugagggucugcgaaucacuaugcuugcagucugucuccaggguagaggcagucuucagagccuuuucuaacuuuagaauuggguaaacucacugaacauucaacauugugguuucuaagggggguauuaaaaguugcugaauuuaaaagucuaaagcaaaauaauaucccaaucacauaugcuuagaaccucuuaaugugcacaggacucagcaccauuugcaaugagaucugaugcccuucuuggugugucugaagacagcuacaguguacuuauauacaauacagaaauaaaucuuuuuuaaaaauuuauauaaaaaaagaucucgggggcaggugagauggcucaacacugacugcucuuccaaagguccugaguucaaaucccagcaaccacaugguggcucacaaccacccguaauggaaucugacgccuucuucuggugcaucugaagacagcuacagugucuuacuucuaauaauaaaugaauaaaaaucuuuuuuaaaaauccuuuaaaaaaaaaaaaagaccucaacauacaaaaugacuaaauaucaagaaaggacguaugcaaauguuauccuaagaaggaaaagacaagaauacacacaaagaaggcaugauuuuuaaaaauggcaacuuucucccucaggcuuguacacuagaauguaaaauucuggugccaugcauggcugccugcugucaugcucucuguuauggucucacccacucaaacuguaagcccacaacaaacgcuucaauuaaccaaaaccagaaaucugcauacauaaaaccaacuccaauuagaaacucaguauccucacugagcacaacuaacuccuaaaacaacugcagccuggcaagacagcucaggaaguaaaugcaccaccuauaguagcugaccgcauggugagagaggauggcauccucugaccucaacacacacacacgaaacuaaacuauuaacuuguaacuuugggauugcucauuauucauuuuuuacaucugcccuuaauuuauguaaaaauccuuaauuccaugaguugcuucuaugaacuaaacuuguuuguugcauuuaauuuucagaacuagcauuaaaaaaagucauuuuuuuucuuuauucuuggggaaauguucccauggacucaauccccaaaacaagggaaaagaagaauacauuuagacauguuugaacaaugggauuugcaguuggaaagauuuuacauuagcgaguacuauuucugaguaugagauaggucugaauugauacggacauugcuccauaugaagauuauuucuugggaaauaggucuuuacuuaucaaaucaaagaacugguagaugaauccaaucaaggucauauaguagggcagagcuugacuauagguuuucugagucaucuguuuuuauucuucugucucccuaaagauaaaaauuaaaggaguaaauaugagugaccauuuaggggagacaaggugaaacagaacaacguagugaauuucaggacagcuagggcuacauagagacccuaucucaucaagcaagcaaacaaucacccccccaaaaaaauaaaucaagcagcagguguacgagcauacacuuaauagcauccuuagaagacagagucaggggggucaauugaauuugagacugacuacccugagacucuaaaacagacaagcaguucuuugugcauuuuuaguacacagugcagguuaagucucuuuaagaguuaaacuuacauugcugccaguagaauagguauggcgggugguacagaccgcaaagacaggaggauuagggguuccaagucagucuuccuggaguacaugagacugacuuuuuuuuuuuggucucaagagaaaaaagauaagaaaggggaaggaacaagaaugagggaaaaagccaaugugcauuguuuguuaccuuuucaacacauaauaguuaguggcaaucugaaugcuaaaacagugucuugugccaccuuaguaguucucauuuuuaaguuuaguaugcacauccugauauuuuuguuuuuugguuuuucaagacaggguuucucuguguagcccuggcugucuuggaacucacucuguagaccaggcuggccucaaacucagaaauccaccugccucugccucccaagugcugggauuaaaggcgugugccaccacgccuggcuuuuuuguuuuuuuguuuuuguuuugagauaagauuuggcugcauaguucaggccauccacauacuccaggauauuugaauuccuguaugcuggggucacacaggugcuacaucauccuaguacuaucuuuuggagaaaaaaaaaaaaaaaaaaaaaaaacuuuucucuccuccaauugaaauucuaaaauucacuaggauaagcaugacugacauguuuugguauuucucucuaguguuuucucagugaaauauaauuuuguguuauugacuagaaacuaaugacaggacuuaggcagguggucaauaacuaggaguuggggugcagaagagauggcucaucaguuaagagcacuuguuacgucucuagaggauacucaggugauucuuagcacccacaauaaggcucagagccaucugugacuccaaggggaucugacacagcuucuccccucugaaggcaccuggcauguuuguaauaaugcaggcaaaacaccuauacacaaaauaaaaauaaguuuuuauaaaagaugagcagguauguugguacauacuugaacuuugaccucagguaacaguacuaaaaguuuagaacuagagauaaaaauuaguaggcaagcaagugugcuauuacuauauauagucuuccaguuauaauucccucagcaguucauucuaggaacuguuuacaaacauuuacacuguaguagauuaaaacucauaggaggcuguaugucaggugaacauuacaccauguagauucaggacuuguaugcucauugguagagacacagaaguacaccugagcaucacaguguaacugccuucaaaaggcugacuguguaaagagcuuggccaggugaguauagagaaauuucuggguucacucccaaacauuguagaagccaggugcggcauaccccaguaaccauaacacuugggaacuggagacaagaugauugaucauaacuucaagguuauucucagugaguuuaaggccaagcugagcuacaugagacccugucuaaaacaaagaaaaagaaaaaaaccaagacacauaaacugcugaacuccauacucagccaaaaaguccaauuuucaauuugcugcuuuuccuuuaaaucuuuacuuucauuuuauuguagacaaaacuaucauucuccugguauccaaacucauuucuguuuaauucuguccauuguuucuuuuaggacgucauggcagaaccuuuagacugcaaauucucuuuuaccuuucuauuccacuccuucaacauuccuaccagguggccucaaauucugcuucucauugucuuucccuggcuucucugcagcuaccauucauguacuauaauguuagcuaaacccugcuuucuucaaggcagguuuuucuuccuuuucacugagucuuucugcaaaauaaguaaagacaauuccagagaaggcaaccuacaugaucccacuuacuuccuuuaguuggcaaccccagccgggccugcgugguagugcacgccuuugaucccagcacuugggagacagaggcagguagauucgaggucagccucuacagagugaguuccaggacagccagggcuacacagagaaacccuaucucgaaaaacaaaacaaaaccaaaacaaguuggcaaccccaauacauauaugagcuugacaacucuggcacauaauucaccuagaaaggcaggguuuggaacaagauuuaucccuaucuaagauucuaucuacuucacugggacucaauaccuuaacaucucaguuuaugaucuucaaacugaaaaugauacauuuacagaguugguaaggaggagagcaauaauguacauuagaauccuuuacaguguccuggaguguauuuaaaauaaaaucacuaaaagugguggguauuaagcuucaauguuuaauagcuucauaauucaccccgguuccuuuuuccagaaguaucauccaaggcucccacacaugaagaaaacuauaccaacccuuugcauuucuaggccagguaaaaaauugcuccuccaaucucugcuuaucuaaauuuuuaaaguccaaauaugguccuaacauuauuucugagcuggguguguagcccaggaauuuaggugguccuucccauuuaguuggcuauaaacgauggagggaagagguggauagauggcuuagcugcuaagaacacuuguucuuucaauguuuccaacauccauauggcaauuccuaacucuccacaacuccaauuccaggguauccaaugccauauaaaacaaucuaaaacaaaaauuuuuaaauuaaaaaugaucccauuacauuuauacagaauauaugggugauguuuaacuuccauguuuauacaaaauaaucagaaaucaucucagaaaaaaauucaucuugcuuugucagguauggcaguacacaccugcacaccuuuaaucccagcaccaaggauguagagguaguaaaaucccagagauggaggccagacuggucuacguaacaaguuccaaaccagccaaagcuucauagugagaauuuguuucaaaauuauuuuaauguccagccaacuuuucaacugagguaauuuuaaaauuccucuugaaaaauuaccacugugauaauaaggcccaucccucuagccuuaccaccaacuuucuaaauuacgaaaaccucagaauuggcuuucuuacauuucaagguuuucaagauuuucaaaguaaacacucagacuccgaauacaugggguggggguaggaaugggggagaucuaaauaauccaggcgugguacugggugcuaggaauauaaauacuuucaaguuguuuucaaguuuaauagagcacaagaucuggaaguuacuaaagaaagcaaacuaaaggccucauggagaaaagcaauuugaaguaauuuuaucucauuucuaauucugcaaacugcaguucuuagcaauucuaccacucugagugaugaugacugguuucugcaucaaugaaaauaacauucaccacaaaggccauauggguugcccagaccaagaacugggugucagggcuggugagguggcucaaaggguaagaacacugacuguuauuccgaagguccugaguucaaaucccagcaacaacaugggguuuuacaacaaucuauaaugagaucugauguccucuuccugugcaucugaagacagcuacaguguacuuauuuauaauaauaaauaaaucuuugggccagagcaaguaggcacugagcaagccaaagugcuaaauucaauucccaacaaccacaugaaggcuacaaccaucuauacagcuacaguguacucauauacauaaaauaaauaaaucuaaacaaacaaacaaaccaaaaaacgaacugggugucagucucugcaaaucagguguaccaccuuuuagguggcccagaccaacaacugggugucagccucugcaaauuagaucaccccauauacagcuaccaggagaaaacaguaggacugccaucuucuucacaaagaaaaucuguuucauaaagguucauaucuuaaguguuugccuucucugacacuagguaagcaugcucagguaagcauuacacggagauaacuaauauaacaugcuuguaaccaaaacagaacagaaauacuuuuaaaucagaaauggaauucaguaguagaguaggcacauucauauacacaauaaucugguuuuauaauacugaggucagccaggucuacauaguuaagagugucugucugaugacugucgccugagaagccuuguuagagccuccuuacaaauacagaggcagaugcucacagccaaccuuugaacugggcuuggggucccuaauagaagagucagaaaacggccuggaggaguugaagggguuugcaacccuauaggaagcacaacauuaucaaccagcuagacccccgagcucccagagaauaagcaucaacaaaggaguacacauggcuccuccugcauauguagcagaagguggcuugucaugcaucagugggaggagaggucccuugguccuaugaaggcuugauagaugccccagagggcaagggaggugggaguggguggaugaacacccacauagaagggaggaugggauaggguguuuccagaaaggggaggaacugggaaaggugauaacauuugaaauguaaauaaggaaaauacccccccccaaaaaaagucucgguuugugacugucucucuccuucguucuacagaugguguuggaucucucuagagcuggacuuacagcagguggugagcaauauaaagugagugcuggaacugaacugggguccucuggagaagugagugcucuuaacugcugauacauuucaagcccccaaauauuuaaagauuacauuuauuuuaugagucaauuugccacaguacuugugaagauuaaagaacaaguaaugauauucaguuuuguuuccaccauaaugccauacauacuaucauguaucuuaccugaacugcauaauauaaaaauaauuuuacacuacggcacuaacauucuggcaucauaucuaauucaucaaaacuauauaaaauccaugacuuuagagaacauuuucuaauuguauauuuuacuuuacaguguauauuaacuaugaaacaaaacccaaauuaccuauaauacugaauuagcuuuuacucuaucagaccaagacuauaaacacagggcaguaucaaaugucauuugcugucaccaaaggcuaugggaagaacagaauaguagugaauuauaaucuggauacauauucuuugggcagcuacugaccaauuuuuauauggauagugaaggaaaaacugaugucucaaacaaugaaaacagaucacuacguuuuuguuuucauaauuacaagucaauaauauuagaauuaaauccagcaaaaaucaguaaucuuaagggcacucauuaaacaucugagaaagcugaaacuacuaagucuccuuaugaccacucaaguucugcacacacuugcagacucacuaaacuuaacagaaggguaaaaaggaaaaguaaugcuuuuaggaccuuagacaauaaucaguuuuaugauaagcaaacuacgcuuccuagguccauaaugcaaaaagaauucuagagaaaugugcuaaguacuaugauuuuaucuaaaaaguacauugcauaacccaacaugccacaaucugcuucucuaaccuccuuucuaaaccagcaauugauauuggucauuuuuccuucuuuaaaaugcccaaggguuaucuaaacacacacauaugagauauauguuacucuaguucaguguuauuuacagguguacuuuguaagaucaaucaacaugugaggaacagauucgaguucaacuguuucccagacuugcuauaucgacugacacucaacucugugccuuuacacaugcaggguccaugagccauuuuaaaaaaaaacaaaaaaaaaaaacuacagcucggugugguggcacacgccuauaaucccagcacucgaggcagaggcagguggauuucugaguucaaggccacccuggucuacaaagugaguuccaggacagccggggccauacagagaaacccugucuugaaaaacaaacaaacaaacaaaaaaaaaaaaccaaaaaaaauuacuaugcauaaaacuugaauguuagccgggcauaguggcgcacgccuuuaaucccagcacuugggaggcaggcggauuucugaguucgaggacagccuggucuacagagugaguuccaggacagccacagagaaacccugacucgagaaaaaaaaaaaaaaagcaaaaaacaaaaaccaaacaaacaaaaaaacuugaaugucuacagaaugccucuuccuacuacuaccccucaauccuggcauucuaucuucaguaaccucucauggaauaugccuuuaaucagagccuuccauauuuuuuauuucuucucucucucauaccuccaaauggguccuuuugucaaguagacauagcuucuuaaauucucaagacaauaagacaccuuauccaaaauuucaaacccacccuccaauagagacacacacuucuuaaucuuggcuugcuucuauguucacuuauguucucacuuuucuucugaaugauaagagacuggaguuugccugcugcugaauaauuaauuaccaaggcaucacuaaugaauacuuaccacagcuuacucugagaugugucaagucuuggcaaaagggggccaagagcugaaggucaaccucaacuacaauguacaccucuaagcaaagcucucuuaaucagguagucguugaaacauuuuccucucaggucuaacaguggcucagggauauuacaccuuacagagcaugcuggaaacugaguuuuaguccuagcaguacacacuaacaaggcaagaaacaaaacaaauaaacaaaaacaacugggggagacaccaguccuuucaucuuuuguccuuuggcuuuuacagaucuauguguaaagucaaucugcugugcauucaaacccugauguuugccauaaagagugcugccuguucccuccaucuccccccaccccaagagaacccucuucucuccaggcagagggcugcuucauugucuucccuaacucaaaauaaaacaaaauuuuuaaauuuugccuaaguccacuaaccaauuacauuaauaagauuuaucaauguaaaugcuacauuaugggccugacacacccauggcauaacuauguaaauaccauuuauuuuguuuuucuuuuuucaagacauguucucgcuaugauucccaagaccaccuuaacuuacugaguaacucaaauaacuuaaagccaucuuucugucucagccuccuggaauguugagaugaauauagcagcuaccuucuaagccuuggcuaacguuuaaaacagauauaaaugcuaaaaaacauaacaaaaacuuaauuggaaagcgaugauuugcguuguauuugguaauaagacuaaauaaaauauuucacacauaacaaguccauuuauagauccccucccccaaaaagaaaaaccaccuacugaaauacaguaccaacauuugacuaggaacacagauugguucauuuuuaggcugcuucuaaacugcuugcuagcuuugcaaacccucagauaaguaagucucaccaauucuuuacagaaaaugguuagcaaaauguauaaauuuuaacgcucauaauagacuugucaacauccgcacccaacugaaugucuugcagggacucuaucaauaagugaguccacgaguguuccguggcaucaguccuauguaccaguucauggaaugaucacauuuuaaagacucaugacggaagggacaggauuacgaaaccauaaacagucaccauagcacauccaccacucuguagagaaaguacugacagcacguucgaaagcugucauuuguaccaaguuuugguacucccauaagcccccaccccaaauccaucugcggggcgagcgaggcugagucauuccaaggaguaacuuuacaccgaugcuugcacuccggggucgggacaaaggcaucaccucuagguuccucccgucagggcacuccggcccuggcccaaacccucuccgguuucccgagcccgacacuccagugcaccgagcccuggagacggaggccgcgauucaggccucgggugagcaccggcguccugccgcucccgcgauccugucagcggccagcgggccucaggguccccguaggacugccgcggcgacccuccgagccggcgccgccagacgcuccggcgaacccgucaggugcugagcggccgggccaagcccgccgccagaugggagcaggggcggcacuuacccggcagcgccuccuccgcccgcggcagcaacacagccggcggcccuccgcaccaucuucugccgccgcccuggccucggcggcggcuaucaaccgccccugcggcgccgccaaccgacacaaccgucggcgcccagccgccgaguacccggcgaggcccggaaggaugggagucgggcgcagccgcugcuccggccccucggcuccgcgcggggacccgaguccgccggccgaggcacugagagcuuggcagggcugggucgcggccgccgugggguuuguuauugucgacucggc

SEQ ID NO: 12270 - RNA, 14102 nt, Mus musculus
ggcgguacgugggguuacggcugcgguagcugcgggacuggcuagugagugucgggcuauggugggaaucgggaucugauuucgcuaggagaguuagugcggcugggacuggaugcuuuaguuaucccucugcucaccccuucccgucugggcggggaaggaacggaagcucugagucucuccggccuccccagcuccuggcuugggggaggggagaggaguuuggcgggaccuuaacuagcucagcucggugggucuggaaaggggagaggacaggaggugcgggcuggcugggccuccuccaggcugagcgcggggaggguggaguuaagagcauggcagccggaucgcuuuuccguuuugccuaccucaugugcgcuuguauuuguuuuacuguuaaaaucagucgcuagacccaggagagagcccucgccgcuuuaagcuauaggacccugaaagaaaguuuaccuucuggacaacuuggguaauuucugccuggcuggguacauuggcucauuugugcaucuaucuaccucucauuuuugccugaaaggaguuaucuagugccagguacagugcccauuuauuuaguuucccuuaaggaacucuucaguuuugugagcaugaaaguuuugucauuuagugcaagcaugccuacucugcacuuucuaguguagaaagcaauugaaauaguuuuacaacuugguccauacuaccagaucugcuucuuagucccaaauugaauuuuauuuucuguuaaguggucuaagaugguaaauacuugaucucguuuauauuauguguuauuaagccgucgaaguucacaaguggauuuaaucuucagugaugaguaaacuguugugguuuuauaucauggauguuuguuaauuuauaguaauuugggguuucuauauuucuauuuaucaauuuuuugaguacucuuggaugacauggaaguuguacucaguaacucgucuggucuaaauguguggcccaccaggccuaucucccaguuguuaguuuuaaagguguagccgccaugcuggcucuuaucuuuucaacuugcuuggauuaaccuuggaccucaacuacacugaguccgcacucuugugugccacuacuccauaucuucaucccccuauuuaauuuauaaauggcuucucauccuucauaugauauuucucuaauuaccagacugggucgguaauuugauguagcauguuugccuaauguccagagacccugggcugguucuccagcaucacacacacacacacaagaaauguugguuuauuaccucauaaugcuauuuuuuaaaaaaauccauuucuuuuuugagacuuguagcccuugcuagccugaaacucgaccauguauacuugcauggcccguaugccucuggcuuccaagcacugggauugaaggaguagaucaccacacccagaugguaucuauuucaaauggagaaaaucugcuucauugcuagauaagauaggaaugcugcaguguacauaggcaaugguauagaagcaaggugauaguuuacuucucuguauacuaaguucuuaagaaauugcgcagaucuucgucuuauugcuucagggaaagauugggguuuugugcagggguguaugucagauuggaauguaauaggaaagucuuugcauguaugcuuugauauguuaauagacuccaaaugcuuugauaguuuacuaaguacaguaagacaaagacauccaauacuugaaaauuuacacacacaguuuuugguguagaaauaggcaugaugucagaaaccuguaaaccuuuauucagaauauucaggaagcucaaacaagcaaaggauugacaagaguuccaggucaaccaagagguccaguaaagcccuguugacucucccucaauaaaaaagaaaguggggggaggggauacaucaauaagaccuuggacagggaaagacccuugggauuugauguuugagcuagaaacaucauagggagguuuaaaggaagagcuucccacagcagucacugcaaacgcaagggccuuaaagugugagugaacuugaccuagucaggaaauuccaaggacacaaaugcuuggaacauaugccagauaagguuauagccagcccugccugaccuggcacucacuuuguggaccuggcuggcccagaacucagauccaacuaccucugcuucuugagugcugggguuuaagguguacaccaccaugcucagguguaguagcuuaaaaaaauaguccauuuaaaauacaguuagcuugaucuaaagauguagaguucaaaucgguagaacgucaucugauuugaaauauaaauuaaaaccaaaucuugucuuucauuccuagaacaggaaaaaaaaagcuuuugccuuugcuaaucaccuugugaacaguagugccauuuacugaagucagaagacagaagggagggaacauugguuucugacagguuuaucaggaguucucugugggacuuagcuugauaacucaguaagacaggaucugcagagcaugcccacaucuuaaucacagagguggaucugugaguuugaggccagccugaucuaagaagacaaauuagauguuucugacuggcacucagaguagguauagaacuagggaggacaaaaugggaacuguaucuuuuagaugauauuuaaauauuuaaacuggaaaauaucaaauggguaguguuagauugaucaaagaaagcaggugaaauuuaauguacugcuuugauuuuuauguuuggggcagagucucaccuugguagaccaggcaggucuuugaccugguucucuuuucucagcuuucccguguuaggaucuuagaccugugucuugcuugauuaugagccucuuccaaagccuuaaacacuuuucaucccagcagagauaggaagaauaucuugaguuuagggcuguuugcuugaucuacauagugcaaggacagccaagaccuagcucagaauugggagggguuucuugaagauuggugauagaauagggaugaagcagacagauuuuagaacaugcaaggcucugggaccuuuaacuuauugaacauuuacuuuuauuuuauguguaugaguguuuugccugcagauauguguuugcuuaauguccacagaagcuagaagagcguguuaacucuccuggaaugggaguuaggacaguugugaaccaccauguaggugcuuggaaccauucuagugggucccucuucuggcucuucaaugcacaugguacauauguauaauucaggcaaaauacuaguuuguaauguggucuuuguaaagucugcuucuauaagguuuuacaggaacauagccacauucacuaguuucuaucuugucugugacugacuuaacaguaguuguggagauguagucguaacagacuuuagagacugauaagcauauguuuacugucugacccucacagugugcugcucccagcagcgcagcgcagcacaaggauacuggaggaugguauagugauguuuauuuuguuccugacuucugccacugaaaccaggaugacuuguucacucccaucaugacacauagacuuccaauuaggauauaggaucauaaaaguuuaauguauucauucacuguguacuaggcaucauucuaaguguuuuguauaucaauucauucuccaaaauucuuuuagguuucuuuaaguuguuguguguacgucugugugagugcaagugccugcugaggucaggggauaucugacccaucuggaacuggaguugcacauggcugugaagccagcugcugugcauacuaagaaccagacucagguccuguaaaugcuguaugugccgagccaucucuccagcucuaccaggauuuuauuuuuuuuuuaagauuuaguuauuuuauguaugugaguacacuguagcugugagccuucauuugguuaugugguuguugggaauugaauuuuuaggaccucugcuugcucgggucacuccgcccacuugcuccaacccaaagauuuauuuaucauaaguacacuguagcugucuucugacacaccagaaggaggagucagauaucauuacgggugguugugagccaccaugugguugcugggauuugaacucaggaccuucggaagagcuaucucgccagccuacuuuuuaaaaaucuauuuuauguguaguuacuaacaauuuuaagcugcucugugggugcuagaaaucgauucagguucuggggaagaccagucacugcuccugucucuacaugugcuccuugucaaucacucuugugccugauaagacccuggugccuaaucucuggccuccucuucccgcuucucuccuggaugugcuguucucccucugaaaggguucuuggaccauauaucccugccucacugccuucagacuucuguccaguguuagugagacuucucuucacaaccuugaaauacaaccucuuucuccucucuucauucccugcccacuuuccuguacuuauuuccccauagaacuucuuccauuauacacaauuugguuuucugaucgauacacaccuccuuuugggugggggugguaguugacguaauaacucucaguguacucuuagcagaccuuaaacucuugguaauucugccuccaucucaagagcuaggguuucauuaaugcuccaugaagcugggcuugucacugucauuuuuuuuuccaugagguuaaaaucuuuguuguguuuuguccccuguacauaggauagcauguggcauaauacucuagaguaguguuugugaggugaguggauuucuaaacugguuuucaaccacacucaguuguugugcaccccccccccccccccagacaggguuucucuguguagcccuggcuguccuggaacucacucuuuagaccaggcuggccucgaacucaaggagauccaccugccuccgccucucaagugcugggauuaaaggcauugccagcacuuccuaagugacuugguggaaucgauuguuccuuucaacuuaguaaaauaauuucaucacucagucauccaggucaaacacagucuuuucacacauacauuuuuuguugaagguuuguagccacccauuuacuuucuuggaacagcuaaucugcuucuuuuuguguaacaucuacuuauccaaagaauuucagcuaguuuuauugacagucuaucuaguguucuuguugauucugguuuggcuuugguguacugagacuggguuggccucaaaccccauucucugcuuuagcagccugaaugggauuacagguguauaccaccacacccugcuuugacuguuacuauuaagauuuuaaguaaagccgggcggugguggcgcacaucuuuaauccagcacuugggaggcagaggcaggcggauuucugaauucaaggccagccuggucuacagagugaguucuaggacagccaaggugacacugagaaaccccgucucgaaaaaccaaaacuaaguaaagcguugucauauguauuagugcuguagacucagcacuuccuaaaggcaaaaguccaggcacaugaggaaguguguguucaaacugagauuugucuccaaauaugagucucuggauguuugaguuucacacuuaaccaugucauauuuugucaugucauauauauaucaugucauauaugucaugucauaacuauggugguaggaguccuuuacuccuuucaacuucaugucgcuggcaugcuggcccugauuuacuacauuaagucuuuagagaaauuguugcuucccaaaggccuucugaaaugggucuuugcaugguugcuuagcuacaacuaguuuauaaacaaccuaguguuuuuacuauggguauuaucuaaauagaaaaguugacacuugaaggacgucaaggauuuuuaauuuuucauuuuuaaaaugaaaagaggauaucaacacaaaaugaugguuuggguggaauuuuuaacugccuuuuauuacaaagagacauggaguacaguuuuuaaaguuuuagagaaccuuucaagaauuuauaucaacaacuuaagaaaaaacaaaguugauucauguggagcuaguuuaaaacaaaaccaaagccauuuaaggccagguuagggcuggguguggugaugcucaccuuuaaucccagccagggcagggcaguugaaucaaggcagcugaggucaaggacauguucuacagagcaaguucaaguucaggacuaccagaacuugcucuguacguauagagaaagcugucuuugagaaaaaaaaaaaaguuuuaaauucggggcuggagagauggaucagugcuuuaagagcacuggccacuauuccagaggaccuggguucaauuccaugcauccacauggcaacucacaacugucuguaauuuuagucccaggggaucugacaccccuacaccuauaccuguaggcaaaaauauuccaccaagucacuuaggaagugcuggcgcaugccuuuaaucccagcacuugagaggaggaggcagguggauauccgugaguucgaggccagccuggucuacagaguugaguuccaggacagccagggcuacacagagaaauccugugucaauagggaaagaaagaagguuauuaaaaaaaaaaaaaggagccaaaagcugggccauaauggcacccuacaugcccuuuuuuguuuuguuuuuucauaacaggguuuuucuguauagcccuggcuguccuggaacucacucuguaggccagccuggccucgaacucagaaauccaccugccucugccuccccaagugcugggauuaaaggcgugugccaccaccacugcccaccucccuauaugccuuuaaucccaacauuagggaggcagagacaggcaaaucugaguuugaggccauccugguuuauaagcaaguugcaggaggcagggcuacacagagaagaccuaccaugaaaaacugaagagaaaaaaaaaagugaaaucuaucaggcuuuaaaucuacuccuaaugcagucacuuuagaggaaugauacucucuugggaaacuuacuuuuacagaagauguuuaucugaaagguaagggaauuacugcaguggucaccaguaaguaagcccacaagguauuaaguaagggcuuugccaggguagcccuuuucucuccuuuaucucauauuagaagugguacaaguuauugaaauuacugaaaaaaaauugacuuuguaggaaucauuuuauuuuguaaauuuaagauuucccaaaauaggagcuugagagaugacucagugguaauacuagcaacuguuccuuaggaccugagcuagauuccaaagucacgcccaucuuguaacuucaguucuaggggacccaauacccucuuccggucucuaaagacacuaggcauaggaaugaaugguacccagacauacauguagacaaaacaucugcauauguaaaaauauaaaaauuuuagaagcauuuuucacauaaauuuuuuaguaauuacacauuuuuaauuacauuuuguguacauauguuuuguuugucggggucaaaaggguuuggagccuauguaauuggaauaacaggugugagcccucauugugggugacuugaaccuggguccuguggaagaacagcagauguuccuguucaucaucucucaccuaccccaaagguuuuaguauuuaacccuuccuuguuaaauucagaacuuuaguuccuuguguacagaaugaauagaagacuaaaaaaugcaugugcagugcacacuuuuguaauagagcaaacaaaccuuaccuucuuugcauggaacauaauucgccauguugcauaaucauucauccaggcaagcgcuugcuugguguacgggcaggauggaguuuuguuuuguuuuaauccccacuccacugaaggaagccuucgaagcucacugacaugaagaaggcacauggaacuauuaauuuuagaagcuaacaugacuucauuguccauuauuaaacauugaaaugcuaauuaauaagauuuaagucagccuuguaccugauucuaucuaaaguucacucuguugucaaugccuaggaaaagcccucccuuccaucuuuggucuucuagcaagcuuaacguagcuagaggcucacugucagcugcuuggacaacuauaggaguauaacaugauaaaagaauuuaaaagccaccauuuagaaacgggguggggggcgggggacuuguuucugaugacaauaagacccacagguuucuucagauucucagcaggaaaagcagugaucuagaacguuuugaaacagugguuuuugguucuuggguuuaaguuuagguagggauuuuaguuguuuguguuugugguuuacgugugcauuuuugaugagcagagcuuuuugacaugcauucuugacaugucacuuuacagcugcucagcacuagcaccaucagucagucagcuuguguguguuaacucugggauggaaguuaaggugggaccuuguacauaacaagcagaugcaggagcucagccacagaccugagccuccacauaagcuucgcguuugcuuggguuugguuugauguugaaaguuucccucuauaaacuggccugucuaauaaacuagcaaucuuccugcuacuuagucauuacuuuuaaauaaucuuccaggaaugccccuacugaaguucugagagcguguuggaauuaugaccuucuacaaggagggagaguccugaaaugacuagcaucaguaacauauaguaaauagaaauguguggggaaaugcaaaugcaacauuaauuuuuguaugcuuuuuuuuuuuccaggaaaauacuaaaguuccucugggcucagauagaauuuuaucagaacauaauggguaaguuauacagagguaauuuuguguuuaauuccugggagaugguuuuuccucucaacuaggccugugggccuacacacaugacuuuauugcacagaugagcacuugaacaccaagggauggcuuuuaaagucaucacaagaaaauagcuaaagugaaauuaauguucauaugaauaguuuauuauuccguaucucaguaacaauauacaguaacuauuacuaaaaaauuaguaaugucaauaccuuaaggaugagacauuuacaccagauugugauaguacacuccuucaaucccaacacucacaaggcagaggcaagcacauuucugugucuaagaucagccugaucuacacaguaaguucuaggacacacaggacuacacaaagaaacccugucuugaguucuaccaccccccccccugccaaagaauaauaaugagacuuuuaauaauaaaaugcagaauaguuguauuugguuuuuccauguaugaucagauaaauaccugcaaaaacuugaaagggucguauugcuccuaauuucagguauuucauucaucauaacaaggagagugcaugucgagcagagcugcucaacugcuagucugcauuauuaagggagaggacaagguagagcucccaaguacauuugccugguugauccuuuucaguggcuuaagcuauucagagccuucuugauccacaggugguucauagaugugacauacauuucauuaggcauuucucaagccagucaaguugauaaucacaaucaaguaucacagaaugcaaaaauaggagaaacauaaaaugaacuucuuagcagauagauaguguugagccaggcuggccucaguguguuaauccuacauuagccuuuucuucuucuucuuuuuuaaucagacucccuggaacuggaggaggaagaggaggaggguggugguaguggucgucguggucgucgucauggucaucuucuuccuuccuuuuucuuccuccuccuuccuuccuuuuucuuccucuucuuucucccuuucuuuuucucuuucucuuuuuuucaacagggucucuguguagcccuggcuguccuggaacucacucuguagaccaggcugaccucaaacucaaagaucuaucagccucugccuccuaagugcugagacuaaaggcaugugccaccaacuggaugauuuuucuucuuguuccuccuccuccucuauuucuaucuuaguaggaaccauuaaaaaucuauaagcuugaguaguuuagaaauugcuuacauuuuuaugaauucccaugcuuuuauuguaauaauuacaagagcuguauagugucaaacccuuuucagggaccuggagagaucgauaucucaguggauaaagggcauggugugaaaacaccaggacuccaagccccuguaaccuuugaaaaggucuugcauuugggagcuagcuacuuguucaaagacuggaauuugucuuguauggguuuagauucagaugaaacaucuuugacagaaauggugauuuuaauccuaaucuuuguguagggauuucugaguguggauguuuauagaugaacagaacaaucaucuugauucuuccacauugucgagcuuccuaagauuucagaauaagauuuuaaaugcuuuuauauaaugguaauuacaaaagacacaagaaaaaaccuugagguauauaaaagcauguauuuuuuuuuuuuuaaagauuuauuuauuuauuauauguaaguacacuguaguugucuucagauacaccagaagagggcaccagaucucauuacgggugguugugagccaccaugugguugcugggauuugaacuucagaccuucggaagagcagucgggugcccuuacccacugagccaucucaccagccccaaaagcauguauuuuguuauuauauuaucccuagcagaaaauuguagugaagcuagcacaguggcaaugguggcaucaguagaacaacaacuacacaccuguccucaccucuaaugugauuuuuuuuucccuuuuccaugcugagcaaucaaacuugugugcuaagaacaugcucugcugcuaagcauggaccaugacuacauuaauuuuacugcuuuaucucagauggagaggagaagaccuaugguggcugugaaggcccugaugcuauguaugugaaauuaauaucuucugauggccaugaauuuauuguaaaaagagaacaugcacuaacaucaggaacaauaaaggcuauguugagugguccagguagguaaauacggugacguuuccuucauauauauccuuuuaaugucuaaugaauguauuucaaguuagcuaugcauggcgagagagagagagagagagagagagagagagagagagagagaguaguugcagugguccaagccuguagucucagcuuugcaaggauugcuucugaccuaagcgucuuaggccagccuggacagcaugaugagacauuucuccaaaaaggaaaaaaaaaaaggacuggauacauaagguagccagaggcauguggaccuaaguuaggcuuuccagaauccauguaaaaaaaccaacaaaaauaaccagguaccuuauaauuuuagcauuggacaaagaggaagaaggcaaaccagacgcacacaaaccacuuggcucugaucuuuuagcauucuuuaaaguaaauauuuucgaacguccaaaauaauucaaagcauacaaacccagcagcaauuauuacaucuguaucauguacagccaucacuaguaucuaguucuaaaaauuuuuuuuauuuauuucuccagaaaaaaggaaacucuguaucuauucauucagcuuuaucugugcccaaucuguuuucuguugucccuacucuggauccauacaguauuugaccuucuguuaggaauacgcuacauuguguuucucugcucaucacaguugauagaacauucugugucuauccuaaacagugcuguuguagauauaugugugagugccuauuuaaaacaccagcauucaguucuguucuguugcucugaagaacugguugccauauguucauuguguuuuggaggagccacugaaguguaucugaagaggugcaauuguuuucuuuuuuguuguuugaccgcauacuagucuuccauuuuauaaaacacccugacuaggauuugucuuuuuuuucuuguaguuuauuauaucuauagaauguaucuguaucaguuuauauguaucacauguauauaagagcuuguagagccagaagagagcaucagauccccuagaaccagagucaugggugcuugggccaguggagugcugggaaccaaacccacacucugcaacaacagugcacgcugaugcugagcugucuuuuugcucauuacugucuuuuaaauuuuguauuuguauuuuuuuuuuguaacuacucauaucgaacgccaauucaugcauuugcugaccauuugcauguauucaagauucuuguacgugcacacuaauuaucuuuuuccucccuccaccuuugaaguagcacacaccuguagucucagcacccaggagacagaggcaggcagaucucuguuccaggauagucagagcuacgcaggggaauaaagugcuuaauggugcuggcucuucuauagcaugaugagauaucuuggaacuagauggggugggguggggugggggucacacaauuaugaaaacuaaaugcaaguuuaaggccagguuagucuacagagugaguucuagggcaggcaaggcuacacaguagugaaacccuguuuaagaaaagaauauugucucuauuuguguuaaggccaauguucuaaauauguagauugccaagacauuuugaggcacuacuggaaacugcuucauaaagcauuaguucagaauuaggugucuuacaaagaaaucacauuauggugaauuguuugguuuuauuuuuuugagccuagauuuagcuaaacugucugagucagccuccggucagucauccugccuagccuuaacuguugagguuacaggcgugugccacuauaccuagcugcuguuuuaguuuuaaagauuuggguagauaaucaauuguccuuuuaacauuagcuuucugccucacaaagugccauccuguauguacugcauagcuuaagaguggagaacuuuuccuacaucuaaagugucaaacuuuagauauuuggcaguguugguuugucuccuuugaauaauggucucuuucuuugucuuuucacauccucuucucuccgcucugucuagucuucugaugaggaugccaguuguauuguacuacuguccuagauagagacuuuguuuuaacauaauuuaaaugaaauaucccaccuucaaguacaaucacauucugagggaguuggacuuauguugaccuugaauaauaaaaggcacugugcagcccuaacauauauaaaacucuucuguuuugcaggucaguuugcugagaaugaaaccaacgaggucaauuuuagagagauccccucacaugugcuaucaaaagugugcauguauuuuaccuacaagguccgcuauacuaacagcuccacugaaauuccugaauucccaauugcaccugaaauugcacuggaacugcugauggcugcaaacuuccuagauuguuaaauaaaauaaauuauaauaaacuguuaauuuuuuucaguauuuaauaccuguaguucaguuaguaauuuuuucacauauagcauguugccuguaugaaauugagcuguaaagcuaauugccgagcagauuccuucugucauuugcauagcagaguugaaauuuguuugcuacaucaacaaauuaaggacauuucacaagucaaaaaauaaauaaauaaugccaguuuauagaugguuugcuuucuccuggauaugaccuuuaaaauuauaacugauagagcaaauccuggaauauaaacguaaaugaauauauucuacagguaaauacaggggcuuuuuauguuucuaguguuuuuuuaagaaccaguucugaucuuaugccacugagcauuacuagaguuaugcaaauaauuacauggaaaacauguuuauaacuuagccaaaccuugauuuuuguaacucaaagaauaagaguugaaauuucuuauguguuuuuuuauaaacugcaguauuguuuaagugcau

SEQ ID NO: 12271 - RNA, 71746 nt, Mus musculus
cucggcacugggcggcgcuggcuggcucccuggcugcggcuccucagucggcggcggcugcugcugccuguggcccgggcggcugggagaagcggaguguuggugagugacgcggcggagguguaguuugacgcgguguguuacgugggggagagaauaaaacuccagcgagauccgggccgcgaacgaaagcagugacggaggagcuuguaccaccgguaagaggagcaggaggaggaggcaggagccggagagagccggggggacagaggggggccggggaggcgccggacacccgcgcucggggccuuccccucgcaggaggggccgcgguaaagauggagccuccgcccgagccccacaacaccgccgccgcucgcagcgaacaaagaauaauggcggcggacuggagccagcggcggccgggcggcagcgacucugccugcagccagcggcggcgcucauggcggggggcggccgggccggggcggggugcgagcgagcgggcggccggccgcggcaagcuggcgcccgcguucccgccgccgggccgggccgggcccggccgugccgggcgcggagccggagccggcgcggagcggagccgccccgggggaggccgcccgccgccgccccccguuccucgccgccgccgcccgccugcucgcacgcucgcucgccccggcugugccgggcuggccgcccgggccgccgccugggugcccgugggggguggaggaggaggaagaagaaggagacaguugagggcagaggaggugaaggugcugccgccuucgcggcggugcccgcucggcgagccgcaacguccgaccugcuuuccucuacagcgcucuuugugcaauaaaguucgaaacccaagguuuucucuggugcuguauuuuauucuugccccucuccccggcucccacgcggucggagaaaaugcuguuuucugcccuaggcuguuuuaaggguuugggguuuuuuguuuuuguuuuguuugguuuguuuuuguuuuuuguuuuuuuuuuacuauuucccucaccccucggcuuugaagaugaagaacgaaucaguaguccugggaaugcauucuuuugggaaggaaagaggugcuaagaaaacauacauguaauaacuuuuugcagaaacuguugggaucuuguaaaagggaagcuggugcuugaaaacaguuucgguuuuaacccuuuccacuaagauaaugaucacuugaggucaaucauucugaaacccuuagaaauuaucgaaggggaaauuaguauuagcgaagguacuuuucguuuucugucauuugaagggaggcagucuugccaagguuuuuugagucauccguaucuccccuuagccucugccaugcuccucacacgcuucugucugaacuuuaauggaggauugauauaauucucacucuaaaaauaguuauugaaacuauccauuauuuguauauugccguagguaaucccagccugagguugauggcaguuuaagccagcagggguugugguguuccuuuuuuuccuucaccuagaacaucugcaaaggggacugucaaaagucauugacaccuuaaagauccaaagacauuuuuaaagggcauugcaguaugaccuauuuaaaccugccauaucuucucaaaguuaagaguuugauccuagccucaguuuugcaccacaucugccuucaaaagaucuagcacaaaauaccuuugggccaucuauugaaaucuugugcccugaugaucauuucccaauugaaaagcaaagcccaaaauuuuaguugauuugaaaggugcacaguuuuuuauauauuuggggggggggguugcuuguuucuuuuacaauacaaccaguuacuguaccauugaauugugauugguccauacaaggcuuuugguuaggaauaaauauugauugguaauagaaccauuguguuugauuuuuuuucuaugcgucaggacucugaaacuugacaaguuacauugcuagucuuuagcacuccaauuugcaauuguuaagaaaauuaagaugcaauagaaggaguuguuuccauaggguugagaagaugauuuuguuuccacacagugaagacucuauacaugguaauguugaugauaaaauaguuuuuucaaaagauuuucuacaagccaauagugaugauacaugaggaugauucuuccccugugagaauaaaaaaaaauuccuauguguccuuucuucaguguugaccaaaagauacuuuagguuuuauuuaugggaucuuuuauggagaaucaaauugauucucagcaauugcaagugaaacuuggaacacuuuuugugugcauuaauuuucaagcauucaccuggaaccugacaauaaauuacaguucucucuugcagaggucagugaaaguucuagcacggugugcuucccuccucuuccuccuuccucuccuuuaguuguuuauuuuugauggaccuauguauuuuagaaagcuaaugaauuauuuacaaaaacuuaccuaaugaauacuaagugagcauuccuuuggaauuuaaaacuaguguuaaacacuuuugaacagaauuucacacaagggccugaagaaacagaccauaauauucuuuuuuccuacccucagauacucauagggauuuuaguuuucuuagagaaguaguuuugucacuuguaaagcccuuggguuuguuuuuuuaaaucucauaugccuuuuuuaaaacaauagagaacauuguuuacuugugacagugcuuauacgauauaaaauguuuauuacaaauacguuagcagauacagccauauaaacucaccuguuauacauucgugugagcaucuuucuugcuguauuacuucuagugguagcuucauuauuuugaauaaauagagcucaaaucuuagcuuaagaauauaauagauaucagaaaauagauaauuauagcaguuuauuccucaugcaugugugaacuugacugccccgcugaauacuugacaguagucacuggugaugugaauauuuaacacauauagugaugggcaguacauugaaagaucgucuaucugguuugggaaaucacgaguguggguuugaaacugcuagucuugucacaugccugcacuuggggaguuuugugaccaugggacacugucugcuaucucugccucaguuucuucacuuguaaaguuaaaauaauagcauauacuccuggggguuuugagauaaauagaaaguacuuuuucuagggugaguuuaacuguucaucuuaguuuuuaccucuuaccuuugggacuucccaaagaugucauaauuucuccaaacuuacuguguuuaauacaguuggccagaaagaccaacaaauccaacgaggaauuuuacugguuuuaugcuuaaggaacuguugggaacaguuauuugucauuugaaaacaaucaaaggaaagagaacacucuuggugagcugaaaaggagucuuuguauuuucaguuuuguguuuuaauuauuuuugugguuauaguguaaaacauaaguuauagcaacauauccuauauucugugucauccaguguugcccacauguuuucagagaugcucuguccauaugcaaguaaacauguauguguaucguccucuauacaagcaguagcauacuauacaaucugucuugaauucuguccucccuuaccuguuugacacucauuucccaggcuacuuauaaugacuuagcaauugauuuguauaagcauguaaagaccuuuuuaaaaagaucuuuaaauuguauguguauauguguauguuugaguguaugaaugggcacagugucuguaggagcccaaaauggugagaagaggacaucggauccccuggagcugcacuugugagccaccguguggauguuggaacacaaccugggucuucugcaagagcacuuaaccacugggcugucucuccaaccugaaccuuuuuuccuuuuccauuuuuuauuagguauuuagcucauuuacauuuccaaugcuauaccaaaagucccccauacccgcccacuccccuacccacccacucccccuuuuuggcccuggcguuccccuguacuggggcauauaaaguuugcaaguccaaugggccucucuuuccagugauggccgacuaggccaucuuuugaugcauaugcagcuagagucaagagcuccgggguacugguuaguucauaauguuguuccacccauaggguugcagaucucuuuagcuccuugaguacuuucucuagcuccuccaucaaccugaaccuuuuaaaagaagcauguauauagggauauacuuaaauuuauuaaccuuuuaguaagcugauucuauuucuaggucaugcacggccuuuuaaauuguaaugccaccaagcuugguauuaguucaugccuuuaaucccagcacuuggggcaaaggcugcuggaucucuaaauucaaggccagccuuguuuuacaaaguaaguuccagcaagggcuacauaguaaaaccuagucucaaacacaaacuuuauuuaaguaacacucaucugagugaaaaguaauggacuaguuaauaaguggaaguugagguuuaauuuaaacugccuuauuuuuagcuccacuuuauaaaagcuuuaguuaaaagauugagauguacauagcaacaagcaaacuaugaguuuagaaggaaugacuuugcuucauuagaauucuuaccaagcugaacuuucaauuacuauuuugaccaaaaaaagucuuggaaguuuucucuacugguaaaaaacaaaaaaagaaugguuaauuaaauuuagugcaguguuuuguuugagagggagaacggcucuuuucuguuuauuugguuguuugaggagggucuugguguguaaucuagacuauccuagaacucauuauggagcguaggcuggccucagacuugaagucauuuugccuuagcuuguagccuugugaguacugagguuacaguuuuguuuuuuaaacauuucuugguguaauuuaccagugaguuuuguauuucuugcucaaauagaaaacaaguagguuggcacacgucuaucuccugggagucacacuguacugcugccuuuuuuaauuguugaaagcucuuagucagucagcuggacuauguaaaaugcauuucagccccagcacugaacaagucucaguagcucuuuguuucuuucuuggcucuucaaagcagcuuaaagcuauaguagguuuuaaguauacaugcuacagauuuucuaaacagugcaucccccuguuuucuuuuaguuauuaaauaaagcugucacaauagagugaauuguuuguaugguuaaaggcuuaaguugagaaugacaguguuguggucaugcagguugcaguuuuacaagacuacucuuacugcucuuuggagcuuuucuuaguauuauaaauauuaacaugcugcuuuuaccugcugcauaguuaaaggacuacacaaagcauguguauagauuugguaaaaaugggguagauaauugaaguuuauaaaggcaggugacuugcggguauuugcaagcuaucagcaagguacauacaugguuucuugaugucuuugggucuuccuucaguuuaguauuuuguucuaaucauugggguuuguuuguuuguuuguuuuuucuagucugggcuucucuguguucccuaacuguccuggagcuugugcuguauguagaacaggcuggccuugaauucagagaucaccugugucugcuucccagacguugggauuaaaggcauggcugauguagaauaauuguuuuauauacacacagaugcugaguuuauuuuauaaauguggguuuuaaaguuugaaugaggguagccauuucgucuucuccgucacucagauuguauuucuucccuuacuaugagcacacucuugucucagguccugacuuuguuuagcuuauggucucuuuucuuaauucuuccagacuaguucauuuaaaauauauguuauuauuauuuugucuagauuuuugguuaucucuuggguuacccuaaauugccuuucauauucuccuccacuuuaggagaggaacauaaucuguaauuucugcacacauuagauaguccagccaugaaaaauuguucagaacuaaguaccuaauucuugaggcuauuuacauaaauaucaaagcaguaguugggacugaucacgugacucgaugagagcacuugccuaugaugaacaagaccuaaauagaugcaagcaagguuugugaggaggugaucuaggggauuuauagagcuuuuuuuuuucuaaaaggagaaaagauugauacuuugguucaagaagagugagcugagugggaagauaaaauagccacuuccuguuccuggaguaaagggugugucuuaaugcugacuaauacuaguaggaauggaaauuucuuucccaaacauuaauggauccucuuugaaacugagauuuauucaaucgauuguaguuguauccuaauaaccuggugauuugcaugugaaauucugguugugauuaugauauagauguagcaagcaauguuuaauucggcaaggguauaaugaaacauucuccagaaauuuaucccugcuugcuuuagcaauugacaaaaagagacuuggaagucucuuauuuuucaucaccaaaguaauaauuauugcucauuugaagcauuuuuauucuucuuaggguuuuucuuuuuugugugauuuuguuuguuugucuugagacagaaaucuucccuuguggauugguuguccuguaucuaccuaccuccgccuucugugcugggguuaaaagugguaucauuuucuugaaucaauagaagccugcaaauaauaauaguaauauucugcuguucuuuguugcuauuuaucaaccuaauuugaucauggaacauuugaugaucaucaauucaaaguugaugagcaaaucacaagaaaauguauucagguaguuaagaaaauaauuccuagccaggcagugguggugcacgccuuugaucacaguacuugggaggcagaggcaggcggauuucugaguucgaggccagccuggucuacagagugaguuccaggacagccagggcuacacagagaaacccugucuggaaaaaaacaaaaaacaaaacaaaaaaaaaaaaaaaaaaagaaaaaaaauaauuccugaauguuacaugaagauguuuagauguuauaaguaaaaaaaguccaaauaugucucuuacccacaaagaauuugcaguacauacuguaggguauggugaugcaaggacaaguuucugcugucaugaagagcuauagcguuuagaagagaaaagaauucacauggggaacuuggugggaagauagcauucaaauggaguauugaagaauuuguauagguagaaguaaaaagggugugucauagacaguaaaauggaaaaccguaagaggacgacgcugaggugcaaugaacuugauauacacacaaauuggugaagagaauguuagauuagcuacagaucaacacuuuaaggaauccugaauaugaauccucauggcacagguuuaaguuuuauguaaguaguguguguguguguguguguguguguguguguguguguguuuguguuauauguguauaugaacaauacaaugacuaccuuaaaaguguaguuuuuuuuacuuccaguguguuguauuauaaaggacacaauagcuucucuauaaacuuuuuugaaguguuauauauaaucuucccauuugguagguacaguuccaugauuuuuaauguuguuagccaguugugcaucuacugccacagucagcccugggacauauucaccaccucagaaagaaacuaucaccccuuaaacuuccuacacaacagcccaagacaacagcuaaucugcuuugugcuuuauuaauuuguuuuuggacauuucauaugaauaaaagcauacaguguauuaucaucuuagcauaauuuuuucaaaguccaccuauguaguauuuaucaguauuaauuucuguugccaaauaauaguccacauuaugcucaauauuuuacucauucguucauggacacugggcuuuuugauuugaguuauacuaauauaaacauuuucauuucucuuguauagauaucuaggaaagaacguguuggguuguaugcuaacccuguuaaagcuguuuugaggaacugccaggccauuuucuaaaacuacugcacauauuuuauaaggaguguauaaggguuuuaaugccuccauguccucacuaauacuugcuauaaucuaucuuuuccauuauauccauucgugugggugacaaggaagcuauuuugauuuguauuuuccuaacgguaucaggcaucuuuucaaauguguuuauugguccuuuauauaucuuugaaaaauguauuuguuuagauccuuugccuuaccagguacauauauaauuuauauuuuucccucccauuguauagauugucauuuuauguuuuguuuuguuuuguuuuguuuuuuccagacaaguucucacuauauagcucugacuggccuuggauuugcucuguagacuaugccuaccucaagcuuacagagaucugccugcuucuaccucucagguucuagaauuaaacgugugugccaucaugcuugaggcauaaaauuuuucauuuuuauuucugguucaucaauuuuauuuuucuucuguugcuuguacccuuagaaucuuuuucuaaacaucacauuuuuuuucccccaaguaacugaaagcccagcaaacaauagcauugcuuaaugaaaaacaguuaacugaauggaugcaggacuauguucuacuuucuucugcucuucuccauuaaucuguguccuuaugccuuuuuuuuuuuuuuggagugacuuauguaaaaaaaaaaugaaaagaugaaaaaucaagaaauggcaauuuugaauauaacauaauaauugguuauauuuuuuuaguucauuuauggugucagaguaaguauaguguauuacuuauaaacuaccuuacuugggaaauuuauauauaaguuuggaaguuuauauaaacuuagaugugagggaaauuuuagugccuuuguuuguguguuuguuuguuuguuuguuuguuuaaagaagacuaaauugguccuguggacuguaaaugauguacuuacugucauagacugcucguuuuuuggucacauuaucucuguggaaaaaguuuucaaggcucuuguuuuauuaauaacuccuaaaguuugucucuaagcaauaucagcuuuaguuuauaaauagcucacuuggaggugauuauccuaguauaggucauggaaaaugcauuaauuuccuuauuuuauuaaucagaucuuuaucaguagagagguuauacccuccacucccaauuucuuaaauccuagucauuuccaaauggacaugcauacuuuucaauaacuuaccaaacagaaaugcuuguuuagagggaauauuuauagguacccaaguuauaacuauuacauuauacuugucuccuuugauacaauauuucaucucuaacuagauuguaagcucuucaagaggaccgucuuguguguuuuaaucuguuacuuccuggagauccaucgugcaggaaacacagaacauuucuuuagugauuuauucuuuuuagggccauacauuuuaaaggaaggguuagcaguauucuuuuagaguuguacagauuagaggaagcagaaaaaacauguuuacuauaauuuaauugauuuuucuuucccugagacagaguuucucaguguagaccuggccuugaacucagagaugagucugccucugcuuuccaagugcugggauuuaggugugggccgccaggcccagcguaauugcagguuuugucuuuuguuuuuucuuuuuuaaagauaaagaggaaguuuauuuuuauaccuuaaaaaaagucuucugugcuuuggauucccuuucauccuuaugcuuuacacaguggcaucuuccucuggaaccuaagcauagugcugagauuguguugcucagaauaacuucucgagaagucggggucacgguaguaaagaagcgcgccucccucgaaggcuggacuugguguugauuaugucacaaucaaagaaaaaaacacugaauucaaaauaagucuucucaaaacuacacauaaagaacaauauucggucugauacuauauaguggauaugcaugucauucuauauguccagauucagugcgaaguaccaagauaaaccgugaugucaaaaaauaaauacaguaaaaauacauaaagcuuguaucauugucuacaugcuauuuaucaguuuuauagacuauccauggacuguuuuaaguauaaucuguugcaucuuacauuuuucauuugcuggaugacugguaagcaauguauuaaaaugacuugcauauuucuuucuauucuguagagcuuuauuguugacaauacagacaguucuccacuuuuauaauauugaagacagugaggauagcccugaagccuauaaauuccuuacagacuucucagcaucuccaguugucugguuaaaugcagaauauguguucuuugaccuugccuucaugcagucccaccucagggagcugaguuuucacuguuccaugucugacuuguaaauauuucaucaagaauucaagaccuaauucaaaaucacucacacugaugcuuaaacuuacagaccucuuaaaaaaaucuaccaacaacaauaucaaacuguguaggccuucagcguccuuugaauguagucuuacacagucauuuaggauuugcugaccaccucagauagaauacuaaauauuuaacugcaggucauacauaacuuugugguucuuucaguucaggaauugaacuaguuuauaaagcaaaacuuaaagacagcuucacucucuuucagugugaaaacuaguuuuagaaaaguaacuacuuguugaagauguagugcuuuuuauuuuuaagaaaugagcuucuggggcugaagagaugguucaucggcuaagaguacuggaugcucuuccagagguccugaauucaguuuccagcaaucacgugguccacaaccucuaugaugagaucugaugcccucuucuggcaagcaccauauauagacacagaacacucauacauaaauaaaaaaaauuuuuuaaaugaacuucaggguccauuucguagcacuuuacacauaggcauugcgugaaggguuggcuuucuaaaaaggcucaguguagagagcugugugaggugcucaugucugcgaagguaguucacugggaagacguggcauaaaaguguugccaaaaaaagccagugugugguuuguuguguaaaggugcuugcugccaagcuuggugaccugaguucagucccaggaaccugcaugguagaagguaagaauccgcuacauaaguuguccucugaucaccauacucacacaugcacaugauaaauaaaucuuaaaaaaaaauaaggcacuuaauaccaucauaaaagauguauaaauagugcuguguaguugcaauugcuuaccggguagcaggaagcuuguuuuuagaaccauguguagucucaccuuaaagaaaacaaggcaagaaaauguugccaguacuuuaaaaacaagacaaaaaacuuggauuugauaauguuugacaacuuucuuguugaaagaaacuauauaugagauauucauaaaugucauaaguuacacagcguuuacauaaaucacauaacauuuuccuaauuuacucuugcugaauauuugcuuugagaacaguauuuuucuuaagcugugcuauauguuaaaauuuguuaaaacuggcauuccaauaaucugguaauuacaaaauuacaguaaaccauuaaauacugaaauaaacuuucucuguguuaagcaaauaaaucaggagauuuacuaaauaacauugcaguguugcuauuugcuguuuccauuuggaguggugguuagguuacacugguguuuacucauggcacauauugucuaugaaaauaugaaaacugaaaagucuuccuuugcaucuggaauuuacuuuaggauuugugugugcgcaacacauguuugggugcuugcagaggugagaaaugugugucugauuuccugaagcaggaguuacaggcaguuguaaaccaccugaugugggugcuggaaccuaaguuugauuacggaagaguaacaaacacuuuuaacugaugagcugucucuccagccccuagaguucuagucauuacauuacagucaccuugauauuaccuuucuucccccucccccucccccacccccuccccccacccccggguuucucuguauagcccuggcuguccuggaacucacuuuguagaccaggcuguccucgaacucagaaauccgccugccucugccuccagagugcugggauuaaaggcgugugccaccaugcccggcucauauuacauuucuugccuuuguuaucuagaggagagacuuuaaguauagauucauucucuguuugaaaaaggccuuaauaggggcucugaaaauuugagaagagaauuuaauaaacuuaguguagauagcauuuagugaugucauugucuugacuuguucuuucaaaauauacaacauuuccauuuuguuagaacauagucugacuuaaucucagguuuagacaguucggguuaauaaguauuaaauuggguauguauguaggagaugacugaauaugcuguuuucuugucuggauucgaugaaggggugcuauauugaccaccgggagacuauucgcagagauuuggaacauugcucaguuucuguugauuauauacauuucaguucugauagauuagacauacaaaaugucuaauggcaaauauuucaaggugaacaagaaagaacugugcaaggauaagguagagaaguacaggcagugccacaaggucauuggcugugaaacgucugucacacagaacccaagcuuuugucccucgucagugacacuucagaaaaggagcauauauaucagcggugaaaggauggguuggcaaggcuuuuaaacuucacaaaacuaaaaacaaguacaaaagaacuagaaaucacuguaccccauguaaggcuggauauacuucugcagaacuugcacaagcgugugugugugugugugugugugugugugugugugugugugugugucuacaugcaggcaccugcugagaccccauguaaggcuggauauacuucugcagaacuugcacaagcgugugugugugugugugugugugugugugugucuacaugcaggcaccugcugagaccaggggugucagauccuucuggagcuggguuguagcugagugugagugugagcugcuugcuagacauaugacugcuggaaaacagacacagguccucugaaugagagauacacacacacuucaacugcugacucaucucccuaacccuagucaguuuuuaaauuacaugcccaaauaugccuuuugcugaaguugcccuagaaacuucaguucuguuuaugugguugccuuaaauccuuggaauuuuaagcguuaaggaugaacuaagaucuuauucuuaugcugaaaaaucguuuucucauuucuaacagguuauuuucuuuuuaacagacagcauauguuucacuaguuagaaaagcauuucuuugaaauauuaucucauaucuuuguaauaauuaaauuugaauuuaagacuuaaauagccagguuaugaggaguauggauuuguuuugcuuuaagauuuauuucauuuuuaaauaugaaugcaugugagacugggcauguuugugcaggugcuugcagaagccaggaguuagccuuggauccaggggguggaguuucagguuauugugagcugccucuggugggugcugggaauuaaacuuaggugcucuacaggaacaguauacacugaugaaccauauccagccuccugaagauagauuuauuucucaaaaacuuguagagugaugaagaucuuaaggacugagguucuuaagaaaaucagaauauuuuaggaaaaagaaguggaaguauacaaccucccuucacuuggugauuaugaaagugacaguuugacuuucuuugaugagcuuuaauuuucaguuucaugacaauuuguguuaacuugguguagauagauagggagguagugcugccaaauuuauuucugauacagcacacuucuguguaggugcuacuuaggggaauuuaaaugcuagccuguuagacagguucacuggucagccuucauaauacuggcuaguaugucacgcauaauauugccacuguuuguacuaggcuaauuuuccuacacacuuccacccucugacuugguggacauuuuauaugccugcucuuuuguacuguuccugcacagcagaaugaaagcuuuauaaaagaaagauauuuacgguuucacucaauagcuugaaugaugcuuagcauguagagguaaauugaucaacuuuaagacuauuguuaguaaaguauauuaguaaaggaaauuauuuuguugugaauuagcccauugcaauuuuuaaaauucuaaguccaguaacaucaaguguuaugauuuaaaauauauaauuacaugcaugaugggugcgguagugauggcagcuagaggcugacuuuguggugucaguuugguuuucucuuucugccauugagggagcuuccagggauuaaacucagguugcuaggauugcauggcaagcgucuuuaccugcuuagccagucucagcccuagggauuaguuuuuauauuuucauuguucaggauccuacaaauuguuucugauagguaauucuguaccuggauacaacacugggguuaauagaaaaaugaagauccuacacgugaugcuccauacucuguccuucccauacgagcagacaagcagguggaaugggccugcuccaaaugucagcgcaggccaaccggcagaauggugguguaaugucuuuaaggugaaaaccaagaguguuguaguugaguccaagaaccuucucaucugucguaguaaucuuacuagcacuuucuucuuaggaaagacacuauucgugucacugcccauuugguuggcaucuguuuaagguaaaagguaaccauuuaaaacuggcuccuaccuugaauaagggccaguagccaccugacuaaagugguaauaaaacacuagcaguuuaguugaggacccguugcuacuggaaauaccauaguguccagugauagagaggauuaucuagaugcaggaaggggaugugaaaaucauagccauuuucauacauagucugcagcuguaacuacuuaaauuuucuguuccaaaaacucaucaagaagccuuauaccuuaaauuuaaauuaaaaaaaaaaaaaaaaggcaaguagccucaggcuguucucaauagaaacaaggaaugggacccaucuguaggcucccuuugaucaaaugguaaagugaaacuauguguggauggcaacauagguauaaauaaguaaguagacagaauuuugaagagguaugguuuggaagaacgucuuaaaaugaucauuuauauuugucuuuucuuucuuucuuucuuuuuuuuuuuucccuuuuugguauuuugagacaggguuucucuguguagcccuggcuguccuggaacucacuuuguagaccaggcuggccuggaacucagaaauccaccugccucugccucccgagugcugggauuaaaggcaugcaccaccauugccgggccucacaugucauuuucauucaagucaaagguguagauuuguuuugggauagccaacuuguuuuuuaaugguuuggguuuuuuuguuguuguugguuuuuuuuguuuguuuguuuguuuuuuuacguacuauguuucuuuuaaaaaaauuaguauaacugauaugauaauuuuauaaauuuucauaacuacauuauuuguuuuuccuucauuuauaaaaacagaguaaacaguucagccaaaauaaguacuuuuacuuaaaaaagaaaaagugagggggcuggagagauagcucagugguuaagaggacccagguucaauucccagcaccuacauggcagcuuacaacugucuguaacuccaguuucaggggaucugacacucucacacaguuauacaugcagucaaaacaccaaugcauauaaaaaauaauucaguaauuuuuuuuuaaaaagugagguuugagaaaaugucaguggauaucuccaaaucacuguugaaauacaguuuuuguauuggugaauuauugaauuauugcuuaaacuauacaaacacucuugaaucuauguuuccuagaaggaaaauagucuucaaccagugcugauauuaaaggauguaaaaagaguaccagaugaugagacuugccauccuauaaaagauuuuuauagaucccacuuccagcuuaguguuuaauuccccacacccuuuuuguggccacaccuucacacuucuuuuuuaauuauaagugggauuccacuguauuuaaugucauuacauuguagacaggcuucuuuuuacugcauuaauucuuuucauaucccuccuaaaaauaguguuucuaguuuugugguuuuaaaaacaaaagaaaacaaaacaccaaaauucuaucccagauaccuuugaacuacuuuuuuuuuguaaacugccuguugaggguuucauauugacucagaguugcauuuugcacgaucucgugguggucuuggcaguuacuucucccagugccucaugagcuugaugacuguuuuaauacccaugcugacaagucugcugaucuuuuuucuuugucaucuauguuuuauggauacugguauuucuaacuuuuuauauuaauuuuugaaauggcauuuuaucuuaaauuuaaaguauuauaaauaaugacauguuaaauauuggauacauuuaauaguauauaaugauuauaaggaugaaugucuguuuugauuaguuuuagaguuguuugguaaagcauugagauuucucugguuuaugagagaugaguauagauaccacucaugguaaguucaucuugucugguaauauguaggcauugagcuauaagaaggauacacuauagagguauucccuuuuuucuuguccccaaaauuuagaaaggguugcuuccccaguuaucugaaagcuuaguaaaaugugcauuuaacuucugcaccuaggaguucuucucucuugaaucuugcugcugagagguguuagagaacuccacagguaugcaaaacaaggucuuaaaaguucaagaguccaauauugacuuauccagaauuuuacaaucauaaaaaguugcuuugcuucucucuguguguauagguaucguguuguacucugccaugagugaggaguaggacaccaugaccuucgcaguguuugaagucucugauuaggcucuggccauauauuuuccuuuuuaccucugugcccuacuugauuuguccuguuaccaguuaccuucuagggagcagcuuacaguugcucuucuugcucugauaggaagaaaugccuagagggaucugaagccagaccucaggccugacuucacuccugcuuucuacacucuuucugaaccuggcuggugcagcuugggaaaaucagcuuugcugccuccucuggccuccuggcuaguaagggaccaaucaagacagggaccauuccucauuuccuauuaggaagaaacacacagagaagacuuuguauuucuucauuguuuguuuuuguuauuugaaguuacuaagauuuauagcuaaucagauuugagcaaguugaguaaaagaucagcugcauucuguuuuagcuagauuuuuaagugcauuugcuaacuuaaccaccacauagccuauucauaacuugaaguuugccuuuaaagucacucaaguacaaagcacuguagugcucguaacgaucuuccauauuauuguagguaacuaaaugaccauggaaucuggagcagacaaccagcagaguggagaugcugcuguaacagaagcugaaaaucaacaaaugacaguucaagcccagccacagauugccacauuagcccagguauaaaaauacauggagagauuccaagcuguaucucuuuuaagaguaauauguuuccaagagaauuuaauuuuuaauaaacauauacauagaaugaguggaaauuuucuuuaaaauaucagaauuccuguucaguauuagcauuagcuuauguuuagaaaugaaaguaaugauaaauuaacauauuaguaaaauguaucauuaaacauuaauauaauguguguagugacaugauucagaaauaauuacuuuuuuguuaauaaaugaauuggcccucucaaggcaaugaugacaacugccuuguuuuucuuuguuuguuuguuuguuuguuuguuuuuguuauuuuuguuuuaaauaccacacaagcuuauuuugggaccuugaggugcagacgauuugaaagucuaaauuuauauauucuaauacuaaaaugcagagucaaaggucgguguggaacucaguccuaaaggugauaacagccguucuuuccugugcauuuuaaaugcguuagucggauuuuguuuuaagaguccugcccuugccaggugugguggcacacaccuuuaauuccagcacuugggaggcagaugcaggcagauuucugaguucgaggccagccuggucuacagagugaguuccaggacagccagggcuacacagagaaacccugucucagaaagaguccugcccuugaggcugucaucucugugcuugcuuuauuguucauaucuguuuuucuuuauuaacaucuuugcuuaaauauuaguggaaacagugcuuaauauaagaaccaaauaaguguuaaaccugcuaggguaagaaugugguauuuccuucucugauuuuuggacacagaaugucacuguguagcccugaguggccuccaccucagagauccaccuuccucuggauuaaaggugcguaguaccacgccuguguguuuuuaaagugaaggcucccaaagaaaaauaauccuggcaaagcuuugcuuugcuuaucuucaguuucuccaggaguuaaaaaucuccauuggaaguggcuaauuagaauaaguccugggaaauacaggguuaaccacggcuggggugagggugggaaugagucagauacuggagcuccaggccaaauagucagaguaagcaagcugacuguccuuccuccuaagaacagggcuucccugcagaucucacgaguaagacaacaccacauaugcuuggagauaagauauaucagaugagguagcacuuaauaggcuuaguaaaacaggcauggagaaauuggggcacaucugaccauuuagcugagcagucuccuugaugaagacagccuucagcauguugucuauucugguuaccauauucuauccagcuugguuguucccugaguugacuuuauagagucaucuuggaaauucuuuuugcucucauuauuuuuucuuugggaauuuguauucuugaugaaguagaacauguagguagcauaauuuugagaauaaaagauuaacugagauaaaaauucuugguaagauacuuucuuuggaaguuuucuaugguccacuuaguguugcuuacaaauuuuuagaagacuuaauuucuuauaucucacauguuauaaaauaccuuagaucuccucacaaugaauguucauuuuuuuucuuguggaggauggaaacucacacccucuguuuuaggaaauuucuuucaauuaguuguuggugguuuuguuuuucauugucagaauccuugugacccagauguuacgcuucugugacugguuuuguggugguacguuuuuguuuguuucuuccauuuccuuauauuuuccuugcaauuuuucacuuuuugcucuacuuccuaggaauguauucacuccauccugccugcugaauuuuuuuuuuuaaauaaacaguucauuuacaaaacauggguuuguuuuguuucuuuuaagaagcugugcaacuguuuuuuguguuuuguguuuuguuuuguuguuuuagauuuauaacauauacagcauucugccugcacauaucccugcagcacagagagggcaccagaucucauuauagaugauuaugagccaucuuguuacugggaauugaacucaggaccucugggagugcagcuacugcucuuaaccacugagccaucucuccagccccugacugaugaauugcuaucauguuuccaagaguguuauguuuguucccuggguagucuuuugguauuuucuuuuugcuuuguuuuguuuuguuuuuguuguuuuuguuuuucgagacaggguuucuuuguauagcccuggcuguccuggaacucacuuuguguagaccaggcugaccucgaacucagaaauccgccugccuuugccucucgagugcugggauuaaaggcgugugccaccacacccggcugguauuuucauaguauccuguguuuuauaaguauucuguuuauuuucaggaaaagggguuuguuuacggugugguuuucgccuuauucgguacuuauuuugaguuucuauuucucacauggccacauaacucuucaucuucauuuccauuuguuuuaguguccaucuuuccuaguagaggcuuucaccagauucuuaauacucugugaaugucugcucaggauuaaaguagaggaagacuaggagauaggauuguagcuuaaugguagagcauguacuuagcacuuguaaagcccugggcucgugucucaacauuaagugaaucguaggcagauauaaaaugacgaagaagcuacuuugaaagcuuuguguauauaguagcuccaagccaagaacuuaacugcaggacagugguugucuuaacuuuuaguaccuuggaucuugaauuugaucagauccccagagguuucacuaacccucuguuuauauauaaaaggccugagagccaagggaaagaagagggcugggauaucauagugacuuucaguaaaccugguaugacgugguuaagacccauuaucuguguaaugcugcacucuucucucacagcgggccagacuucuuuccugcacggauugaguaaggauucauuuguuuuuaaagagcuuccagugaacccuuuacuuauuuucagcccuucucuucaugcuuccguuugcaguguugcagaccccaaguaccuaucugcauuuguguggugcaagucaggcuuuccuuccuccaagauuggaccaucugugggcagcuuaguuuguuacuguugacccaucuguuccacugccuccuuuccuaguccuugcacuuauuugauugugcauauagaagugaaauuaauuucaugaaauauaacuuggaauccagaagggaacauacucaguuuacuaucaggcagccuuuuagcauagaagacuuagaauggaaugcguaguugaccguggauuuuaagaaagcuuuucuuucuucuugucuaguuacaguuuuacuuuuuaguuacuaucugaguuuuuuuuaacaaaaacaccauacuaauaaaaauuaucuuuuuuuuuugagaguuugauacauguauauaauguauugugucacauguaucaccucuauacucuuuugcucccaccagacuucuucuuuccaagauaccuucuacuuuguugucuucuucuggugguaguggugguggugguggugguggugaugacccacugaguguaauuaugaaugcuuacaugaacgugaguggggaguuacauaacaccuugucaguggcuaucccacugaagacaaugucugucccucuuccaguaaccauuaacugcuaauaguuccuaagagagcuuaugaaauccugccucuauccaugguaggauguuacaggccccaucuuauacauguuuuaugcaggucaucagaguuguuguagcaguuuguuaguguaacagcagugucaugcccagaacucagaguuuaccagcauuccuucccauccucuguuacauuccuuccagcuguucucuuaaaguguucccugagccuugagggagguguauaucauagauguugacacaccuccuguuaauucugacuccagauaauguuugaaugcuaguuuuuaaauacuaggaaaacauuguaaagugaaggcagaaugauugugcuuuugccaaugaauaggaggggaggaagcaaguagugaaggaaagcaacguuaggauuguguaggcuggccucacccgugcugucuccucaguaccacacaggggagaauguuacauccaguaaaucuaagcaaaaaguaaucauaggacuuuauuaagcaauaaagaauuaaacagaaauaaugaacuucuacaauguagcucuauuuuuagacuaugucaagauauuauaauuacccuaaaaccaaaaaaauagguuauggugguguguuguaaaaauugaaugugucugugugucuugagagacaucugucaagcauggcucacuuugaccaggccauaagcuucccagaauaguugugaauauggcccaacaacauuauaauaucaaaagauaggacaucugugauaggagagugcuuaccuagcaggcgggaggacuugaguuuaaucuguggcacagaauaaaaaaagcuagaacacagcaaaaaugccauggugauucugguaguagagacagaugggauuuuuaggcaggccuuaucagacagccuugugagauaacugcuccuugggagucugagcaggaggaccauaaguucaagaucagccugaguagucaagugagacacugucuuaaaauugaaaaaaaggaggauggugauacauuuccauguuagauuacuugucugcuacucacccauacacacacgaaagagggcuuacuuaauacuuuauguuugcuuccugugucuguguaaccuaaauguaaggagcuuugauaaauagcuaggauaauucacuggaguagcuuguuagguuuacccuugaaggaugcagguaagaagucacugauacuguaauugcuucaaauacucaaauagcuuuccuaugaaauuaagaugagacgcucagcucauaauaacuuuauggcugagccuuuuaaaccuaaggaaucagcauucuuaguuuccucuucaauuugucauuacaaacaggacaacaugugcgacucugcagauaguccuugcaccacauuuauagaaccaaguaaaauaaaacaugacugaaaauaggacuaguacagaaggcuuuuguggaugucuaaggaaaggaaacuucuaguuuuaaucuguguguuaaagaucacuugucuucaagaggccuugcuggguagguaugucugcaaacuggcauucaguacuauaccuuucaccucaaccccagcucucccaaacccugucccucuuucauucugucucgucuuuaauuccucucagacagccuuucagaaagcccguggucugccucaggauguucauaugagcugcuucucuuggaccuguccuuaccaccuacuacccuacuucuggcucucaucagccuacccuaacuauauaggcuuucucaugguacaccacuuccacuuuucucugucugaaguguauaucagucauucagccacuaaagugauugaucuaaaaugcaaacauucuauuuaguucagcaguucuuccuauauauucucagaauaaaugaaguuuuauuuuugagacauggccuugaauggcucaggcuggccuuccuuuacagcaauccuucugcccaaauaucuuuaguauuggaauuacaaacaugugacacuuuuacugacuaaaaugcaagauuuuuguuuguauugaaacagggucucacuacaccucugguuugccugaaagucacagagaucuggcuaucugccucccaagugcugggcuuaaacacaugagacaauaggucuggcuugaaagcuuuuuuaaucugacauauagagaggugugggguuuuguuuguuuuaauuauuuuguguaugugaguacacuguugcugucuucagacacaccagaagaggacauuggaucccauuaaagauguuugugagccgccaugugguugcugggaauugaacucaggaccucuggaagagcaaucagugcucuuaacugcugagccaucucuccaggcccauauagggagguguuuauaacuagaccauugaagacuuuuagaaccucuguuacuuuaucucuacuucugacauuagcaaugugugugccuuuccuccauuuuacauacacacacauucacguauacauaugcgugcaucacaugcgcacacacacauagacacacacaaacaggugcacaccuacacacaggucaacuuuuugaaagcagggcccuauaucuuucuccuuuuugugguuuuuauuauaacauugcucucaguacauguguugugguuacuauuuaucaaaugcaaugaaaguuucuuaaauauguuggugcuuaggaacaauaaauacuauuugauagacaugucaguaaacucuuaagaucuggacauugaaucauuaauauugacuucuuugugcuucaagaaaaacuaguuuccuuuuaauauucuuuuagcucugcuccuuuuucauccaaaauuaaaacacuucuuaaaauuccaccuguuaccagauuaguguuuuuugugaaugugaaaaaucgaaauuuuuaauuacaaugcauguaccuucuuguuaaugaaaaaacauacuuuuuuaaaaaguaaaucuuuuucuuucuuucuuuuuaauuaauuaacuuauuuauuuauuauaugaaaguacacuuuagcuguuuucagacacaccagaagagggcaucagauuucauuauggaugguugugagccaccaugugguuccugggauuugaacuuaggaccuuuggaagagcaaucagugcucuuaacagcugagccaucucuccagcccagaaacuuacuuguaauuagucuaaaguagcauacuaaagucuuuauuuagcauguguuguucugaacuuagcaaguccuuguugcccagauuggaaaagcuaagauuuuaaaacaugauuuaacagcaggguguugugaaaacuuuuguacuuaagaccaguagcaugucugucguugaccuugagugaaucagucucuuagcauauuuuugucuuuacguaaauauaauccuuauuacucaaccuuuaaaaagaaggagagaaaauuuggauauaaaaaagcagacagggaaauguagacaccgaaugaaugggguauucauuagcuucagagaaugacuggguugcauguuuugaagcuacaggagauagcuggcucuugguuguuuugcuuugucacuugggaauggcugaaaaguagagaagauuuguaggguuugaacuuuuuuuaagacuaguaaauuguuggcuucuuguacauuguuaaaauauguaucaagcagaacggucauaguuuugcuuauuagaagucacucaacauuaaaccugaguagucccacagaguuuucugugguggucauugcuuucuguguuucuauagguauccaugccagcagcucaugcaacaucaucugcucccacuguaaccuuagugcagcugcccaaugggcagacaguccagguccauggcguuauccaggcggcccagccaucaguuauccagucuccacaaguccaaacaguucagguauguguauaaaaguuuuguauguacuuuaauaacuuguuuauagccauuucugucuccuuucauuaguugugaaaauaaagacacaucuaguuuagauuuauuuuacuugacaguaaaggaguauguuguaucugcauaguucuguuauauguaccaagucagaccucaagaaaauuacuuuuuuuaagcuucaaaagaaaaagcauuuauuuagacagauaaauaguaaauacaugugauaaaggaaauguugggaaagacuguaggacugauguaaccuuagugcagcugcccaaugggcagacaguccagguccauggcguuauccaggcggcccagccaucaguuauccagucuccacaaguccaaacaguucagguauguguauaaaaguuuuguauguacuuuaauaacuuguuuauagccauuucugucuccuuucauuaguugugaaaauaaagacacaucuaguuuagauuuauuuuacuugacaguaaaggaguauguuguaucugcauaguucuguuauauguaccaagucagaccucaagaaaauuacuuuuuuuaagcuucaaaagaaaaagcauuuauuuagacagauaaauaguaaauacaugugauaaaggaaauguugggaaagacuguaggacugauguaccucaauuaaggaaaauuaacuuaaaaugaaccuaaguuuguauggggaaaggguugauaaaaauuaauuaauagccuuaccugagauagaauuuguacuuagagaucacaucagacaucauauugucuguugagcuuuuagguagaguauguaacucugaaauaauacuauauucagaagguacaucauaaggaucauugauuguaucacauauaucugauucuuuggagagcuugcuucuuugggguuuugggaauaaaggcauucugaaggugacuacuuagaucuagggaccaagagcaguaacaggauaauucuuuaccaaucagcuaauugaaggaaaaaaacaaagacugaacauucaugcaaguaggccauaaccccagccucccguuucauauuuuuuuacuucacagucuuccuguaaggacuuaaaaagacuuuucuccggaacucaggugaguccuagguccuagauuugaagaaaguuauuuuuagaaaggaaggugagaaauuauuuacgucuuuuguccuucucugugaacauggaguuuugggguuugagucaaagucuacaccuccguuguacugcucacugcauaguuacugcucaggucucuguaacagcucuccucccccagaacugcaugaaugccuugagaaaaggaagcugaaccuccugaggucuagacaauuagacaugaagccuaacugcuggcauacugugugacuagccagaguauacuuucuaaaauugggaccugguaaccccaagaacucagcaaaucucacucauuucugucagacuucuuccuuucccuucuuuccccacacccuucccacuguacagcaaguuuucuagauucaacaagcuucuauuuuucuaaagcacuuauuauaugguguauguugauuucucuugcccagccuuggcuguuucugcuguguuuuccuuguaugguagccagaacugauuaguauuuuugcaaaggggaaaggugcuuccuccuuuguccaggaaccauucuguuauuguuaucaaagcccacauaagguucauuagcgguuucuucccuuugggcuucugauuugcuguaacauuuacaggguagaaaacuguuacgugaaauccugguuacuaguuucccgaagaugcugggaauggacauuauuaacaagccuugacaguauuagccagauuaaggccuauuuuugagaaaccacagugauaaguaguccugugacuuaguuuguauuucaugaaaugccaccuugccaaucuccauaugaucuuagcauuaguaccgucccugaauucuucucuagggcuuaccugcuagucaagaguuuuagagaucagaccuacuuuggauaguaauaggucaagugaugguaagcacaaauggcccuuacuuucucuuuuucacuuacagaaaguuuuuguuauuaaaaaauaaaguuaagcuacaaaauacauauuauaggauuugggguuuguuuguuuguuuguuuguuuguuuguuuguuugagacaggguuucucuguguagcccuggcuguccuggaacucacuuuguagaccaggcuggccucgaacucagaaauccaccugccucugccucccaagugcugggauuaaaggcgugcgccaccacagcccagcccauauuacaguuuuuaauuaauaaaacaugauauuuaauuguugccuguauucuuauuuuuaaucuuaucuuggggcaaaauaauuugaacucaaguauuaaauguccuuaacuuugauagaaaucuguguuugucuuuuuaagaauacauuuuuaucacagugagcuauguuuauaacuuuaaaaaaacauguuugaaaaagaaaacuggcuccuugaagccuggacuauauggagauguaaauguguuucuuuugcauuaaacacucuacaccggaagaauguguuaaacuuugaugguuacuugagccagccaacagugguuaguuuuaauaacuaggaaguagugguuuacaauagcuuaucaaacaggguggaaguaucccucaaacuucuagaugguagaaugauagcguuauauauaaaguuuccaaaauagacaagguaugacucuccuaauggaagaguaggaauaguaggacaucgcuugauauauuucaauauaguaauauuggagacuguacuaauauuuuauguacagcuucacuuuauaauucuuacguguauaaaucacaucucauaggugacaugagaauucuugcaaaaugacagcaguuucacaguguauauaggguuaguaguggcacuuaccaauuugggccacauuucaauauagugcugucuaaauguaccagaaaggauucauagauuuuuaugaguguaaauuauuacauccauuucuucaacaaauguuuauugaugacaugcuaugugccagucauuguucuaggugcuaucaaaggcagcagugaacaaacaguacaucucuguucucaugaagaucacauuugagugaagagagacauacuaugagaaaauaaaauaugucaggugaggauaagugcugcagaguuaaucaaacaggggaaaggguagggcaagaugcaaagggaagugugcuggaacucauugacggugguugggcaguacagugagcagaaaccagacagcaggagagggagcuaagccaagccaaagauguggaaaugaggauguuugugauuugaaagaguagcauguuccugcugguuaaagugagugagaaggggaaggaaaacgauggagacucccucaguguugauagacucgucaaugauaugauggagacagugguaaagccuucuacaacauagguagugguuccguucucuggcuaucauauagcaucgcugugucugaauuaagaaugaguaguggguuuggggaccugggggguugggagggauauuugguuuuuguuuugcuagcccaagacaaguguuccaaaauuucugaucuuggugauggcaagcaagggcuuugagggauauuuuaccuaauagaaaucccuuuguacuaucuuuguggggagggggcauuagccacaagugaaaggauuauuaguuauaagaaauugucgagagaaauuugaaaaugcuuucuuaacuuuuuccaugguaaacaguguaaguuuaucugcuuuaagucuuagaguuuccucaguuguaucacugucagccuuaguggagguuuauauacuaagaucuuguugcaaaaaaggaaaaaaaguaucuucuuacuggagugcaauauguaaaugaaaauaauuauuuucuaagcacagcuaaaaggcacuuuuuuuuuguuaaucucuacauuuagaguucucuuuuaaauugguagauauccagccacauuuccaaaaauguagaccuaggcaggcaggguauuacuguauagguagcccucaaagucuuugccucagugcugggauuaaaggcaugugccuccauacuugacuugaaucaccguugaaagauguuaaugaucuuuuggguuuuccagaugggcuuucucuguguagccuuagcugucccagaacuagcucuguagaccaagcugccucuaacccaaauaacgcuuucuucuaccuccugagugaugggauuaaagauguauccacuaucuaccuccugagugauggguguaaagaugucaccacuggcuguuagugaucuuuuaaugaaguacauuuaaugacauuguucuuacuguuagugaaaaacuuaauucuacuugaauaauuuauuuauuuagccuauccuaagaacuuuuaaaauaaauaacauuuaaaauuuacaaauaaacauauauguccacgugaaauuuuuuuauuugucugcaugugugccuguacaagaugugcaugccugguaccuguugaugccagaaggaagguauccugaagacuggauuagaaaugguugugagcuuccauguaggugcugggaauuaaacucaggauuuguaagaccagcugguguuuuuuuuguuuuguuguuuuguuguugguggugguguuguuuguuuuuugguuuugguuuuucaagacaggguuucucuguauagcccuggcuggccucgaacucagaaauccgccugucucugccucugaagugcugggauuaaaggcaugugccaccacaccuggccccagcugguguuauuaucugagccauuucuccaacccccaguuuucuuaauguaagggagauagcagaucaaguuuuaagauccggccuuauuuugauccauugaguaaaaaguuaucuaaaccagccaagcaaaacacuuaaguuugcaaaggauuguauaguuuuaauaauguuuuagcauuucuuaauuucuagucacuguuugguucuguuaaaauuucaaauuauaaaaauaaguaaugauuuggguuuuggcaauguccagacuguuacaaagagccaaagguaaaaaccuguuuaaggaauuuggggagauagacauuaagagacguggcaggaggugugaggacugggggggggggguguuacuggaaugugauaauuaugaaaccuauauuagguuuuuaauuuuacaugauuacuuuuaauuucuuacacuuaugaaguuauaaaauugaauuuugauauuuuuauuaguguaaaaagcauguauccuguauaauuuuuuaagacuucauuuuucaagagcagcuugauucacagcaaaauugagaguuaaagaguuuucccauguauuccuggcccccacauguguagcuucuuccauguuaacaccccuauaccagauugcuacauuuguuagagcugcugcaucauaaccauccaagcccaaguguaaaaugauacacaggcucucaguguugguaugcuucauagccaugugguuuggauuuuucauuuuaguuaauacuuucuguuugaaaagacaaaaucuuuuagauuagagaaaggccacaaagucuacugaguugguguaggaaacaaaguugcaacuaaaaaagcagaauuuuauuucaaaacuaaucuguacuuuauuucuuuauauauuuugauuuuuguuguuguugaaacauaaagcccaaguugacuuuggacuuacuguauggcauguauaaccuugaacuacuaauccuucugucuccaccucccaggugcuacguuuguaggcauaaggcaccauacuuucuugguccugagaaucaaacccaggguuuuguucauguuaaacaaacacucuaccaacugagcuacauccccaagcccaguauguaaggaacuagcucauagagcuugcuuuauugaguuucaacaugaaugagguauuccucugucaguguguauccuuaagaucuugauaguuguuaagaguagggcauggcaguacauagcuauugcuccagcauuuagaagcaagacuaggaggucugucugucugaggccagccuagcugaccaggaaagacucucugccucuucuuuccccuagggaaaaauauuaagaugguuguaaggaugggggauaucauaugugagagucaaagguagaaagccaaaggggaagaaagauuagccaaaauaaguacauuugccauaguggugccuacuaugaauguauuuauuggcuauugacuuuuucuuguucuggguuuuuuguuugguuuuuuuguuuuuuuguuuuccuagcuucugaucuucucuuuauccguaagaacauuuguauagagacacuagagugggcuagguauagcagcuagagcauuccuuauuuuucucugcaaugagcauauacaucauacagcacugucaaaagacaugaguguccaccuugagcuuaaguccuugagcuuagauugcauguggaauuccuuuggaauuucucaaauuugucugaauaugguuuuacauguugcuguuguugacuauuuugaggcaaugcuaacacacacucuuguauuguuuaagacacuaccgagaaguagugugacagcaucaugucacauggaggaaagcacaugagacuuauaguauaggcuagaaaaacuuggucauauaaauuuuacagauuuggaguccagagugaucuaaagugcugugagcuuguugcuaugacagcacugacacugggaccaccaggauuuuaaugcguguaaaguggaagugcugagugcagcaaaggccacacuccuuagcuuugcggccccauagaguugucuauccugcuugugccuuagcucuucuaucuucuucaaugaacauaagaccaauggacucaucugguaccugauacuuaugaaauaauggcaccacccacaauggacuggaccuuaccccaucaaucacuaauaagaaaauguccuacaggcuggucugcagccagaucuuacagagaaguauuuucucaauugaggcuuccaccucucugauaacucuagcuugugucagguugacauaaaacuagccaauagucuacuacuugguaaagaaucacuaacuuacuuauacaacuguaaaucuguguuugcacaacaguuacaggaaaucauauuauuauuauagacucauaacucaugucggaauccuuauuuuucuuggcaguucuguucuaacaacugcaagaaaucacugcuguggugauauauuuaggauugauugcuugguagaaauuaaaaacauuuucuggacaaacauuuuuguuuccauggcaucauguuagucuguaggagaugaaucuuaguggugugguugucuccguuaaaaacugaaguguguauaagauuuauauauacaucuuguguuggacuuaaauauuuuaugggaacuaaauuugauaaauuugauaaucaagauaaaguuauucuuugcuuucagauuucaacuauugcagaaagugaagauucacaggagucuguggauaguguaacugauucccaaaaacgaagggaaauccuuucaaggaggccuuccuacagguaugugauuuaauaguuacagucagagacgugcaggaagacuuaguacuuggcagguagagaugucagacaccaauaaagcugguccagaaaguacuuugcauauuauuucucuugaguuacuucucaaauaagcugauguuuauaguacaaaauaagacuauuacucuaaacuagugguucucaaaccugugguuugcgaucccugaaaaccauuggaaaaacagguuacuuacauuaugauucauaguaguggaaaauuauaguuacaaaguaacaacgaaaauaauuuucuaggugagggucagcacacuaugaggaacuguguuaaggguuaggagauugggaagcacugcucuggcagcuguaggacauuucccuccuguuuuuguagcugugcagacuguugcucucccuuuaaaaagcuuggguuaccuuugaguguuagcaucguucuuggugcacuguugaucugcuuaguuacacauuuauaggcgauuuuuaugucaugguccuuagcaaacagcuguauuuaauaguuuucaggguaauucuuugcuaacauccucaaguuugagugcaacugugauguuaccuaccuagucuaugccuugccucaaaagaaggucaaaaccaauuacuacaauauaucaauugguuccauguuaaguauaucaagaaacaacauuaucuauuaaucucaugcuuacuuaagaauucccuuaacagaguuaacagagacaaaguuuggagcugagacaaaaggauggacaaucuagagacugccauaucugggcauccaucccauaauuagccuccaaacgaugacaccauugcauacacuagcaagauuuugcugaaaggacccugauauagcugucucuugugagacuaugcagggccuagcaaacacauaaguagaugcucacagucagcuauuggauggaucacagggcccccaauggaggagcuagagaaaguacccaaggagcuaaagagaucugcaacccuguaggugcaacaacauuaugaacuaaccaguaccccggagcucuugacucuagcugcauauguaucagaagauggccuagucggccaucacuggaaagagaggcccauuggacuugcaaaguuuauaugccccaguacaggggaaugccagggccaaaaaagggaauggguggguagggaaaugggggggaggguaugagggacuuuugggguagcauucuaaauguaauugaggaaaauacguaauaauaaaaaauaaaaaagaaaagaauuccguuaacuucagaauuuuacaguaaccuucuguguuaguuuaaauuaugccuauuuauguacauuucuauucauuauuuguuuuuagauuuauuuuguuuuauguuaauggauguuuugucugcauaugucuguacaccaguugugugcauagugccaacaaaggucagaagauguuggauccccuagaacugaguuacccaugguugugaaucacucuggaugcugggaaucaaaacaggccuuauaauagagcagccagugcucuuaaccucugagccgucuaucuagccuuacuccuuuuuuuaaaaaguaguugauugccuuaucucccuccauguacuuacuuagaguuacuacuaagcucuuuuucaauccucauccaauuauaaauuccaaauauuauuaguuaauuaauuuugagguccuaagaaauuuuauguuguaagauauauauuauaggcauuuauauguauagucuuuacuauuuguuuuauuuugugugugugaguauuuguauuucuguacaccaugugcaugacguaccugcagaggcuagaagugaugucaggcccucuaguacuagaguuagaaacagugugagcugcuucucuuuuguuuucaauauagcauguguuagaucuugagacauugaaguauaucuuauguuaguauguaauaccuuugauccugaagcaaauccaacaaaguauuaagaagcaagucacaugacuucuccuaaauccuaagcaaaucauagcugccagauggcuccagcagauaaacaugcugaugcaagcuuggugaccugagucucagccacauaaggcuggaaggcaagaaccaaguccaccaaauuguucuaugaccuccacacagggaccuccuacuacauucacacuuaaacaaacaaacagacaaaacccacacaaaggccagcuuuauguuugucuuaauauuucucuggccaaaauccuagcaaaaguuauuuaaaucaaccaugcuuuacuaaugaaaggaaagcucucuaaagaaagcauggagagaaaggguuauaaaggguacuguuaccuuaccuuagaguuaaaccuucacacugagauacuauuuauaugaagguuaugaauuccugaaauguagccuuuauaucuaucuagauuauaacaagcuauuuaacagaugcuuauaguaugcuugcaagguuagaaaaaugaaauugauugauuauacaaaauagguuaaagcaguuaauuuguauacagcagaaaggugcuccauuuugucucuuguggcuugauauuuucaccaguaauuguucugaaaaaauagaagccaugcauaucagauuugcaaaugauagaaccaucaggcuuaauaaagugcccuggugcuaggagcaugagugccuugaaaggucacagcaggcaaaggaaaugggcuggaaaaauaaggugaaacuguaaugacaacuguaaagucucugagacagcuuacaaaauaaacaaguuguucaaauaucugauucuggauuuauugaugaagaaguaaaguuauuuauuuuuaucagccaauauaaucuagagcaaaaagaacuaaagugugaauaaugucuuagcuguggguuuggauucucaugcaaaggggagcuagauuagauugugagacuaaauugaugauguuuaaacuuccaacgauaauccuaaauaaggaauauuucuucauguuauaauagcgccaggcauacaagguauguaacuguaaucccaguacuggugaggcuaaggcaggaggauugugaucuucccaaccugagauucauaauaagacacugucuggacagugguggcacacgacuuuaaucccagcacucuggaggcagaggcaggcggauuucugaguuccaggacagccagggcuacacagagaaaaaaaaacaaaaaaaaagccagguggugguggugcaugccuuuuaucucagcacuuaggaagcagagaggcagaucucuugaauuugggcuagccuguucuauacagggugacaaggugaguuucagaauaaccagggccacacagagaaacccugucuuggaaaaaaccaaacauacauacauucauacguauguaugugcauauauguauacacauagacacauggcuugugaaggcuggagugaguaaggggagauggucuaaaggacccagauucaauccccaggucacauaguaucucacaaccaucuggaacucuagucuaagauacacaguggccucuucuggccucugcaggcaccaggcaugugcagauaaaacacccaaacacaucacaaaaaauaaaauaaacauauguaguuuuauuuuuuauacugccccaccaccaccaccaccaccacgcaauucuugcauuugaaguuccugcuuuguuuggaguuuauucauguguuugaauuuuuguccuauacguuaguaguuuucuaaucucuauuuguacuuagugaauuuuuuuaaaauuaaaauagcucuuuauuuuucuaggaaaauuuugaaugacuuaucuucugaugcaccaggggugccaaggauugaagaagaaaagucagaagaggagacuucagccccugccaucaccacuguaacagugccaacccccauuuaccaaacuagcagugggcaguacagugaguaauacauuuuucuauuaugaaaagugagaaggaaaacuguuagagucucuuuaagaaagugauaaaugccaaggcuuuugcugccaauauuguuugcccuacugucagacauuauuaaagaauuguuaagaggcauuuauuggaaaugucacuuuuuuuuucuuuuauccuaucuucccuuucgccaugucucuuacaugauucaugcacaaauuacuauuuuuaauuuuagaaugauguuggcuugccagccuguaauuuguauuccagcuguauuuaaaguagauuccuaaaggaaaauuuuuagcuuuuccaacacugaaacuuuuaguauuauuuauaagggaggggguuuuuuuuguuguuuuuuuuuuuuuuuuuaagauuugcuauuuuuauucaugcgugugugugcugcaugaguuuauaugcaucaccugugugcagcaguucugggaaaccuuuggaucaaauccuuugaaacuagagugacagacacuugugagccaccuaauaugggugcggggaaccaagccuaaguacccuagaggauuaagcauucuuagccaccacgucaucggucugaaccguaaggauggugcuuuugauaaacugccuuuacuaucugugauaacugagcuaaauaagcuuagauagauuuuuuuuuccuuaaauuauugguggcuguaaaaagguauaucuuccucacccugccugugugugucuguguguguguuuaguuugagcuaauuucauuuccaguuuaaguguucaagaugguucuuuucugacauuguacaagacuucuuuuuccaccagcaugaacauacugaggguauaucauauuccuguccuaacuuacuaccucggggauucuuacuugaacuagaaaagaugauuuuuagaaaagacauacaggagcugacugggagaaguauuagauuacuaccauccccuuagauacuuuaguuuaaauguacuauacuuugagauuuuucucuaaaccuuuauucauuuauauacugccccuuugguacaugcaugugugccuuuaaugaaacugguuuagcauuguguucuugauuuuucuuuuccacuaagaaacaacauaaugaauacucacauguauggcaaacuacuuauuuuuguaacuuauuuauuuguaauuuuuaaaaaaauuuauguguaugauagcuuugucugcauguauaucaacaccacauguaugugguaccuguaaaagguagaagagggcguuggauuccucugauacugaaguuacaggugguuguuagccaccaugcugaugcugggaauugaaucugggucuuuuggaagaguagucagugcucuuaaccuuuaaucaucucuacagcccuguauuuuguaacuuguaaaguuaacaugguuaccaaacuugaaggguuggauuuauaauauccauaaacuguaaaccucuuucagccuuucccaugaggaaggauuguauauaucucuccucucucauucuauuuuucaauaagcuguccuguacagauucucagcuaauacaguuuaauuguauuuagauuauuaaaguuaaaauuuuacguaauuauauuuccuuguucauauuucucaguaguaauuuaauuaaaccuagagauaauaauuuucuuaaugaauuugguuuugucaaaacugucuuauacuuuuaaagugaucaaauggacagguaaauauugcauaguuaaagacauguuuaaaucuuagaugagacgaauauauucaaagaaucgucauuuguguguguguuagacaccuuauuuaguguuuaaaacaacuaugcaucuguuauguaagagcagauguuuuuagauuuccaggaaaauuacaaagucgaaugaucuuaacagaguagcccauaucuuuucuuguguaguuuuuuccuuccauucacuuugagccuguuacuguguaaucaagaaaaaaguagaguguugauuaaaugaagagguuuuguuaaccuucugauucuuuaaaguacccuuccccacccucuugguguauuguuacuuuauaugcguggauguuuuccuugugcaccacaugugugcagcgccugcaaaggccaaaagaggguguccaguccccuggaacuagcugcacauggcuaugagccucccugucggugcugggaauagaaagagcagccacgucuccaggucuucccaaguaaucuuacagaauuaguuguagaacaauucuuagacauuuuuuuaacaucuaagauaaaaaaaaucugugauuagcuaacauaggaggauuauauaugcuaguauguuaauuuccacaaauuuaucaccuugauaaagugacuaaauaauaaugcucuugauugaacagugaauuaucaauuuucuguguacacaccacucaggaugguauaauuccccagaucucacugauacucccaaacuaauucacuucuguuagacaguaacaucauuagauacauugauaccacacuuuuuaaacuuuccuuuuaaugcaauuauaauccauuauggagagcugggaacaaaccucaaucaauggagugcauuccuacugugagugaaaguuuuauucucaauacucacccaugcauauacacacacauacacacuuuaugaaauugcucagguaaaauuaacaauuuuuagucuuuuuuuggaaaacgugauccuuagauuuaucugagaagucaaucauauuuucaguucuaguaucuaaagauuauguauugcaaacaagguaagaacuuaccuuucaagucacuuuuccuguguacuguuguauaagggugacuugugugaguauugauuaauuuucauuugccagauaguagcuagugugcuuacucaucagucaguagaaggcucugugaagacccagacauggagcuuagaacaagaugaggugcaucuagcugagggucuuggaucugaguuuaaacuugaugagacacacauaguaacugagauccaggguauuuccugucuuucuugaugagauuuuugguggagaugguggaugguaggugcuagagacugaacccagggccuugcacauuaauguauuacugauuccucuuuuucuuuucuuaaauaugacuaauuuccuggauuuauuuugagaugcugucuuacuguguuucccaggcuagucuuaaacuccuagcucagugauuuuuuuguuguuguuguuguugcuuuagcccccugagaaguaucaugcuuucacauggcugucuaaguacacuacugacagaguuuauaaauuguuuuaagaguuagaaaauauaauucacugacagauggcuuuauuaaauacacuuuuaacaaauauuuauugggugcuucuuauauuaauuaauuaguuuucuaccaaaaaauguauuuacaauuaaagcagcagauaguaaaaauaucugagggaguuuccagugcuguaaaggaaaguguuguuguaaagcaugcccuccuuggaguuuaaauaaguucaaaaagaguuuguguuuucacuuuuuauauuguuaccaugcauuauuuauuauaguacaauucauagaguauauuucucucauagaaauuggauaugguuuccuggguacacgguuacuugaauauaccaaguuuuucuuggugauauuauuuucuagaauaauuucuccuagauuaugcuuugcuaauugcauggguuuaguguauuuuaaaagucuugugugguaugaauuaaacuuguaacaauaaaauucauuggguuuuaguugccauuacccagggaggagcaauacagcuggcuaacaaugguacggaugggguacagggccugcagacauuaaccaugaccaaugcagcugccacucagccggguacuaccauucuacaguaugcacagaccacugauggacagcagauucuagugcccagcaaccaaguuguuguucaagguaauagaauuaagaauucauacauaugguacauucuuuuaaaaauuaauguguauacucaugaaaaguaaguauauuacaaagcacuacuaaaauaguuuucuucaguauagauuuagauauuaacaguuuagauaugcauguauuuaauacauaaauaucucucaugcaacuuuccacucagaugaaaaugucauggcauaaaaacaacuaucuuuuagcuuaaaagggguuuuuccugucuuuaaugccuucaguagucaggauuggaagaaccaaaauauguuagaagagaacugaggaaguuauagccaggcugaauggccucaaguaacacuagcuccccugggccccuuucuuucccuccucugugugcuaugucacuauuaaagaguucuaguggauucugcuguuuuaucuguuuugucuuguuuuuauuauuuuuaauuuaaaaggaauauagagcuuuucugaagucaucaauuuggauuuuggauaagaacaagcaucauuaugcagauccuugcucauuggagaacaaguuguccuuuagccucgguggacgagaggauuuuguuuuguuuuguuuuguuuuguuucccaaaauuucaagagucuggagaguguuaacuauucagcauuaauucacugagcaguucauaguucaauauuaccagauuaaaaauuuauagauuaaaaaaauaauauuugcuucuaaaaauauuuuauuaauaauaacuaauguugccuguguuaaugagaguuauaucccuucaccauggauaauuacuuuuggaucauaccacaacaccaaguagaacaucuuuuguuuaacaaugucuaauaaauuuauacuauauaucuuguuauuagaccaaugauauuuaaaaaauauuuugcuuauuagugggaguaaaacaccuuuucacuuuacaugcagguacucaaaaaauuguaaagcaggaugucagugaauuugaauucucaacgucaguuugaauaugguaacauguuuaguauauaaaucuuugucccucaaacgauacaaucgguguuuuuaacugauaugaaugauuuuauaaagacauucaaaaucucucacauaguauuaggguacuuaugaaagcauaucaugacacuguuucuagaagcaaauaauggacaaauagugauuuuuuuuuucacauauggagauuguauggugaggaaaacccaaacuacacgccuuuaauuccagcacuugggaggcagaggcagaggcagguggaucucuugaauucuaagccagccuggucuacauaaugaguucuagacagccagggcuacauaguaagucccugucuuagaaaacugaaaugaaaacaauucagcuuuuacuuacuuaguuuuagucacuuauauuaagauauguuuacauauaccaugauuggcagcaaauguccaguuuuucauacuuggaguuuuguuugaauuagaaauuuauaacaguuucuauaugcuuauuuuuuuucuucuauuuugcuauuuuaugaaaaaucauggucguuuuuaugucguggcaagagucuacuugaguuuuuuggguuuuguuuuaaaugugaauuuauguaaagcaagggaagauacugaggccugugugggaggacaucucugcucagcuccuuuagacuuaaagcugacaagcaugcaaaccacagacugcaucucccucccagcacaacaugaauaagacccgcagggacgcugaggcacccugccccguaccuguacuaauaaauaggacagacaauuggagucuucuucuuagauagagucccauucccuguuucccuuuuaaucuaaguauguuuagauugauugagacacaguugaauuaaauuguaguguuucugugucuuauaccuuguucgcucuucucugcagcugccucaggcgauguacaaacauaccagauccgcacagcacccacgagcaccauugccccuggaguuguuauggcguccuccccagcacuuccuacacagccugcugaagaagcagcacggaagagagagguccgucuaaugaagaacagguacagauuccaaacacuuaaaugcuaugggucaaguaugucuauaaacucuucugugugugccuuuacaucugcuaacaguagguucugugcauugauuuucuuuuucugguagaauuaguggaucuugcuaaagcuucuuuguuuauuaaguugcauuuauaagauggcuaauggaacuuuaggucagucuucaaucaaaaaaguaauuuuucuucauaguuuuuccacaagagaaauacauagcuuuaaugaauuuguacuuuauucuagcuaauaggauauguuaauuaaaaaaauuuguaaguaauauucaucaaagugucacauauguauacuaacauuagacucuaguuuauuugcauuaaauuuauuuauaacaaguauacaguagccauuuuuguuuuaaugaauacuuucuuuugcauuuuuauacacuuacagauuuauuuaugcauguuuuaugcauaugugucaaugccuacauguauguauauguaccacauucauaccacaaagggcagaagaaugcauuagaucucuuggaacuagagugagagggguuggucagccaccugccuuguucuuuguuuggggucagagucuugcugugugggccaaaguugccuggagcucuuauccucccgccucugggagugagugcuggaaucacaaccuugggccuggccuuaggggcaggggcuuucuuuacucaguaauaacuuaacauccaaacacuuuuaaaacagagaaauucuaaaaaguaugguauucccgacaaagccuuaaugcacaguuaauguuagucuuaagaaguuaaagugguacagaagagaagcuauaaaacacagguaaagccuuucuuagaaauuuauuugcuuucaaauguuuuugccaucuuaaaaaaaaggaaguuauuaauguggaaaugaucaaaacaaaacaaaacaaauggucugaggaggccaucguugguuaauguguucaccauccaagcaagaacacuggaguucagauccccagaacccauauaaaauucuugguagggcccuguaauuccucugauggcacaggugggguuuucaggguaagcuugucuguaagcucuggguugaagaaaccaugacucaagaguaagcgaaaaagcaacauuagggaagauagccugcacacacauaaaacaugugaguaaacaucaaggggcuauaaugggggagggaggugaaaacuaaaagagaaucaagguguauagagauguaaacuauuuaaauucuucuuuuuaccccaagaguguaagaacuaugauaaaguaaaugagacagaaauugaacuuagcagaucuaacuucaauuccugcauucacccuuuagcuaugacucuggaagaauacauuaauuuccuaaacuuggguuucuaccuuugaguaaaauaagaucucuccuugcacccaaagcuuggcucucagggucagguaagacagcacauggcaucucuacugcuccuucucuuccaacaauuuuauuuuugguaggucagcaucauuguuccugaaauagucuuaacugucacagucuuaguaaauuauaucuagcuaugaaaaaggagaaacccauucugagauaguaagggaaucuugaaaagaagcccugugaccuuuauugugcaccaaacuguagucuccccucccccagccugaaaccugcuugcucagggguggagcuucccacucaaucguucugccacgcccacugcuggaccugcggcuuugcuguuuggagccgugcacguggucacccugcuauuugaccccaagacuaauuggcgggaaucgggcccccuuccccugcuucauaacugcguguagaacaguaaaauagaacuuugaucagaaugccugucuuagcugcauuucuuuaucucgccaccuaguccucuucucuuccagguuuccaaaaugccuuuccaggcuagaacccauguugugaucugcuggccggacacaacaccaaacaacuauaaguaguuaagauauaauagaaauguacugccuaacucuuauuuaaauguuauuuggaaauacgaauuaaguuacacauuaaucuguucaguuuuaaaguauuuguuaagaaauaguugaccuuuucuaaaauaagaaagaaugguguuuaagaugucucaaguaaagaucuaauuguaaaauuucagacagcagcacuuacuaaagaaacaauucuaaggggacagaguaaucagaauguuuuuuaaggacuugaaaucauggcugcauacuuuggcucuguagagugaaggcucaucucuuacagagaaccucagagaggugugggaccaugugcaggggcagcaccagcuccuuucuuccucccuuccuugcaguacuggggauuguccugagggccuguucauaguagacaggcgcccuaccacugauuuagacucaacccagccuuuuuacaauuuuuaaaacuuccagacaggguguugcuguuacccagguugaucugaauucacucugagauccgguggcacauuacccaucccuaccucaucucuggaauccugaagcaaagcuuaguuucaauaaaaaagagccaggcuacuuuuuccagucuuucugucucagcuuccugaguagcugagauuacaaccugugccagccaagccuacucauauuacaccuucuuagcugcccagagcauugccugcuuauaaacacuuguuagguuuaccaguaggcacaaugcugcuuuuucuccacuucucaguguucugaaagucacucugacagaauccccgagaaaccaacuuaaagaagaaaaguuuuaaaagacgcucaguuucagcacuccaugguuacugggcaccauugauuuuggucucauggugaggcagaacaucauggccaggagccugcaguggaacagaguggcucacguuuuagcagacuagaggcagagaaagaaaaacaugucuggagagacugguaguggaucucacacaauggaaagaaaguaacucuccaaaauuguccucuguuccccuucugugugcuuuggggugugugugugugugugugugugugagugugaguguguguguguucccccuaguuaucuucccuggacacacaaaaauaaguaaauguaaaagguugguaauguaggaaugauagacaacacucaucgaccucugguuuccacaagcauauguaccuguacagaccugcacauuacacaagcuuagaccacacugauaggaaugagugaauguaaguuguuuuuaagugauuggaaauuauggccuagucuucaagggcauaacuuauugacccacuucucuucagcuaaguucuaucucccaaguuuuccgauaccuuccuaugcaauugugaacguauccauggauuaacccguaagugaggcgaagguccucauaacucacaacauugcuuuuauucauagccaagccuuuucaggaacacuccauugaaaccauaggccacucuacuacugucacuaccuccaaaccacaccagguuaggaaggcaggucauuuuuuuuuuuuaaucauaaucuucucagaugguuuauuuuugcuuggaaacaucaucaaaaggauaaauaguguacauaaaauuuaaaaacaagaucuuccauuuaggaagucaacuaguauuuuauuuaugaauuuucagggaggaaagucacauuguaaaaugauauuuuacaucuucaagugucccaggaguagaugaaaaaccacgcuguccaagauggccauccuuaguuugccugcugugaggauauauacuguugcuggccccaacuaacagcuguguaucagcacacaccagauuuccacaauugggacaaaauaaaagaguacaauauccaaauaauuuuauauuaacugugcauuaaaaugauaauacuuuaggauaaaugagguuaaguaaaauucauuucaaauaaauuuuguuucucuuuaaguguauaaucaaauauauguaucuaauauucagcguacaaagcaaaaagauacuauuuuauuauguauuguugacauauaaaugggcuucagaaucuaugcuuuaaaaaaacaaacaugaacaaagaaaggucaugaacugcagggcaguucccugggaauucauacaaaaccaguguuugcucugauggauacugacgcaguauuaacuucaucauuuacugugcaugaaggcagggcagauggugagacagcuguggcagacgguuuaaagaucaauaaacacacaucuaacuuuguaucucuuaucucuuguccuuaauggaagguaaacagugauaugcgugcaagcgugccgugggugcgugcgugcgugcgugcgugcgugcgugcgugugugugugugugugugugugugugugugugugcuauguaugugcuucuugguguguucacaugcacacauacacgcacgcagcucaagguuuccaagaggaaaugaaaagggcuaacuaaacaggaaggcaguuguuaagauaguugcuuacaagaggucuacaaagcugccugauuacaagcagggacuguaauaagaugcuuuugcuuagauuuaguuacugucugucaaagggaaguugcccauacucugaaguaguucucuuuccucuacccagggaacuuuuuaagcuuuccuagaaucuggcuucuuaccauaucacuuacaugugccuagaaaaguacaggcuuucccauaccccuggcaagucuagcauacucuucucaguuauuucuaccucugugguuagccaacuuuugaauguucaguauccuaagcuucccugguuuauucuaaguuacaguguguauuagacacuagccuucacacgcagucugucucuuauagccaaauaagaucuuuuuccacuuugcagaagagaaagaagguaaauaccagagaaaagcuaaauagcagucagauguccgguaucuuagguaaaaagccugaaagacaguuugacccugugucuaaugacaagucuccugagcuuguuucacccugcugugccucuaagcagaguaaaacacacuguugucaggauacauagccccaggaaauaacuguagaaugcuuuccugggauguccauuuugcucagagucaagagaaacaaacucuaauuuuaagaggaaguaaauucaaaagacauuaguacuguaguaguugcuuuaagcuguaucuccagaaucaccuaccauauuggugucauuauuacuguaagucuucaguagacaaguuagagcaucauugaccacaauaagugacccucguguacauugaucacagcccaucucacacugaacuuggggaggugguuugaggaaccccaaaauucuauugugugagaguugucaauuauuccaaagugaagauaauuggcauacauuuuguguuacuauagcaacagucauaaaaucucagcaucuuggaacagcaugaccucuuccucucauuauaaguuguacauugucaguuccaagucaguugcuguggcuugucuucauaucucaucgucauugccaguugcuuccuggauccccacugaguaagagcagcauguucaagacauagccuuucuauggcaaauggggaaggcacagggccugagcguaagauccaaccauuuuuuucaggagcuggcucuccgcuucuaccuuguuuugaggcaugucucauuucugccacugcacugcauuagggcugcuguaguacagauccagcuuugugugugcaaugaaacaguuaggcuuguucagugugcgcuuucaugcccugagacaucucccaaccuacauaugcuuuggcucacuauguccauuuguguccacuggcuacaacucugggaaggcaagcccaagucagugggcugugcauggggauucuuuccacagagaggauugugagaguaauacaguuugcugcccuuacuuuuagauagccuacaguguagaggggccuuaaauaggguuuccaaagaugaaguuaauaaaccguuaaauagauuucacacuaaauuuaaaaaccuuacuucagugaagaacaaaagaaaaauagcaaaguaaacauuaaacugggggauuagaguugaggauauggauuggcagauuuacagaaaaugaauauguucuugaguuucauguguuucccaaauuguaucuuauaucuuggguauucuaaguuucugggcuaauauacacuuaccacugagaacauaucauaugaguucuuuugugauuggguuaccucacacaggaugaugcccuccaggucaaaccauuugccuaggaauuucauaaauucauucuuuuugguagcugguaguacuccauuguguaaauguaccacauuuucuguauccauuccucuguugaggggcaucuggguucuuuccagcuucuggcuauuauaaauaaggcugcuaugaacauaguggagcauguguccuuauuacaugcuggaacaucuucuggauauaugcccaggagagguauugcgggauccuccgguaguacuauguccaauuuucugaggaaccgccagacggauuuccagagugguuguacaagccugcaaucccaccaacaauggaggaguguuccucuuucuccacauccucgucagcaucugcugucaccugaauuuuugaucuuagccauucucacuggugugagguggaaucucaggguuguuuugauuugcauuucccugaugauuaaggauguugaacauuuuuucaggugcuucucugccauucgguauuccucaggugagaauucuuuguucaguucugagccccaauuuuuaaggggguuauuugauuuucugagguccaccuucuugaguucuuuauauauguuggauauuaguccccuaucugauuuaggauagguaaagauccuuucccagucuguugguggucuuuuugucuuauagacagugucuuuugccuugcagaaacuuuggaguuucauuaggucccauuugucaauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacaugauaacaaccaguugugccagcaccaauuguugaaaaugcugucuuucuuccacuggaugguuuuggcucccuugucgaagaucaagugaccauagguguguggguucauuucugggucuucaauucuauuccauuggucuauuugucugucauuauaccaguaccaugcaguuuuuaucacaauugcucuguaguaaagcuuuaggucaggcauggugauuccaccagagguucuuuuauccuugagaagaguuguugcucuccuagguuuuuuguuauuacagaugaauuugcagauuguccuuucuaauucguugaagaauugaguuggaauuuugauggggauugaauugaaucuguagauugcuuuuggcaagguagccauuuuuacuauauugauccugccaauccaugagcaugggagaucuuuccaucuucugaaaucuuuuuuaauuucuuucuucagagacuugaaguucuuaucauacagaucuuucacuuccuuaguuagagucacgccaagguauuuuauauuauuuuugacuauuaagaaggguguuguuucccuaauuucuuucucagccuguuuauucuuuguguagagaaaggccauugacuuguuugaguuaauuuuauauccagcuacuucaccgaagcuguuuaucagguuuaggaguucucugguggaauuuuuagggucacuuauauauacuaucauaucaucugcaaaaagugauauuuugacuucuuccuuuccaauuuguauccccuugaucuccuuauauugucgaauuccucuggcuaggacuucaaguacaauguugaauagguagggagaaagugggcagccuugucuagucccugauuuuagugggauggcuucuagcuucucaccauuuacuuugauguuggcuacugguuuacuguagauugcuuuuauaauguuuagguaugggccuugaauuccugauauuuccaagacuuuuaucaugaauggguguuggaucuugucaaaugcuuuuucugcaucuaacgagaugaucaugugguuuuugucuuugaguuuguuuauauaauggauuacguugauggauuucuguauauuaaaccaucccugcaucccuagaauaaaaccuacuuggucaggauggaugauuguuuuaauguguucuuggauucgguuagcaagaacuuuauugaggauuuuugcaucgauauucauaagggaaaucggucugaaguucucuaucuuuguuagaucuuucugugguuuagguaucagaguaauuguggcuucauagaaugaguuggguagaguaccuucuacuucuauuuuguggaauagucugugcagaacuggaauuagaucuuauuugaaggucugauagaacucugcacuaaacccauaugguccugggcuuuuuuugguugggagacuguaaaugacugcuucuauuacuuuaggggauaugggacuguuuagaucguuaacuugauccugauuuaacuuugguaccugauauuugucuagaaauuuguccauuucguccagguuuuccaguuuuguugaguauagccuuuuguagaaggaucugaugguguuuuggauuucuucaggaucuguuguuaugucucccuuuucaguucugauuuuguuaauuaggauuuugucccugugcccucuagugagucuggcuaaggguuuaucuaucuuguugauuuucucaaagaaccagcuccucguuugguugauucuuugaauaguucuucuuguuuccacuugguuaauuucgccccgaguuugauuauuuccugccgucuacuccucuugggugaauuugcuuacuuuuuuucuagagcuuuuagguguguugucaagcugcuagugugugcucucucuaguuucuuuuuggaggcacucagagcuaugaguuucccucuuagaaaugcuuucauugugucccauagguuuggguauguugaggcuucauuuucauuaaacucuaaaaagucuuuaauuucuuucuuuauuccuuccuugaccaacguaucauugagaagaguguuguucaguuuccacgugaauguuggcuuuccauuauuuguguuguuauugaagaucagccuuaguccaugguggucugauaggaugcaugggacaauuucaauauuuuuguaucuguugaggccuguuuugugaccaauuauauggucaguuuuggagaagguaccaugaggugcugagaagaagguauauccuuuuguuuuaggauaaaauguucuguagauaucuguuaaguccauuuguuucauaacuucuguuaguuucacugugucccuguuuaguuucuguuuccacgaucuguccauugaugaaagugggguguugaagucucccacuauuauugugugaggugcaaugugugcuuugagcuuuacuaaaguuucuuuaaugaauguggcuauccuugcauuuggagcauauauauucagaauugagaguuccucuuggaggauuuuaccuuugaugaguaugaagugucccuccuugucuuuuuugauaacuuuggguuggaagucgauuuuauucgauauuagaaugucuacuccagcuuauaucuucagaccauuugcuuggaaaauuguuuuccagcuuucauucugagguagugucugucuuuugcccugggauggguuuccuguaagcagcaaaauguuggguccuguuuguguagccagucuguuagucuaugucuuuuuuauuggggaauugaguccauugauauuaagagauauuaagaaaaguaauuguugcuuccuauuauuuuuguuguuagaguuggcauucuguucuuguggcugucuucuuuuagguuuguugaaggauuacuuucuugcuuuuucuagggcgugguuuccguccuuuuauugguuuuuuucuguuauuaucuuuugaaaggcuggauucguggaaagauaaugugugaauuugguuuuuucaugaaauacuuugguuucuccaucuaugguaauugagaguuuggcuggguauaguagccugggcuugcguuuguguucucuuagugucuguauaacaucuguccaggaucuucuggcuuucauagucucuggugaaaagucugguguaauucugauaggccuuccuuuauguuacuugaccuuucucccuuacugcuuuuaauauucuaucuuuauuuagugcauuuguuguucugauuauuaugugucgggaggacuuucuuuucugguccagucuauuuggaguucuguaggcuucuugugugcucgugggcaugucuuucuuuagguuuaggaaguuuucuuccauaauuuuguugaagauauuugcuggcccuuuaguugaaaaucuucauucucaucuacuccuauuguccguagguuuggucuucucauuguguccuggauuuccuggauguuuugaguuaggaucuuuuugcguuuuguauuuucuuugauuguugugccgauguucuccauggaaucuucugcaccugagauucucucuuccaucucuuguauucuguugcugauguucgcaucuaugguuccagauuucuuuccuaggguuucuaucuccagcguugccucacuuuggguuuucuuuauugugucuacuucccuuuuuaggucuuggaugguuuuauucaguuccaucaccuguuuggucguguuuuccugcaauucuuuaaggccaggaauguugcccuucccuucauugcuuuaaaccuuacucaaccacgguguggugggcuccuguaaucccagcacucaggccagacaggacugaaauuuugaggccaaccaggucuacucagcaagacuuugagacagaacaggcuguugugcacauaaugcccccauuucuuguuucucccagccagcuguguuccuucuuccaugucuguaccacauaguaaggaugugcaaggaauagaucucugcuucuauuacaaaugguugccuguaaaauugcucauuuuuucauguuuuacaaaacuagaauauuuuuacuuucuauugcuaggauuauugaacuauagauagagcuuuugaguuuaugaguuuguuuugaagcuugccgaauaauaaauuuuuauucuuuuaauuuguuaagauuuuucaaccucccuuuuaauccuuaaaaaaaaaagcagaauuucuaucuugaccauuuuuaaguguacaguuccgaaauacuauauauauccccaucaugguuuaauagauuuccagaacauuuuuaucuugcaaaacacucaaccugauagucaugcuuauaauucauguggacacuacccacgaaacugaguauguaguauggaaucauaucucaaaacaagaacccccaaacucucucuguauucgacaguucuccacuaaccccauuccaaucuuucggcaaacgcauccaguccuauaaaauuuuauucuaacaaacucuuagaagcagaauucuacaguuuuguuuuuuaugacuagcuuacuucacaaagcaauauccacauuauagcauauaccaaaguuuucuucauuuuaaaggccauguaacauuucauugucuguaagcacuuuguuuucuuuuuuuucuauuuuuuuaagauuuauuuauuuauuauauauaaguccacuauagcugucuucagacacucuagaagagggcaucagaucucauuacggauggugugagccaccauaugguugcugggauuugaacuugggaccuuuagaaagucaguccgugcucuuaaccugaaccaucucuccagacccgcacuuuguuuucuucauccauuugucaagggacacuuggauugcuuuuguacaucuugaauauugugaagagugcuagagacacagguauacaaagauuucuuuuaaaucuagugaaauugaugaauuguauugcuuaauucuauucauaauguucuacacacacacacaacacccacccacccacccaccauucuguuuggucaaucuuggcagaaauugggccuuuuguaaaugugaugcauucuacagauuugcuccacuguagcagcaauuauagauaaaacugugcuagagccgggcaguaguggcacaggccuuuagucccagcacuugggaggcagagacagguggauuucugaguucaaggcuagccuggucuacagagugagcuccaggacagccaggguuacuucugaacguauaagccagccccaaauaauuguuuuccuuuauaagaguugccuuggccucugggucuguucacagcaguacaaccuaaaacagcuauuaggacauuucagaauuaaugauaaggauaaaugugguagaguaacccugucucgaggggcagguugggggggguggggggugcugugcuaguuucuuuucauccuuucaguuauuucuuaagauagugauuaucauuuuuaguauggccauccuaauaguugugaaguacuaucuugugguuuugauuuucaucccccuagugauugauauugagcaccuuuucaugugccuguuggcuaucuguacaucaucuaagucugcuaaaauuguguguguguguguguguguguguguguguguguguguguguguguguuccuuugcuugaugucaggugucuucuuuaaucauucuucacauuuuuugugaaaaguuucucauugaaccuggagccuugcaguuagcuagaauggcucccuggcaagccccagggaccugccuuucacugcuuccucuucacaggauuacaggcuugcaccucgcauugguggggaucagacucaggcgccaucucccagccagugcuuauuuucuaaacugcuuauuuuauugucaaauuguaauuauucuuaacuaguuaucaucuauuauucaaaaauagucucauuuuagucugccuuuuuacugaucauuguaucuuuaacguacagaaacuuuuuaaauguggugaauccucauugucuguuuugaccguuuacagugcuguacacaagaaaucacugcgaagcaaaauucagaacuauuuuguuguaaaaguguuacacauuuaggucucauauuuagauccuugauccauuaugaguuaaauuuugcauaugguaaauggcaagggaaaaacuucauuauuuuaccuguggagauccaauuuuccuaacagcauuuauuuauuuuuauucuuugaauguagauguuacuguaaguauguauacacuugcauaugcauuuguguggugggcuaaggguagcaucaggacuuuucuuuaauuacuauuuaacuugcucuuaauauugauuuauuuuuauaauguauauaagcauugcuuguauuaauucauuuuuauaauguauauaaguguauuaauugcauaucugucugcaaaccauaguguguguagugucuauagaggccagaaaagagugucagauccucuggaacuagaguaaauaggcaugacgugggagcugggaauaaaaccuggguccuuuggaagagcaacaagugcuucugaccacugcaccauuucucuagccccuccaacguugauuguggauuguuguucuuguuguuuucccuuuuacuggaauagauguuuucgcacauauauauccuuauuaguuuccccucccccuacuccuuccaguuccuucccacuucccuucccuuccggauccacucccuuucuguuucucauuagaaaacaagcaggaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaaaguaaagaaaaaaaaaagaaaacaagcaggauuaugaaggauuauaauaaaauaaaauauaagauuaaaaaaauaacauaccagaauuggacaaaacaaauggaaaagaguccaagagaaggcacaauaaaucucauucacacauucgggguuucuauagacucauaacauauaugcagaggacuuggaacauagcuaugcagacccugugcauacagcaucaaucucaaugaguacauaccauguguguucuuuugugacugggcuaccccacucgggaugauauuucuagguccauccauuugccugcaaauuucaugaagucauuguuuuuaauagcugaguaauauuauauuguguaaauguaccacauuuucuguauccguuccucuguugagggacaucuggauauuuccagcuacuagcuauuauaaauaaggcugcuaugaauauaguggagcauguaucguuguuauauguuggagcaucuuuuggguauaugcccaggagugguaagcuggguccucaggaagugcuauguccaauuuucugaggaacugccagacugauuuccagagugauuguaacagcuugcaaucccaccaacaauggaggaguguuccuuuuucuccacauccucgccagcaucugcugucaccugaauuuuugaucuuagccauucugaguggugugagguggaaucucaggauuguuuugauuugcauuucccugaugacuaaggauguugaacauuucuuuaggugcuucuugaccauucgagauucuuuaguugagaauucuuuguuuagcucuguaccucauuuuuaauaggguuauuugguucuccagagucuaacuuauugaguucuuuauauauauuggacauuagccuucugucagauguagaauagguaaaaaccuuuccccaaucuguacguugccauuuuguucugacaguguccuuugccuuacagaagcuuugcaauuuuaugaggucccauuugucuauaauucauuuuagagccugggccauuaguguucuauugagaaauuccccccugugccgauauauucaaggcucuuuccugcuuucucuuuuaauagauucaguauaucugguuuuauguggaggucuuugauucacuuggacuugaacuuuguacaaggacauaacagugggucaauuugcauucuucuacauguugacugccaguuggaccagcaccauuccauuuguugaaaaugcugucuuuuuuccacugaauggcuuuagcuucuuugucaaauaucaaggucuauggguucauuucugggucuucaauucuauuccauugaucuaccugccugucacuguaccaauacuaugagguuuuuaucacuguugcucuguaguagagcuugaggucagggauagugauuuccccagaaguuuucuuauuguugagaauguuuuuucacuauccuggguuucuuguuauuccaaaugaauuugagaauugcucucucuaucucagaaaaauugaauuggaauuuucauagggauugcauugaaucuauagaugacuuuugguaagguggccauuuuuacuauguuaauccugccaaugcaugagcauaggagaucuuuccaucuucugaggucuucauuuucuuucuucagagacuugaaguuuuugucauacagaucuuucacuugcuugguuagagucccaccaguauauuuuauauuauuugugacuauugugaaggguguuauuucccuaauuucuugcucagccagcuuauucuuugaguagaaaaaggcuacugauuuguuugaguaaauuuuauauccagacacuuugcugaaguaguuuaucagcugaaggaguuuucuggugcaauuuuugaggucacuuaaguauacuaucugcaaauagugauguguugacuucuuccuuucuaauuuguaucccuuugacauccuuuuguugcuugauugcucuggcuagaacuucaaguacuauauugaguacauagggagagagugggcagcuuugucuagucccugauuuuaauggaauugcuucaaguuucucuccauuuaguuugauguuggcuacuaguuugcuguauguugcuuuuacuaucuuuagguauggaccuugaauuccugaucuuuccaagacuuuuaacaugaagggcugucaaauuuuguaaaauccuuuuucagcaucuaaugagauuuuuuucuuugaguuaguuuauauaguguauuauauugaugaauuucuguuuauugaaccaugcuuacaucccauuaaaaugaagccuacuugaucauggugagugaucauuuugauguguucuuggauucgguuugugagaauuuuauugaguauuuuugcauuguuaugcauaaaggaaauuggucugaaguucucuuucuuuguugggucuuugugugguuuugguaucaguguguaacuguggcuucauagaaugaauuagguaguguuccuucuguuucuauuuuguggaaaaguuugaaaaguauagguaguaggucuucuuugaagaucugauagaacucugcacuaaaaccaucuggucuuggguucauuuuuugguugggagacuuuuaaugacuguuucuauuagggguuaugggacuguuuagaugguuuaucugauccugauuuaacuuuggcaccugguaucugucuagaaaauuguccauuucacccagguuuuccaguuuuguugaguauaggcuuuuguaauaggaucugauuuuuuuuuuuaauuucuuugguuucuguuguuaugucuccuuuucauuucugauuuuguuaauuuagauacugucucugugcccucugguuagucuggcuaaggguuuaucuaucuuguugauuuuucucaaagaaccagcuccugguuuggcugauucuuuguauaguucuuuuuguuuccacuugguugauuucagcccugaguuugauuauuuucugccagauuauuuccugccuucuacuccucuugggugaauuugcuuccuuuucuucuagaccuuuuagguguguugucaagcugcgaaugugugcucucucuaguuucuuuuuggaggcacucagagcuaugaguuuuccucuuaguacugcuuucauugugucccauagguuuggguauguugugccuucauuuucauuaaauucuagaaagucuuuuauuucugccuuuauuucucuccugaccaaauugugauugaauagagaguuguucagcuuccauguguaugugggcuuucugguguuuuguuuuguuuuguuuuguuuuguuuuguuuuguuuuguuauugaagaccaaccuuagucccuggcaaucugaugggaugcaugggauuauuucaguauuuuuauaucuguugaggccuguuuugugaccaauuauauggucaguuuuggauaagguaccauaagaugcugagaagacaguauauugauuguuuguuuuaggaugaaauguccaauagauaucuauuaaacccauucaguucauaacuucuguucauugcauuguuucucuauguaguuucuuagacaugucauagaugauaguuucaucaucuaugguaauugagaguuuuguuggguauaguagucugggcugacauuuuguucuguuagggucuguaugacaacugcucaagaucuucugacuuucauagucucuggugagaagucugguguaauucugauaggucugccuucauauguuacuugaccuuuuucccuuauugcuuuuaauauucuuucuuuguuuugugcauuugguguuuugauuauuaucugacaggaggaauuuuuuucugauccaaucuauuuaggacucuaucaucuucuuauauguuuauggucaucucuuucuuuaggaaaguuuuauucuauaauuuuguugaacuuguuuacuggcccuuuugacuugggaaucuuugcuuucuucuaugccuguuauccuucgguuuggucuucucauuguguccuggauuuccuggauguuuuugguuaggaucuuuuugcauuuucuuugacuguugugucaagguugagacucuuucuucuaucucuugucuucugucggugaugcuugcaucuaugaauccugaucucuuuccuagguguguuuuguguuuuuugguugguugguugguugguugguugguugguugguuugguuuuuuuguuuuucgagacaggauuucucuguauagcccuggcuguccuggaacucacuuuguagaccaggcuggccucgaacucagaaaucugccugccucugccucccaagugcugggauuaaaggcgugcgccaccacgcccagcuucuccuagguuuucuaacaccagggcugucucccuuugugauuucuuuauuguuucuauucccauuuuuagauccugaauaaccauguucaauuccuuuaccuguuugguuauguuuucuuguguuucuuuaugggauuuauguguuuccucuuuaagagcuucuaccuguuugcuuguguucuccuguauuucuuuaagagaguuauuucuguccaucuuaaaguccacuaucauuaucaugagaugugauuuuaaaucagaaucuugcuuuuucagguguguugggguauccaaggcuugcuguggugggagaacuggguucuaauaauaucaagucgucuugguuucuguugcuuauguucuuguacuugccucuugccaucugguuaucucugguguuaguggucuugcugucucugacuggagcuuguucuccuggcuuguuagcacuccugggagaugaggggcaggauuugggugcagauagcucuguggcacagggucagcuccagggcgcagauggaaaccucuagaaggauccuguccccagcugcaccaugguuccuggguccugugggcucugguugggucucauaggucucagcugugaucuuaugugugucagcacucgugggagauucgcuuucucgggucgggacuggggagcagauaguuuuggcacagggucaacuccaggucccauauggaaaccaaugaucuggguuucuuauccuuccuguccgacuguuauuuuuagauuuuguggugucccguauuucuaggaugucuuuugccaggaauuuuuagauuuaacauuuuccuugauugaucaauuucuucuguccugucuucaaaaccagagauuaccucaucaucuuugcauucuguucaugugacuugcuucugugauuccuguucaaguuuuaaagguuuuauuugcagaguguccucagcuuggguuccuuuauucuguuugcacuuucagacuuugaguuguuuuaucccuuccaucccacugcuuguugugacuucaugggagucuuuaagggauuuguucauuucuucuuuaaggcccucuaucauauuaauaaaggcuauuuuaaaaucgguuucuuguuuucggcucuguugcaauacucaaggccugcucugguaaguuugcugagcccugcuggauacauuguccuagcuguuacuauuuuuaugcugacaucuaggcaucugguuugagaagaauguaauucuagguguugauaucagaucuuguguuugugagcaugauuuauuccuugguuucuguugcucucugguucuuuggagaaugugguuacucucuguuguuacucuuuguugucuggugggacauucuucugggaucucacacacaguugaucuaugaugguccuggagguggggugcacagggaagagcaaagcaggguguuccaccaggaucugcucagaccccugggagugaggccagagugagaaguuacaaguagucuucuacagaguuggggaugagacucggggacagacuuggaggaauacaggaagaggugaggagaugggcgcaggagguggcacagaggccucagagguaaucuacauagcuauggaugugacuggggaauugguuuuggaggagagaaaauauaggugaagaucggaaauuagucugccuguuucccuggugagaguggcaugcagauuccuagggagucccuguuggaguuggggucugagauaaggcaacgaguugggggggccggaggagggagguuagagguguucaaggaagaaaccucugcaggugacacgggauuggauuuggagggacagagggaaaaaaagagaagaucuccacuuagccuccauccuucccaccaacuuccauuuuugaaagucuuucauuaaaucuggagcucaaggauugagguaggcuuuauggccaguucauuccauggagcuuucugccuucugucugagcccguugugggcuuuuaucagggugcuaagcaucugaauccaguccacugcuugugcguugguacuuuaccuacugagcuauuuuuagguaguuggaaaagauacauuuuuuaccuagugcguguacacaugcaugggagcagauaaguaaagaagaagcaguagguucucaccaucagccaugugggguucaggggcugcgcucagauuguccagcuuagcagcaaggggcauuaccagugugcugccgcaucaggcaaugccaguaucauuuccugagcauuucuuguauaauacugaacguuugcuuauuucagcuguuucucuagaaaacauucuguucuaaaauuaguggaauggaguuuaugaacauaaauuuuuuuguguuuuucauuuuuagggaggcagcaagagaaugucguagaaagaagaaagaauaugugaaauguuuagagaacagaguggcagugcuugaaaaccaaaacaaaacauugauugaggagcuaaaagcacuuaaggaccuuuacugccacaaaucagauuaauuugggauuuaaguucucuccuguuacgguggagaauggacuggcuuggccacaaccagaaagacaaguaaacauuuauuuucuaaacauuucuuuuuuucuaugcgcaaaacugccugaaagcaacuacagaauuucauucauuucugcuuuugcauuaaacugugaauguuccaaaaacuacuuccacuucugcccucaagaaaugugcagcgccaggaaucaugaagagacuucugcccuccgucuccaccacccucaagaaguaaucauuugcuuauuuguaaauuguugggggaaaugaggaaaaugaaaucuuggcuuucuuauuuuuguuuuagguuuguuuuguuuguuuucuuauuaaugacuucaagguuuguugagcuccaugauugccuuagggacaguuacccagccugcugagcugacguaaugugugggccacacaggaaaguaaggaaggugcaaugaagaaguguugacugccaaauuaauguuuuuacacuuucauugugaauuaugucgaacuauuaaaaacauccuuuaaauaaggauauuagugugguguugggaguaaacuuuauauguauguuccuuucuucagcacugacaaguuguccuuggugcugagaagcacgguauuggcuacaguuccucuguagggcaguuguugcuucuucauucaguucuguguguucagcaguuugaauacauuaacagaaguaaccaacugaauggaaagcaugguuuugaauuuugaguuaaguuaaaaucauacuauaaagcuuauucuggugaguacuaagucuuaaugaguaggugcuggccaggaagcuaacuccuugaguuauacaauaagguguuuaauaaauaaagacuuuuguccuugcuuuccgaauccucauacugucacucauuuaccuaguccacugcugcauuuacacugugcagccaacaggagcguuuucaagauguccagccaaagugauggaaaguacuaaauagacaaccuuuucuauagucauauuuuuaucagagaaucucuugggauuuuuuuuuuuaaaucaaagaaguuacaaggaugugauucuaaaacauuguguuaaaugcacacaagaaaaguaauuuccuucagacauuggagugugugcuaugguacaauauuuggcaaacacuuuuuuuuuucuccuaaaaaaggugguacugcuuuaacuauccaaaagcuguucuguuucugaagauguuucuacuuacauccuuaccuauagucuacauuuauguguaacauuguuucugauaagacuuaguaauaacucauuuuuuuuuuauuaaaccuaauaaaaucuaagaguuaccucuuuaaaagacaaauaugaggacaguggaggcuggcauguuagguuacuucacguuugaggaagaacucagacucagaagagugucuuauauuugcuuugggauauuaagaaaguuaauauuaauaucaguauacguaugagcgggaacuguuuggcccauuucuaagcuaagacuagguugcuaucuguaaauguucuacguuguuuauaacaaaccauugucuuuuuucaaggaugaacaguuugugaaggacaugauucuaggaguugagugauguaauaauccuucugucuggacaguucaccagauucuccagaaggcuuucaaacggcuaaaguuugaucuuuguccugcugagcuugcugggaaggagauagcauaaaagcugucugugcuagcaaguagauguaucauuugcuaaacguggugaaacaaaaaggaagcagaaucacaaaucugucaacaaacuggaauuacuucacauuaagucagaaugucagauugaacauuuuaaaugucacaaguggaaaauuugccuagcgugcagaaguuguaaucucuaagugucuaucuucaaaagucgagguuuucuacauaaugaggaaacagguggucuccuuaacccuuuagagaccaaggcagucucagccauacuuccuaguuggauggauauuaauuuacagaggccugggucuuuaugcuuggagcaugacuguacuaguuugacaccaguuacuugauaaugugagaaauauaugguguugugaaaccugacuuugaaauuucaguucauacagaaagaaaucaaagccucuuuaaugcaagcuggauuuuuuuuuuaacaugagaaugagaaaaacaaaaacaaaaacuuguuuuugagcuauguggagaaucuuuauuaagaaaaugacauaauuuuuuaaaaacucuuauauccaaaauuguauguggccacauuaucgguaauguuuucucuucauguuggccaaaagggaauggaacugucauaggaaucuguacauaugcuacugauuugccuagagaauagaaguuugguacugcucacuuugcauauauauaguggcacuuuuaucuauagggcagauuaacucuaauaaaaaugaaauggggauagguuuauuuuugauauauuacucuucugaguuuucaagcuuugauaguguuuaacugaaaaaugguuuagaaagggcuagauccaauauguucauauuuaaaaaauugauaugagauacaauuuaaguucuuuaucaaaagcaaguaccauauuagcaaccaucauauuguccuaggugcugugcuuguuuagaugguauaguguggguggggacguggcauuuuguaauauauguguacauauauacauacauacaguauaucaucuaaaugcucugagagcugguaugucaggaaugcugaguauuauagcguauugagguccggugagauuccacuuugcugugcuuucuccugcaucucuucugguguuucagugacuguuuuacuccagcacucacaacuggguuuucucuuuucuuccaguuuuuuauuagguuuuuguuuuguuuggcuugaugcuuuugaguauguuaccagucacuuaaaaacuccuaaaccccaagcucuuuucccccugcuuuguuucuggcagcuauaaaauugguaagaacauuuugaaaaaagguuuuaagagaauuguuucaagaaucauuuugggcaaagacuuuucauguuucauuugaacagggauuuuugucaagauguguuuugaugguaggccagcaagcagugcuacugucuaaagcacaaaccagucaggcaggcuguccagccagaagcccucuuggcugaagccggucucugccucucaggacuccucccuacuauuuucgaccauuuagggugacauggaaucauacaaauauuggggcuuagaaacaaacauuuauauaacccggaaugcuuuuacguacuugaagugacuucagucaaaauguugccuuuccuguuuaggaagcuuugguucucuguugacucgucagcuaguaacacaaaucgguuucucuaccaauagcugcuucauuuucaguuccuuccagaggcuuuuguucugccuuuguaacacugaaacucuggauuggcacagcaucccggggcccaguacacaggcuguauguugacuugagguuguauuuacaguaguucuuuguaaagguuugcuguaacuugcacuuuuuuuuaaggacccaguuuggguaucagcaacuugggaaauuccuuaucaaugaguucucagcugacccuuuugucuuccuccuucaaaucaugacuccuuaauggaagcguuucauugaucacaguaucauagcuagccuuaagcauguuauaaaagcuaaauaucugggaauuagguuugacuaauagugaaggaaaaauaaguacuuauaauuuuaaauuucauccuccaacuuuaguucuauguagagcaugccaaaaguuuuuuuucagaagauuacaaaccuuguuaaagcaauuaauuuguugucaucaugggaaaccauguaaucgauguuacuaaaucauuuuaauuuggcuuuguuaacuuccgagaaaugcugccuaaacguaacugguuucugacugcgggggaguacaguaugcuuuguuaggccuguaggugacucauucuagaauaaacguguucacugagauguacaaagcacaacuagaguuuuggguggcuugugugugucuugauuacuuucaauguuaauguugacuuuuuaaguuaacagucacuguuauguacuaggaacugguuuccuugacuuucuagaaucaauggccaagagaggcauauaauccuugagggguugaagguaucaugaaguugagucaguauggaagaauuucaaacaaaucaaacagggugcugaaguuccggcugacucaucugcucaugguaugcuuacugauuagugaauguaguuuuaagccuuuguguguguccucaggggcagacagacuuuaacaaggaccagauaacauuugaauggaggaauuauauuucagguguuuuagcuugaaauuuauuuuuuaaaaaaaagaaaaauuaaaaaaaaaauaagagagcaaaguuugggaagcgaguugacaguaugaaagcagcagagcugaggaugagcuggccugucccacugcugcaguggggugggucccagcuggggaaauguuacauuguuaccagcaagaaaaaggaagaagggucaaaaaguaggaaacuccuacuuuugcaggcaugauuuacuacuuguccauaguaguauagcauuucuaagcuucuaagggcaucucaaaagauaagaguaaguccgagauguugaaaaaaucaguagggaagaaagaucacugcagaucauaaucuauguuggccacaugaaaugauuuauuauauuugggaaguuuuauuuucuuauguuuuuuaaaauugaauugguaagugcuuuauagacguauuuuuacccaggugccacuucaauguguauguaauaaaauuauuuauauuaaaagugggaaauuuugugaacauuuuucuguguguguagauuuauuaggauggugaagaagugugcuaguuagcaguuuucuguguaaagcugucuugagcugaucuguacacaucgguuauaaugccccaguggaaccuagacaugucacuugagacuuuugaaaaacaaaauaaccagggaaguccuagaaugguauuuggcuguuugguuuuuccuugaguacuggaguagagaauaccuccccagaacugucagcacaaaacaggguaucagcuuuaacucugauguuccuauuggaguagaguacuaauaacuaugagaaggggaauacauuucuaauaaccuucccuacaaucuagaaacgucccuguuuaaauuuuuuaccuaaaucuuuuugugcuuuauguguaaagaauaaaaguaccaagacaccaugcauuuuauuaacacuauguacauacuggcugcuuuguguucagaaugguagcaguuacuuuguauauuaaagugauccuugugaauuugugaaauauugucuuaaagugcuuuucuuacuguaaucuuugugguaucaacugucauaaugcccuuuuuacacagacauuuaugugcagucacauaaacaugcuuuuaaaaacucuguaaagucucuuuuuugggccugggacaccccuccccaagcuaguauuuguuuacccucauuuucuuggacuugauguuauuuugucaaaugagcaaagauuacauugaaugaucacaagcuuguaaugcuuagcaacagaaaacuguaauucauacaacacaucuaaacacucaauuuuacugaauucuuuuuagcacuuuuuugaguaaggcugagcaugaucuaaaacucccaagugcuguucucccgucaaguaacuaauggagauguguuccgcaguuuaaaguuaagacgugugcaugcccugaaagaacaauaaaaacucggaucaccuuuauucugaaauaugugacuguauaaaaugcagaaggaagguggguacaauagcauggccuuguaaucccagccucaugagaacaggaggcagaaccagggacuaggugggcuaucugguagagauccuguagggaaggugggaaggguaugaacaagggaauccugaaaugcacguaucuauuauugccaaagaacuaauaagaucccuauaauguucugaaguucuggaacuuaggaacuuuauuaguaagcuguguaauguucccugguugcuugucagaugugguuuugaagcucgggucacauggauuuccuguuucuccuuucugcagagcaaccacacuuaaccgaauuaccgagacuuaauauuuuaaaaaugaaaggauggaagcuggcaugguagcacguaccuuuaaucccagguuuugggagacagaggccagccuggucuacauaagugaguuccaggacagccagggcuacauagugagaucccuuaaaaaaaaaaucacaaccugaaaggcagguguaaaccagaguuguaccaagcaguucaguucugugaucauauuacuuguaagcuauugggccuccggaaagauaauagugccuaucuuccuguagcugugacuuggcauucauuugaggaccuaggaacuagaguaacagaagaaaaguacuucucaaaaucgaaaauaguccuccaagaauauaacuugguagaguugguaucccuuuccucuacaaugaauucuagacuuccauguguuuguuagaugggaagcacaggucccaaacagaacaaauuucuccuccaaaucugucccuucaggcauuuuccaugucauacacacggugccacuuuccauuaaguugacugucaagcccaggaaagcacuguucguccgugccaccuugccugagacugaauuuucuucaguuuuaagcauucuucagauaaagacuuagcaucaaguggaaggcaggcucauuuccagcgaugaguauuauuuuugcuuuuuaacugauaagugguuaacagaaccauaaagugacccauuugcguucacacacuugggcaacuaccauuccugugcaguucacagacauuuccaucaucuggauaaaacccuacaccuacuaaaugguuaucuuuccccuuuuuccuucugccucuggcaaccagagucugccuucuguaaauugagaaauuucaaauaaauggaaucauaaugugua

SEQ ID NO: 12272 - RNA, 75439 nt, Mus musculus
auacaagcacaaauaguuuuaaugauuuauaaguuuaaauccauuaggaaaaaauaaaaauuacacacauuucuauaaaagaaaguacagccucaaguguuaaaagcuaacauaaaccaacugcugaugcugcugauggaaggaaaauggcgaauacuaccaggaaaguaaugggccaacaaacaguuauucggcuaucucagaagcaggucuacugcgaucagagacuggaguaucccuaaauggagagaagagcaaacagagcacuuggaagcccuugaugccaagucucggcagcaagcagcagugugggaagaaagcaguaauggagcugaaggguagugcgugagacagcgagcagcugaagaaaacaaaggcaaacagccuggcagcacugccacuaugaggacacugaugagcugucccuaaaauggaugcacaacugugugacuuuagccuuaagcucagggagugggccaaagaugucucccacuugcacuccauccuuaccucccugagcagcccugaaaagccaccuuaaagaagcaggacaucugcaacaucuuaacccuacucagucaagcuguucacauaaccggauacguaaugcugagggcuuuugucuuuagaguuggucauugugacugcgcaucuccuucaacugcauucucccuggcauucagagaagaggaggaggagaaaggggaagaaggaguugaaguuucagugugagaccugcgcuuuugugaauuauucugaaaauacauuucuguuucagacaauuuuuuuuaaaaaccagcauucagagcauucaaaaauaauacuaguaggaaagaagggaaaccgagaggaggugaggcaagagauuaaaacguaaacuuuauaugccccaguacaggggaacgccagggccaaaaaaaugggaauggguggggagggaaguggggggggggggaggguaugggagacuuuugggauagcauuggaaauguaauugaggaaaauacguaauaaauuaaaaauaaaaaaaaaaauaggaacaggaaccucaaaggcuucacagcaacgaggcugugacccugggcaggggugagacgccacacgcaacaggaaggagcucaacaugugugugugaaguaaagggaaaacuaucccuacaccccaaccccaggccuaaauggcuuaauccacauggcacccuucuacccaccccuagaugcagaaggaacugugugucaaacacagacaaaaccuuauuagacuguccuaacuauugauccugggaagccagcauggggaaacauuguguucacgucaacaugccuauuggcaugaaaaaauaguaugucaaagaaggauuuaugcaaggugcacuuucaaaugaucaacagaaucucaaacuuuccuaguaaguggaucuugaaaugacuggcaucccagcuuccugguguucugagcuggggcaacuccacccagggcuugucaagcugcccucuucuccuaaaaacagagcugaugguugucuuaggacuuccuucugcaaaccauaaugcugccaacucuuuaccuucugggaugaugcauggaagaauccucuucuuuaagaccauuuacaaguauagacccuguccacucacaaugaggaccuacagaacaggcagaguaagcugcagugugcgcaggcucaggagugccccccacaccccugcuggggcugcuucuguaacaagaagaagcucuucucacucccacugccugauuuccugcuacaggguuugugucggauaugguaaaaauguaguaaaucaagcaaucuccaacuuuugccuacccaccaaucuagaggcuguauaaaaaauuaaagcugggugagaucagggcuagcuuggcuaacuuagcaagauugucucaaaguuggauauaguuauguaguagguaauugccuagcaugcacaugauccugacuuccauacccaguagcacaaauaaaagggaggaaaggagagaggaaaaggaaggaaggaaggaagggagggagggagggagggagggagggagggagggagggaaggagggagaaagggaaugagagaagggauuaaaaccuucaaggacuuauuuuaguaauuuccagaaagauuuaccaaaaccagauugcuuauaaucuaaugaguuaacauuugucaguguucuaaacuggcaagacauucuaagcagugacgcuaaaauaaguuacagaaaaaaggugugcacagcgcacaguaggcagacagcaaauguacacagugagagcauaccgcugauuuuaccacuaacauucagugcuucgaaucaugauuuccuaaugcauacacaagauuauuuuuaaauaaauaaaaaaaaaaaacacaauggaaagccaagaaaacacaagaaacuaaaauacaacauaagaaaaggauaacuccagauagagcuuuuugccuacacuggcacauuuacauaaaugcucuauuaucauuauaaaaagggcagaauaaaucauaugaugauauucuguuuacuaaaggaugcuaaauuaauaauacaccacguggauuuaacaaguaguuugaugcuaucucacuuauuaaucuucgacagauguugagaaagcugaaagacaugaucaaucaaaaaaaaaaaaaaaaaaaaaaacacaggccacauguaaaauaaguuccuaguguggaaccugugccucccacauaggugaugaagacccuaagacuugaguuauagcccccacccuuaaaaaagaacaacaacaaaaauaucuuaaaagcaguuuaggcaucaaaaugaauuccuaaucuacuaucaauuguuuuauuuugcaauucaaagggggaagaaauaugaaugguucuaccuauucauaaaaacaugaaugaccagaaauaucacaauggccguuguucuuacaaaccaugcauguccaacuuaaaauguucaccugguaugacauucagcugucaagaggaagcaauucaaaggccauuauacagcugauaagccagguggacggagccauccagacuuugcccugccgaacccucucugggugacaguuaaacaggucuucguagacgauguacugcguacagaagcgcugauccgacucaggcuuggcaugguaugcaaccguguugauggucugagucacaucacugucuggcuugggcuugcgacucaggacuuugccuccugcugcagcaaugagcuuaaggaggucaucccuuggaugaugcuugaaguuuccccccaaaaagaaguagcauccaucaaacagcuuuggcaacugaaauaacaagaaaguaacuguuaaaagaagaucaaaauauuuucaaacacugucuaugaaugaaggacauaagaacaauagucacgugucagaaagagccaauuagaaacugucuuugucauuucuacuauaguuacauauaucaacagaauaauggaauauuguccauuaaagcugcaguauguggcaauaaagacauaugguaacuaaauccgagcagcagcuguaagucuucuuucaagcuacuuccuguaucugagauuuaccucagauucugaaagcuuuaugggaauguucaagaugccaaaaauccauuaacaguaugaaauuauuaccuucuggauuuuacugcgcaccgugaucaucuuucagaaucaagugcuugaaauaagcacaauuaaaauuuuaaucagucaccugaacuggaugagagggcaaaguuuucccgaugaugauaaugacacgaagcccuaagaacaagcaaguauguaaaaggaaaauaccagcugcucucuguugagccugcuccucuguggaccuccaggaacuucauacuuuucuuccugcucacguacuuugcuguccagacaggcuuucaccccugacaaaaaauaagguagaaucaaguaaguagcacaugagcauaugugaagucugucuaauuagucucuucuuuauggcuggccuaaauauucugaaaucuuccaaccccaauuauacuaaaagaaacuauaauaaagggagggcuggagagacagcucagcaggugaacaguaugccuguaagcauaggaaggugaguuggauccccaguggguguggcagcuuguaccugugcuagaguuuggagagcaagcagaucccccagaggucaguggucagcuagucuagccaaaaugauagcuucuaggagagaaacuaucucaaacaaauacaguggaggaugacagaggaagagaccccaagucagccucuggcaucaaugcaugaacacacaagucacugcaccuacacacauagugauaucacacacacacacacacacacacacacacacacacacacacaccacaucccacauagaaaaacagaaagaaaguaugagaaagcuagcuuucuauacuuaaaauaaauggaagaaagccuuccuuccuaugugagauuuuaagcaauuaguaugcucaguccagucuaaacugagcauuuaacaaauguuggcucauuuuggcaguuacauguaugguuggucuuuaaaaguccagugaucccacaugcccauauguacaaagacacaugugcauacacacauacacacacacacacacacacacacacacacacacacacgugucauguggcacucagauaucaagauauaauuugagaaacaguguagauaauuaggcgauuucuuuguuuauaaacaucgcugaguacacuuuaaauuaaaauuccuaugaugucacuaaauugaccuacucuacaaauguauguuucuaguccagcauugaccauaaugccauuauguguugugugauccugugaacauguggacauuuguugccuguaaauggucuuagugaaucaucacugacuuuuaguuaaaccucuauagagaguauaaaaaaaaaaguccagugauccaaugagagugcuuuugucuacagcaccacccucagccaaccacacaacaggaccuuagcaggaccugugaaaauaaauacugagcagagcccacgagcugccugggaacugacagcacuccuguagaggaguuggcuugauauucccuggagaaagaauccuucugauggacugcaccagaguguuuauaguuuaagcugaaaaggaaugagcuauugcugucuagugaauaggaaaucccuaagcagggacaucagcagucacccaucaaugccuggcuguauucuagaaauaauacgcccaauacuaauaacagaggagaauaggaccuaagcagcaacaucuuaccuguggaggaggagaagggagagaaagaggagaaggaagaggaggaggaggaggaggaggagguagaggugguggugguggggugugugugugugugugugugugagagagagagagagagagagauacugcuagguuuaaugcauacaacuaaguuugagauacgaagucaaaugacuuauugcuuuaguaaaacuucauaaacucauaagguuagcuuuguugccuaugaaagaaaaaaagaauuaggaacaccacccaucucaccauaccagccauuguuuuuaugcauaaacgagguaaccuagauccauagacaaaugccacagauccucuccugucaacaguuucuagccucagcaccucagauugcauacacaacaugacguaaccacagacaucaggaauguauagaccuuagauggggugggggagccuugguagagaacaggauauaagugcaauguagugggaauugcaguaacagggaggaguucccacgaggaggagggagaguggucaaugcagauggaggaguagaggugggggacaaauaaugccaagacugcuugauaaagccucaaggaauauuauuuuauauuuaccuaaaauuauauauauauaaaaugcauacauguguguguguacauauauacuuuuguacgugcauacauaaggagguuaagccaguugggcugguaauacuccaccugaaaaaccacagacuaaccaaaccccuagugcuagacaccagacuccuucugaggaauaucaggguaguccaagugacuuucaaagcaauauaucaauagccaagcugaauuugaccugaaagugucuuuccuucaaaaaaguuucaugguuccagaaaauacuaugcaaguugccaaaagauguaggcaauuaaacuacccagcuacaacacauaugagccugacaacuacuagcauggcaacauaugcauaaagaugucaaucaacagcugugcaguuggacuuaaggcccauucaucaggagggaaacuguacccagaggaaaccuagccagcuuucuggggcuagugaggucaugggccugaacuuaauaaugaaucuucuaccccggcucugcucagccagagugauuccuuaccauauuccaaauaugauccuuacacccacagauaagcucaacaaggcuucucuuuacagcaaaugaggacaggaccgucacaaaaauucacagcaggugaugauacagagaucaagauauuguggugagcccauggcaacaucuacaucacagcuucugcaucuuaugagucagggaaaucacagaagggguagaggacucuaagacccaggaucccaggaaguauguugucucuuauagacagcgggcaggagccauaguacuacaaugaacaugugaauguggaagaggaaaaguugugaggucucacccuaaacaaagaauuacaggcaacuauagccuacugggaggagaaucagcaucuccagggcaugagcuuccuaauggguugaucagccuugaaaccacacauacacaaacaacaaaaaccgacuuggcagguucuauuuauaucuccuugugcauacagauauuuaucuguguauucaacaaauauaaaagcaaaugagauuaucaauugagagugggagacauugaagggguuuggaggagggugccuaagaggggcuaaaggaagaaaaggaagaggaaaaccgauauaauuauauuuugaguaaaggcauuauaaauaaacuugaaaauaaagggucuaucacaaaacugaaaaaaaauugcaaaauggaucuuauaauauacuauuuucacuauaaaaacaaacuauccagaccauuuucuauuuaccuuagagauuacuucacucaaagaugugaguuuuaccacugagaaaacaacagaaaaaguaugaacaauuuaaaaacaaacaccaaacaaaaaaccacugaauaauguuuauccagaagaaaacuuuaucuauaccaacauauacugagaauuagaaagauaugcuagaaauauaugaacauucuaauaggggcacugccagugauuagaugccacugaaggacaacaccucagucugcaacucugcagagggccauaagaggcucacuucugagcagaacuggcccagaaccaaguaucaaucugccaucagcaccacaacugucccauguugugauuaaaacaaacagaaucuugugagcaugagaagaggaaagccguauugacaggacagaggugacauguaagacaauccguacuuuccaagagugagugacagcccacuuuggcauggccuagacuucgaggcacccaucauuaaggcuucuuuucuauuaccccaaacuagaaagaugauaaaacauccaugaguuaaccugaacacauggaggaagggacagaaacugaagauccugacauccuuaacagaaaacaaacaugguuugagcucugguauggcaagcucauugauaaguaaagaaagcaggcguugcccacugcucacagccuuccuccacagggcaucugcagcuguacuguaaacaccuacuauuuacaaaaugaauuacucauggcucuguagagaacacguuuuuaaguuuugguugcaaaaacuaaucuucaauuuucauuaaauuuggaaggcuuuaacggagugcucaacuaaagugaaucuaacgccacagcucucucuuccucugucaauaaacacuccauuauaaagccacuucaaaggcccaugugaaaucuuccucauguccaaggcaugaaggauggcaguccuauggauggauggauaagcuccagccgaggcacucacaggagagagggcaggucuccuccuacucagcaguuuuuagagcccaggaggacuugcauuucuauuagaaagacaaugguggggcucaggucaagggugcagucagacacaagcacagccaugcccuugacacucaccuuucccucuuggccagucuaauugcaaaccuucagaagaacagguuauaucugguugacagagguaauuuaagaaaaaacauuuccauuacauuucacauuuaguuuagauauacuaaaagcaaaaguaauuggacuuuuuuaguaaaaauauuugaaugcauacuuauuucuaaaacacaauucuagaccaauuuaccuucauuuuuaaaaaauugcugcugauacauucuagaaguauuagugguuuugcuaugguagagaaguaagaugcaaaauuuguaguauggcaggaaauuaugcacagcuagaguuuuaauucuuucauccaauaaaauauuaaauauugagaagaaaacuagaauaucauuaaggaaauauaaaaaagcugaaguguuuauuguuauuuccuuggguacagaugaauugacgaagagaagcguacuguuuuacuccuaacaccuguaaaucuuucucaaaacaucucucucauucguuuucauuagugaaaagccaucucacuaacauuauuuuaugaaaucuauggauguuguguaaucuaauaauucaucccaggagcagggugcacuguuauaauccaaaugcauaaacauugucuaacacucugaaaacauuaauuucccacuauuuaaauaauaaaauacuaaugagcacggggccuaaccaaagaacuuuaaaaggaauguauuucuuacggauauaaacuauguacuaaugguuucugaugaaauuacaggggaaaaagacaaaacacuuccaaguacaaugcacugcacuguuuuccuuuuagauagcauuuuuaacuguuuuagucguucuuacuuacuuugugggugugggugugggcgugaaugcacacgcaugugaagucagagacaacucgcucgcaggagcugcuucucuccuaccacaggggcccagggaccaaacucagaucauuagacugauagcugcuccgccaauccuggagugcuguuucucuaguucuaaugcccaacgauacugccacugcuccaaggaaagcccugacaaucuuagggacugcggcuacuaugcauguuuuauuguguguacaguagugguuugguagacacuccuuaccugcagcaguccuggucuagaaagaagcugcaaacacugaauacggugacuggaaaugcucugcugugcuccuggacauuuuuguaaacugaugaagacuuccuguucuggguguuuaaaaaucaccauaguucuugcacaguagcauucauuagcauuggagcuacauuaaacuuugggccugaguaagguuccccuuccaaccgcuagggggcuacuuuaaguguggccucaacaacagagucacaugugagaagcaagcucugcacgcucugcugcguccgaaguccagcugaauggagaaggcaggacucacacgcuggcuaucagcugggacaaugcgcuuuugcacccaagcccuaagguaccccacaugucuacaaaggcuuuuaaguacugacuuggggauuuacaaaauuuuagcauguagagcaaauucaaaaauguaaacugcacaaacaauaggauuuacugugugcucuuuccauuucaggaggagaaauaaagcacaaaggacuuagcugguuccaagccauucagcugcuguggcaggaugggaaucuaaacccaagucugcucagcuuucgaaagccaaugcauuuuacauacaaaaauauauaaguuuuugguaugcaagcuaaacuuuggacucuaaaaggggugauugugaauauuucaaaugauuuuaagcugcuuuuaguauuccaagauguugcauauuauaaaaaaggaaaaugcuagcaacugaauaccccauuucucccaaagcugagugcugucaauauaauguuucccuucauuuaggauuguuaauguguauucaauucaacgcuaagggacuagagagcugcuucagaggcuuagagaccuugcucuuauugcagaggguuuagauuccacacccgcaucaggcaguucacagcugccuguagcugcagaucugguggauccaacauccucuucuggcuucugugggcaccugaacauacauguucauaugugcacauaaauaaaaauaaaauacaacaguuaagaaacuucccauaauuccuuacuuguauaauuauuaauuuguuagguuugcccguguuuugauguucaauaaucuuuugcccaguuuuuaagauuguaucauuugaguuugcugagcugaaguccugaaucuuauuguucuaaacuuauaaauuguuguuuggcaugcaaugaaguauuuuaaauagcauuauuuuaaauaacuauugguuaaaaugcuaccuaauguaguuaauauuaauauauuaacuuuggucggguaugacagcucaaaucuggaauuucaacacugggaggcugaggcaggaggaccagcugugaguuugaggccacaguaaguuugaguacagccucagcuaaagaaugagauuauguuuccacaaaauaaggcgcgcgcguguguguguguguguguguguguguguguguguguguguaaaaugaaguuuccuauguguguguguguguguguguguguguguguguguguaaaaugaaguuuccuauacauugaaaaugagacucauaauuugugccuaggucaauacuacccuagcaacaaugcucaguaugcuggucacauacuguuuguauauaaaauaggaaccuaaaaggaacuaccaguauaacaaaaucaucaacaaacccauuccuuuauauguaagcuauuauuuucauuuuuuuaucaguuaggcauccacgcauccacuccucauucuaucugcagagcaguacuaucuuuaggugaacaacuacaacaaugccuacuguaucaggaguagccagcagacacaguggacugugccuaugggcugcuuuauccguuuaugaguuuauauagcuuauuauuuuaacucccacaaugguaucuguugcuucuaacaaugugcugcugcaaguaaacagaacagagcauagacagagcagggucugcuaaguaccacacugggagacgggagaugggagaccgagaacaccaacaacugagaagguagcuuaguuuccuaucagaagggacgcacgcuacuguagugguuguacuuugguucauaaaaucuucagcuuuguaguaggugauaaguagacaagcuaguuuuuuauuuuuaauuggaaaaaauaagaugagcauuuacaaguuggaaaaaaaacagauacugauuuccugaagagcaagcaauguugaugguugugcuaaguccacagauacagucuacuguguggcuucauguccacacauguuccucucguaaagauuuacuaauaauaugugacaaccugacauugguaguacuaugcacauagaacuaagcuaacaugcugaggcaagucaccauggugugguauugucaccacggggcuaaaacaccuggaaauacagaggaccaucuacaacuagggcuguguuucaagaucauccuucaaaccauuucugcacacgacccugaaguaagcgaaucauuuauacuuuaauaaccaaugugaggcacagccuuaggggacaagagcacaagguaguaugugcagguucucugacauucacuuuugcuauauaaagacaggaaaucguccuuuuuccugcaagaauuagggagaaaguagcuaaaaguaagucuucauuuguugucaucauaugaucauaugcacaaacuguucuguugccucuguccauccccaucaauaucuugaaucucuagccauuucauuuguuaauugucugaguuugucaggugauaccguucugcuggacugacauggccaucaccauccuugucagagacuuggaacacuuuacagauuucuucuuugcuaucuguaucuuucccuuuucuagccaccaugacuuaauauuuugggaaaugaaugaugccauuccaucaacaugcauucuuggaccauauccugcaauucggcgucuacuggguuuuaacacagcaaccucauggcaaccccaaguuccuuuguuucagugguaucauugccauccuucccagacagagacucagcugccuugaguucagcaaucuguucuuugugaucagccuuaguguacauaagagaagaacaggggcaggagagggcagcuguacaggcacagggacugagcacuggacgccuccacugccgcagcuaucccacagguaugcugcgcuauccuccccagacaagagacuccaaaugcagaaacguucaguggucuggucuaacugcaauuacugagcugaucaaacacuccucugauauucucuuauuccaggaaacugcucaagucucugccacccaguaccagcuaagaauuugaauuaagucuagaagauauuugaauggcaacaaaguccuuuuauaaaguugcuaucacagcacagaaacccuuugggaaguuuugaaagccaaacaacaucuccuccuaagguuccaacucaaacaccuagucagaccaaacauuauagaaauccucauggauuuaauugcuuuuccuggggacucaaugagauuaaaacuuaaauauucuccgacuccugaccagccuuuuuuuaagucucguuauugagcauguuaaaaacaucaucuaaacaaacagcagcuaucucuauuuaaaauuguuaugugcugcuucucuuguaguagaucacaugauccauuucuuaaggauuaaagaggaaaacagucauuuuugagagauuaucccaaaagcacaauaaacaguagaaaguacuaaggacucugaagacagaagggauggagauaauaaauacauuuaucccugccuuuaauggucaaugaguuuaugugaucugcuaccaaaacugucacugucaaucugguuucccaaguucuagaaugaaaacacauuugaagauacacuauucaauagauauuuuccauaauuaaaacuucagugcuuaugaacuuccuuuuuagauuaaucaacgaaacagauucacuaaguaaguaaugaacauacaugagauacucuaaggugaacuuucagaaauuaaaugacauaguaauaucaccaaugaaaugaaagcauagauuaaccaaauaucccccaguguaggggaaugccagggcuggaaggugggaguggguagguggaggaggagcacccacauagaggcagggggaagggggaacggauagggaguuucuaaugggagaccuagaaaggggauaacauuucaaauguaaauaaaauaugcaauaaacucaagagauccaccuaccuaccuaccucucucucucuaaaccaauuauuuuauaaccaucauaaaugaugaggcuaugauuugcuacuaaaaguuuggcagaaagaccuuauauauuuccuuuacaagaaaaaacaaaauugagaucacaaucuugcuuguuuucuccacgaguaauuuucaaagaaaauuaacgucauaguucuacauguaaacagacuuccucguuuaccagaacuaugcacacuuugaaugugucaagccacuauucuuauaugauguaugauuuauuucaucuuuguuaugcugaauauauucuauuaagauuuuaucuggaguuaucacuucacagggacaaaggaacaagucaccugugcagacacuuuuuuagugaaucagaugaaguccugaccaugccuacuauuuaugccaguuuucuuugagccugacacugagugauuuuucugugugcaggagaugcacaaucccccaaguauuacugagcucaaauucauuaauaugaagucauuaggguagcucuggccaccauggcaagaccaaggaucuuugcacacucaggcagcuuauaacuguuagggcuacguugguauuuuuaaaaaagaaauuuauauuauacagaaaacuguuccuuuauucuaaacuguuagccugcauucuugucucuaguucauaaaaacauaacuuauagauauaucuucauuauagaugcaugaaccaguggugaucauuaaucuauauugagcugaaucauuuuucucaagucugagaaaaaaggauuaacaaaugaaguagaguaaaaagaagugcccugaacggacaguuacacauauuaauaaagaaugcaaacacaugaagagagcuaaagcuaugaucugcugaguguccacacuagagaagauuugucuuacagggaaagcaaaaccaaacacacaaacaccgugucuuuacucucuucaaaagcuacaacaacacaggugcagauuuuaacaaagaguuauccuucuggggcuucuggcucuuccuaaagagagaacauggaauuuaaaauugcaguaagccaacaaauuuccuuuaagaaacuuaaaauacuaagugucacuccaccucaaagccaacagucuaaauagauauggcauuagaauuaaguaggaauuuaugucacucggaaagacaauaaauaaacauccacggaguucuugacugguucaguuaaaaaucaacacucgggcuguaaaaccaaaggaaucuuuccuugaaaacgcuucuauauaggugcucagucagacaggaagagccauucuacacgaagacaaagugggaaacuccaaagugcaucaccacaguuucuccagggccaggugacaggcagcucacggcgugaaagagcaagaguggcccaaugaugaaaugaacgaaggcucaggggagaaaagaaaaccauucaggcucuguugcugcgauccaagccauguguuggcccuagcuuguccagagacaaaaaccaaccaacacauaugucaucaucacaaaagagcaaacaaaucccauuaugaaacguauuaguauaucauaaaaaaauuuuaaacaaaacuuggguaucaguacugacacauauacuaugaauaauaguauuaaaauugucuuauguuuaaagaacaaauugucuaacgcccaaagauucucaugauaauuagaaaacuuuugcucagugguuuuaagucaauuaucuuuuuaaaaaaguguuuauguauuuuucuauaucugcaauauaaacuauuauaucaguuggguaacaauuacaaauuguuacaguuuacaaauggcucccaccaugcauguuuucugucauauacagguuuuaauuucccuuuuuaagaucaacgcccugaacuguccaacuaaucuuuggaaaagaccaaaaagaaggaucgaauuuuaacugguauuagaaacgugaagguuuuaauucauucuuagaggauguggauuuaauacaauaagcacauauucuuuugaaaaauguuaaaaauuaauuacaauaccgguaccuugacuguaaucucagcauuuauucucaaugcacaggcaggaaaaccaggguuugaggccagucuggacuauacaggaagcccauuucuagaaagaaaagcacccucuuugguagccccggccacguauguuuucugucacacacugacaguugccaggagaaaggguacaacuguuucacuccuaugcaggucauaccccaaguccugcuaccauauaacagacaccuuucccacuuguauuacuuguguuacugacgucaaauaaauuaucagaaaaauagggguuauuugauaaaauaauuuucuuuauucuuagagaaucuuugaugggagacuuuucuguuauuugcuaacuuguuuuuuuuugggggggcaggggggaggucuauguagaacagcuugcugggaacccacuugguaaccaaggauagcucugaacuccuguucgucuugccucagcuuuccaaaugcuagaauuacagggcugugccaccauguccuaccugaugagacuuuaggaaacacacucuucuaaucaguucuacuuuacagaaauguuuuaguaucuacuuacauuuuauuaguugacaaaguuuauugggcaaaacagaaauuccaucaaucuuuauaacucucuacagcacuuucaaaaguucacuuaaaaaggcaacucuaauagaaaagaugacuguuaaacugaucaugacguuacuuaguggcugccuuuuagaguccguaacucaaaucaaccagccaaugaguaaacaauacugaaggguauccucccugcucuuccucauucagcucacaggagucuagaguaaccaagcucaaccaagugggaaauagacagauacacaggcagaucugcagauggaagugagccaggccagcucaccucugagugccuggcucacugaaacuacaggacacugucucaaaaauuaugaugccaggcuaagaugucugaugucaagcucugacuuucacacacaaggacacguauacauaugauaaaaauuccucuucaauucauuugguuuauggaaaauaccaccaaaaaguuaauauuaaagcuuauauguaguuauuuuauuaauaauucuaucugccaagaaacuaauuccuagaaucaaacaaacauuuaauaagucaugcaccuuuauaauuaauucugaacgcaguaacccccaucauuuucucuaauauauaugauuucuagacaauucugaauuucucugaaaugcuuuccaaaaacauugaggugccugacacagaaaagagacugagguauuguuagcacagaaagacuuugagagcauaugacuuauuuuauaaacccagugaccuacugacuacuuaaauacuugucucagacuuugaauuuauuucucuuugaggucuauauuaaaaaaaauaugaacauaugaacuucaauaagagauccuauccaucguuuauucuaaaagaaccuucaguauuagaggauguuauucacuacagugagaaucaccaaacagcacacuauuaacucagccugaguccaucagggauucuauaaaaaugacauggccaagccauuaaagugacaaaacucacauuuccuacaaaaugguuuuauagacauggauuuccgguacauauaaucaaaugccaguucagcaaauucuuaaaaauagacucaaaguccagaaccaucagaucacucaaaauuccacaggguuucuuuauugauaagaucuugcuauuaugaaaauugacuaguucuagccauuggcaauaguucuggcccagguaugguacaaaagaaugcauaaucuuggaggcauuugguguuuaaauacugagacucagaaagacuuacuacagacaggaaggguaaaauaaaguucaaaaccagacauauauugccaauucacacaauuauaccucucaaacugguuugacuaagaguaaacuauuuuccagacuacugacuauuuacagauaaugagcagaaacgagagcauagcucuuaucacaggaaaccaaacucaagaauauuaacuacaaggaggaaguggaagccaguuuuaauagcugauaucucuccaggucaaaucaauuucaagccuaaguucuugauaaucacucuaccauaaggccuucaaagcacaaagcuaguauuuuuagugaauuuuaauauaugaugcacuucuuaaaaacaauauccccaucguucuacuuuggucuaacuaccauuccaggaggcugcaaguguccauccaguguuagcaucuagcucuagcacaagcaccagaccaccccaguacggagcagcuccauguggacaacuggguagcgggccugggaaauucugcccuucagucguuccugacauaagaaauagcaagacucccugucaguccucugcaaucacuuaacuuuccaaagaaguacugaguaagagcggugcaucugccaucauacuuuagcuagcauaccaaaaaguagauccauccauuagggaccaagaaacaggaaauaauagcaauggggaggaaguuaugaaaaaguuugagagaggaaagggaggggagaaauguuguaauuaaagcucaaucucaaacauaaaaaaaaaaagauaauuaggaauaugcuuucuccuuuuaauccuaaaugacaaaagguuaaguaagaauaccauccgcuacaguauguaaaggagccagcagcucugagggugaccgccaacagaggagagaaacagggacagugauggaggcuuaggcaauggcugcuggaaaccaugcagaucagguagaaucagucaacuccccaacagaugccuaaaaugacugaaucagccacaagauuaaaagauauuauauggguaauacuguagaaaucuuaaauggaaaacaauaaauuaauuucacuucacagaugcaccgagcaaugcauuuaaaacaugaguauauuuugucaaaagaaccauuuagcauuaauauggacuauuuagacuucaaaguuaacaucaaacaacauuuauucuuuauuaauaugcuugauauuauugaauaaagcuacuuuaaaaucaaagcauauuuaugcacauuuauuaaaaaaaaaucugagggcuggagagauggcucaguggauaagagaaccuaucugcucuuccagagguccugaguucaauuuccagcaaccacgugguggcucacaaccaucuguaauaggaucugaugcccucuucuagugugucugaagacagcaacaguguacucauauauauaaaauaaauaaaucuuuaaaaaaaaaagaaaucugaaaggcaccaaugauacaugaaucuuucaaaacggugacuaacuccaaggacaggacuauacuaacuggucuaguaauccucccagauccaguacuuacaaucaaacuucaggauccagcauccacugagaaucccaagcauacacuucagaguacucugcgcuuccucaucaggaacaaugacaugaguuacuaagauacaaacaaagcaauaaggaaaacagaaagaaaauaaucuacuuuugauaauccguuaauucuauuuaauuaacugacacuucaaagauaacuuuuauauucaguauaauguuucuucuauucaguacuuuuuaaccuggccaucaacaugaaaaauaagaucauaaaacacaucauaaggccuggagagauggcucagugguuaagagcacugacugcuuuuccagagguccugaguucaauucccagcaaccccaugguggcucacaaccaucuguaaugagaucugaugcccucuucuggugggucugaagacagcaacaguguacucauauacauaaaauaaaucaaucauuugaaaaagaaagaaaguuaaaaaaaaaaagaaaaacaaaccauaaaacaguauucacacacaaaauuuucagcuacuuucaaaugauucaugguaucauacuguacuauaauuuauuauuaacaaacucagaaaaucuguucuucugacagugcucuauccuaaaauguauauaaggcuuaaccuuacaguuccuguugaggguagagcaccugccuauuagcauguaaacagccuggguuucuucccaguaccauaaaaacaagcaaaauaaaugcuuuauauuucuuaagcauaucaaaccuauagaguauagauacauuuuauaacaugcaaacuacauaacuacaacccaaugcuuaaagcauuaauaaauuaaauuaauaaauuaaauuaaaacauuaauaaauuaucagguuauucuuuaaugggacuaacauaaaauuguuuucuaccaagaaacaaaaaacaacaauaaaaacaaaacaaaacaaaaaaacuuccucaccuguacugucaaauuccauacacuuuuuagccuuaagaacugucucaaguuugcugagcauuuucugcugcugugaagaaagcccacugccuauaaauaccagcggcccauucuuucgcugcccgguguucaccuguuaaugaauaggcauuaugguaaaaacacguaacagagagaaggcacacacucacuaacaagacuccuauuuuauuaauuaccuuauuccaguuauaauccccaguaauuucuagugagucagugcccaucaaccuaacacucaaugcacuugaauaacuauuuucuauuuauucuccugccaagccaauguuaguugaaauagcuuuguccaaacagcaagcugcuuuuccugaugcugaacuagauucacagagggcuucauaauuucauucuguucccaguaaccuaaaauagccauuaagaaugaccaauuucauaucccuucuccaaagaguugaaccuaaaaaaaaaaaaaaaaaaaaaaaaaaaaaaccuaaacuugaucuauuuaagcuaagauaauuuuaucagcacuaauucugaagaaagaaaauaauuuuuuaacccugaaucaaagugaugauccugggcgagagaacugaggagugaagaaagcagaugcacaaauaggaaggacucccuguugcuccugagaaagaacaacggcugacuuacagagacugacgcuuaacaucuaaagacaaauagacagcagcggugaagaaugugugagaugugaaggggcgacaauucagaguggagcacccaaaagccuaaaggacaaaacuacaacuagaguuagacaaagcugcuugugaaagagaaggaaagaggaaacagaacaccagcacuccugugcuaaggacaagaugccacauccacauacaacacaagccacugggccuuugcaugcacugagugcaaaugugcacugaaggcugggcugucaaaggcucuguagaacacgagagagaaacagcaaaggcaccaucucagcucagcaacuagaggagacgcucgguauguaaacauuaacuucacaucacaauagugaugacuucuucagacucccuaugcuaagacagugaagcuguugguuaacucuacaguugacucaauucauucaaaaugaauuaaaugagagcuacuauauaguaagcacacaaaaauaucaugauaagugacaaugcauggcacugaaguucagcaagguaaguuauuuacccacuuaugguucagauaacaaagauuugacuggggacauauacacgcauauauuauuguauucccauauaaaugcauuauuaaucucuugucagagaauacagccaagucaaauuuaaaguguaaauauucccuaacaugaaaauaguucagaauauuuucaaaauuguucaauuacaaugauauuaaaagucaacugucaaaaguucuuguccuuuaaauaaguaccaucacaauagcucugcagagaguacucauuuuauaugacuccaccuuagguaaauuagcucuucacauaaaacacacaagugaaaauuaucauuucuaaauacagcauacaaaacuauuugugccaagcaagggaaguaucagagugggucaugcauuuuucuauuguagucucuuuuuuaaaaaauugcauaaaguauaaagucugguacuaauuucuuauaauuaaggacugcuauaauaaaguauaaaguaaacaacugccaaggacacaugucagcuuggaauuacacaucauaggggcugagaguuucauucaaguaagaaggugucagaaccaggaugcucaaaugaauccagagguaauacuccuacuuuauagaaacuuagggauuuguuccuugacaauaaguaagcucaguacuaaaauucaauauggaccuuucguagauaaaauuacugcuauuauuaauaaauuuaucagacuaguggaguuaaagcgucugaaaaggcggcuaaaaggagggcacagggggacaaggagcuugcagcuaggccucacuacccgagucugauccccaucuuaguggcaggagaaugacuccugcggccgucuccuguccuccacgugugcacaguaagggugaaucuagucacauacacacucacacauaaacauaagcaaagacaauaaaaaaaaaaucccuaaagaaucaggaaagacuagaaaagauaaacauguugcuguaagggacagagaagacccuaagugacauggcaagaagcuuucaguaaaagcagagguugguucucagccucaaagcagagccaccaaauuuuacuugaaacacagcuuugaaugagaaacaaaggaauuaaacugcaucgacuuaucaacacaugcccugaugcagugccucagcacaguugucaagauaaauauaaccacucuagacuccacugucaagcaaguguacaugguguggggaccagcaugcagcacacucaccacucucuggggcuuaaaagccugcucacaaaauccacacacuauaagugagaacucaguacucgccacacugcucuccaggagaagaccuguuacagggaacaagucccugccuucaugcgguuuacauucuaaaaaggcaaugcagacaggcagacaggcagacagacagacacacacacacacaacagcaggaaugugcuguccuucccucagcuguaggguaaagggaacaaagggugggcagugagcagcacugggagaaugcugcuuuuaagcaaugguauggaguuggggcuguaguucauggguagacuacuuaucuaguaaauauaagauucuaauuucaguauaaauagauacaaucaggucugaaggguuaaggaagcaagauauaggaacccuggcuucucaaaucuauucuugguaagaaaauaacuuaaagccaggacgugaaagggaauguauuugauagacuaaagaccuagcaagacagucagguugagcgaguggugucugaugguggcuaugggcauccaucacagaccuuaccucuuaaugacuauauaugaccuaccaucuccacuuacauagccuguaucacccacuagguucccgagccaaauaucaaucauuaagacaauaagauugaggcaggagcaaauaaguuguaaauucuaggcuauccuaggcuacauagugaagaccuaucucgaaacaacaaaaagacauaaugauaaacucaaucucacauggcauauagaaaguguauguuucuuagauuucaaaauaaaaauccuuuuaaaggugauugccauaagacuccaagaauaccauaaaaguaucuguauuucuuacacauuuaaaauaaugcaugauaacaacuuagacauaccaugucuggcaggaaguucaaguacaaaucaguaaaauaagaaccaaaguauaaagcauggcauggcagagcagagccaagacuuaugaaagcgaagcucugauugguccauuaagaaaaaaaaauguucaaugucugguuaauaauccugggcaaaucaugaccuuucuaggucucaauuuuuccauuuuuaaaaggaagaaauuaaagugcugacuucuagguccuuuucauuucccaaacuaucauuuggaacacauuuaucagacugcagucuaaaacaaaagguaacguuucucaggguauaaaggagacuaccccugauagcaccugugaccacagcagauuauaaccagcucaggcgaaaucuguaacugagcaauggcaucaaucaccacugcacugcccuuucuggaugagaagggcucugaagaccagccauggcuucacucagccugacaagacccaacaaagcagccuggggugacugaguggacucugguaguaguuaggggguaucacaucccggacauuaccucuuaacaacugcacaugaccuacuauuccaacguacacagauguguuuaucagucacuagcuuccuuagcuaggugucaaccauuaagacaauaagaaggcuuggucauagugccacauccuuccaucauuugaauaaacaugaaaauaaagugagcucacugugucugucucuucucuccauccuccucauucucaucucacuaccaucagccaucauuucagauccuacgaauucuagacauugcugcagcaaccuccacucagccugagcugcaucugacugcuagcucuccugcagaucguuuuguuccagguauaaacacacagaugaggccccauuaaaucuaaagucccuauuaaaaaguuauggccucucucaggcugaucccaaucuagcuucccacccugaaacuacuuaacguucuuuaugcucuucacacacuaaacauuaaguucuucaaauuuccaaggguuuucuaugccuccauuccucugagaagcugaagcaaugggcuuugcugguuuuccacacaaccauucuuuucauucuuuucaucuucuacacuaacaucagucagacuuuauuagguagucgcccuacaagaucugucccaucucuaucccuggauaccucaaaaccaauuuguagccaguucuaacaaaaagcacaagaaaagaucucagcaaaggcuccaauaaaaugcuuugcugucuucuagcuggccacugucacaucuggaauuauagcaacuaccuuauaggcacaaggacauauccguaacaccagggacacuaagucaagggcaucaaguaaaggaaaaacauggguccugagugcagucagcagugcccacgguggccuuuguaacagucaguggugacaauuacaagcugucuguuaucuuccacaacagcauucgucagcucuuucccucagacacugucaucuucugugaaguucuuccugacagcuucugaaaugagcuugcuccuauugcacaugucacagccucugcccauuucauaagcucuuauuauauauuacaauuuauaauagacuuuuuuacauuuauaucuuccaauuggcuauggguuaacaaggaaugggauucuuccacugucucuagcugguaccucuuaucuaauucacaggcucacauauccaauuacuaguuaacaguuccaucacgagauguacaaguggaucagaggacaaagggucuccccucccaguacuaggaacuggcaccaacuacaccaugacuccagcgagacuaauucugcuuguuuuccacucaccagagaaaacccaagaauaagaaaaaacacacacacugaaccacaauacuucucacagaccuucagugcuauucacuuaguuagagucuuaucugucacaaccuugccuguuauuucuuccacucucccacacucuguagcacagaaguucagcccugucacucuugcacugaaacuuuucaguggucuccauucucaaacucucaguuaucgucagcaguaacaaacucuggaaucuucaagcacagccauuucaucugcuugagggucucuauacaauguguguuauguggccaccuggcugccucccucucauaaucugucuuaguuuaaauuguuccugaaaaggcccucacgaacacaguguccuucaggagccuagcaccucgcccaguuacauacuacaaagccaucuugaaagcacuuguaaauuuacuucugaaaugagugcauguaucaauuuacauauucucugaccauuucuucucuaccucuuacuggcaugcaaguuccuugaaauaagaguuguuuuagucaaaugcauuguuguaugaaugcugccuaaagugcaaaggauucaauaagaugucuugcuagacuuauucugauugugucuuugaauccauaguagucaguacuccagaacugcuuaguaauggugaauaaaagcuaucugcuaacuggaaguuuuccuacuuuuuccuuuuauaaccaaguucaauaaaagacauagauguagcaaagcggacuccacacuuacgauagagcacuggcuaguugagaaugauucauucuccucuggcagcagcaauaaugaucuuauauucucauugucuguauaguccacaggccgcacaccaaauauguuacuguuaaaagaagugcacauggguuuaaguaaauaaaauguguaacuucauucuuaacaaagagacacacuucuagaacuauuuucaacauccuuaauaauacacaauuguaagcaaagugucagagcucacguagucaugaggaucgacuaucaaaugcuccugagcugggugaggaaggaaagaaggaacccagagcacuccauucccuagggacugugccuccuggugaggacccagguccuuccuaguucuucccugcagccccuucaccuuuuccuacaccuccgacccauagagcagcucucugccagacucacagccuccacacuaggcugggacucagguaggcaaacuguauuguccuuccugcccuccauuaauguucccccuccaccccucugugcagccugucugaaggagucccuccucccagcccacuucaucccuuuaggggucuggccucaggcucagguuccauuaguucuucccuguggccccuccccuucagccuuuccuucuaccccaucuccacugcucugagaccccccaccaccaacccacagagcaucucucuaccagagaccuaaggcuaggaucuagaaucacucucuaccagggaccccagagccacuacauuuggcugggacucgagccuccuuccagccgacauccauuaccuaggaacucagccucuuaguguggacccuaaaacagagacacucuuguuaauagaggggcauauauugucacucgggccaauagacaaaaacuaaugcuguaguuaaauaaugucauaaacgaaauagacauagcagacauuuauaaaacaccccacccaaacacuaaagaauauugcuuucuucuuagcagccuauggaacuuucuccaaaaguggccauagauuagggcacaaagcaaccaacaaaucaaaaaaaaaaaaaaaaauugaaauugauauccugcagucuaucugauuaccaugaguuaaaccuagauauuaauguuagaaaccacagaaagcagacaaacucacugaagcucaacaacucacuacugagugaaaaagaugggucaagacaaacgugaacaaagaaauguaaaacguuuuacgauggaaugaaaauaaaaacccaguguagggauacagugaaggcaguuaguuccaaaaggcaaguucacagcacugacugccuacaucuaaagcuugacaaggccuuauauuagaaacucagugaacaccugaaagcucuaaaacaauaagaaauuaauacccuaagagaagaggacaaggaaaagucaaacucaggcugaaaguggugaaacagaaacaauaacagauaaaaagaaucaaugagaugaaauugaguggauagggagaugggcagaaucuaggaagagucaggggaggagaaauaacaugauuaaguauauuccauaaaaacagauuuaguaaagaaaauuaacuuuuuaaaaugaaauuuuuccauuaagggaguaucuuuaacuaaacagaacuugcauguacauuuuucagaauucuguauucuguguauucauauuuuuauuuccuacucauuaaugaccauauguuuuuaugugcaaacauaaaccauuuacuagagcuacuauaggugcuauugucuauauaaacaaauacaaaucuagauuauuaaaaagaaagcuauccggauccauuaggacaaaccuacaacacagaacaaacaaccaauaaaguaaugugugugugagugugugugugugugugugugugugugugugugugugcaagcaugugugcucaaucuagucuaaauaaacauagccccuguagauucuaugcuucagagaacagcugauuaacaaucacugaacacacacugcuuuccaagucacagcaugucauucuggaagagguuucaaagaucauaguaggacucuauuauuuccuagaacauaaaccggaguggcagguuccaaugaucugauuaggucacacuugccuuguaucauacucaguaacauucaauacuguccaugcuuaauauauccauuguaaauaauuuguuaaagcuauaacacuuggucaaacauuccuuuucuuuauaguuggagaauauuuuuaaaauauauuuuaauauaccuaugguauuaagcuuucacacugaaguuaucuuuugaaauaucuuauggguuuuaagacuaugguauuuauaccuuccauuauagcucauuacacacacacacacacacacacacacacagacacacacacagauauacauguccaugguucagugcuuaucaaacauguacaauacucuagacuuuauacaaagcacaaagugaaaauauaguguguuaagugggaaccaaaaauauuuucaagacacuaaaccaauuuuauaaacugaauugagugucuaaaaaugucuuaagagaaaaaagacuaaaacacuacaggaagaaggagaagggaaaaugucaagccaguuggacaagucacagaagucacacacuaaggcugugagccucuccaguaaaugaccuuggggaaagcuauuauuauaauggcaucguggggacagagagcuacgagauuaagauaagaaaugagucacagcaaaucucucaugacagcgauucaugaccaacaggcucaggugcugucaucuuucagcagugcugaauaccagugacaagucugcauccucagguuccccuuccugcccagguccacaccauggcccuugccuuagcaacacuccuccagccacgguaaaaggcaacugcaucuuagguuucugauuuacaacaauguagcaugaggcacuguuuacaguuacagcaggcaaugucacagcaauucaaagggaucccaucuacucuacuggaaaugucccaauuucauacucuauuaugcucacauaccaacuauacuaucuccucauauacauaugcuauaaaugaccaucacaauagaauucugauugaagaaucaagauucuauuucuuaaaccaccaacugcaaacauggguacacaaagucaaaguuuauacacacacacacacacacacacacacaccaagcacgugaggacuuucuaacuagauuucagaauucacagaaagcuuaaccaagugaacuuuaauacacacuaacagaugacauuagcauuguuauuauacaaacagaaauaagacuucccugugacaacagauagaucaauagauagauagauaaacagacagacagacagagagcaggcaggcaggcaggcaggcaggcaggcaaaauggccuagaacaauuaaauccucacauucugaagaauuucuuuauaaacuauagcaggauuuuuuauaagauauguauuuauuauauacaaauuacagaugacauguucagauaccacagguuuuuaaaaaaaaagucuaagccuaguccugcuuuauagaagacaugaccauagaagacacugucauaauuugguguuuugcugucaaccacagaaauauugaaacagacuaagguuuacagguagaaacuuaaacacaacaagcagagaugaggcauauuccacucuuauguggaaauacacaaaauaugcuuucuuccauaauauuugaauggauuaacacuuggguaacagguauagugugaaaaacuaauuuaaaauucauacuguucauucccuuuguguaaaauagauaugugaaggaaaaguaacacgcuauugcauagucacuaacacugagacugcuaauuauaacagugguaaauuaguuauucaccaucaucguauacuaaagguuuuuuaugauuaacucaaaacagacauaguuuauuauuuuauuaaaaaggacuacaaagagauuucacaaugauuccuaacuaaauauaaaugcaauauucucuauuuucuggcaugaagcauuagcccuaauacauccagaagaaagaauaaaguguguagaacuuuucauucuuuaucaacaacugcgagcaaauacuaacacaaaagauaaguaugaaacgggaacugaucauguauauaucaaagaaaaguaauggggugaaauaaagguaaagaauauauacuggcaaaugaaauggucuugggccaagacuggaaacuggcaugugguagaugaacgggaagggaagagcccgaggaaggaacagcaauauggcggugagcuagcuguauacaccacauggaaagcagccuucuacuacaugaacacaugggacaguaaaauacaauggaagaaacuacuccaguaucagacauaagcaauggacauuagagggaaggagacacuacaacugggaaacuguuaaagcgagggugugagggucagugcagcaccaauaauaacuaagguauuuucaggacacaggguuauaaaauuauuuguaguucuugacaauauaugaauaacuuccauauguaucauuucuaaccauuccuuuaacgccuuguaucaagaaaaaucucuuaaaauucugugaacuccaaaugaucacauauaaauaauacucuccaugcaucaggaauucaucuaaaaaugcugccuacuugguuacugaagcauauuauaucaucauugaccaaaguuuauuaauuuucucuauugauucuaacacaguauauuagcagguuuuccaacuuaauucccucuagcauauacugcuugcccuacgguuuuacuuguguaagugugaguguguggggaacagagcacacgggcuguaguugggcuuucccuuccuauaggaucccuggguccuagggagugaucucacaucagucaggccuggagacaagagccuauacccaaugucauuagccauuugauuggccaucuccagugcuuuuguuugguugaguuuuguuuuuuaagacagggucucacuaugcagccucagcugucuugaacucuuaaagagcucuaccacucucugcuuccuuagugccaggauuaaaggugugagcugccaugccugguuuucucucauuuaaaucacauuuuagaaaauauauuucauuuaaaauuuuacagaaaaaguuaaggauuuuacauguucaaacgcucacagaagucaggcaugguggcgcacgccuuuaaucccagcacucgggaggcagaggcaggcagauuucugaguucaaggccagccuggucuacagagcgaguuccaggacagccggggcuacacagagaaacccugucucaaaaaacaaaagcaaaaacaaaaacaaacaaacaaacaaacaaacaaaaauccucacagaagacaaguguuccuaagcuacaggauuuuacuaccuaacagcuggggggagaggaaaaucgguccuacugaacacacuaauagacuguaugaaaauuagcaauacuuaauguaucuaaaugaugggcaugugauagaaucaauaaucauccauguacuuuacacacauugagaaugugguaagauugcuauauaaucaguuugaaaauauucauccauccaacaagggagguucuccuccucuuuuccacacuauggagccaguuacacaaagguacuuuccaucucgacagagcucaaugagagaaguacacugcgccaacuuuucagucucgugagacuuuccagaccuagaaagggauacagaggcagaauaagaguccuccaagcagagagaaagaugugagggcacuguggguuagucuagggaauccucaaaacugaaaaggggggagaagagaggaaacggaugaagaaaaggaguggggagaggagguacacacaugugccucaggaaacaaagauauggaaaccaagagcuaugugugccuacuuuugaaagaacaaaagaaugguaugaagguggacguuucuccuggagcagcaagacccugaacaggcuucaguaggagggguagcaugguacaugagagcuaagagccagguuccagaggaaaacugcccaaauucaaguuccagugcuaggaucaguuguguggccuuucacacaaacuacuucaaucucuuguguccauuuccuuaccuguaaaggggggcuguuagaaccuaauuuucuaugacuacuaaaagaucaagugaauuaauguaucaugaauucauaagacaguggccagcaaauaguacuagcucagugacugcuaauacugcuaaauuugcaccauugagagacagacagaaaaaagaaauaagaaaacaugacagguuauacuuggagugcaaaucauauuauaauuucccccgcuugaugauacauuucacacacauucuacaauaauaguuuggaugcuuaauaauggaaaauacauugaagcauaauuuuuuaaaaauauuaaaauaagaaucuucauuucccuauaugguacaaucuaaacauaaagaguaugagacaggggcugaaaaugcuucuuagccaagauuccuucauaucaucaagacggaugaagaaggcguccuucaguuauugaaggguuaaacugcgguguuuacggucucgcucuacccaagagaguguucagacaauaaauuccucuaauguccuuucccauacaggagugaccuaccuacagcugugcccugaaucagcuguaacaacaagauaaaguaaggagaugcaaaaacaaaauuuuuguuugcauauguagaucauccaacauucaaaaacauaaacuaggcauuuuuacuagaacuaaacuuacaagacaugcccaaaugucacgacaauggaugaacaggauccuuucugaacaacuauaaaacugcaaucacaaaggcuucauuuuuuacaguacuuugcuugcucugagcaggcaaaagcaaucuuucaaaggagcagcaugcuucuuuaaggcuacaaaacaguuaucuuugcuguauaugaucuguuuuuuuuuuuaaauuuacuagggcaagaaaacaauuaauagguccaaccuuccauauaguauuuuucuacuugagaauucaauguccauccaagggaaagcucuuaacaggaaaccaaucaccaguuccaauauuugggaaggagggauagcguauaaaguuuucaacauacuccaaacaguucuacggugacagcaucaaucucagcugaaggguugcagggguuguaggaaggcacggagaaagacaagcggcaaaugcagcuuggacaacuaucagugcaaaaaucacuggauaacacguacuauaaaagaugcauauucuuucucauuagccaagauuaaaaugaaauuaguuuuacucuuggacaaugaauucuuaguuaacagaagauaaauuacccacaauuaaauacagagauaaaugaaaaucagaacaaaugugaaguauuaugaaguuuacacaguacaaguucaacacacauuauaaaacacuccagcaaaaugugacuucaacaaugagauacaagaaaaugaagauaacucaaaccaaaauguaaauucuaaaguaggcagacauguuacuuccuacccucugcaauuauaaauacuuagggucaaaacaauagaaaaauucaguugaagagcauagcuucuaugaaaaaaacuaggauuaggaagacuccacugaugacauuaguaaauguagaauaucaaugauacacguuuuuacacuggcuaucacuaaucccuaacaugccuugccuuagauagaucauuucaagauucccuucucuccacaugcaacacgaugccuaugaacucauuugcuuugcaauauuagauguucuagccuuucuucuacaucugaccuuccauaaagccucaauaacuacuuauauugaugaguuguugacucagcaguuacuacccaguuacuaaggcauuugagcccaggaguucaacagacuagucuggacaauaagcaagacuuugcuucaaaagaguaaaaaagauauauuacaauaguaucaaucgaguuuaugccagaacacaaggauguuuugaaaugaauaaaagugucaugagaacaacaaaguguguaaucaucucauaaagaugaaaaucauuuaauaacacaaaauauaguuuuguuuuuaagaaaggaaaaaaaagacacuagaguccuggccacacacgauacugagaauaaagaacggcugagugcugcagacguguauccccuuuucuuaacacuggcacagaagagaugggaagaauaugggaaccugaagauagggacaagagcuacaacaaugcuaacuucuaagcauaacgugaccauggcaaacauaaacucaaaggagcuuguacguacuagcucggacgcacuggacauacacaaguugagccagcacaaaagucagcuaggaugaagaagagacucacaaagcacccacaccacuuacacugaacuacuggcagcuaauggauucugggaagaggaaagcauccuauucaguugugcacccacucgugagccuaucauacucuaaugaauaguuccaaacccauggccagagacagccauugguccucgauaaacucugggacauuaaggaagggaaguaacagaggguguccagaagaguaacuauacccacacaaaagagaggaagggagaaaggaacagagagagggagagagacagagagggagagaauuaugucuauuaacaaaucaucuagggcuggagagauggcucagugguuaagagcacugacugcucuuccagagguccugaguucaauucccagcacccacaugguggcucacagccaucuguaaugggaacugaugccuucaucuggugugugugaagacagcuacaguguacucagauaaauaaaauaaaauaaaauaaaucauuaauucauuaggggauccagcaaaucaaauaccuaauacagccuugguacuuaagacacaucuguccauacacacaugcaaaacagauuaaaaacuuccuaagagacacaaggcagaaugcuuaaagaaaugggggaaaugcuaaauaaauggugacauuugccaacuuacugcaaugggugauucuacucauuuucauucacaauacuaaaaggguauuuuuaaaaugugacgaaauuguaaucucauccaaauacuuacugaaagaugaagaaauauuucuuugcucacugaacacugacucucuacacacagaccugaguacugguuauguuagguaacugagagagacugggauagcugacaugaucccuaccugguccauacagcaaauaaccgaaugggaagacaaaaaaaaauauacuguaacccaaaccuuauugacaaaagaggcaccauauauagacaucugaaacuaacaaagaauacaaaugaaauuaaaucuaagaugguaucaaaggaugagcuacuggcaaucagaaaugaauauuccagacaaaaugaaagcacauacaaagggcaggaggcagaguggccuuuuguuuuaaggacauaaaaauuaagaaagggagcugggugguggugacacaucccuuuaaucccagcacucaggaggcagaggcaggugaaucucugagcucgaggccagccuggucagcaaguuucagaacagaacagccagggcuacaaagagaaacccuaucucaaauaaauaaauaaauauuuggucagauuuauauaguguuuaucaugacuacaaaguuuaauucaacacacacuuauccaguaugggggaugaauuaaagaaaaagaauuugaaaaggaaaccaacaugauacugauaaucaagugaacaacagcucauacacauuuaacacacacaaacucacacaaacacuacaagaggagaggauuuuaugauaaccaagaggcuacaaaagaaagaauaaauguucacugacagcaaccacaccauauuaaauugacacuuccaucuauccgauuauccuuuauccaacaacagucucaauuucucuuaccaaauaaauccuccucccaccugagcuaucuauaccaaccauuugacacaacacaggaguuaccagacacauguggcuauuuaaauuaguaaaaauuaaguaccuuuaaagacuuuauugcugagaggugauuuccaagagcuucacaaauauagauagcuacuggccccugaauaucagacggugacacaaacauuuccuuuaaugcagaaaggucuaccacagugcuuagcuauaccuaguugugucacuuugcuaggucaggccauucaugacaaaaugguaccugaucucugagaaaguaccgaugaaggcagacuggaucccugccuuguguccacuccuuguauauuaacaaauccucacagcgcagugaagaaucaugguguacaaaccacaagacaggcucuguguuuuggcucauuaauccucacuaugcucugaagaaauagaaaagcagcaggcagcgccauguuuuauaggugaggacaccaaagcacagaaauuaaccugccugcggcuauaaagccaauaauggagucgcaaauaaaagcuggguucccuaacacgaccagugcuccauucauuaaaguagucacggcugauuuaagaacccuaggauggaaaguacucuguuucacccgacccgagcaaccaguugcuuuaucaaacggcuuacuacacccccaggagggucauaucuauaaggucugcacauaguuauauauuaccucuauuaugagaguccuauauacaaaugcagagaaacagaaaaaaacaugugcacccgcgcgugcgcgcgcacacacacacacauacaagaggugggaauauacauacauacguacauacauaaucuuucccagaguuugacccaacuaccuuacaacuugugcugggaaauuaagaagaguugauaagcuuguugaagcuaaauguacuaggguaugguauauucuucauugguaaauuguuuuucaacuguguuaaguggcuaccuauuaaaauuacaagccagaggaucugcaugguguagcuuuuucuuaucucucuaccaaggguaaagcuuuuguugugcucuucugaagccuaaaaagcaaugagggcacaaagaagcaauucuugcauuuucauuucaacugccuaauuaacugaaaagaguaaaauaacauauagaaagacaggagucaaguuacagauuaaagauauaaaaucugcauauggcauuugcuugcgagccucuugacaauaguaaucugaagaugcagccccagcauucgcuaaugcuccucugugcccugacacugcaaaacaauuugcucagagacucauuugaauaaugugaaaaaucugggagauaauucaacugcacacccaauaucugaauucuucuacacuuugacuuuugcuggacuaauaugcagaaagggauaacagaauauuuaaaaugagucuaaaguauuaaauaacacaaaaaauuaaaucagauuucuauuaaguaucaaaaaauuaaauaucuaauuuucauuacauaugacucaaucuacaggauauaaccacuaagugaauuugucuauaaagcugagguuuguagauguguuugaaauuguuucugaagagacuaaaucucccugaaguguaugaguuuugaggaagagagcaugaguguggauucacacacacagugaucagcacaucuaaguuuagcuguggaagacaagagaccaaaauaccaacguggguauuuacugcuucgguacacaucaccauucaggaacacaaauccauuuugaaaaucagauacuuacacagcauuccuggaagcaccgugggacaguaacaccuugacuauaucgauguggccacucuugacggcaucguggaguggcgagucauucugauagccagggguguucaccagggcauuaugcuggagcagcaacuccacuaccuucaggugcccaugacugcaggcuucaugcuaauccaaacaaaguuucaaauagggcaagugggaagaagaugggaaaacaguguguuaauaaauacacauuagagaaaguagugggaacucaagucggucaacuuauucuuauagaacucuuuucuggcuguugacagacacuuaucguaauuuuuaugguaaaaugugcaguagugaaaauccauguacuuugugggaaaggacaagccuuggaucaccugcuuuucuugaaaaacuuaucguaauuuuuaugguaaaaugugcaguagugaaaauccauguacuuugugggaaaggacaagccuuggaucaccugcuuuucuugaaaaacugugcuuuagagcaacuucagcuccuauguucuccuacacauuacaacagcacaaaaagacucuucauguggaacgagcagaucaaacagagauagggaauucuccaaagcucaagagaacuaagugcuucguccauaccccaaacugcaccccaacauuugcaccuagucacccagcagagcgacagcccaggaagguuuacaagacauguaaaucucugcugagagacacuacugggaaucuggggucagugucaagagaaggaacaugacuaagugugacagcuaauguuccuuuaccauguuagcuagccuguggaacacaaugaacuaaauccagauuaagcccucuuggcuuaagaacuuggcaagaaguuauuuuauauauacuauguauuuauuuuaacauauuuauauauuauaccuuuaagccacuuuuguaccuggccuaaugagucucauuucuauacugaaauucuggucuacaagauaaaggccgcucuuuguacacacuucugggcugcauucuaacccagugcuuacggucuucauuaacacaaguuaaaacuguuuccaaguauguuuuccauucuuuuuccagaauauucuucacauuguaaucaaugcuaccaauaauaaacagacauuuuaaaauauuuaggacaaagccuucuacuccugccucuguaaacggauagaguguaaaacaagauccaaguacucccuguuaaucacauccuaucuuccugacuauacugacccaggaaacccaaucucucugguuccaguagcacacaaugcugcacagcgcagccccaugucugccauagcuguuaccuccacacaugagcugacuuccaacgaugcagugaagcuggacuccuauaucuaaaaguacucaaaagguaaccaauuacuuuccugucacaacugaaaagcuagaugaaaaauaacuuucuuuucauacuuggucaaagcauaaauucuucagacuaaaaagaguguagguggcagagcaugauauaugaacaaccacaaaccauaaacuagaaccauaagcauaagaagaaugagcaaaacaaagagaucgcaggacugcaaagauauacaaaggaaaacuaccaacgguguccauccagcauggucuuuaacauuugggucguuuccauuuugcaagagguauucaacagaagguauaucacccugguagaauaacaaaaaaaagaaaaaaauuaaagaauauuaaaauauaucaugaaugaaauggggcuacuggggcuguauuauaaagacucugucuucuucaagucaaaacuaucuuucccuuuacaugccgacuacugcucaugagccaagaauaucugucucuaaaguccugagaugccaagucguuugcucuguacuugaauauuucuagcaguccauauuggaaaugcaguucaagguacaaaaugaagccaaagccuauccuaaacuucaaguaaucauuucauuugcaaaaaugccauuaugaacauauaucaaaauauuucugagcauuaaaauaaacaaagcuguuuacagccaacaaauuagcuaauaaaaccaaaguuaaaacugccaaaaaguacuuacuguuuuauuggccauuacuuuauuuacccuaagucacuaauuuaguuuauauucacuuuauuugcaccaaagguaucuucauggcagaagcaguugcgguuuaaaaugccaggaaagggauugagagaaacagucaaacaacacacaaaaucagcauuuaauuuuauccucuguuuugaaacugaaaccauuacccauuaucagcuaacugaaugguaggaaauacagcuuccauuaaauccaugauauucuuuacauguccuucucacuagcugaauacguuuccauuugucucuagaggcucacguaguaacuuuucaacagugucucagacacagggagggcagaaggaaaagagcugcagucauuauuguaguaucagagccugcuuucaaaggagaugaacaagauauugaaaauaaguaaguuaagauggcguaaaggacuggagacaaguauucauucuuccuucaaguuaagacacuuucaauuauuaaaugacaugaaaauuaagucuccuucugauucugagccuucugugucuucugugucuuuaucuaaggaaauccuaauauaggugagugaacugaaggaagauggaagauuccuucuguugcuacccuuuaacaaagugagccuugucaaaggagauaaggcuaggaauugggcuugcauaaucucucuucucaaaauucugugcaugcuacuaaaagcacguccuacaccaccuucuaguuucuauuccucuguccagaaacacaauuuccaaacuacaaaacacugcaggcucuuuaucacaugcauuccccaccaauguggguggaaggaucuggcauagaucuaccauacuugauuacaaacuaaaguauuggucaacccuuaaagccuuaaaaaacaaacaaacaaacaaaaacaaaaaacaacaaaaaaaaacccucuagcuauaaaacauaccaccuccuuuuaaaaaagcaacuuaaagcauuagggaaaguguaacaggauuuuccccguccgauuacauuaaaauauuagugcagcaggaggccugugauugcacaaagaaaagggaggcggagcuaagggcugcagaggcagagaggcaagaggaagaagagggagaaagcaagauggagacugaguggcugacaggaugauucagaaccaacauggcuuuaaauagccauagacagauaugauaucauaaaggacagaauaaucgggauaacuugucuaaucuaggugggcagcuuuuaucauuaucaacuggcgcagaaauuaucguauuuauacagugggaugacauuuguaaaauuccccuaaaacuguuaucaguaauggcaagcaaaauaaaaccagcucuuugaggauaauuaaaaaaaaaaaaaaaaaaaagacagcagaagcacucaugaauugucaacaggaaccaaccaaguggcagugguagggacauaaacagacugagucuguuuccugggcucccugcuuugcuuucaugucacuucugaguaucaucaaagguagggcucuauuaauagucuaccccuaaaauguacagcugauuagcaaacugcuagcucuuuagacccaagaugcuuucuucucccuaacacuaaaaaguuugucuuauuuucaucuuucuacuucaugugaauguaaugucacacacauaaauaaaauuaugauaauuaggagguguccacaguaacuggaugaguuugcacugauauaaaguuuccaggaaauaaauuaacuucugcuucuuguugcuuuaaauuacuuucuucucuaggagaauuauuuuuuuaguagaacucucucauuccuuacaacuuaaaagaauaauugagauuuccuuaaagcccugaggggggggaaaaucaucugaagaaaguauuuaggaagacuuacaagaaauuuuaaaugcuuuugguauuuucaagcaauacuuuaaaggccccaaaauaaaggagugugugcccaaguggauuuguauaucugcaucuuuguaguaaaaagaaaaauucuucauauggucucacauacugugaauaugugcauauuccagaaacauacacuaaguuucuaaaagcauacaaacaaauuuccuuugcucuauuagaauacaugcuccuaaaacaacacuaaaaaaaaaaaaaucuucauuaaagacaacaggacauuacaauuaaguacaauaaaauuuacauaaucaucacaacuaaguuuuccauuaacaccggcugaccaauuagauggugugaguuugaauagguauagccccauagauucauguguuugaaugcuuggcccauagggagugccaauaccaggaggcaugacuuccuuggauggaguaugucacuguggggugggcugugaggucuccuauguucagggcuuggcucagagugacacaguucuccugcuguuuguggaucaagauguugaacucucagcuccuucuccugcaccacaucugccugcacacugcccaugcuuccugccauaauaaugcacucaggcucugaaacuguaagccagccccuauuaaauguuuuccuuuauaagaguuguagucauagcguuucuucacagcaaugaaacccuaacuaagacagaugucauuuuuaaaagagaaaacaaaaugaccuuuacgaauggaguucugcaauaugguaaacaguucucuggcuucuuaaaauuuacagaagaaaguaauuucauaaauaaauaauccugacaacucaacgcuacaaaaaaguuacuaguaucacaagagcagaggugggagaccaacugaaggaguuagaugcugacuccaugugauguuccagaaauaaaaucuugaacauaucacagaucccuguuugcuuaugugucuuuuacuuucucaugacgcuagcaugaaggaaacaaaauaccgugauuucacauacaauauaacagaacagacuggaaguauacucugaagcagagccucuccgugacuaucuacucagaauuauaauucauuagauucucagcaccaugccuucaagaugacauaguagcaucuauuaugucugcauaacaacauggaaugccagacucuuacacuucucagaaaaccuacuucuugaaagacaaaucaaucgcuucuauguuacuuacuucuacaacacuauaaccaaauaccuuacagaaauaacuuauaggaagaaggguuuauuuuguccuuggggcuuugguccauuguggcucagaaguagcauagagcaauucauaucauggcaacuaggaggcagagaggaguagaaauaucagaaaaaaaggcuaguguaagauaugccuguaaguauacacuaucaaugagccacuuucucuaaagacugaauuauccaaugggcugaccauucuuuaggucagagaccuucuuaucugucucacaggcacacugagguaugcugauaaugccauaguguuucuaaaacagaagguucuaccagggacugggauauugcuguaacagaccugaccaugcuguuguuuagaggaauauggaagacuuuggacuagaaaaucagugaaugcuuuaacaaugauuaauagaccaucuuagcaggagcauggaugacugugcagagggugauaugaaaugugggggcccagcuugaaagguuucagaaggaaagacuaguguuggcuggccacauuguuguaauauacuggcaaagaauauagcugcuuucugaucauguccuaaaaaaacugcaaggggauaaaauggaagaguuuuggauuaauggcacaagcagagauuuccagauagccuuguacugacuccuugugugguuacuagugaucacuauuauacacaccuacaaugaaaaggagcaagugaagcaaagacaaguauaaaucgaaguuugaggagaaaacagugccaggaaauguaaccugaggccaugucuggugcccaacaaggguuaaaguguuaaaggcucaaugcucaauggaauaaagggaguggugagcuaaggaugagacaccauccacauccaccuuaaucuugcaaccagugaaggaauaaaccugagggauuuccucagccuagaaacuaucaagacaaagcuauguaaauggaagucauuaagaggguuacauuucagguggcagaacuggacagcauaagguucuggcucaaggagucaaggaguuauggaaccuuccuccuccauuauggaaagccuuugaagcuaggcccggggcagacccugcaugcaauccuagggaagucauugcaagaagccuggauugaauuggugaccccaagaugugaaagguguagcauuaucuggcaaggagagcugcagacuggguguggagccagucuaagauagggaaguguguuguagucaacaaagcugaaaggaguuggagaugugaagagcgccuugacauuggacauggagauucagaacgugaagucuggccugcucguuuucagugaugcuuuggucuaguauuucuucacuauucccucuucucucccccuugaaaugguaauacguauucuguaccacuguauguugguaguaugugaucuaguuuuggaaacugauuuuauaagggauuacaauucagagauugccuugagucucagaaaagaccccugacuuuuaaacaguguugagacugaaagacuauguaaaggacauuugaaauuggacuaaacacacuuuacauugugaugugacuacaagucuauguggaucagggaguaaaauguguggcaguuuaaauaaaaaaggccccgacaggcucauauucucugucucucugugugucuguauaucugucucugucugucugucucuuuuugauaccugcagaccucaaaguaaagcucucaagcuacuccucuagcacaauaauuaugaacacucugaaacucuaaguacacccccaaguaaguguuuccuuuauaagaacugucuucaucaugguaccucuucacagcaauagaacagugacuaagaaagacauugguaucaggaguggagugacugggaaagaguguuuguuuugugcucuggcuagccuuacacuagcuacauaauccaaguuguccuucaauucacaguaauacuccugccucagcuuccugaaugcuaagguuacaggugugaaccacuugaccaggcuccaaaaagggugacaaucaagauuaaucaucacaaguaccaugaacuguggcagcugcaaauccaccuaugugcaacaauacagcagcagccugggaaggccuuccuucugaccugcauaaacccacugcuuccccuuuauugguuuggcugccuuaaaggucaccaaaucugaauucacugugucaagaaacgccggucccugcuccuugcuccauuuuaugguagcuguaauauuaaggcccaugcaaauuauuucugaaguagguggacacacagcuaaaauaagacugcagaauuauagugcuugacuuccucauauuucuaaauaauucauucuugcucuauauggaaaaauuaaggugagaauuaaaugaaaaacacuucuaaaaagguaacaacgaugauacacccacugauaugucuucuucccaaauccuaucuaucaaguucaaacacaagcugaaagcccagcuauuugguagagugcccgaguaaggcccuguguguuucccagaauuguaaaaacaaacaaaaaacaaacaggugggaaaacacauucgccucacaauaaaacuuuaagagaacaugauuguuaauuaaaaaaacaauauaaaucaaugcauauuuaaauguagcaaaugagaauaagucaauuaauaacaauaacaauaucagauaauuagguucaagaaaacaaaauagacaacuuuacuuugggcaagacucuucaaguagacagccaacugagaaaaacuugcacaaaguaaugaugaacacaucaaugaagaaaagucaccaggacaccaucaugccacaauuuuucuaccuguucuacuuuggcuuuuuuccaugcuuaggaaaacagaauauaagcuacaguaugugagggagccaccugaauucgcaaguuguuuuaauugguuuacuuguugucuauggcuauuucugcucuagaguaauauauggcacauacuauauaguuugaaaguaaagaacauuuucucuagcaaccuccauaagaguuuauuaagcacuggccuagacacuaggcucuagagauccucauuaauaaagguaaauuuuucuuauaguuggaauaacauucucuaccaaauuaagggaaugcuugaucuguggucugaaaauucccagaaagagagacauagaaacuacaucagccuacaaucuuacuaauagaaaacugaauggagcauaauaauuauuaacuagauaguuuaggaagcauuaaccacauuacaauagcuuaugugugcauauacauauuuuauacauaugacaagaaugaccaaaacuagaaauuuucuaagucaggcuuaagagaaaccaauugaagcauaaccagaauuaacuccaaauauuugacuugcucagaguagaggaugccuagguuguagcuaacgacaugguuccacugccacagccucucucucaccuccaucuucuacauuaagguuuucacggcacuggacgugaagaggagaugggaucccaccccuuccuuauccccucuuuuucucaucagugggccgagggggcacacacagcuuuuguuccauaacacacaucuaugaugacaagcucaaagcaacagaaccuauugaacacaaacugaaauuuccaauucugugagauaaauuaaguuuguacucuuauuaucucaaguauuuguuacaguaagagccaaaaaaucuggucucuuucuaagauuugguucugaguaggcagccuaccuuaauagaagcaauaugaaguaaggucucuccucugugauuucuuuuccuggcuggcauaccagaagacagcuucacuguggaggggcuugacaucauuugucugugaguugaauuguucagcagaggugggggugugcccggugaaaggcuaagggggucaucugaugcguuacucuuucuccugagugugacaucaaccuguagcuggccugaaggcagugaagagcagucaaccaacacuacguuuucugcaagcaaugcuggcucaccgaugccucugcuggugcucggaauguugcucccacaacugucagaaguagaagugguaggccuguggcagccuuuacgauuuccauuacucccuccugaacgaagaucuuuuacacagaccuucuucuccggagucucuucauucuugcucacagugucuggagacacuauaugcucagccaaugguaaagagacuucagucaagcuuccagaacauucagguucuacaacagaaccacuugcuaauaagucuauuucaccauuuacccguggucucuccauaacugguauuuggcuacaggagacaaccuucucuuccuucagcuccucuuuggaaucaaaucuacuauccuuuguuucuggccuuaaauucuccucccuguugaucuuagcuacagauuucuuuggaugcuuuuuugcagauguucuagaagcuguuuuagcacucuuaggaacagcuacagggggaguugcggaaacaaauucauacauugaggcuuccugggcuuugucguccuuugccuuuugaggcuguguuuguacugacacuuuagucacaacauaucuaaccuucuuacuucgaggacuaaaccacauuuuuauugaauucuucuuccuuucugcaucaccaaauaaacuugcccuagauguguugucuuuugaaucugauagaaaaaaggaaaagaaacaugcuauaaggauuaauuucuccaccuugaccuaccaaugaauucgacuuucuguucucuaaggacuguuacguuuuauuccucuacugcucgaccaccaauuccuaaaugccuaggauuguuugcuuugucucuucuuucaccucccaucuuacaaacacagccaccagguaaaaagcacccuaaguaaggaagaggaaguggaaaauaaguaaguaguuuucaaccuugcaggaauguaacacaugacccugccuaacaauaacagcacuuggacuauacuguaaagacuccacuucuuccuagugacaugggugagugcacugaagacaguaaacaaauaaggccggcuacaagcagagcuauguaacugaacgagggcagauuccccaaagccauugaaguggaauuguugagaaacccauggucuauaguguuacugagacaggaucuugaaaaucauaagaaugagauguccauucacaaagagacuagacgucuaaauucaacaaggccuuuccucugcagugauauguagauuuuaaaaccaagccacuugugauacaaucucgagucuagagaacggucaaaaugaaauguuaccaaggauugcuucuuaagaaggccucaggauuacaaagacuuaaagguuaauccucaagucaucugagaaaaguuguauuugguuuuaauuuauuauuuuaaaugcagaugaugacauuuucaaugaaaaacaagucaaaucuugauuucuccauguuuauaauaaaaaguagagcugggaagcuaaagaaaauuacacagugauaacacagucaauuaacuaaaaaccucaaaucuaaaacaaaacaaaaaaaauaccaaauuucaacaucagcagcauguuuccuaacuuauaaaagagcaaauaaacagugaacaaguauguaauuuauaugcaugcaaucauuuuauugacuuggguacuaacaccuuugccuggaaauuuuaaucacaccacuugaucuaacuaagcaaggauaaccacaaacaauaacuguaaauucuggauuuuaugcagcauaucuaagaugaaacugaaaagcaaaacaauucaguggcuagaacauaaaucauauuauuaacagcuacaacuguuuuauggaugaacgcuucuaagcuugauaaauuaucauauucauuucaugaagaaaaacauugguccugccucugcauagcaaauuucuuaaugaugacauuaaaaaaaaaaucuuacucucugaauuuaaauauuuuagaauauacaaugaaauuuaaggagcagagauauguguguuacuaaggagcggcauggucaagguuuuuuuuuuuuuucucaaaauuuaauaauaagcauagaaaagagaagcaauuagaaaaugugaucccccuaucauuaaucuacaucaaaggaugauaaugauguacauugugcuuuccaaauuauucucuauuguaaguuauaacacaaaacagaaguugaaaaacugacuagcuagcuccuuauuuaaaaaaaaaaaacaaaaaaaaaaacaaaguaaaucacagggaggcccucuguaucccaucugugugacauuaacaccugaagaauauuuauucuguagguuaaaauaaguuagaaugcauuuagaucuauuuaaaauaacaacagcuccguggccacccuaguauccaucuccauccaugguaagaagucauagcauacaugagacacuaaggagucacuucagaaggaucaggaucuccuaaagcuacagcagagaaaugcacagugcggucugugaaagcauaaucaagguucuuuauuugagugucaccagcaccuacacgguccacaaacgugaccagcaccugcaagggcuguuuaauaugauagguucaagggaaaaauagcaacuuuaaauuuaccucuauuaguagaaaaaagauuguuuuaaagaauaagguaaaauuacccauaaauggcccucagaaaaauaugacaaccucuucucuuuaaagcacacugaaccgaggaaaauauguggggauguuuagaagcucaucuuagcaccuucuccuauaaauuggcuucaucuccaauauaccaugcaccauguccacgagcugacaagcucuuccuaauuacccaccuuaguucuaguaauuauauaguuuauaguaaaugcaaguaacaaaggucauuuggaagauaaauuaugugcuacaaauuuuuguuuaaagauagagaaacugugagagcugcugacccuccacuugguucaucguuuuccaugugagcaucaucauuuggaguuagucaggcugcaggaaaucacucggucgcccacccuuauuuuaauuaaggugagauccuguucuuacuacaaggaagagcaacccucacugguucccaauuucuaguuccuucuacugcuaaaacauuucaccaccuacuauguaaauuugguuuuaaaaggccucacuaaacuaagacaggcccucaggacauguacuaaagaaacuauaaagaacugaaacagagggagcuacaccagggggaaaaauccugaaaacugaaaagccaaacacccuucaaagcuggcuuguuuugagaggacuuuuagaagaaaaucugauggugauguaacuuaaaauagaaaaaauaaaaaacaaaaaacuuuaccacaaaaacagagguaucaaguagauauauucaauaaacuucucuaacauuucugugaucuccuaucaaggucacaaaggcccauugccaguuuuacuuucuucuuuggauuaugcaugugugcgugcaagugagugaguguguaaguggucacaccugugcacgcaugaaaggucagaugguuagaggaggcccucaguuuucgaugaguugcagucacaggugugcauagcacacuuggccuguggugcaggugcugggaucuaacuccagucccacacuucaaauguuuauacaacuuaauuuaacaaacuuaauaccuacuagccacccacccccaaaagaaauguucaaaacaggaaaacaguaaaaacauauucuaaaaaggcucagguccuacccugaaucuugcuugaaauuuaguuuuuccacugucuacaaaauacaaaacuauacuaagauucaaaugcccuccacucacuacaguaaauuucuagucuuacuccuuuuuguaaccccaagguaccuaacagccuagugagccauaacagaugacaauuagcuuacaaaguuacucuagccuccucccauucuaucacuauuaaaaaggucaaauuauuuauuuaugcauuaaacugugaccuuccuucuacuccuuaaauccauacgcugaaaccauaacuaauaccugcaacuccaaauguaaucuaauuaaagucuaaauuagacucauccaagaugaaacugcacuggggugggugggugggugcccuaauguaacuaucaugaagacaugcggugaacacggauacgggccacagaucuccgagaagacacuccugaagcucagaugucaagccuccagaacugaggcaggcucuuuuacuugagcugcccaguuugucacguucugcuacagccaucugcagugacccaacacacuauuccacacuaacuggagacaagucaaguuaggaaauuaugagucucaaaaguagaccccacauuuuggagguguuuggccaauaaucuuaauaaucagacaugccuauggaaucaaaugagagcaacuuucagagauauacuguuccuacuguacaaaucauuacgggacucauugguuccucuccauucccaacucugacacugccuaacccuaacccuaacccuaacccuaacccuaacccuaacccuaacccuaacccuaacccuaacccuaacccaaggaccuugacuaggaaucacuaugucaacuuagugcguauguuggguggacagaggcugaucagaucauagacacaaucuuuucaaccucuaaauacacaccaucagacacugugcuuaaggaagaaaagcauucagaugaacuaaugacaucuccccaaugcaguccuuuucuuuuuuuuuuuuuuuuugaaguuugcaugguuuuauuuuauuuauuuuuauuuuuuuuuccauuuuuuauuagguauuuaacucauuuacauuuccaaugcuauaccaaaagucccccauauccacccacccccacuccccugcccacccacucccccuuuuuggcccugguauuccccuguacuggggcauauaaaguuugcaaguccaaugggccucucuuuccagugauggccgacuaggccaucuuuugauauauaugcagcuagagucaagagcuccgggguacugguuagcucauaauguuguuccaccuauaggguugcagaucccuuuagcuccuuggcuacuuucucuagcuccuccauugggagcccuaugauccauccauuagcugacugugagcauccacuucuguguuugcugggccccggcauagucucacaagagacagcuacaucugcguccuuucaauaaaaucuugcuaguguaugcaauggugucagcguuuggaugcugauuaugggguggaucccuggcuauggcagucucuacaugguccauccuuucaucucagcuccaaacucccucucuguaacuccuuccauggguguuuuguucccaaaucuaaggaggggcauaguguccacacuucagucuucauucuccuugaguuucauguguuuagcaaauuauaucuuauaucuuggguauccuagguuuggggcuaauauccacuuaucagugaauacauauugugugaguuucuuugugaauguguuaccucacucagaaugaugcccuccagguccauccauuuggcuaggaauuucauaaauucauucuuuuuaauagcugaguaguacuccauuguguagauguaccacauuuucuguauccauuccucuguugaggggcaucuagguucuuuccagcuucuggcuauuauaaauaaggcugcuaugaacauaguggagcauguguccuucuuaccuguuggggcaucuucuggauauaugcccaggagagguauugcuggauccuccgguaguacuauguccaguuuucugaggaaccgccagacugauuuccagagugguuguacaagccugcacucccaccaacaauggaggaguguuccucuuucuccacauccucgccagcaucugcugucaccugaauuuuugaucuuagccauucugacuggugugagguggaaucucaggguuguuuugauuugcauuucccugaugauuaaggauguugaacauuuuuucaagugcuucucugccauucgguauuccucaggugagaauucuuuguucaguucugagccccauuuuuuaaugggguuauuugauuuucugaaguccaccuucuugaguucuuuauauauguuggauauuaguccccuaucugauuuaggauagguaaagauccuuucccaaucuguugguggucuuuuugucuuauugacggugucuuuugccuugcagaaacuuuggaguuucauuaggucccauuugucgauucucgaucuuacagcacaagccauugcuguucuguucaggaauuuuuccccugugcccauaucuucaaggcuuuuccccacuuucuccucuauaaguuucagugucucugguuuuaugugaaguuccuugauccacuuagauuugaccuuaguacaaggagauaaguauggaucgauucgcauucuucuacacgauaacaaccaguugugccagcaccaauuguugaaaaugcugucuuucuuccacuggaugguuuuagcucccuugucgaagaucaagugaccauagguguguggguucauuucuggaucuucaauucuauuccauuggucuacuugucugucucuauaccaguaccaugcaguuuuuaucacaauugcucuguaguaaagcuuuaggucuggcauggugauuccgccagaaguucuuuuauccuugagaagacuuuuugcuauccuagguuuuuuguuauuccagacaaauuugcaaauugcuccuuccaauucguugaagaauugaguuggaauuuugauggggauugcauugaaucuguagauugcuuuuggcaagauagccauuuuuacaauguugauccugucaauccaugagcaugggagaucuuuccaucuucugagaucuucuuuaauuucuuucuucagagauuugaaguuuuuaucauacagaucuuucaccuccuuaguuagagucacgccaagauauuuuauauuauuugugacuauugagaaggguguuguuucccuaauuucuuucucagccuguuuauucuuuguauagagaaaggccauugacuuguuugaguuuauuuuauauccagcuacuucaccgaagcuguuuaucagguuuaggaguucucugguagaauuuuuagggucacuuauauauacuaucauaucaucugcaaaaagugauauuuugacuuccucuuuuccaauuuguauccccuugaucuccuuuuguugucgaauugcucuggcuaauacuucaaguacuauguugaaaagguagggagaaagugggcagccuugucuagucccugauuuuagugggauugcuuccagcuucucuccauuuacuuugauguuggcuacugguuugcuguagauugcuuuuaucauguuuagguaugggccuugaauuccugaucuuuccaaaacuuuuaucaugaauggguguuggaucuugucaaaugcuuuuucugcaucuaacgagaugaucaugugguuuuugucuuugaguuuguuuauauaauggauuacauugauggauuuucguauauuaaaccaucccugcaucccuggaauaaaaccuacuuggucaggauggaugauugcuuuaauguguucuuggauucgguuagcgagaauuuuauugaggauuuuugcaucgauauucauaagagaaauuggucugaaguucucuaucuuuguuggaucuuucugugguuuagguaucagaguaauaguggcuucauaaaaugaguuggguagaguaccuucuacuucuauuuugugaaauaguuugugcagaauuggaauuagaucuucuuugaaggucugauagaacucugcacuaaacccaucugguccugggcuuuuuuugguugggagacuauuaauaacugcuucuauuucuuuaggugauaugggacuguuuagauggucaacuugauccugauucaacuuugguaccugguaucuguccagaaauuuguccauuucguccagguuuuccaguuuuguugaguauagccuuuuguagaaggaucugaugguguuuuggauuucuucaggaucuguuguuaugucucccuuuucauuucugauuuuguuaauuaggauuuugucccugugcccuuuagugagucuagcuaaggguuuaucuaucuuguugauuuucucaaagaaccaacuccucguuugguuaauucuuugaauaguucuucuuguuuccacuugguugauuucaccccugaguuugauuauuuccugccgucuacuccucuugggugaauuugcuuccuuuuuuucuagggcuuuuagauguguugucaagcugcuaguaugugcugucucccguuucuucuuggaggcacucagcgcuaugaguuucccucuuagaaaugcuuucauugugucccauagguuuggguacguuguggcuucauuuucauuaaacucuaaaaagucuuuaauuucuuucuuuauuccuuccuugaccaagguaucauugagaagaguguuauucaguuuccacgugaguguuggcuuuccauuauuuauguuguuauugaagaucagucuuaggccaugguggucugauaggauacaugggacaauuucaauauuuuuguaucuauugaggccuguuuugugaccaauuauauggucaauuuuggagaaggucccgugaggugcugagaagaagguauauccuuuuguuuuaggauaaaauguucuguagauaucugucagguccauuuguuucauaacuucuguuaguuucacugugucccuguuuaguuucuguuuccacgaucuguccuuugaagaaagugguguguugaagucucccacuauuauugugugaggugcaauguaugcuuugagcuuuacuaaagugucucuaaugaauggggcugcccuugcauuuggugcguagauauucagaauugagaguuccucuuggaggauuuuaccuuugaugaguaugaagugucccuccuugucuuuuuugauaacuuuggguuggaagucgauuuuauccgauauuaaaauggcuacuccagcuuguuucuucaguccauuugcuuggaaaauuguuuuccagccuuucacucugagguagugucugucuuuuucccugagauggguuuccuguaagcagcagaauguuggguccuguuuguguagccagucuguuagucuaugucuuuuuauuggggaauugaguccauugauauuaagagauauuaaggaaaaguaauuguugcucccuuuuauuuuuguuguuagaguuggcauucuguucuuguggcugucuucuuuuugguuuguugaaugauuacuuucuugguuguucuagggcgugauuuccguccuuguauugcuucuuuucuguuauuauccuuugaagggcuggauucguggaaagauauugugugaacuugguuuugucguggaauacuuugguuucuccaucuaugguaauugagaguuuggccggguauaguagccugggcuggcauuuguguucucuuagugucuguauaacaucuguccaggcucuucuggcuuucauagucucuggugaaaagucugguguaauucugauaguccuuccuuuauauguuacuugaccuuucucccuuacugcuuuuaauauucuaucuuuauuuagugcauuuguuguucugauuauuaugugucgggaggaauuucuuuucugguccagucuauuuggaguucuguaugcuucuuguaugaucaugggcaucucuuuuuuuauguuugggaaguuuucuucuauuauuuuguugaagauauuagcuggcccuuuaaguugaaaaucuucauucucaucaauuccuauuauccguagguuuggucuucucauuguguccuggauuaccuggauguuuugaguuaggauccuuuugcauuuuguauuuucuuugacuguugugucgauguucucuauggaaucuucugcaccugagauucucucuuccauuucuuguauucuguugcugaugcucgcaucuaugguuccagaucucuuuccuaggguuucuaucuccagcguugccucgcuuuggguuuucuuuauugugucuacuuccccuuuuaguucuaguaugguuuuguucauuuccaucaccuguuuggcuguguuuuccugcuuuucuuuaagagccuguaacucuuuagcagugcucuccuguaaaucuuuaagugacuuaugaaaguccuucuugauguccucuaucaucaucaugagaaauguuuuuaaaucugggucuagauuuucgguuguguuggggugcccaggacuagguggggugggagugcugcguucugaugauggugaguggucuugauuucuguuaguaggauucuuacguuugccuuucgccaucugguaaucucugaagcuagcuguuuuaguugucacuguuaagagcuuguucuucaggugacucuguuagccucuaugagcagaccuggaggguagcacucuccuuaguuucagugggcagaguauucucugcaggcaagcucucuucuugcaaggcagguacccagauaucugguguucgaaccagacuccuggcagaaguuguguuccacucacuagaggucuuaggaucacguguggaauccugugugggcccuagugggugucaggcgacucagcuggcaagguagccggggcucgaguggaguggaagggguuugugccccagaucaagcccggguagccugcuucccuauguaccgcagucucaaguuccacgcgauuggauugggguaggcgcuguguuccacucaccagaggucuuagggucccguggggagucccgugugggcccuugcggguguugggcaagacucugcugucaagguagcccggggcucgagucucgagucgagcggaagggacuugugccccagaucaggcccggguagccugcuucccuauguaccacagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccacagucucaaguuccgcgcgauuggauuggggcaggcacugugguccacucaccagaggucuuagggucccguggggagucccguguggacccuugcggguguugggcaagacucugcuggcaagguagcccggggcucgagucucgagucgagcggaagggacuugugccccagaucaggcccggguagccugcuucccuauguaccgcagucucaaguuccgcgcgauuggauuggggcaggcacugugauccacucaccagaggucuuagggucccguggggagucccguguggacccuugcggguguugggcaagacucugcuggcaagguagcccggggcucgagucucgagucgagcggaagggcccuuuucuuuuuuuagcauuuaauuuuaucacuauguuuaugugcacaugacuacaggaguuggaccuucuggacauggaggugccugaccugagcacuaggaagcagcacgcagggccucuaccagaguaguaagagcucuuaacccacugagccaucucuagccccucaauacauucuuuucauaaucuuuuuauuguauuauaccuuuuuauuccuuuaaguuauaauuuuaucauuuaccccuuucucuuuccucccuccaaccccuccuaccuacacucccacccugcuuacuuucaaauucauggccacuuuuucuuuauuguuacucaacagacgcaaacagaguuguuauacauauauauguuauauacauauauguacguguguguaucuauauauacauacauaucuaucauauacaucuauacauauauaugauagauauguaaauaucuaucauagcugcccaaacaagaccccuaacaaauaacaucaauagccauguuagcacaaaagggggaaaagcucacaugccucaaccccaaauaaagagcugcaggaaaccaagaaaugcugggagcuggagaagugucucccaggugcuuaugcaaugccaagucgucagcuauaaaaucagugcacucuuugagacuuuuuaaauacuuuuuaaagcaaguccuuuauaaaauauauacacaccugcauuccauaagucacauugcuaguauaacauauuuuaucauuaaaaauggagacuagcacaaagaucagauaacucaauguaaacacagguuaacuaugacuuacauucuuaaaaauacaaccagugucaguaauacuuagauuugccguuuuuuaauuuuguucaaucacccuuacuaguagcugacaguuacaauauuacaucagaauacaaagaacaaaagacuuaaaaacacaaagcugacaaauuuauauugccacuaccaaucucucauggcauccugccagacagggucuccuauaaacacaugcuaaaauaauaugauuuggucaaugaaaagacaacuccaacauccaauuaugaaaauucaaaacacuuuacuuucuuuucacagccaauuaguucucagcagaaagcacaaugcaaagauauauaguuaauaugcagagucuaagaacaauuugaaaaacauuaaccccucauuuagauagaaaagaaaaugaguguuagauuuuugcucuuucaaaauguacaccuaauuaauucagucuagaaagugauccucacaagaguauuguauucuaucuucuaacaguguagcaaagugacuuaagcacuguuauaaauaaaaucacuccagcaucuauagucuauagaaauucccccaccuauagcaagcagccagugccacccugagccucccuggacugacaucaagagaugcacuccauuucccuugcuucuuacauuaacuacacauaagacugaaggcgagagcuccuaacuccucuggaccuuaggaucucaucuauaaaguuuacacuuaauuaucucauuucucacaaugacuuuuagaaaacuauuaaccucgaaaugugaacuacaucauucagaauucucucuccauucuuucuucaugugcuccuuauuauuaauuuguccacucuuuaacaaaacauaaaggaauaucacucaccuuuauugucauggagcaaauuuuggagcuuacuagaaagcuggaucaugcuguccaauugucgguuuaucuugaggucuaggauccaggcugggguguaacacacugggcauccugagccaacacagucacuuauacaaccacuuaaaaaaauucaaagaaaagucagcagaaucugaacuccaaacacugaagaguagcaacagaaggaaagcauagguuguuuuacauagacugguaaaacggugcgcucugauaauaugguauggacauauauguaaaaucuuaucaauugacuacauagagacauuauuuagcacgacaaucugcuuaauuuuucccaacaaacaaaucuauggcuccaaaaagcauaaggagauagagaugugcacaaauauagccucuguauaaaggaacaaagaccagaaacuucuaaaucugugagccaaauuaaaacuuucucccuauuauauauggugugaaucccaaaugagugcuuuagagccugugacaggaacauacaauauuacaagugugccugacaggcucacuguuacauuuggcccucaacuaaguagugcuauuuggggagguggaacuuuaggagguagggcccagcuagagaaaucacuacaaacaggccuuugaagguuccaccuagugccaaaucccaggucucuguuuccugccugccaggacagaacaucuaccuccacagguuccugccaccaguguccucugucacaagguguuugaaggaugaacacuuucugcccuuggcuuauuaccccaagaagcaaaauuaguguucaagcaucuaauuaaccaaagcuaaccacuguagcugaagccugugaaacucagcucaaauaguuugucagguauucugucaaaaaggugaccaaacgggugaccaaaaggguggcuaucaaaugccuauuaacucuucagaucauacauugugaacagcauggaaaaccucacuaaugggccacaagacacuaggugggaacagacccucccucagaaggagcaaacucugucagcaugcaucagaacuugacuuucuggccuucugaucuacaacaauaagugucuacuguuguaagucacucgugguuggaaauuuaagaauuagacuucaauaaauuuugaaagauuauuagcucagucauucaaaccagauuuaagaagacacauguggaaaaaagcauuauuuccuuucaagaacuuagcagcgcugcguauguuacccucugagcuuucuuuauuuguagauggaaacaggaauaaaggucaacccaagauaacgugcagacaucacaacugcaucacagugugcaucaagcucuaacaacucaccuacagaagaugugcucacauccuccuaagcacacgggcuccuucagaauauuagcacugauugaagaaaggacgagauaagcauaagucacuguuagguauuucaugcccaauauuuuacaaacccaagacccaacacuaccuguuucucucuuuaucaaaccagaaaauauuaaggauacuuuauucccaaggcuuugauucugcugguuauauacgccauggacacacuugcuaaguucaaauagaaacccucagcacaugcucuagcaccguuuaugacuucuuuguugagagguuagggaaagggccaagugcccaagcaccuccaaacgucuucuuccaacggauaagggauacuuucccugacugacuggaaaugaaacucaaaucugaaaauguggccugccauccaaaugagagagaauuucucauuucacucagagagugaagaggagugccuaaguauauaggauguugggacaaggaguacaaaccagaacuuuuucaaaacacuagggcaucaggauagcuugaucaugauaauccauggguucccauuuaaaaugaagaccaagaacacaucauuguuucuugcuauaaggagccaucuaccuuuuacagaaguuuugagcaaauauaacauucuuugaauauacagauaauugaaggucuuguuccuuaagcaacugcagacacaaaucaagcuggcagucugcagacuaaaggagauucaauaagcagaagcaaaagcuguccaucagaacgccugcucgcucugcaaguccuggggaagcaugggcucuuacuaauauacaugcauuaagcccugaugcucagauggggaauugcaucaagagcacagcacacaagugaagccuucaaaggaugaacgaacacuuccugcacuuggcuuauuauaacaacccuaggaccuguagguguuuacaccauuauuauccaauuaccucugcacacaaccacauaucaguaaaacacaguucuccacauuucuggaaagaucaaaaguuucacagugcacauuuuaauagauaugaacauuaaaguaaaauugagcuuucaggaagaggcuaagaagacaguacacagcccguuauucucaagcuauuaaaaaugcugcucacugacauuacaaaauccauuacuuucaaaaccucacaaaaccauuuuuuaccauacuacaugggauaaauugauaaaauguaaguuuggcgacucuggcaauaugaugauuauaaaacaauauuugugcagccccuauaauuuuuauuacaugaauaggucaaaccuaaccuccucuuucauaacuaagaacuaaauucuacuugcuccuguguaucuccuguugcaacauccuggccaaaccuaacuccaacuagagugaaacugaccauccuuguaguuccuaggacucacuauucagcccagacuuccaagcuuaaugacucagagccaucuuuacugcugugcuccuaagauacucaugaaugcaaguucauaaugcuucgcauucccuggggcacaccuaauuuuccuacucugagaaagcagaagcagaaggauccuaaguuuaaggauagcuugcaccacauaaugaauuccaggccaccaaaaaaaaaaugagacuaaccaaaauaagggagagaaauaacuuuaaaaagcaguauuucuucaccucuguaucucuacaaugaugaaauaaaugcuaagcaguggcuacaugguuauucaagcuaccugugcuaaucaucuccaauggugugaaccugugacccucuggcuaccugguccucagccucaccccuuccucugucuuaaagcccucccucagcuacucuucauccuaagaugcucugcuaucaagcuuccauaucuucccaguuuuaagucuguggcagucaucauuugaaucuccuuccugucacucacagauaagcaugcacagguagccucuccuucagcccaaaaaacagacaaccaaccaaccaaaaauauuuugaccugccaccuauucuacggucucccccaacucagcuaaaugagcucuacaaagucccaucguugaacguccccuggguacuuugguucuugcucuucucugaccucucugugaguucacacugaucucaucuucuccugaggccuguccuucuagggagcuggacuuucuucuagaacaucuaccugguuauuucagcacugccuuggcugcuucacccccgacccuccauaucagcacgucuccaccaugcagucagcccacagccuacuggcuuucucggaauucaauguccaaaaucuguuuguaaaccucuuauuuccuuccucagguaucuuacauaaguuauccuaagauaauucugaaucuuuuuuauaguuccuccccuucacccuagcaaugacaugcuaucauguaauuagcaguggcauagcaucuaugggaaagugaugaguagaccuuuucuaauuaguggucuagacuggauuucuugagguuguuaacaaacgagaaaagauguggggaaugucagugaguucuguguggguuccgagaaaaggaacagugaggagagugugaugcuagccaucacaucucuagguggaaagagaauacagccaacuucaagggcagguacaaggcagacauuguagggguagaguucaucugugucauagacagacuucagggaauggccagccucuaguuagaauaccaagacugaaagaacuuuaccuuccaucuaagagauacuaaccaaaaucuuaaaugaacccaacuuuaaccaaauuauuuccgcugcagcaauuucuguuggguuacuuguaaauaaugaacugugaaagcaacaaacauccucuagguaagcuuguaaacgcuuccagagauuaggaaaccacacacuagacccacaccaagaucaagacagccaacgcacagaggaacuaggugaacuccaggccucgagccuuacagaggaggagcuacaggaguucucuagggagagaaugauuugggggauggccacugguaggcuuccagugcuccaguggauggccccccacccauucacauagggcaacacuaauggaacuuaguauguucaaagaaaaacaauucaaaggcaauguuaggagcaagguggauugggagacuauaggaggaacugcaggggauaacuaugaucauauuucauuguauacauguaugaaauccucaaaauuaaagaaaaaauguuuacaaaguaaaccaguuuugcugccauaaaggccccuggaugaagcuauuugaacauuucaaaaaauaaaaaagaaauacaauuaaaaugucacauauauuguuuaaaaagaaaucagcacauaggacuuuucaaagguuauaagagaugagacaaacuaguggaauguagacuuaauaauggaaaauuacuuuguacuuugagucuccugauaaccuucuacaguacaagguuaauagaaaauaagaaaauucagccuuaagaguaagaaguaaggaaauagcaucuaaacuaaaauaaauaaauaaauaauaauaauaaacccuagaaauggggauaugcuauugagaaaccuagagguaaaaaagugaacugaacccaagcuacagaccucaggaguggugggagaugaggaauauauauauucaccacagcuuucaccuuugccaacuauguucguacacaagcauugaaaaucaugguaaaaauacucauuccagcugugguuguuacugcagaagaccacaagcaacuuaacucuuuaccaggaaggucacggcuaagcacgucauagcuacuaugaaggcauauacagagaaucucuuaaaagaugcacaagaagcugaugaacaugaguuaccagacaagacucagauuuaccugacauucacuccuucagggguguuaaaguaaacacuguuagacugcaauguccuucagaaucugguaacaguaaagucacacagugugacccuucuuguugcuccucagcagagcucugcuauuguugggccagugucugugacaaauccuacuuagccucuauccagcuccagccccacagcuuugccuggccuguucuccaagccuagaccacacuuucuucuacacaauaaauacgaaggccuaacacacuugacacuacccaaacacuacaaagggaacauaauaacaauggcacuaguaaacagauaagcagauuuuaguuccaucccaggaccugaugcaauuaccaggcacaugaaggacacuaagcuagcuaauuccuuccuaaggaucuuagacucaagugggguauuauauaaacuauuaaggccuagauaaaauauuaagaccuaaauggaacguuaaggccaacauaaaaugguaaugccuagguaacuauucccuagcuagccugucauguuguucuguuacuaaugaaguaagaaaacuuucucauaaguuauuucugcuauuauuagaaaacuuucucaugcccaaguugauuacauagucugcuuuguucugaacugcuuuguauaguuaguuacacacaauaagcucagacccaaacaaaccacccagcagcacuuccuacaccuguguauaagcuuucaugguauaaacugcgccuaggauggaucccaaccuaagagaggcaccugcaccaccaaaagaagaaauaucuggaauaaaacuuccauuuugaguaguggucaauuaaaguuugguaagaccucccugggaacucaccuccuacuuggcaaaaagagacaagaacauggguaacugacauccugguuaguaaguuaagacaaguuccacccuaauagauaaguuaagacaagaacacuagacaaggcaaguccccugccacaguugauuaccccaaccaaugggagcaggauaaguguacaacaaaagauauuuucuuaaagaauccccuaucccuaacuccugacugguggauaacuuggcacagauguuuguagaucccaggcuuagaaucuggaccauggcccuggucauucagucuugggauguaugcuaaauaaacuaucccugucugucuaagauugguguucaugugguuugugaggcaauuccuggaccccaacauaagcaaauugacuuaaggaagauauaagauauucuaauauuccaaagagcagugaugacaucuaauuggggcucuggacuuuaaugcuaaaaacaaauacuuuuuauuuuaccugccagauucuccuuuucuuccacaugagacuugaaaauuguuuugagcucccugaccccuuuuauccaccuagcauggaucgagauaacccuuaguggaugaagcaaauaaaaggucgugcaaauuuucauuuauauuagcauuuauacucuacccuuauuuuauuuucuaugcuauuuaaauauacuagaagaaaugcagaaaaaguacuuccuugauaagauauuuaaaauuaauaacuccacaccuuuaaaaaaauucagcuuuacaacucucuuaacuauacuucucuguguaguggauuuacaaagaccagugcauuauaacuuugaaacaaacuaaacaaugaaaacaagcaauucuaaaacaauccuacugucuuagaguuucuauugccacgacaaaaaacaccaugaccaaaacacaaguugggaggaaaggguuuauucugcuuacacuuacacauugcuguucaucaccaaaggcguuagaacaugaaaaccggacaggauccuggaggcaggagcugaugcagaggacauggaagagugcugcuuacuagcuugcucuccauggcuugcucagccugcuuucuuacaguaccaccagcucaaggauggcaccacccacaaugagcuuggcccuccccauuaaucacuaagaaaauaaaugccguacagacagauauuuuuuuuaagguguguaugugacagaagaggacaucugaucccauuauagauaguggugagucacuaugugguugcugggaauucaacucaggacuucaggaagagcaagcagucacuguucuuaaccucugagccaucucuccacagccagaucauaaaggcauuuucaaaugagguucucucaccuuucagauaauucuaguuugucauguugaaacaaaacuagccugcacaccuacugauaacauuuucuuuacaaaggaaaacugaauucaacugagauuauacuaaugaagcagaaguauuuaacugaauggcucuccuaaacucccaagagguacuaacugcuaguuaauauuagcuggaacaaggacuccagugcucuuaaauuguaagguauccucaagguauuuuuaaguuacagaucaguguguuuaacaugaaauuguacaaacuucccaagcuaauuaagcaacuuguuacauuucccuuuaagagaaugagagaaaagauaaaugaguaauaccuuauucauuugguuuagguuuugugugugugugugugugugugugugugucugugucugugugucugauguucagguuaaucucaacucaugaugcuccuguuucuaccccauucggugaucacagacaugaaccaccaaggcccaacuaaguaagcauucuauucuuugugacuauuuuuucccuuuuauucaaaagagauuuuauuucucacauagugugugauuauggcuucccucccucuacuccucccaccucccuagucauccagcuccacccccuucugucucucacuagagacaagcaggcuuuuaaggaugauaagaaaguacacuaaagcaaaacuaauguaucaggaugggacaaaacagagcccaagaaaaggcacaaagaaaacuuacagaugaagagaccacuuauuugcacccaggaaucccauaauaaaaagacacuaaacuggaagccaugaaccugguacagaccaguacaggcccugugaaugcugcucuaucugaguucaugagcuuugcuuguguuaguuuaaaaggccuuguuucuuucuugguguccuccaucuccucuggcucuuacacuccaccauaggguucucugggcccuaaggggagagauuugauggagacauccuauauagaacugggugaucuggcugugugggucucuguauuuguuuccaucugcugcagaagaaagcugcucugauaguggcugagcaaggcacugaucugcuucccuggcuggagucucucugugacuauuuuauaugucagauccagguaaaucacaagggaaaacuugaaauuucuauuuaauugcuuagugucagcaaaugucaaaugagacaauucuuccaaaaguaaaugcacaacagaauucuaguaaugacuaauuacaguagauccuauccugggagaaucugccauagaagccccaaagacuaucauguagaugugaccaguguugaaucugucuucuauucccuuuucuccaaaguaaaauagcuaagcuuaauagcugcucugccgucuuauuaagcuucaucccuuucaccugccauucuggauuucaaggcucacacuuaaguguuccuuucuucucuucucauuccuagaaacagaccagucacaugcaaguaacccucagauaucauugucauucucuaaugucuccucugagcccagaccugcuuagcaguaauaccuucacuugugguauaaagaacagaagaaaggcauccagcugugcucaguagcacacaggggcaaacccagcaccagggaggcuaaggagagacaaucugggaguuugaaaucaaccugagcaacagaaugagacccugucuuaaaauuaaauaaaauaaaagauguccccugcguuugacaaauuucuguaaaagucacaagcccuaucuaacaacaccagcugggccuucacccauaauaggacugcauguaugguaguuuuaacucugacucucagaagucagacugaccuacauguacaucugccuugaggccuuaaccaccguucaguauugguaauuaacacuggaaaccaauacaggauucucuuugugcucuuggugacuuuaaguaggucaucuuagcaucaccacuuugaagcugggacauacuugaccuaauuuuuuucauucauuauuuuaauacuuggaaacauuauauuuggcacuguggcuaaaaaugugagccugucuuuaugagaacuauaccauaauugaaggagguagacaucaagcaaauaaguaaaguggcacauaaauaaauuccaugaauaaagaaauucuagacuggaggauauggacacuaagaaucugugccccgcuuuuacauagauguuaauuuuuauuaaaagcuguaaacaaugcuaauaauuaugaagucugaauauuggagacaacuuuaaaagccaauucaguuauauucaucauuuaauagcuaaggacacagauuucaggaaagucauaugaauagcccuccucgggaagcuaacugcacuaacucuuuuauucuuauguuuuaacugucaauuacaaacaaccuagagucacuugggucaagggaacuucaacugaaaaacugccuuaacagauuggcuguguugacugacaacugauguggagagcccgggccacugugggcagcacccucccuaggcaguugggccugggcuggcuaagcaagacugcugagcucuaucuaguuagagagcaggcaguauugcacaguuucuguuucaguuccuacguccaccuuccuguccugaauuccuucccuggucucccucagugacccuuuccuaaaaguauaaaguacaaauccuuucaucccaaauugcuuuugguuaugguguuaaucacagcaacagggaaacaaacuagaauaauaauuauacaaacuaauaaauaaacuaauaaacuugguuuuuaggcuacuugucccucaagaucugauugguuuuacgucuuagaccaucuaacccacucccuguuuauucuaacauuccuagcuuagucauuugcuaauaucaccaacaccaccacuguggccaauuaauaaaaauguacccacaucucaaaggucuaacugcaaagccuaagaacuuugcuccaccauacagaccuaagcaacguuguuuccuccacaucuccugggccuucauaacuuacccuaaacuguguauccuuuguacuccuuaaaauugagcacauaagccuuacagggagaaaaugcacugccgcuucuaugccucagugacuucuuguucuaaugaaccagugccacagcaaaccagagggagcaaucauccuacuuaaggaucacuggccuguaagaucacucugaagagucaaaacuccuauagaggcaaaagcgaaaugcuuagagucaggagaucugugcuuuauuuuaagaacauccauccauaacauggguacaaagggcaauuuuauuaacacuuagaaaacaaggaagugaacaaagaguaguaacccugacccaggaucugaagcuggcuggaaugcaguggcaggcgucccauccaucuuuuauuuguacguauacuugcacaaaagcuggauacauguguaguauaugcauauaugggcacauacagaggccagagacuaauuagaauacgacccucaaucauuacaccuauguuucugagauagucuuuuacuugagauaaccauuucagccuggcugcugaccagcaagccccugauaucuaccugucuccuauaaccccccacacugggcuuacagaagagcaaagcagccucacuuuuacauagacgcuggggaucugaauucagaucuucaugcuauuuguucaaguguuugcacagcaaacacuuuaaccaccaagcaaccucccuagggccuagaauccauguauaaugcuuuggucccagcacucucaaggcugaggcaggaggaucccaaacuuagagcacacacacauuacgcauuuacauguguguguacauacauauacauacacacacacacacacacacacacauauauauauacaaauauaaacauaaugcacaugugcuuuaaguuuauauauguauauacacauauauaaaaugaauuuaucuuuuaaauaacaauauuuugaaaaaaccaacuaucuucaaaguuaugauuauuuuuuaaucgucucuaaagugauauaaaaagcacaaaauaaaauuagcauaaaaagcccaacccuccucacuccaaaaauaugccaagaaguacguaauuaauuuuaauucacaaaacagcauccuaggacaccuggcugcacuaacagggcagcuccuaucugcaucuccugcuuccuuuaggaacacauuaguucucugcuuucugccagccucucaaauaguaaggucuuccagcuuccuuucccccaguccuuaaauagcuucuauuugguugugaggcuuggcccuacagucaaugucacaucuggccucuucaacacguucaccagcuucaccuugaagccagagucauguuauaaggucaggaaaggaugcccuguaacauagccaauccacugcaggagcaagccaugccugcuacaaaacagauccaaugugcuacacaagacaggugacagcugggaacagcagagagaugacagcugcaagcugaaugugaggguaaucgggguaaucagcagccuaguggggagagcucugaagcucggggacaggagcacaccauucaaauaacaugccacucugggugaugaugagcaaagcagcagcagacuguccaggguugcucuccucuagcaagcaggaagggagaggcagaaagagcuugagagacagcaaagccaggaagaaaagcauuucccauaugaccuaaaccauuuccugugagcuguaaaccaguauaaccaaagggucuuuaaacuuaaguuugcuuccuuaaaacugagucugaggcuggacauggugccauacaucuguaauccuagugcuaaggacacuacagcagaaggucacuuaauuuaaagauaagaugggcacaaaauauguuccaggcuaacccaggcuauggagcaaucuguuguaucaacagaaaaauaaaagaaagaaggaaaaaaguuugaaaaguuguugccucugguccaaaucaagccaaaacagccugcuuucccacagcccuuugaacaaagaacauuuuuauacuuucuguuugcuuugguuugguuugguuuucgagacugggucucacgauguaguccugcaagccaggaacucaauguagaccaggccggcuaaaaacucaaaggcaacugauuguaacagccuccagaaagcugaguguaagggcaugaaccacccacucccagccuuuuaacccuuuuaaagaaaguagagaugauuugugacugaaaaaccuaaguaauauuuauugacacuucacagggaaaaauuaauucaaaguccuauaugagcuuauauccucuaguaguuaaaauaaacucauuuagcagaguuuaauaaacugaaaaaaagaaaaacaagaccacaggaaccucauauucucuggacaacuggauguggcauaguacagccugagccuaauuacuauuaucuucaggcccuugacucuuacgguaagcuagcucgcuuaguuuaaaagagcuggcaguugguaaaaagggaaacugguuguuuaauuuuaggacaaccuacagauuauucauauuacuuuaucuaguuagucucuuccaaauggcucagcaagcagacuaaaucauuuucucaucacaucuuuuuguguccauuuuggauagucaccacaggaaacaacuuacauguauuuaauuuuuucuugggaucccugaggcaggguuacagaaacauugggaaggaagcuuugcucacgaaugggcucuccauacucggaacacuguuugguauguauucauuacauguuuauuaucaaaucucaauauuagcaaauuaauaugugaaugagcaaaccauuauuacugagguacagagaagaccaaagauguggcuggaaccugaacucauguggucugacacauucuaaguggaagaauauguguuuccaucugaguuuaacugugguucaacuauuuaaagcagugguugggucucaaccuucccugaugcuacaaccccuucaauauaguuccaaacguuguggugacccuaaaccauaccauucuuuucuuugcuacuucauaacuguaauuuugcuacuaagcugggucuccguuccuaagaccuaaaugugugucccaguggucgcgacccacagauugagauccaacaugugcgucaucacuggccugcuacugcaacuagaaguugaguuuccgauguaugucuacacccaggaugauccguaugcuuuaggaaaacacaagcagaacucagaacguguucauguuaacagaaucgccacucuccuaagaaauacaaugccauucuuucaaauacuaagaguuuguaaaaaaaaaaaaaaaaaaaaaaaaaaaagaauaauuuaacguaagugcaaaguuuguugccaguuaacuuuaaaaaaaaaaaaaaaaguugcaguuaacacuguauuuguaguaaagacugaaggcuuaacauucgcuacugccaaagagaaaaaaggggaaagaaguauauuucuugguaguauucgauaaacagccucagguaagaaaguaccacuuaggagugcauuucagacugaauaaaauccaagagagggcauguuggaggaucagugguacagggccauaaucuaacuaaguuaaaauugcgaugcucaacaaacugccaucgccaaacuaccggucaccaggucccuagccucccauuccccacgccgagccugcuacuagagaaaggaccaaaaggucagccucacaggggcuguugugccccgcacgcaaccacgggaccacgcucccagaggaccgaacuccaggaccccagcagcacuagcucggcucagcuccgagcgucaccuucggggagugaccaacgagcugcgcuuugagccacgccccgaaggcaguucucccgcgaaaauucgaaaagugccguuugagucaucuucguugcagguggcugggaagccacucagaaaacucaggagugggacacggagggacagacgacacuaggucgccaggccgguccuuaccagcgggagcagcgcagcagcuucuccaggcgggcaagcgccgcgcggcugugggcccaaagcccgucgguagccggcuccauggcgggcacgggagcaggcugguucccagagcagacccucggcggccggcguggcauucccacagaggaggggaggucagguuugcucuagcgccgcaccccgcuggucaccgccggauccugcugcgugcggagucucugaauuggucggacgccuccggcucggaggcugaaacgcgguaaaacucagagauggaaggacccggcuuuaggccacgcccu

SEQ ID NO: 12273 - RNA, 75439 nt, Mus musculus
agggcguggccuaaagccggguccuuccaucucugaguuuuaccgcguuucagccuccgagccggaggcguccgaccaauucagagacuccgcacgcagcaggauccggcggugaccagcggggugcggcgcuagagcaaaccugaccuccccuccucugugggaaugccacgccggccgccgagggucugcucugggaaccagccugcucccgugcccgccauggagccggcuaccgacgggcuuugggcccacagccgcgcggcgcuugcccgccuggagaagcugcugcgcugcucccgcugguaaggaccggccuggcgaccuagugucgucugucccuccgugucccacuccugaguuuucugaguggcuucccagccaccugcaacgaagaugacucaaacggcacuuuucgaauuuucgcgggagaacugccuucggggcguggcucaaagcgcagcucguuggucacuccccgaaggugacgcucggagcugagccgagcuagugcugcugggguccuggaguucgguccucugggagcguggucccgugguugcgugcggggcacaacagccccugugaggcugaccuuuugguccuuucucuaguagcaggcucggcguggggaaugggaggcuagggaccuggugaccgguaguuuggcgauggcaguuuguugagcaucgcaauuuuaacuuaguuagauuauggcccuguaccacugauccuccaacaugcccucucuuggauuuuauucagucugaaaugcacuccuaagugguacuuucuuaccugaggcuguuuaucgaauacuaccaagaaauauacuucuuuccccuuuuuucucuuuggcaguagcgaauguuaagccuucagucuuuacuacaaauacaguguuaacugcaacuuuuuuuuuuuuuuuuaaaguuaacuggcaacaaacuuugcacuuacguuaaauuauucuuuuuuuuuuuuuuuuuuuuuuuuuuuuacaaacucuuaguauuugaaagaauggcauuguauuucuuaggagaguggcgauucuguuaacaugaacacguucugaguucugcuuguguuuuccuaaagcauacggaucauccuggguguagacauacaucggaaacucaacuucuaguugcaguagcaggccagugaugacgcacauguuggaucucaaucugugggucgcgaccacugggacacacauuuaggucuuaggaacggagacccagcuuaguagcaaaauuacaguuaugaaguagcaaagaaaagaaugguaugguuuagggucaccacaacguuuggaacuauauugaagggguuguagcaucagggaagguugagacccaaccacugcuuuaaauaguugaaccacaguuaaacucagauggaaacacauauucuuccacuuagaaugugucagaccacaugaguucagguuccagccacaucuuuggucuucucuguaccucaguaauaaugguuugcucauucacauauuaauuugcuaauauugagauuugauaauaaacauguaaugaauacauaccaaacaguguuccgaguauggagagcccauucgugagcaaagcuuccuucccaauguuucuguaacccugccucagggaucccaagaaaaaauuaaauacauguaaguuguuuccuguggugacuauccaaaauggacacaaaaagaugugaugagaaaaugauuuagucugcuugcugagccauuuggaagagacuaacuagauaaaguaauaugaauaaucuguagguuguccuaaaauuaaacaaccaguuucccuuuuuaccaacugccagcucuuuuaaacuaagcgagcuagcuuaccguaagagucaagggccugaagauaauaguaauuaggcucaggcuguacuaugccacauccaguuguccagagaauaugagguuccuguggucuuguuuuucuuuuuuucaguuuauuaaacucugcuaaaugaguuuauuuuaacuacuagaggauauaagcucauauaggacuuugaauuaauuuuucccugugaagugucaauaaauauuacuuagguuuuucagucacaaaucaucucuacuuucuuuaaaaggguuaaaaggcugggagugggugguucaugcccuuacacucagcuuucuggaggcuguuacaaucaguugccuuugaguuuuuagccggccuggucuacauugaguuccuggcuugcaggacuacaucgugagacccagucucgaaaaccaaaccaaaccaaagcaaacagaaaguauaaaaauguucuuuguucaaagggcugugggaaagcaggcuguuuuggcuugauuuggaccagaggcaacaacuuuucaaacuuuuuuccuucuuucuuuuauuuuucuguugauacaacagauugcuccauagccuggguuagccuggaacauauuuugugcccaucuuaucuuuaaauuaagugaccuucugcuguaguguccuuagcacuaggauuacagauguauggcaccauguccagccucagacucaguuuuaaggaagcaaacuuaaguuuaaagacccuuugguuauacugguuuacagcucacaggaaaugguuuaggucauaugggaaaugcuuuucuuccuggcuuugcugucucucaagcucuuucugccucucccuuccugcuugcuagaggagagcaacccuggacagucugcugcugcuuugcucaucaucacccagaguggcauguuauuugaauggugugcuccuguccccgagcuucagagcucuccccacuaggcugcugauuaccccgauuacccucacauucagcuugcagcugucaucucucugcuguucccagcugucaccugucuuguguagcacauuggaucuguuuuguagcaggcauggcuugcuccugcaguggauuggcuauguuacagggcauccuuuccugaccuuauaacaugacucuggcuucaaggugaagcuggugaacguguugaagaggccagaugugacauugacuguagggccaagccucacaaccaaauagaagcuauuuaaggacugggggaaaggaagcuggaagaccuuacuauuugagaggcuggcagaaagcagagaacuaauguguuccuaaaggaagcaggagaugcagauaggagcugcccuguuagugcagccagguguccuaggaugcuguuuugugaauuaaaauuaauuacguacuucuuggcauauuuuuggagugaggaggguugggcuuuuuaugcuaauuuuauuuugugcuuuuuauaucacuuuagagacgauuaaaaaauaaucauaacuuugaagauaguugguuuuuucaaaauauuguuauuuaaaagauaaauucauuuuauauauguguauauacauauauaaacuuaaagcacaugugcauuauguuuauauuuguauauauauauguguguguguguguguguguguguauguauauguauguacacacacauguaaaugcguaaugugugugugcucuaaguuugggauccuccugccucagccuugagagugcugggaccaaagcauuauacauggauucuaggcccuagggagguugcuuggugguuaaaguguuugcugugcaaacacuugaacaaauagcaugaagaucugaauucagauccccagcgucuauguaaaagugaggcugcuuugcucuucuguaagcccagugugggggguuauaggagacagguagauaucaggggcuugcuggucagcagccaggcugaaaugguuaucucaaguaaaagacuaucucagaaacauagguguaaugauugagggucguauucuaauuagucucuggccucuguaugugcccauauaugcauauacuacacauguauccagcuuuugugcaaguauacguacaaauaaaagauggaugggacgccugccacugcauuccagccagcuucagauccugggucaggguuacuacucuuuguucacuuccuuguuuucuaaguguuaauaaaauugcccuuuguacccauguuauggauggauguucuuaaaauaaagcacagaucuccugacucuaagcauuucgcuuuugccucuauaggaguuuugacucuucagagugaucuuacaggccagugauccuuaaguaggaugauugcucccucugguuugcuguggcacugguucauuagaacaagaagucacugaggcauagaagcggcagugcauuuucucccuguaaggcuuaugugcucaauuuuaaggaguacaaaggauacacaguuuaggguaaguuaugaaggcccaggagauguggaggaaacaacguugcuuaggucuguaugguggagcaaaguucuuaggcuuugcaguuagaccuuugagauguggguacauuuuuauuaauuggccacaguggugguguuggugauauuagcaaaugacuaagcuaggaauguuagaauaaacagggaguggguuagauggucuaagacguaaaaccaaucagaucuugagggacaaguagccuaaaaaccaaguuuauuaguuuauuuauuaguuuguauaauuauuauucuaguuuguuucccuguugcugugauuaacaccauaaccaaaagcaauuugggaugaaaggauuuguacuuuauacuuuuaggaaagggucacugagggagaccagggaaggaauucaggacaggaagguggacguaggaacugaaacagaaacugugcaauacugccugcucucuaacuagauagagcucagcagucuugcuuagccagcccaggcccaacugccuagggagggugcugcccacaguggcccgggcucuccacaucaguugucagucaacacagccaaucuguuaaggcaguuuuucaguugaaguucccuugacccaagugacucuagguuguuuguaauugacaguuaaaacauaagaauaaaagaguuagugcaguuagcuucccgaggagggcuauucauaugacuuuccugaaaucuguguccuuagcuauuaaaugaugaauauaacugaauuggcuuuuaaaguugucuccaauauucagacuucauaauuauuagcauuguuuacagcuuuuaauaaaaauuaacaucuauguaaaagcggggcacagauucuuaguguccauauccuccagucuagaauuucuuuauucauggaauuuauuuaugugccacuuuacuuauuugcuugaugucuaccuccuucaauuaugguauaguucucauaaagacaggcucacauuuuuagccacagugccaaauauaauguuuccaaguauuaaaauaaugaaugaaaaaaauuaggucaaguaugucccagcuucaaaguggugaugcuaagaugaccuacuuaaagucaccaagagcacaaagagaauccuguauugguuuccaguguuaauuaccaauacugaacggugguuaaggccucaaggcagauguacauguaggucagucugacuucugagagucagaguuaaaacuaccauacaugcaguccuauuaugggugaaggcccagcugguguuguuagauagggcuugugacuuuuacagaaauuugucaaacgcaggggacaucuuuuauuuuauuuaauuuuaagacagggucucauucuguugcucagguugauuucaaacucccagauugucucuccuuagccucccuggugcuggguuugccccugugugcuacugagcacagcuggaugccuuucuucuguucuuuauaccacaagugaagguauuacugcuaagcaggucugggcucagaggagacauuagagaaugacaaugauaucugaggguuacuugcaugugacuggucuguuucuaggaaugagaagagaagaaaggaacacuuaagugugagccuugaaauccagaauggcaggugaaagggaugaagcuuaauaagacggcagagcagcuauuaagcuuagcuauuuuacuuuggagaaaagggaauagaagacagauucaacacuggucacaucuacaugauagucuuuggggcuucuauggcagauucucccaggauaggaucuacuguaauuagucauuacuagaauucuguugugcauuuacuuuuggaagaauugucucauuugacauuugcugacacuaagcaauuaaauagaaauuucaaguuuucccuugugauuuaccuggaucugacauauaaaauagucacagagagacuccagccagggaagcagaucagugccuugcucagccacuaucagagcagcuuucuucugcagcagauggaaacaaauacagagacccacacagccagaucacccaguucuauauaggaugucuccaucaaaucucuccccuuagggcccagagaacccuaugguggaguguaagagccagaggagauggaggacaccaagaaagaaacaaggccuuuuaaacuaacacaagcaaagcucaugaacucagauagagcagcauucacagggccuguacuggucuguaccagguucauggcuuccaguuuagugucuuuuuauuaugggauuccugggugcaaauaaguggucucuucaucuguaaguuuucuuugugccuuuucuugggcucuguuuugucccauccugauacauuaguuuugcuuuaguguacuuucuuaucauccuuaaaagccugcuugucucuagugagagacagaaggggguggagcuggaugacuagggaggugggaggaguagagggagggaagccauaaucacacacuaugugagaaauaaaaucucuuuugaauaaaagggaaaaaauagucacaaagaauagaaugcuuacuuaguugggccuuggugguucaugucugugaucaccgaaugggguagaaacaggagcaucaugaguugagauuaaccugaacaucagacacacagacacagacacacacacacacacacacacacacacaaaaccuaaaccaaaugaauaagguauuacucauuuaucuuuucucucauucucuuaaagggaaauguaacaaguugcuuaauuagcuugggaaguuuguacaauuucauguuaaacacacugaucuguaacuuaaaaauaccuugaggauaccuuacaauuuaagagcacuggaguccuuguuccagcuaauauuaacuagcaguuaguaccucuugggaguuuaggagagccauucaguuaaauacuucugcuucauuaguauaaucucaguugaauucaguuuuccuuuguaaagaaaauguuaucaguaggugugcaggcuaguuuuguuucaacaugacaaacuagaauuaucugaaaggugagagaaccucauuugaaaaugccuuuaugaucuggcuguggagagauggcucagagguuaagaacagugacugcuugcucuuccugaaguccugaguugaauucccagcaaccacauagugacucaccacuaucuauaaugggaucagauguccucuucugucacauacacaccuuaaaaaaaauaucugucuguacggcauuuauuuucuuagugauuaauggggagggccaagcucauuguggguggugccauccuugagcuggugguacuguaagaaagcaggcugagcaagccauggagagcaagcuaguaagcagcacucuuccauguccucugcaucagcuccugccuccaggauccuguccgguuuucauguucuaacgccuuuggugaugaacagcaauguguaaguguaagcagaauaaacccuuuccucccaacuuguguuuuggucaugguguuuuuugucguggcaauagaaacucuaagacaguaggauuguuuuagaauugcuuguuuucauuguuuaguuuguuucaaaguuauaaugcacuggucuuuguaaauccacuacacagagaaguauaguuaagagaguuguaaagcugaauuuuuuuaaagguguggaguuauuaauuuuaaauaucuuaucaaggaaguacuuuuucugcauuucuucuaguauauuuaaauagcauagaaaauaaaauaaggguagaguauaaaugcuaauauaaaugaaaauuugcacgaccuuuuauuugcuucauccacuaaggguuaucucgauccaugcuagguggauaaaaggggucagggagcucaaaacaauuuucaagucucauguggaagaaaaggagaaucuggcagguaaaauaaaaaguauuuguuuuuagcauuaaaguccagagccccaauuagaugucaucacugcucuuuggaauauuagaauaucuuauaucuuccuuaagucaauuugcuuauguugggguccaggaauugccucacaaaccacaugaacaccaaucuuagacagacagggauaguuuauuuagcauacaucccaagacugaaugaccagggccaugguccagauucuaagccugggaucuacaaacaucugugccaaguuauccaccagucaggaguuagggauaggggauucuuuaagaaaauaucuuuuguuguacacuuauccugcucccauugguugggguaaucaacuguggcaggggacuugccuugucuaguguucuugucuuaacuuaucuauuaggguggaacuugucuuaacuuacuaaccaggaugucaguuacccauguucuugucucuuuuugccaaguaggaggugaguucccagggaggucuuaccaaacuuuaauugaccacuacucaaaauggaaguuuuauuccagauauuucuucuuuugguggugcaggugccucucuuagguugggauccauccuaggcgcaguuuauaccaugaaagcuuauacacagguguaggaagugcugcugggugguuuguuugggucugagcuuauuguguguaacuaacuauacaaagcaguucagaacaaagcagacuauguaaucaacuugggcaugagaaaguuuucuaauaauagcagaaauaacuuaugagaaaguuuucuuacuucauuaguaacagaacaacaugacaggcuagcuagggaauaguuaccuaggcauuaccauuuuauguuggccuuaacguuccauuuaggucuuaauauuuuaucuaggccuuaauaguuuauauaauaccccacuugagucuaagauccuuaggaaggaauuagcuagcuuaguguccuucaugugccugguaauugcaucagguccugggauggaacuaaaaucugcuuaucuguuuacuagugccauuguuauuauguucccuuuguaguguuuggguagugucaaguguguuaggccuucguauuuauuguguagaagaaaguguggucuaggcuuggagaacaggccaggcaaagcuguggggcuggagcuggauagaggcuaaguaggauuugucacagacacuggcccaacaauagcagagcucugcugaggagcaacaagaagggucacacugugugacuuuacuguuaccagauucugaaggacauugcagucuaacaguguuuacuuuaacaccccugaaggagugaaugucagguaaaucugagucuugucugguaacucauguucaucagcuucuugugcaucuuuuaagagauucucuguauaugccuucauaguagcuaugacgugcuuagccgugaccuuccugguaaagaguuaaguugcuuguggucuucugcaguaacaaccacagcuggaaugaguauuuuuaccaugauuuucaaugcuuguguacgaacauaguuggcaaaggugaaagcuguggugaauauauauauuccucaucucccaccacuccugaggucuguagcuuggguucaguucacuuuuuuaccucuagguuucucaauagcauauccccauuucuaggguuuauuauuauuauuuauuuauuuauuuuaguuuagaugcuauuuccuuacuucuuacucuuaaggcugaauuuucuuauuuucuauuaaccuuguacuguagaagguuaucaggagacucaaaguacaaaguaauuuuccauuauuaagucuacauuccacuaguuugucucaucucuuauaaccuuugaaaaguccuaugugcugauuucuuuuuaaacaauauaugugacauuuuaauuguauuucuuuuuuauuuuuugaaauguucaaauagcuucauccaggggccuuuauggcagcaaaacugguuuacuuuguaaacauuuuuucuuuaauuuugaggauuucauacauguauacaaugaaauaugaucauaguuauccccugcaguuccuccuauagucucccaauccaccuugcuccuaacauugccuuugaauuguuuuucuuugaacauacuaaguuccauuaguguugcccuaugugaauggguggggggccauccacuggagcacuggaagccuaccaguggccaucccccaaaucauucucucccuagagaacuccuguagcuccuccucuguaaggcucgaggccuggaguucaccuaguuccucugugcguuggcugucuugaucuuggugugggucuagugugugguuuccuaaucucuggaagcguuuacaagcuuaccuagaggauguuuguugcuuucacaguucauuauuuacaaguaacccaacagaaauugcugcagcggaaauaauuugguuaaaguuggguucauuuaagauuuugguuaguaucucuuagauggaagguaaaguucuuucagucuugguauucuaacuagaggcuggccauucccugaagucugucuaugacacagaugaacucuaccccuacaaugucugccuuguaccugcccuugaaguuggcuguauucucuuuccaccuagagaugugauggcuagcaucacacucuccucacuguuccuuuucucggaacccacacagaacucacugacauuccccacaucuuuucucguuuguuaacaaccucaagaaauccagucuagaccacuaauuagaaaaggucuacucaucacuuucccauagaugcuaugccacugcuaauuacaugauagcaugucauugcuagggugaaggggaggaacuauaaaaaagauucagaauuaucuuaggauaacuuauguaagauaccugaggaaggaaauaagagguuuacaaacagauuuuggacauugaauuccgagaaagccaguaggcugugggcugacugcaugguggagacgugcugauauggagggucgggggugaagcagccaaggcagugcugaaauaaccagguagauguucuagaagaaaguccagcucccuagaaggacaggccucaggagaagaugagaucagugugaacucacagagaggucagagaagagcaagaaccaaaguacccaggggacguucaacgaugggacuuuguagagcucauuuagcugaguugggggagaccguagaauagguggcaggucaaaauauuuuugguugguugguugucuguuuuuugggcugaaggagaggcuaccugugcaugcuuaucugugagugacaggaaggagauucaaaugaugacugccacagacuuaaaacugggaagauauggaagcuugauagcagagcaucuuaggaugaagaguagcugagggagggcuuuaagacagaggaaggggugaggcugaggaccagguagccagagggucacagguucacaccauuggagaugauuagcacagguagcuugaauaaccauguagccacugcuuagcauuuauuucaucauuguagagauacagaggugaagaaauacugcuuuuuaaaguuauuucucucccuuauuuugguuagucucauuuuuuuuuugguggccuggaauucauuauguggugcaagcuauccuuaaacuuaggauccuucugcuucugcuuucucagaguaggaaaauuaggugugccccagggaaugcgaagcauuaugaacuugcauucaugaguaucuuaggagcacagcaguaaagauggcucugagucauuaagcuuggaagucugggcugaauagugaguccuaggaacuacaaggauggucaguuucacucuaguuggaguuagguuuggccaggauguugcaacaggagauacacaggagcaaguagaauuuaguucuuaguuaugaaagaggagguuagguuugaccuauucauguaauaaaaauuauaggggcugcacaaauauuguuuuauaaucaucauauugccagagucgccaaacuuacauuuuaucaauuuaucccauguaguaugguaaaaaaugguuuugugagguuuugaaaguaauggauuuuguaaugucagugagcagcauuuuuaauagcuugagaauaacgggcuguguacugucuucuuagccucuuccugaaagcucaauuuuacuuuaauguucauaucuauuaaaaugugcacugugaaacuuuugaucuuuccagaaauguggagaacuguguuuuacugauaugugguugugugcagagguaauuggauaauaaugguguaaacaccuacagguccuaggguuguuauaauaagccaagugcaggaaguguucguucauccuuugaaggcuucacuugugugcugugcucuugaugcaauuccccaucugagcaucagggcuuaaugcauguauauuaguaagagcccaugcuuccccaggacuugcagagcgagcaggcguucugauggacagcuuuugcuucugcuuauugaaucuccuuuagucugcagacugccagcuugauuugugucugcaguugcuuaaggaacaagaccuucaauuaucuguauauucaaagaauguuauauuugcucaaaacuucuguaaaagguagauggcuccuuauagcaagaaacaaugauguguucuuggucuucauuuuaaaugggaacccauggauuaucaugaucaagcuauccugaugcccuaguguuuugaaaaaguucugguuuguacuccuugucccaacauccuauauacuuaggcacuccucuucacucucugagugaaaugagaaauucucucucauuuggauggcaggccacauuuucagauuugaguuucauuuccagucagucagggaaaguaucccuuauccguuggaagaagacguuuggaggugcuugggcacuuggcccuuucccuaaccucucaacaaagaagucauaaacggugcuagagcaugugcugaggguuucuauuugaacuuagcaaguguguccauggcguauauaaccagcagaaucaaagccuugggaauaaaguauccuuaauauuuucugguuugauaaagagagaaacagguaguguugggucuuggguuuguaaaauauugggcaugaaauaccuaacagugacuuaugcuuaucucguccuuucuucaaucagugcuaauauucugaaggagcccgugugcuuaggaggaugugagcacaucuucuguaggugaguuguuagagcuugaugcacacugugaugcaguugugaugucugcacguuaucuuggguugaccuuuauuccuguuuccaucuacaaauaaagaaagcucagaggguaacauacgcagcgcugcuaaguucuugaaaggaaauaaugcuuuuuuccacaugugucuucuuaaaucugguuugaaugacugagcuaauaaucuuucaaaauuuauugaagucuaauucuuaaauuuccaaccacgagugacuuacaacaguagacacuuauuguuguagaucagaaggccagaaagucaaguucugaugcaugcugacagaguuugcuccuucugagggagggucuguucccaccuagugucuuguggcccauuagugagguuuuccaugcuguucacaauguaugaucugaagaguuaauaggcauuugauagccacccuuuuggucacccguuuggucaccuuuuugacagaauaccugacaaacuauuugagcugaguuucacaggcuucagcuacagugguuagcuuugguuaauuagaugcuugaacacuaauuuugcuucuugggguaauaagccaagggcagaaaguguucauccuucaaacaccuugugacagaggacacugguggcaggaaccuguggagguagauguucuguccuggcaggcaggaaacagagaccugggauuuggcacuagguggaaccuucaaaggccuguuuguagugauuucucuagcugggcccuaccuccuaaaguuccaccuccccaaauagcacuacuuaguugagggccaaauguaacagugagccugucaggcacacuuguaauauuguauguuccugucacaggcucuaaagcacucauuugggauucacaccauauauaauagggagaaaguuuuaauuuggcucacagauuuagaaguuucuggucuuuguuccuuuauacagaggcuauauuugugcacaucucuaucuccuuaugcuuuuuggagccauagauuuguuuguugggaaaaauuaagcagauugucgugcuaaauaaugucucuauguagucaauugauaagauuuuacauauauguccauaccauauuaucagagcgcaccguuuuaccagucuauguaaaacaaccuaugcuuuccuucuguugcuacucuucaguguuuggaguucagauucugcugacuuuucuuugaauuuuuuuaagugguuguauaagugacuguguuggcucaggaugcccaguguguuacaccccagccuggauccuagaccucaagauaaaccgacaauuggacagcaugauccagcuuucuaguaagcuccaaaauuugcuccaugacaauaaaggugagugauauuccuuuauguuuuguuaaagaguggacaaauuaauaauaaggagcacaugaagaaagaauggagagagaauucugaaugauguaguucacauuucgagguuaauaguuuucuaaaagucauugugagaaaugagauaauuaaguguaaacuuuauagaugagauccuaagguccagaggaguuaggagcucucgccuucagucuuauguguaguuaauguaagaagcaagggaaauggagugcaucucuugaugucaguccagggaggcucaggguggcacuggcugcuugcuauaggugggggaauuucuauagacuauagaugcuggagugauuuuauuuauaacagugcuuaagucacuuugcuacacuguuagaagauagaauacaauacucuugugaggaucacuuucuagacugaauuaauuagguguacauuuugaaagagcaaaaaucuaacacucauuuucuuuucuaucuaaaugagggguuaauguuuuucaaauuguucuuagacucugcauauuaacuauauaucuuugcauugugcuuucugcugagaacuaauuggcugugaaaagaaaguaaaguguuuugaauuuucauaauuggauguuggaguugucuuuucauugaccaaaucauauuauuuuagcauguguuuauaggagacccugucuggcaggaugccaugagagauugguaguggcaauauaaauuugucagcuuuguguuuuuaagucuuuuguucuuuguauucugauguaauauuguaacugucagcuacuaguaagggugauugaacaaaauuaaaaaacggcaaaucuaaguauuacugacacugguuguauuuuuaagaauguaagucauaguuaaccuguguuuacauugaguuaucugaucuuugugcuagucuccauuuuuaaugauaaaauauguuauacuagcaaugugacuuauggaaugcagguguguauauauuuuauaaaggacuugcuuuaaaaaguauuuaaaaagucucaaagagugcacugauuuuauagcugacgacuuggcauugcauaagcaccugggagacacuucuccagcucccagcauuucuugguuuccugcagcucuuuauuugggguugaggcaugugagcuuuucccccuuuugugcuaacauggcuauugauguuauuuguuaggggucuuguuugggcagcuaugauagauauuuacauaucuaucauauauauguauagauguauaugauagauauguauguauauauagauacacacacguacauauauguauauaacauauauauguauaacaacucuguuugcgucuguugaguaacaauaaagaaaaaguggccaugaauuugaaaguaagcagggugggaguguagguaggagggguuggagggaggaaagagaaagggguaaaugauaaaauuauaacuuaaaggaauaaaaagguauaauacaauaaaaagauuaugaaaagaauguauugaggggcuagagauggcucaguggguuaagagcucuuacuacucugguagaggcccugcgugcugcuuccuagugcucaggucaggcaccuccauguccagaagguccaacuccuguagucaugugcacauaaacauagugauaaaauuaaaugcuaaaaaaagaaaagggcccuuccgcucgacucgagacucgagccccgggcuaccuugccagcagagucuugcccaacacccgcaaggguccacacgggacuccccacgggacccuaagaccucuggugaguggaucacagugccugccccaauccaaucgcgcggaacuugagacugcgguacauagggaagcaggcuacccgggccugaucuggggcacaagucccuuccgcucgacucgagacucgagccccgggcuaccuugccagcagagucuugcccaacacccgcaaggguccacacgggacuccccacgggacccuaagaccucuggugaguggaccacagugccugccccaauccaaucgcgcggaacuugagacugugguacauagggaagcaggcuacccgggccugaucuggggcacaagucccuuccgcucgacucgagacucgagccccgggcuaccuugccagcagagucuugcccaacacccgcaaggguccacacgggacuccccacgggacccuaagaccucuggugaguggaucacagugccugccccaauccaaucgcgcggaacuugagacugugguacauagggaagcaggcuacccgggccugaucuggggcacaagucccuuccgcucgacucgagacucgagccccgggcuaccuugacagcagagucuugcccaacacccgcaagggcccacacgggacuccccacgggacccuaagaccucuggugaguggaacacagcgccuaccccaauccaaucgcguggaacuugagacugcgguacauagggaagcaggcuacccgggcuugaucuggggcacaaaccccuuccacuccacucgagccccggcuaccuugccagcugagucgccugacacccacuagggcccacacaggauuccacacgugauccuaagaccucuagugaguggaacacaacuucugccaggagucugguucgaacaccagauaucuggguaccugccuugcaagaagagagcuugccugcagagaauacucugcccacugaaacuaaggagagugcuacccuccaggucugcucauagaggcuaacagagucaccugaagaacaagcucuuaacagugacaacuaaaacagcuagcuucagagauuaccagauggcgaaaggcaaacguaagaauccuacuaacagaaaucaagaccacucaccaucaucagaacgcagcacucccaccccaccuaguccugggcaccccaacacaaccgaaaaucuagacccagauuuaaaaacauuucucaugaugaugauagaggacaucaagaaggacuuucauaagucacuuaaagauuuacaggagagcacugcuaaagaguuacaggcucuuaaagaaaagcaggaaaacacagccaaacaggugauggaaaugaacaaaaccauacuagaacuaaaaggggaaguagacacaauaaagaaaacccaaagcgaggcaacgcuggagauagaaacccuaggaaagagaucuggaaccauagaugcgagcaucagcaacagaauacaagaaauggaagagagaaucucaggugcagaagauuccauagagaacaucgacacaacagucaaagaaaauacaaaaugcaaaaggauccuaacucaaaacauccagguaauccaggacacaaugagaagaccaaaccuacggauaauaggaauugaugagaaugaagauuuucaacuuaaagggccagcuaauaucuucaacaaaauaauagaagaaaacuucccaaacauaaaaaaagagaugcccaugaucauacaagaagcauacagaacuccaaauagacuggaccagaaaagaaauuccucccgacacauaauaaucagaacaacaaaugcacuaaauaaagauagaauauuaaaagcaguaagggagaaaggucaaguaacauauaaaggaaggacuaucagaauuacaccagacuuuucaccagagacuaugaaagccagaagagccuggacagauguuauacagacacuaagagaacacaaaugccagcccaggcuacuauacccggccaaacucucaauuaccauagauggagaaaccaaaguauuccacgacaaaaccaaguucacacaauaucuuuccacgaauccagcccuucaaaggauaauaacagaaaagaagcaauacaaggacggaaaucacgcccuagaacaaccaagaaaguaaucauucaacaaaccaaaaagaagacagccacaagaacagaaugccaacucuaacaacaaaaauaaaagggagcaacaauuacuuuuccuuaauaucucuuaauaucaauggacucaauuccccaauaaaaagacauagacuaacagacuggcuacacaaacaggacccaacauucugcugcuuacaggaaacccaucucagggaaaaagacagacacuaccucagagugaaaggcuggaaaacaauuuuccaagcaaauggacugaagaaacaagcuggaguagccauuuuaauaucggauaaaaucgacuuccaacccaaaguuaucaaaaaagacaaggagggacacuucauacucaucaaagguaaaauccuccaagaggaacucucaauucugaauaucuacgcaccaaaugcaagggcagccccauucauuagagacacuuuaguaaagcucaaagcauacauugcaccucacacaauaauagugggagacuucaacacaccacuuucuucaaaggacagaucguggaaacagaaacuaaacagggacacagugaaacuaacagaaguuaugaaacaaauggaccugacagauaucuacagaacauuuuauccuaaaacaaaaggauauaccuucuucucagcaccucacgggaccuucuccaaaauugaccauauaauuggucacaaaacaggccucaauagauacaaaaauauugaaauugucccauguauccuaucagaccaccauggccuaagacugaucuucaauaacaacauaaauaauggaaagccaacacucacguggaaacugaauaacacucuucucaaugauaccuuggucaaggaaggaauaaagaaagaaauuaaagacuuuuuagaguuuaaugaaaaugaagccacaacguacccaaaccuaugggacacaaugaaagcauuucuaagagggaaacucauagcgcugagugccuccaagaagaaacgggagacagcacauacuagcagcuugacaacacaucuaaaagcccuagaaaaaaaggaagcaaauucacccaagaggaguagacggcaggaaauaaucaaacucaggggugaaaucaaccaaguggaaacaagaagaacuauucaaagaauuaaccaaacgaggaguugguucuuugagaaaaucaacaagauagauaaacccuuagcuagacucacuaaagggcacagggacaaaauccuaauuaacaaaaucagaaaugaaaagggagacauaacaacagauccugaagaaauccaaaacaccaucagauccuucuacaaaaggcuauacucaacaaaacuggaaaaccuggacgaaauggacaaauuucuggacagauaccagguaccaaaguugaaucaggaucaaguugaccaucuaaacagucccauaucaccuaaagaaauagaagcaguuauuaauagucucccaaccaaaaaaagcccaggaccagauggguuuagugcagaguucuaucagaccuucaaagaagaucuaauuccaauucugcacaaacuauuucacaaaauagaaguagaagguacucuacccaacucauuuuaugaagccacuauuacucugauaccuaaaccacagaaagauccaacaaagauagagaacuucagaccaauuucucuuaugaauaucgaugcaaaaauccucaauaaaauucucgcuaaccgaauccaagaacacauuaaagcaaucauccauccugaccaaguagguuuuauuccagggaugcagggaugguuuaauauacgaaaauccaucaauguaauccauuauauaaacaaacucaaagacaaaaaccacaugaucaucucguuagaugcagaaaaagcauuugacaagauccaacacccauucaugauaaaaguuuuggaaagaucaggaauucaaggcccauaccuaaacaugauaaaagcaaucuacagcaaaccaguagccaacaucaaaguaaauggagagaagcuggaagcaaucccacuaaaaucagggacuagacaaggcugcccacuuucucccuaccuuuucaacauaguacuugaaguauuagccagagcaauucgacaacaaaaggagaucaaggggauacaaauuggaaaagaggaagucaaaauaucacuuuuugcagaugauaugauaguauauauaagugacccuaaaaauucuaccagagaacuccuaaaccugauaaacagcuucggugaaguagcuggauauaaaauaaacucaaacaagucaauggccuuucucuauacaaagaauaaacaggcugagaaagaaauuagggaaacaacacccuucucaauagucacaaauaauauaaaauaucuuggcgugacucuaacuaaggaggugaaagaucuguaugauaaaaacuucaaaucucugaagaaagaaauuaaagaagaucucagaagauggaaagaucucccaugcucauggauugacaggaucaacauuguaaaaauggcuaucuugccaaaagcaaucuacagauucaaugcaauccccaucaaaauuccaacucaauucuucaacgaauuggaaggagcaauuugcaaauuugucuggaauaacaaaaaaccuaggauagcaaaaagucuucucaaggauaaaagaacuucuggcggaaucaccaugccagaccuaaagcuuuacuacagagcaauugugauaaaaacugcaugguacugguauagagacagacaaguagaccaauggaauagaauugaagauccagaaaugaacccacacaccuauggucacuugaucuucgacaagggagcuaaaaccauccaguggaagaaagacagcauuuucaacaauuggugcuggcacaacugguuguuaucguguagaagaaugcgaaucgauccauacuuaucuccuuguacuaaggucaaaucuaaguggaucaaggaacuucacauaaaaccagagacacugaaacuuauagaggagaaaguggggaaaagccuugaagauaugggcacaggggaaaaauuccugaacagaacagcaauggcuugugcuguaagaucgagaaucgacaaaugggaccuaaugaaacuccaaaguuucugcaaggcaaaagacaccgucaauaagacaaaaagaccaccaacagauugggaaaggaucuuuaccuauccuaaaucagauaggggacuaauauccaacauauauaaagaacucaagaagguggacuucagaaaaucaaauaaccccauuaaaaaauggggcucagaacugaacaaagaauucucaccugaggaauaccgaauggcagagaagcacuugaaaaaauguucaacauccuuaaucaucagggaaaugcaaaucaaaacaacccugagauuccaccucacaccagucagaauggcuaagaucaaaaauucaggugacagcagaugcuggcgaggauguggagaaagaggaacacuccuccauuguuggugggagugcaggcuuguacaaccacucuggaaaucagucuggcgguuccucagaaaacuggacauaguacuaccggaggauccagcaauaccucuccugggcauauauccagaagaugccccaacagguaagaaggacacaugcuccacuauguucauagcagccuuauuuauaauagccagaagcuggaaagaaccuagaugccccucaacagaggaauggauacagaaaaugugguacaucuacacaauggaguacuacucagcuauuaaaaagaaugaauuuaugaaauuccuagccaaauggauggaccuggagggcaucauucugagugagguaacacauucacaaagaaacucacacaauauguauucacugauaaguggauauuagccccaaaccuaggauacccaagauauaagauauaauuugcuaaacacaugaaacucaaggagaaugaagacugaaguguggacacuaugccccuccuuagauuugggaacaaaacacccauggaaggaguuacagagagggaguuuggagcugagaugaaaggauggaccauguagagacugccauagccagggauccaccccauaaucagcauccaaacgcugacaccauugcauacacuagcaagauuuuauugaaaggacgcagauguagcugucucuugugagacuaugccggggcccagcaaacacagaaguggaugcucacagucagcuaauggauggaucauagggcucccaauggaggagcuagagaaaguagccaaggagcuaaagggaucugcaacccuauagguggaacaacauuaugagcuaaccaguaccccggagcucuugacucuagcugcauauauaucaaaagauggccuagucggccaucacuggaaagagaggcccauuggacuugcaaacuuuauaugccccaguacaggggaauaccagggccaaaaagggggagugggugggcaggggaguggggguggguggauaugggggacuuuugguauagcauuggaaauguaaaugaguuaaauaccuaauaaaaaauggaaaaaaaaauaaaaauaaauaaaauaaaaccaugcaaacuucaaaaaaaaaaaaaaaaagaaaaggacugcauuggggagaugucauuaguucaucugaaugcuuuucuuccuuaagcacagugucugaugguguguauuuagagguugaaaagauugugucuaugaucugaucagccucuguccacccaacauacgcacuaaguugacauagugauuccuagucaagguccuuggguuaggguuaggguuaggguuaggguuaggguuaggguuaggguuaggguuaggguuaggguuaggguuaggcagugucagaguugggaauggagaggaaccaaugagucccguaaugauuuguacaguaggaacaguauaucucugaaaguugcucucauuugauuccauaggcaugucugauuauuaagauuauuggccaaacaccuccaaaauguggggucuacuuuugagacucauaauuuccuaacuugacuugucuccaguuaguguggaauaguguguugggucacugcagauggcuguagcagaacgugacaaacugggcagcucaaguaaaagagccugccucaguucuggaggcuugacaucugagcuucaggagugucuucucggagaucuguggcccguauccguguucaccgcaugucuucaugauaguuacauuagggcacccacccacccaccccagugcaguuucaucuuggaugagucuaauuuagacuuuaauuagauuacauuuggaguugcagguauuaguuaugguuucagcguauggauuuaaggaguagaaggaaggucacaguuuaaugcauaaauaaauaauuugaccuuuuuaauagugauagaaugggaggaggcuagaguaacuuuguaagcuaauugucaucuguuauggcucacuaggcuguuagguaccuugggguuacaaaaaggaguaagacuagaaauuuacuguagugaguggagggcauuugaaucuuaguauaguuuuguauuuuguagacaguggaaaaacuaaauuucaagcaagauucaggguaggaccugagccuuuuuagaauauguuuuuacuguuuuccuguuuugaacauuucuuuuggggguggguggcuaguagguauuaaguuuguuaaauuaaguuguauaaacauuugaagugugggacuggaguuagaucccagcaccugcaccacaggccaagugugcuaugcacaccugugacugcaacucaucgaaaacugagggccuccucuaaccaucugaccuuucaugcgugcacaggugugaccacuuacacacucacucacuugcacgcacacaugcauaauccaaagaagaaaguaaaacuggcaaugggccuuugugaccuugauaggagaucacagaaauguuagagaaguuuauugaauauaucuacuugauaccucuguuuuugugguaaaguuuuuuguuuuuuauuuuuucuauuuuaaguuacaucaccaucagauuuucuucuaaaaguccucucaaaacaagccagcuuugaaggguguuuggcuuuucaguuuucaggauuuuucccccugguguagcucccucuguuucaguucuuuauaguuucuuuaguacauguccugagggccugucuuaguuuagugaggccuuuuaaaaccaaauuuacauaguagguggugaaauguuuuagcaguagaaggaacuagaaauugggaaccagugaggguugcucuuccuuguaguaagaacaggaucucaccuuaauuaaaauaagggugggcgaccgagugauuuccugcagccugacuaacuccaaaugaugaugcucacauggaaaacgaugaaccaaguggagggucagcagcucucacaguuucucuaucuuuaaacaaaaauuuguagcacauaauuuaucuuccaaaugaccuuuguuacuugcauuuacuauaaacuauauaauuacuagaacuaagguggguaauuaggaagagcuugucagcucguggacauggugcaugguauauuggagaugaagccaauuuauaggagaaggugcuaagaugagcuucuaaacauccccacauauuuuccucgguucagugugcuuuaaagagaagagguugucauauuuuucugagggccauuuauggguaauuuuaccuuauucuuuaaaacaaucuuuuuucuacuaauagagguaaauuuaaaguugcuauuuuucccuugaaccuaucauauuaaacagcccuugcaggugcuggucacguuuguggaccguguaggugcuggugacacucaaauaaagaaccuugauuaugcuuucacagaccgcacugugcauuucucugcuguagcuuuaggagauccugauccuucugaagugacuccuuagugucucauguaugcuaugacuucuuaccauggauggagauggauacuaggguggccacggagcuguuguuauuuuaaauagaucuaaaugcauucuaacuuauuuuaaccuacagaauaaauauucuucagguguuaaugucacacagaugggauacagagggccucccugugauuuacuuuguuuuuuuuuuuguuuuuuuuuuuuaaauaaggagcuagcuagucaguuuuucaacuucuguuuuguguuauaacuuacaauagagaauaauuuggaaagcacaauguacaucauuaucauccuuugauguagauuaaugauagggggaucacauuuucuaauugcuucucuuuucuaugcuuauuauuaaauuuugagaaaaaaaaaaaaaaccuugaccaugccgcuccuuaguaacacacauaucucugcuccuuaaauuucauuguauauucuaaaauauuuaaauucagagaguaagauuuuuuuuuuaaugucaucauuaagaaauuugcuaugcagaggcaggaccaauguuuuucuucaugaaaugaauaugauaauuuaucaagcuuagaagcguucauccauaaaacaguuguagcuguuaauaauaugauuuauguucuagccacugaauuguuuugcuuuucaguuucaucuuagauaugcugcauaaaauccagaauuuacaguuauuguuugugguuauccuugcuuaguuagaucaaguggugugauuaaaauuuccaggcaaagguguuaguacccaagucaauaaaaugauugcaugcauauaaauuacauacuuguucacuguuuauuugcucuuuuauaaguuaggaaacaugcugcugauguugaaauuugguauuuuuuuuguuuuguuuuagauuugagguuuuuaguuaauugacuguguuaucacuguguaauuuucuuuagcuucccagcucuacuuuuuauuauaaacauggagaaaucaagauuugacuuguuuuucauugaaaaugucaucaucugcauuuaaaauaauaaauuaaaaccaaauacaacuuuucucagaugacuugaggauuaaccuuuaagucuuuguaauccugaggccuucuuaagaagcaauccuugguaacauuucauuuugaccguucucuagacucgagauuguaucacaaguggcuugguuuuaaaaucuacauaucacugcagaggaaaggccuuguugaauuuagacgucuagucucuuugugaauggacaucucauucuuaugauuuucaagauccugucucaguaacacuauagaccauggguuucucaacaauuccacuucaauggcuuuggggaaucugcccucguucaguuacauagcucugcuuguagccggccuuauuuguuuacugucuucagugcacucacccaugucacuaggaagaaguggagucuuuacaguauaguccaagugcuguuauuguuaggcagggucauguguuacauuccugcaagguugaaaacuacuuacuuauuuuccacuuccucuuccuuacuuagggugcuuuuuaccugguggcuguguuuguaagaugggaggugaaagaagagacaaagcaaacaauccuaggcauuuaggaauugguggucgagcaguagaggaauaaaacguaacaguccuuagagaacagaaagucgaauucauugguaggucaagguggagaaauuaauccuuauagcauguuucuuuuccuuuuuucuaucagauucaaaagacaacacaucuagggcaaguuuauuuggugaugcagaaaggaagaagaauucaauaaaaaugugguuuaguccucgaaguaagaagguuagauauguugugacuaaagugucaguacaaacacagccucaaaaggcaaaggacgacaaagcccaggaagccucaauguaugaauuuguuuccgcaacucccccuguagcuguuccuaagagugcuaaaacagcuucuagaacaucugcaaaaaagcauccaaagaaaucuguagcuaagaucaacagggaggagaauuuaaggccagaaacaaaggauaguagauuugauuccaaagaggagcugaaggaagagaagguugucuccuguagccaaauaccaguuauggagagaccacggguaaauggugaaauagacuuauuagcaagugguucuguuguagaaccugaauguucuggaagcuugacugaagucucuuuaccauuggcugagcauauagugucuccagacacugugagcaagaaugaagagacuccggagaagaaggucuguguaaaagaucuucguucaggagggaguaauggaaaucguaaaggcugccacaggccuaccacuucuacuucugacaguugugggagcaacauuccgagcaccagcagaggcaucggugagccagcauugcuugcagaaaacguaguguugguugacugcucuucacugccuucaggccagcuacagguugaugucacacucaggagaaagaguaacgcaucagaugacccccuuagccuuucaccgggcacacccccaccucugcugaacaauucaacucacagacaaaugaugucaagccccuccacagugaagcugucuucugguaugccagccaggaaaagaaaucacagaggagagaccuuacuucauauugcuucuauuaagguaggcugccuacucagaaccaaaucuuagaaagagaccagauuuuuuggcucuuacuguaacaaauacuugagauaauaagaguacaaacuuaauuuaucucacagaauuggaaauuucaguuuguguucaauagguucuguugcuuugagcuugucaucauagauguguguuauggaacaaaagcugugugugcccccucggcccacugaugagaaaaagaggggauaaggaaggggugggaucccaucuccucuucacguccagugccgugaaaaccuuaauguagaagauggaggugagagagaggcuguggcaguggaaccaugucguuagcuacaaccuaggcauccucuacucugagcaagucaaauauuuggaguuaauucugguuaugcuucaauugguuucucuuaagccugacuuagaaaauuucuaguuuuggucauucuugucauauguauaaaauauguauaugcacacauaagcuauuguaaugugguuaaugcuuccuaaacuaucuaguuaauaauuauuaugcuccauucaguuuucuauuaguaagauuguaggcugauguaguuucuaugucucucuuucugggaauuuucagaccacagaucaagcauucccuuaauuugguagagaauguuauuccaacuauaagaaaaauuuaccuuuauuaaugaggaucucuagagccuagugucuaggccagugcuuaauaaacucuuauggagguugcuagagaaaauguucuuuacuuucaaacuauauaguaugugccauauauuacucuagagcagaaauagccauagacaacaaguaaaccaauuaaaacaacuugcgaauucagguggcucccucacauacuguagcuuauauucuguuuuccuaagcauggaaaaaagccaaaguagaacagguagaaaaauuguggcaugaugguguccuggugacuuuucuucauugauguguucaucauuacuuugugcaaguuuuucucaguuggcugucuacuugaagagucuugcccaaaguaaaguugucuauuuuguuuucuugaaccuaauuaucugauauuguuauuguuauuaauugacuuauucucauuugcuacauuuaaauaugcauugauuuauauuguuuuuuuaauuaacaaucauguucucuuaaaguuuuauugugaggcgaauguguuuucccaccuguuuguuuuuuguuuguuuuuacaauucugggaaacacacagggccuuacucgggcacucuaccaaauagcugggcuuucagcuuguguuugaacuugauagauaggauuugggaagaagacauaucaguggguguaucaucguuguuaccuuuuuagaaguguuuuucauuuaauucucaccuuaauuuuuccauauagagcaagaaugaauuauuuagaaauaugaggaagucaagcacuauaauucugcagucuuauuuuagcuguguguccaccuacuucagaaauaauuugcaugggccuuaauauuacagcuaccauaaaauggagcaaggagcagggaccggcguuucuugacacagugaauucagauuuggugaccuuuaaggcagccaaaccaauaaaggggaagcaguggguuuaugcaggucagaaggaaggccuucccaggcugcugcuguauuguugcacauagguggauuugcagcugccacaguucaugguacuugugaugauuaaucuugauugucacccuuuuuggagccuggucaagugguucacaccuguaaccuuagcauucaggaagcugaggcaggaguauuacugugaauugaaggacaacuuggauuauguagcuaguguaaggcuagccagagcacaaaacaaacacucuuucccagucacuccacuccugauaccaaugucuuucuuagucacuguucuauugcugugaagagguaccaugaugaagacaguucuuauaaaggaaacacuuacuuggggguguacuuagaguuucagaguguucauaauuauugugcuagaggaguagcuugagagcuuuacuuugaggucugcagguaucaaaaagagacagacagacagagacagauauacagacacacagagagacagagaauaugagccugucggggccuuuuuuauuuaaacugccacacauuuuacucccugauccacauagacuuguagucacaucacaauguaaaguguguuuaguccaauuucaaauguccuuuacauagucuuucagucucaacacuguuuaaaagucaggggucuuuucugagacucaaggcaaucucugaauuguaaucccuuauaaaaucaguuuccaaaacuagaucacauacuaccaacauacagugguacagaauacguauuaccauuucaagggggagagaagagggaauagugaagaaauacuagaccaaagcaucacugaaaacgagcaggccagacuucacguucugaaucuccauguccaaugucaaggcgcucuucacaucuccaacuccuuucagcuuuguugacuacaacacacuucccuaucuuagacuggcuccacacccagucugcagcucuccuugccagauaaugcuacaccuuucacaucuuggggucaccaauucaauccaggcuucuugcaaugacuucccuaggauugcaugcagggucugccccgggccuagcuucaaaggcuuuccauaauggaggaggaagguuccauaacuccuugacuccuugagccagaaccuuaugcuguccaguucugccaccugaaauguaacccucuuaaugacuuccauuuacauagcuuugucuugauaguuucuaggcugaggaaaucccucagguuuauuccuucacugguugcaagauuaagguggauguggauggugucucauccuuagcucaccacucccuuuauuccauugagcauugagccuuuaacacuuuaacccuuguugggcaccagacauggccucagguuacauuuccuggcacuguuuucuccucaaacuucgauuuauacuugucuuugcuucacuugcuccuuuucauuguagguguguauaauagugaucacuaguaaccacacaaggagucaguacaaggcuaucuggaaaucucugcuugugccauuaauccaaaacucuuccauuuuauccccuugcaguuuuuuuaggacaugaucagaaagcagcuauauucuuugccaguauauuacaacaauguggccagccaacacuagucuuuccuucugaaaccuuucaagcugggcccccacauuucauaucacccucugcacagucauccaugcuccugcuaagauggucuauuaaucauuguuaaagcauucacugauuuucuaguccaaagucuuccauauuccucuaaacaacagcauggucaggucuguuacagcaauaucccagucccugguagaaccuucuguuuuagaaacacuauggcauuaucagcauaccucagugugccugugagacagauaagaaggucucugaccuaaagaauggucagcccauuggauaauucagucuuuagagaaaguggcucauugauaguguauacuuacaggcauaucuuacacuagccuuuuuuucugauauuucuacuccucucugccuccuaguugccaugauaugaauugcucuaugcuacuucugagccacaauggaccaaagccccaaggacaaaauaaacccuucuuccuauaaguuauuucuguaagguauuugguuauaguguuguagaaguaaguaacauagaagcgauugauuugucuuucaagaaguagguuuucugagaaguguaagagucuggcauuccauguuguuaugcagacauaauagaugcuacuaugucaucuugaaggcauggugcugagaaucuaaugaauuauaauucugaguagauagucacggagaggcucugcuucagaguauacuuccagucuguucuguuauauuguaugugaaaucacgguauuuuguuuccuucaugcuagcgucaugagaaaguaaaagacacauaagcaaacagggaucugugauauguucaagauuuuauuucuggaacaucacauggagucagcaucuaacuccuucaguuggucucccaccucugcucuugugauacuaguaacuuuuuuguagcguugaguugucaggauuauuuauuuaugaaauuacuuucuucuguaaauuuuaagaagccagagaacuguuuaccauauugcagaacuccauucguaaaggucauuuuguuuucucuuuuaaaaaugacaucugucuuaguuaggguuucauugcugugaagaaacgcuaugacuacaacucuuauaaaggaaaacauuuaauaggggcuggcuuacaguuucagagccugagugcauuauuauggcaggaagcaugggcagugugcaggcagauguggugcaggagaaggagcugagaguucaacaucuugauccacaaacagcaggagaacugugucacucugagccaagcccugaacauaggagaccucacagcccaccccacagugacauacuccauccaaggaagucaugccuccugguauuggcacucccuaugggccaagcauucaaacacaugaaucuauggggcuauaccuauucaaacucacaccaucuaauuggucagccgguguuaauggaaaacuuaguugugaugauuauguaaauuuuauuguacuuaauuguaauguccuguugucuuuaaugaagauuuuuuuuuuuuuaguguuguuuuaggagcauguauucuaauagagcaaaggaaauuuguuuguaugcuuuuagaaacuuaguguauguuucuggaauaugcacauauucacaguaugugagaccauaugaagaauuuuucuuuuuacuacaaagaugcagauauacaaauccacuugggcacacacuccuuuauuuuggggccuuuaaaguauugcuugaaaauaccaaaagcauuuaaaauuucuuguaagucuuccuaaauacuuucuucagaugauuuuccccccccucagggcuuuaaggaaaucucaauuauucuuuuaaguuguaaggaaugagagaguucuacuaaaaaaauaauucuccuagagaagaaaguaauuuaaagcaacaagaagcagaaguuaauuuauuuccuggaaacuuuauaucagugcaaacucauccaguuacuguggacaccuccuaauuaucauaauuuuauuuaugugugugacauuacauucacaugaaguagaaagaugaaaauaagacaaacuuuuuaguguuagggagaagaaagcaucuugggucuaaagagcuagcaguuugcuaaucagcuguacauuuuagggguagacuauuaauagagcccuaccuuugaugauacucagaagugacaugaaagcaaagcagggagcccaggaaacagacucagucuguuuaugucccuaccacugccacuugguugguuccuguugacaauucaugagugcuucugcugucuuuuuuuuuuuuuuuuuuuuaauuauccucaaagagcugguuuuauuuugcuugccauuacugauaacaguuuuaggggaauuuuacaaaugucaucccacuguauaaauacgauaauuucugcgccaguugauaaugauaaaagcugcccaccuagauuagacaaguuaucccgauuauucuguccuuuaugauaucauaucugucuauggcuauuuaaagccauguugguucugaaucauccugucagccacucagucuccaucuugcuuucucccucuucuuccucuugccucucugccucugcagcccuuagcuccgccucccuuuucuuugugcaaucacaggccuccugcugcacuaauauuuuaauguaaucggacggggaaaauccuguuacacuuucccuaaugcuuuaaguugcuuuuuuaaaaggaggugguauguuuuauagcuagaggguuuuuuuuuguuguuuuuuguuuuuguuuguuuguuuguuuuuuaaggcuuuaaggguugaccaauacuuuaguuuguaaucaaguaugguagaucuaugccagauccuuccacccacauugguggggaaugcaugugauaaagagccugcaguguuuuguaguuuggaaauuguguuucuggacagaggaauagaaacuagaaggugguguaggacgugcuuuuaguagcaugcacagaauuuugagaagagagauuaugcaagcccaauuccuagccuuaucuccuuugacaaggcucacuuuguuaaaggguagcaacagaaggaaucuuccaucuuccuucaguucacucaccuauauuaggauuuccuuagauaaagacacagaagacacagaaggcucagaaucagaaggagacuuaauuuucaugucauuuaauaauugaaagugucuuaacuugaaggaagaaugaauacuugucuccaguccuuuacgccaucuuaacuuacuuauuuucaauaucuuguucaucuccuuugaaagcaggcucugauacuacaauaaugacugcagcucuuuuccuucugcccucccugugucugagacacuguugaaaaguuacuacgugagccucuagagacaaauggaaacguauucagcuagugagaaggacauguaaagaauaucauggauuuaauggaagcuguauuuccuaccauucaguuagcugauaauggguaaugguuucaguuucaaaacagaggauaaaauuaaaugcugauuuuguguguuguuugacuguuucucucaaucccuuuccuggcauuuuaaaccgcaacugcuucugccaugaagauaccuuuggugcaaauaaagugaauauaaacuaaauuagugacuuaggguaaauaaaguaauggccaauaaaacaguaaguacuuuuuggcaguuuuaacuuugguuuuauuagcuaauuuguuggcuguaaacagcuuuguuuauuuuaaugcucagaaauauuuugauauauguucauaauggcauuuuugcaaaugaaaugauuacuugaaguuuaggauaggcuuuggcuucauuuuguaccuugaacugcauuuccaauauggacugcuagaaauauucaaguacagagcaaacgacuuggcaucucaggacuuuagagacagauauucuuggcucaugagcaguagucggcauguaaagggaaagauaguuuugacuugaagaagacagagucuuuauaauacagccccaguagccccauuucauucaugauauauuuuaauauucuuuaauuuuuuucuuuuuuuuguuauucuaccagggugauauaccuucuguugaauaccucuugcaaaauggaaacgacccaaauguuaaagaccaugcuggauggacaccguugguaguuuuccuuuguauaucuuugcaguccugcgaucucuuuguuuugcucauucuucuuaugcuuaugguucuaguuuaugguuugugguuguucauauaucaugcucugccaccuacacucuuuuuagucugaagaauuuaugcuuugaccaaguaugaaaagaaaguuauuuuucaucuagcuuuucaguugugacaggaaaguaauugguuaccuuuugaguacuuuuagauauaggaguccagcuucacugcaucguuggaagucagcucauguguggagguaacagcuauggcagacauggggcugcgcugugcagcauugugugcuacuggaaccagagagauuggguuuccugggucaguauagucaggaagauaggaugugauuaacagggaguacuuggaucuuguuuuacacucuauccguuuacagaggcaggaguagaaggcuuuguccuaaauauuuuaaaaugucuguuuauuauugguagcauugauuacaaugugaagaauauucuggaaaaagaauggaaaacauacuuggaaacaguuuuaacuuguguuaaugaagaccguaagcacuggguuagaaugcagcccagaaguguguacaaagagcggccuuuaucuuguagaccagaauuucaguauagaaaugagacucauuaggccagguacaaaaguggcuuaaagguauaauauauaaauauguuaaaauaaauacauaguauauauaaaauaacuucuugccaaguucuuaagccaagagggcuuaaucuggauuuaguucauuguguuccacaggcuagcuaacaugguaaaggaacauuagcugucacacuuagucauguuccuucucuugacacugaccccagauucccaguagugucucucagcagagauuuacaugucuuguaaaccuuccugggcugucgcucugcugggugacuaggugcaaauguuggggugcaguuugggguauggacgaagcacuuaguucucuugagcuuuggagaauucccuaucucuguuugaucugcucguuccacaugaagagucuuuuugugcuguuguaauguguaggagaacauaggagcugaaguugcucuaaagcacaguuuuucaagaaaagcaggugauccaaggcuuguccuuucccacaaaguacauggauuuucacuacugcacauuuuaccauaaaaauuacgauaaguuuuucaagaaaagcaggugauccaaggcuuguccuuucccacaaaguacauggauuuucacuacugcacauuuuaccauaaaaauuacgauaagugucugucaacagccagaaaagaguucuauaagaauaaguugaccgacuugaguucccacuacuuucucuaauguguauuuauuaacacacuguuuucccaucuucuucccacuugcccuauuugaaacuuuguuuggauuagcaugaagccugcagucaugggcaccugaagguaguggaguugcugcuccagcauaaugcccuggugaacaccccuggcuaucagaaugacucgccacuccacgaugccgucaagaguggccacaucgauauagucaagguguuacugucccacggugcuuccaggaaugcuguguaaguaucugauuuucaaaauggauuuguguuccugaauggugauguguaccgaagcaguaaauacccacguugguauuuuggucucuugucuuccacagcuaaacuuagaugugcugaucacugugugugugaauccacacucaugcucucuuccucaaaacucauacacuucagggagauuuagucucuucagaaacaauuucaaacacaucuacaaaccucagcuuuauagacaaauucacuuagugguuauauccuguagauugagucauauguaaugaaaauuagauauuuaauuuuuugauacuuaauagaaaucugauuuaauuuuuuguguuauuuaauacuuuagacucauuuuaaauauucuguuaucccuuucugcauauuaguccagcaaaagucaaaguguagaagaauucagauauugggugugcaguugaauuaucucccagauuuuucacauuauucaaaugagucucugagcaaauuguuuugcagugucagggcacagaggagcauuagcgaaugcuggggcugcaucuucagauuacuauugucaagaggcucgcaagcaaaugccauaugcagauuuuauaucuuuaaucuguaacuugacuccugucuuucuauauguuauuuuacucuuuucaguuaauuaggcaguugaaaugaaaaugcaagaauugcuucuuugugcccucauugcuuuuuaggcuucagaagagcacaacaaaagcuuuacccuugguagagagauaagaaaaagcuacaccaugcagauccucuggcuuguaauuuuaauagguagccacuuaacacaguugaaaaacaauuuaccaaugaagaauauaccauacccuaguacauuuagcuucaacaagcuuaucaacucuucuuaauuucccagcacaaguuguaagguaguugggucaaacucugggaaagauuauguauguacguauguauguauauucccaccucuuguaugugugugugugugcgcgcgcacgcgcgggugcacauguuuuuuucuguuucucugcauuuguauauaggacucucauaauagagguaauauauaacuaugugcagaccuuauagauaugacccuccuggggguguaguaagccguuugauaaagcaacugguugcucgggucgggugaaacagaguacuuuccauccuaggguucuuaaaucagccgugacuacuuuaaugaauggagcacuggucguguuagggaacccagcuuuuauuugcgacuccauuauuggcuuuauagccgcaggcagguuaauuucugugcuuugguguccucaccuauaaaacauggcgcugccugcugcuuuucuauuucuucagagcauagugaggauuaaugagccaaaacacagagccugucuugugguuuguacaccaugauucuucacugcgcugugaggauuuguuaauauacaaggaguggacacaaggcagggauccagucugccuucaucgguacuuucucagagaucagguaccauuuugucaugaauggccugaccuagcaaagugacacaacuagguauagcuaagcacugugguagaccuuucugcauuaaaggaaauguuugugucaccgucugauauucaggggccaguagcuaucuauauuugugaagcucuuggaaaucaccucucagcaauaaagucuuuaaagguacuuaauuuuuacuaauuuaaauagccacaugugucugguaacuccuguguugugucaaaugguugguauagauagcucaggugggaggaggauuuauuugguaagagaaauugagacuguuguuggauaaaggauaaucggauagauggaagugucaauuuaauauggugugguugcugucagugaacauuuauucuuucuuuuguagccucuugguuaucauaaaauccucuccucuuguaguguuugugugaguuuguguguguuaaauguguaugagcuguuguucacuugauuaucaguaucauguugguuuccuuuucaaauucuuuuucuuuaauucaucccccauacuggauaaguguguguugaauuaaacuuuguagucaugauaaacacuauauaaaucugaccaaauauuuauuuauuuauuugagauaggguuucucuuuguagcccuggcuguucuguucugaaacuugcugaccaggcuggccucgagcucagagauucaccugccucugccuccugagugcugggauuaaagggaugugucaccaccacccagcucccuuucuuaauuuuuauguccuuaaaacaaaaggccacucugccuccugcccuuuguaugugcuuucauuuugucuggaauauucauuucugauugccaguagcucauccuuugauaccaucuuagauuuaauuucauuuguauucuuuguuaguuucagaugucuauauauggugccucuuuugucaauaagguuuggguuacaguauauuuuuuuuugucuucccauucgguuauuugcuguauggaccagguagggaucaugucagcuaucccagucucucucaguuaccuaacauaaccaguacucaggucuguguguagagagucaguguucagugagcaaagaaauauuucuucaucuuucaguaaguauuuggaugagauuacaauuucgucacauuuuaaaaauacccuuuuaguauugugaaugaaaaugaguagaaucacccauugcaguaaguuggcaaaugucaccauuuauuuagcauuucccccauuucuuuaagcauucugccuugugucucuuaggaaguuuuuaaucuguuuugcauguguguauggacagaugugucuuaaguaccaaggcuguauuagguauuugauuugcuggauccccuaaugaauuaaugauuuauuuuauuuuauuuuauuuaucugaguacacuguagcugucuucacacacaccagaugaaggcaucaguucccauuacagauggcugugagccaccaugugggugcugggaauugaacucaggaccucuggaagagcagucagugcucuuaaccacugagccaucucuccagcccuagaugauuuguuaauagacauaauucucucccucucugucucucucccucucucuguuccuuucucccuuccucucuuuuguguggguauaguuacucuucuggacacccucuguuacuucccuuccuuaaugucccagaguuuaucgaggaccaauggcugucucuggccauggguuuggaacuauucauuagaguaugauaggcucacgagugggugcacaacugaauaggaugcuuuccucuucccagaauccauuagcugccaguaguucaguguaaguggugugggugcuuugugagucucuucuucauccuagcugacuuuugugcuggcucaacuuguguauguccagugcguccgagcuaguacguacaagcuccuuugaguuuauguuugccauggucacguuaugcuuagaaguuagcauuguuguagcucuugucccuaucuucagguucccauauucuucccaucucuucugugccaguguuaagaaaaggggauacacgucugcagcacucagccguucuuuauucucaguaucguguguggccaggacucuagugucuuuuuuuuccuuucuuaaaaacaaaacuauauuuuguguuauuaaaugauuuucaucuuuaugagaugauuacacacuuuguuguucucaugacacuuuuauucauuucaaaacauccuuguguucuggcauaaacucgauugauacuauuguaauauaucuuuuuuacucuuuugaagcaaagucuugcuuauuguccagacuagucuguugaacuccugggcucaaaugccuuaguaacuggguaguaacugcugagucaacaacucaucaauauaaguaguuauugaggcuuuauggaaggucagauguagaagaaaggcuagaacaucuaauauugcaaagcaaaugaguucauaggcaucguguugcauguggagagaagggaaucuugaaaugaucuaucuaaggcaaggcauguuagggauuagugauagccaguguaaaaacguguaucauugauauucuacauuuacuaaugucaucaguggagucuuccuaauccuaguuuuuuucauagaagcuaugcucuucaacugaauuuuucuauuguuuugacccuaaguauuuauaauugcagaggguaggaaguaacaugucugccuacuuuagaauuuacauuuugguuugaguuaucuucauuuucuuguaucucauuguugaagucacauuuugcuggaguguuuuauaauguguguugaacuuguacuguguaaacuucauaauacuucacauuuguucugauuuucauuuaucucuguauuuaauuguggguaauuuaucuucuguuaacuaagaauucauuguccaagaguaaaacuaauuucauuuuaaucuuggcuaaugagaaagaauaugcaucuuuuauaguacguguuauccagugauuuuugcacugauaguuguccaagcugcauuugccgcuugucuuucuccgugccuuccuacaaccccugcaacccuucagcugagauugaugcugucaccguagaacuguuuggaguauguugaaaacuuuauacgcuaucccuccuucccaaauauuggaacuggugauugguuuccuguuaagagcuuucccuuggauggacauugaauucucaaguagaaaaauacuauauggaagguuggaccuauuaauuguuuucuugcccuaguaaauuuaaaaaaaaaaacagaucauauacagcaaagauaacuguuuuguagccuuaaagaagcaugcugcuccuuugaaagauugcuuuugccugcucagagcaagcaaaguacuguaaaaaaugaagccuuugugauugcaguuuuauaguuguucagaaaggauccuguucauccauugucgugacauuugggcaugucuuguaaguuuaguucuaguaaaaaugccuaguuuauguuuuugaauguuggaugaucuacauaugcaaacaaaaauuuuguuuuugcaucuccuuacuuuaucuuguuguuacagcugauucagggcacagcuguagguaggucacuccuguaugggaaaggacauuagaggaauuuauugucugaacacucucuuggguagagcgagaccguaaacaccgcaguuuaacccuucaauaacugaaggacgccuucuucauccgucuugaugauaugaaggaaucuuggcuaagaagcauuuucagccccugucucauacucuuuauguuuagauuguaccauauagggaaaugaagauucuuauuuuaauauuuuuaaaaaauuaugcuucaauguauuuuccauuauuaagcauccaaacuauuauuguagaaugugugugaaauguaucaucaagcgggggaaauuauaauaugauuugcacuccaaguauaaccugucauguuuucuuauuucuuuuuucugucugucucucaauggugcaaauuuagcaguauuagcagucacugagcuaguacuauuugcuggccacugucuuaugaauucaugauacauuaauucacuugaucuuuuaguagucauagaaaauuagguucuaacagccccccuuuacagguaaggaaauggacacaagagauugaaguaguuugugugaaaggccacacaacugauccuagcacuggaacuugaauuugggcaguuuuccucuggaaccuggcucuuagcucucauguaccaugcuaccccuccuacugaagccuguucagggucuugcugcuccaggagaaacguccaccuucauaccauucuuuuguucuuucaaaaguaggcacacauagcucuugguuuccauaucuuuguuuccugaggcacauguguguaccuccucuccccacuccuuuucuucauccguuuccucucuucuccccccuuuucaguuuugaggauucccuagacuaacccacagugcccucacaucuuucucucugcuuggaggacucuuauucugccucuguaucccuuucuaggucuggaaagucucacgagacugaaaaguuggcgcaguguacuucucucauugagcucugucgagauggaaaguaccuuuguguaacuggcuccauaguguggaaaagaggaggagaaccucccuuguuggauggaugaauauuuucaaacugauuauauagcaaucuuaccacauucucaauguguguaaaguacauggaugauuauugauucuaucacaugcccaucauuuagauacauuaaguauugcuaauuuucauacagucuauuaguguguucaguaggaccgauuuuccucuccccccagcuguuagguaguaaaauccuguagcuuaggaacacuugucuucugugaggauuuuuguuuguuuguuuguuuguuuguuuuuguuuuugcuuuuguuuuuugagacaggguuucucuguguagccccggcuguccuggaacucgcucuguagaccaggcuggccuugaacucagaaaucugccugccucugccucccgagugcugggauuaaaggcgugcgccaccaugccugacuucugugagcguuugaacauguaaaauccuuaacuuuuucuguaaaauuuuaaaugaaauauauuuucuaaaaugugauuuaaaugagagaaaaccaggcauggcagcucacaccuuuaauccuggcacuaaggaagcagagagugguagagcucuuuaagaguucaagacagcugaggcugcauagugagacccugucuuaaaaaacaaaacucaaccaaacaaaagcacuggagauggccaaucaaauggcuaaugacauuggguauaggcucuugucuccaggccugacugaugugagaucacucccuaggacccagggauccuauaggaagggaaagcccaacuacagcccgugugcucuguuccccacacacucacacuuacacaaguaaaaccguagggcaagcaguauaugcuagagggaauuaaguuggaaaaccugcuaauauacuguguuagaaucaauagagaaaauuaauaaacuuuggucaaugaugauauaauaugcuucaguaaccaaguaggcagcauuuuuagaugaauuccugaugcauggagaguauuauuuauaugugaucauuuggaguucacagaauuuuaagagauuuuucuugauacaaggcguuaaaggaaugguuagaaaugauacauauggaaguuauucauauauugucaagaacuacaaauaauuuuauaacccuguguccugaaaauaccuuaguuauuauuggugcugcacugacccucacacccucgcuuuaacaguuucccaguuguagugucuccuucccucuaauguccauugcuuaugucugauacuggaguaguuucuuccauuguauuuuacugucccauguguucauguaguagaaggcugcuuuccaugugguguauacagcuagcucaccgccauauugcuguuccuuccucgggcucuucccuucccguucaucuaccacaugccaguuuccagucuuggcccaagaccauuucauuugccaguauauauucuuuaccuuuauuucaccccauuacuuuucuuugauauauacaugaucaguucccguuucauacuuaucuuuuguguuaguauuugcucgcaguuguugauaaagaaugaaaaguucuacacacuuuauucuuucuucuggauguauuagggcuaaugcuucaugccagaaaauagagaauauugcauuuauauuuaguuaggaaucauugugaaaucucuuuguaguccuuuuuaauaaaauaauaaacuaugucuguuuugaguuaaucauaaaaaaccuuuaguauacgaugauggugaauaacuaauuuaccacuguuauaauuagcagucucaguguuagugacuaugcaauagcguguuacuuuuccuucacauaucuauuuuacacaaagggaaugaacaguaugaauuuuaaauuaguuuuucacacuauaccuguuacccaaguguuaauccauucaaauauuauggaagaaagcauauuuuguguauuuccacauaagaguggaauaugccucaucucugcuuguuguguuuaaguuucuaccuguaaaccuuagucuguuucaauauuucugugguugacagcaaaacaccaaauuaugacagugucuucuauggucaugucuucuauaaagcaggacuaggcuuagacuuuuuuuuuaaaaaccugugguaucugaacaugucaucuguaauuuguauauaauaaauacauaucuuauaaaaaauccugcuauaguuuauaaagaaauucuucagaaugugaggauuuaauuguucuaggccauuuugccugccugccugccugccugccugccugcucucugucugucugucuguuuaucuaucuaucuauugaucuaucuguugucacagggaagucuuauuucuguuuguauaauaacaaugcuaaugucaucuguuaguguguauuaaaguucacuugguuaagcuuucugugaauucugaaaucuaguuagaaaguccucacgugcuugguguguguguguguguguguguguguguauaaacuuugacuuuguguacccauguuugcaguuggugguuuaagaaauagaaucuugauucuucaaucagaauucuauugugauggucauuuauagcauauguauaugaggagauaguauaguugguaugugagcauaauagaguaugaaauugggacauuuccaguagaguagaugggaucccuuugaauugcugugacauugccugcuguaacuguaaacagugccucaugcuacauuguuguaaaucagaaaccuaagaugcaguugccuuuuaccguggcuggaggaguguugcuaaggcaagggccaugguguggaccugggcaggaaggggaaccugaggaugcagacuugucacugguauucagcacugcugaaagaugacagcaccugagccuguuggucaugaaucgcugucaugagagauuugcugugacucauuucuuaucuuaaucucguagcucucuguccccacgaugccauuauaauaauagcuuuccccaaggucauuuacuggagaggcucacagccuuagugugugacuucugugacuuguccaacuggcuugacauuuucccuucuccuucuuccuguaguguuuuagucuuuuuucucuuaagacauuuuuagacacucaauucaguuuauaaaauugguuuagugucuugaaaauauuuuugguucccacuuaacacacuauauuuucacuuugugcuuuguauaaagucuagaguauuguacauguuugauaagcacugaaccauggacauguauaucugugugugugucuguguguguguguguguguguguguguguaaugagcuauaauggaagguauaaauaccauagucuuaaaacccauaagauauuucaaaagauaacuucagugugaaagcuuaauaccauagguauauuaaaauauauuuuaaaaauauucuccaacuauaaagaaaaggaauguuugaccaaguguuauagcuuuaacaaauuauuuacaauggauauauuaagcauggacaguauugaauguuacugaguaugauacaaggcaagugugaccuaaucagaucauuggaaccugccacuccgguuuauguucuaggaaauaauagaguccuacuaugaucuuugaaaccucuuccagaaugacaugcugugacuuggaaagcaguguguguucagugauuguuaaucagcuguucucugaagcauagaaucuacaggggcuauguuuauuuagacuagauugagcacacaugcuugcacacacacacacacacacacacacacacacacacacucacacacacauuacuuuauugguuguuuguucuguguuguagguuuguccuaauggauccggauagcuuucuuuuuaauaaucuagauuuguauuuguuuauauagacaauagcaccuauaguagcucuaguaaaugguuuauguuugcacauaaaaacauauggucauuaaugaguaggaaauaaaaauaugaauacacagaauacagaauucugaaaaauguacaugcaaguucuguuuaguuaaagauacucccuuaauggaaaaauuucauuuuaaaaaguuaauuuucuuuacuaaaucuguuuuuauggaauauacuuaaucauguuauuucuccuccccugacucuuccuagauucugcccaucucccuauccacucaauuucaucucauugauucuuuuuaucuguuauuguuucuguuucaccacuuucagccugaguuugacuuuuccuuguccucuucucuuaggguauuaauuucuuauuguuuuagagcuuucagguguucacugaguuucuaauauaaggccuugucaagcuuuagauguaggcagucagugcugugaacuugccuuuuggaacuaacugccuucacuguaucccuacacuggguuuuuauuuucauuccaucguaaaacguuuuacauuucuuuguucacguuugucuugacccaucuuuuucacucaguagugaguuguugagcuucagugaguuugucugcuuucugugguuucuaacauuaauaucuagguuuaacucaugguaaucagauagacugcaggauaucaauuucaauuuuuuuuuuuuuuuuugauuuguugguugcuuugugcccuaaucuauggccacuuuuggagaaaguuccauaggcugcuaagaagaaagcaauauucuuuaguguuugggugggguguuuuauaaaugucugcuaugucuauuucguuuaugacauuauuuaacuacagcauuaguuuuugucuauuggcccgagugacaauauaugccccucuauuaacaagagugucucuguuuuaggguccacacuaagaggcugaguuccuagguaauggaugucggcuggaaggaggcucgagucccagccaaauguaguggcucuggggucccugguagagagugauucuagauccuagccuuaggucucugguagagagaugcucuguggguuggugguggggggucucagagcaguggagaugggguagaaggaaaggcugaaggggaggggccacagggaagaacuaauggaaccugagccugaggccagaccccuaaagggaugaagugggcugggaggagggacuccuucagacaggcugcacagagggguggagggggaacauuaauggagggcaggaaggacaauacaguuugccuaccugagucccagccuaguguggaggcugugagucuggcagagagcugcucuaugggucggagguguaggaaaaggugaaggggcugcagggaagaacuaggaaggaccuggguccucaccaggaggcacagucccuagggaauggagugcucuggguuccuucuuuccuuccucacccagcucaggagcauuugauagucgauccucaugacuacgugagcucugacacuuugcuuacaauuguguauuauuaaggauguugaaaauaguucuagaagugugucucuuuguuaagaaugaaguuacacauuuuauuuacuuaaacccaugugcacuucuuuuaacaguaacauauuuggugugcggccuguggacuauacagacaaugagaauauaagaucauuauugcugcugccagaggagaaugaaucauucucaacuagccagugcucuaucguaaguguggaguccgcuuugcuacaucuaugucuuuuauugaacuugguuauaaaaggaaaaaguaggaaaacuuccaguuagcagauagcuuuuauucaccauuacuaagcaguucuggaguacugacuacuauggauucaaagacacaaucagaauaagucuagcaagacaucuuauugaauccuuugcacuuuaggcagcauucauacaacaaugcauuugacuaaaacaacucuuauuucaaggaacuugcaugccaguaagagguagagaagaaauggucagagaauauguaaauugauacaugcacucauuucagaaguaaauuuacaagugcuuucaagauggcuuuguaguauguaacugggcgaggugcuaggcuccugaaggacacuguguucgugagggccuuuucaggaacaauuuaaacuaagacagauuaugagagggaggcagccagguggccacauaacacacauuguauagagacccucaagcagaugaaauggcugugcuugaagauuccagaguuuguuacugcugacgauaacugagaguuugagaauggagaccacugaaaaguuucagugcaagagugacagggcugaacuucugugcuacagagugugggagaguggaagaaauaacaggcaagguugugacagauaagacucuaacuaagugaauagcacugaaggucugugagaaguauugugguucaguguguguguuuuuucuuauucuuggguuuucucuggugaguggaaaacaagcagaauuagucucgcuggagucaugguguaguuggugccaguuccuaguacugggaggggagacccuuuguccucugauccacuuguacaucucgugauggaacuguuaacuaguaauuggauaugugagccugugaauuagauaagagguaccagcuagagacaguggaagaaucccauuccuuguuaacccauagccaauuggaagauauaaauguaaaaaagucuauuauaaauuguaauauauaauaagagcuuaugaaaugggcagaggcugugacaugugcaauaggagcaagcucauuucagaagcugucaggaagaacuucacagaagaugacagugucugagggaaagagcugacgaaugcuguuguggaagauaacagacagcuuguaauugucaccacugacuguuacaaaggccaccgugggcacugcugacugcacucaggacccauguuuuuccuuuacuugaugcccuugacuuagugucccugguguuacggauauguccuugugccuauaagguaguugcuauaauuccagaugugacaguggccagcuagaagacagcaaagcauuuuauuggagccuuugcugagaucuuuucuugugcuuuuuguuagaacuggcuacaaauugguuuugagguauccagggauagagaugggacagaucuuguagggcgacuaccuaauaaagucugacugauguuaguguagaagaugaaaagaaugaaaagaaugguuguguggaaaaccagcaaagcccauugcuucagcuucucagaggaauggaggcauagaaaacccuuggaaauuugaagaacuuaauguuuagugugugaagagcauaaagaacguuaaguaguuucagggugggaagcuagauugggaucagccugagagaggccauaacuuuuuaauagggacuuuagauuuaauggggccucaucuguguguuuauaccuggaacaaaacgaucugcaggagagcuagcagucagaugcagcucaggcugaguggagguugcugcagcaaugucuagaauucguaggaucugaaaugauggcugaugguagugagaugagaaugaggaggauggagagaagagacagacacagugagcucacuuuauuuucauguuuauucaaaugauggaaggauguggcacuaugaccaagccuucuuauugucuuaaugguugacaccuagcuaaggaagcuagugacugauaaacacaucuguguacguuggaauaguaggucaugugcaguuguuaagagguaauguccgggaugugauacccccuaacuacuaccagaguccacucagucaccccaggcugcuuuguugggucuugucaggcugagugaagccauggcuggucuucagagcccuucucauccagaaagggcagugcaguggugauugaugccauugcucaguuacagauuucgccugagcugguuauaaucugcuguggucacaggugcuaucagggguagucuccuuuauacccugagaaacguuaccuuuuguuuuagacugcagucugauaaauguguuccaaaugauaguuugggaaaugaaaaggaccuagaagucagcacuuuaauuucuuccuuuuaaaaauggaaaaauugagaccuagaaaggucaugauuugcccaggauuauuaaccagacauugaacauuuuuuuuucuuaauggaccaaucagagcuucgcuuucauaagucuuggcucugcucugccaugccaugcuuuauacuuugguucuuauuuuacugauuuguacuugaacuuccugccagacaugguaugucuaaguuguuaucaugcauuauuuuaaauguguaagaaauacagauacuuuuaugguauucuuggagucuuauggcaaucaccuuuaaaaggauuuuuauuuugaaaucuaagaaacauacacuuucuauaugccaugugagauugaguuuaucauuaugucuuuuuguuguuucgagauaggucuucacuauguagccuaggauagccuagaauuuacaacuuauuugcuccugccucaaucuuauugucuuaaugauugauauuuggcucgggaaccuagugggugauacaggcuauguaaguggagaugguaggucauauauagucauuaagagguaaggucugugauggaugcccauagccaccaucagacaccacucgcucaaccugacugucuugcuaggucuuuagucuaucaaauacauucccuuucacguccuggcuuuaaguuauuuucuuaccaagaauagauuugagaagccaggguuccuauaucuugcuuccuuaacccuucagaccugauuguaucuauuuauacugaaauuagaaucuuauauuuacuagauaaguagucuacccaugaacuacagccccaacuccauaccauugcuuaaaagcagcauucucccagugcugcucacugcccacccuuuguucccuuuacccuacagcugagggaaggacagcacauuccugcuguugugugugugugugucugucugucugccugucugccugucugcauugccuuuuuagaauguaaaccgcaugaaggcagggacuuguucccuguaacaggucuucuccuggagagcaguguggcgaguacugaguucucacuuauaguguguggauuuugugagcaggcuuuuaagccccagagaguggugagugugcugcaugcugguccccacaccauguacacuugcuugacaguggagucuagagugguuauauuuaucuugacaacugugcugaggcacugcaucagggcauguguugauaagucgaugcaguuuaauuccuuuguuucucauucaaagcuguguuucaaguaaaauuugguggcucugcuuugaggcugagaaccaaccucugcuuuuacugaaagcuucuugccaugucacuuagggucuucucugucccuuacagcaacauguuuaucuuuucuagucuuuccugauucuuuagggauuuuuuuuuuauugucuuugcuuauguuuaugugugaguguguaugugacuagauucacccuuacugugcacacguggaggacaggagacggccgcaggagucauucuccugccacuaagauggggaucagacucggguagugaggccuagcugcaagcuccuugucccccugugcccuccuuuuagccgccuuuucagacgcuuuaacuccacuagucugauaaauuuauuaauaauagcaguaauuuuaucuacgaaagguccauauugaauuuuaguacugagcuuacuuauugucaaggaacaaaucccuaaguuucuauaaaguaggaguauuaccucuggauucauuugagcauccugguucugacaccuucuuacuugaaugaaacucucagccccuaugauguguaauuccaagcugacauguguccuuggcaguuguuuacuuuauacuuuauuauagcaguccuuaauuauaagaaauuaguaccagacuuuauacuuuaugcaauuuuuuaaaaaagagacuacaauagaaaaaugcaugacccacucugauacuucccuugcuuggcacaaauaguuuuguaugcuguauuuagaaaugauaauuuucacuuguguguuuuaugugaagagcuaauuuaccuaagguggagucauauaaaaugaguacucucugcagagcuauugugaugguacuuauuuaaaggacaagaacuuuugacaguugacuuuuaauaucauuguaauugaacaauuuugaaaauauucugaacuauuuucauguuagggaauauuuacacuuuaaauuugacuuggcuguauucucugacaagagauuaauaaugcauuuauaugggaauacaauaauauaugcguguauauguccccagucaaaucuuuguuaucugaaccauaaguggguaaauaacuuaccuugcugaacuucagugccaugcauugucacuuaucaugauauuuuugugugcuuacuauauaguagcucucauuuaauucauuuugaaugaauugagucaacuguagaguuaaccaacagcuucacugucuuagcauagggagucugaagaagucaucacuauugugaugugaaguuaauguuuacauaccgagcgucuccucuaguugcugagcugagauggugccuuugcuguuucucucucguguucuacagagccuuugacagcccagccuucagugcacauuugcacucagugcaugcaaaggcccaguggcuuguguuguauguggauguggcaucuuguccuuagcacaggagugcugguguucuguuuccucuuuccuucucuuucacaagcagcuuugucuaacucuaguuguaguuuuguccuuuaggcuuuugggugcuccacucugaauugucgccccuucacaucucacacauucuucaccgcugcugucuauuugucuuuagauguuaagcgucagucucuguaagucagccguuguucuuucucaggagcaacagggaguccuuccuauuugugcaucugcuuucuucacuccucaguucucucgcccaggaucaucacuuugauucaggguuaaaaaauuauuuucuuucuucagaauuagugcugauaaaauuaucuuagcuuaaauagaucaaguuuagguuuuuuuuuuuuuuuuuuuuuuuuuuuuuuagguucaacucuuuggagaagggauaugaaauuggucauucuuaauggcuauuuuagguuacugggaacagaaugaaauuaugaagcccucugugaaucuaguucagcaucaggaaaagcagcuugcuguuuggacaaagcuauuucaacuaacauuggcuuggcaggagaauaaauagaaaauaguuauucaagugcauugaguguuagguugaugggcacugacucacuagaaauuacuggggauuauaacuggaauaagguaauuaauaaaauaggagucuuguuagugagugugugccuucucucuguuacguguuuuuaccauaaugccuauucauuaacaggugaacaccgggcagcgaaagaaugggccgcugguauuuauaggcagugggcuuucuucacagcagcagaaaaugcucagcaaacuugagacaguucuuaaggcuaaaaaguguauggaauuugacaguacaggugaggaaguuuuuuuguuuuguuuuguuuuuauuguuguuuuuuguuucuugguagaaaacaauuuuauguuagucccauuaaagaauaaccugauaauuuauuaauguuuuaauuuaauuuauuaauuuaauuuauuaaugcuuuaagcauuggguuguaguuauguaguuugcauguuauaaaauguaucuauacucuauagguuugauaugcuuaagaaauauaaagcauuuauuuugcuuguuuuuaugguacugggaagaaacccaggcuguuuacaugcuaauaggcaggugcucuacccucaacaggaacuguaagguuaagccuuauauacauuuuaggauagagcacugucagaagaacagauuuucugaguuuguuaauaauaaauuauaguacaguaugauaccaugaaucauuugaaaguagcugaaaauuuugugugugaauacuguuuuaugguuuguuuuucuuuuuuuuuuuaacuuucuuucuuuuucaaaugauugauuuauuuuauguauaugaguacacuguugcugucuucagacccaccagaagagggcaucagaucucauuacagaugguugugagccaccaugggguugcugggaauugaacucaggaccucuggaaaagcagucagugcucuuaaccacugagccaucucuccaggccuuaugauguguuuuaugaucuuauuuuucauguugauggccagguuaaaaaguacugaauagaagaaacauuauacugaauauaaaaguuaucuuugaagugucaguuaauuaaauagaauuaacggauuaucaaaaguagauuauuuucuuucuguuuuccuuauugcuuuguuuguaucuuaguaacucaugucauuguuccugaugaggaagcgcagaguacucugaaguguaugcuugggauucucaguggaugcuggauccugaaguuugauuguaaguacuggaucugggaggauuacuagaccaguuaguauaguccuguccuuggaguuagucaccguuuugaaagauucauguaucauuggugccuuucagauuucuuuuuuuuuuaaagauuuauuuauuuuauauauaugaguacacuguugcugucuucagacacacuagaagagggcaucagauccuauuacagaugguugugagccaccacgugguugcuggaaauugaacucaggaccucuggaagagcagauagguucucuuauccacugagccaucucuccagcccucagauuuuuuuuuaauaaaugugcauaaauaugcuuugauuuuaaaguagcuuuauucaauaauaucaagcauauuaauaaagaauaaauguuguuugauguuaacuuugaagucuaaauaguccauauuaaugcuaaaugguucuuuugacaaaauauacucauguuuuaaaugcauugcucggugcaucugugaagugaaauuaauuuauuguuuuccauuuaagauuucuacaguauuacccauauaauaucuuuuaaucuuguggcugauucagucauuuuaggcaucuguuggggaguugacugauucuaccugaucugcaugguuuccagcagccauugccuaagccuccaucacugucccuguuucucuccucuguuggcggucacccucagagcugcuggcuccuuuacauacuguagcggaugguauucuuacuuaaccuuuugucauuuaggauuaaaaggagaaagcauauuccuaauuaucuuuuuuuuuuuauguuugagauugagcuuuaauuacaacauuucuccccucccuuuccucucucaaacuuuuucauaacuuccuccccauugcuauuauuuccuguuucuuggucccuaauggauggaucuacuuuuugguaugcuagcuaaaguaugauggcagaugcaccgcucuuacucaguacuucuuuggaaaguuaagugauugcagaggacugacagggagucuugcuauuucuuaugucaggaacgacugaagggcagaauuucccaggcccgcuacccaguuguccacauggagcugcuccguacugggguggucuggugcuugugcuagagcuagaugcuaacacuggauggacacuugcagccuccuggaaugguaguuagaccaaaguagaacgauggggauauuguuuuuaagaagugcaucauauauuaaaauucacuaaaaauacuagcuuugugcuuugaaggccuuaugguagagugauuaucaagaacuuaggcuugaaauugauuugaccuggagagauaucagcuauuaaaacuggcuuccacuuccuccuuguaguuaauauucuugaguuugguuuccugugauaagagcuaugcucucguuucugcucauuaucuguaaauagucaguagucuggaaaauaguuuacucuuagucaaaccaguuugagagguauaauugugugaauuggcaauauaugucugguuuugaacuuuauuuuacccuuccugucuguaguaagucuuucugagucucaguauuuaaacaccaaaugccuccaagauuaugcauucuuuuguaccauaccugggccagaacuauugccaauggcuagaacuagucaauuuucauaauagcaagaucuuaucaauaaagaaacccuguggaauuuugagugaucugaugguucuggacuuugagucuauuuuuaagaauuugcugaacuggcauuugauuauauguaccggaaauccaugucuauaaaaccauuuuguaggaaaugugaguuuugucacuuuaauggcuuggccaugucauuuuuauagaaucccugauggacucaggcugaguuaauagugugcuguuuggugauucucacuguagugaauaacauccucuaauacugaagguucuuuuagaauaaacgauggauaggaucucuuauugaaguucauauguucauauuuuuuuuaauauagaccucaaagagaaauaaauucaaagucugagacaaguauuuaaguagucaguaggucacuggguuuauaaaauaagucauaugcucucaaagucuuucugugcuaacaauaccucagucucuuuucugugucaggcaccucaauguuuuuggaaagcauuucagagaaauucagaauugucuagaaaucauauauauuagagaaaaugauggggguuacugcguucagaauuaauuauaaaggugcaugacuuauuaaauguuuguuugauucuaggaauuaguuucuuggcagauagaauuauuaauaaaauaacuacauauaagcuuuaauauuaacuuuuuggugguauuuuccauaaaccaaaugaauugaagaggaauuuuuaucauauguauacguguccuugugugugaaagucagagcuugacaucagacaucuuagccuggcaucauaauuuuugagacaguguccuguaguuucagugagccaggcacucagaggugagcuggccuggcucacuuccaucugcagaucugccuguguaucugucuauuucccacuugguugagcuugguuacucuagacuccugugagcugaaugaggaagagcagggaggauacccuucaguauuguuuacucauuggcugguugauuugaguuacggacucuaaaaggcagccacuaaguaacgucaugaucaguuuaacagucaucuuuucuauuagaguugccuuuuuaagugaacuuuugaaagugcuguagagaguuauaaagauugauggaauuucuguuuugcccaauaaacuuugucaacuaauaaaauguaaguagauacuaaaacauuucuguaaaguagaacugauuagaagaguguguuuccuaaagucucaucagguaggacaugguggcacagcccuguaauucuagcauuuggaaagcugaggcaagacgaacaggaguucagagcuauccuugguuaccaaguggguucccagcaagcuguucuacauagaccuccccccugcccccccaaaaaaaaacaaguuagcaaauaacagaaaagucucccaucaaagauucucuaagaauaaagaaaauuauuuuaucaaauaaccccuauuuuucugauaauuuauuugacgucaguaacacaaguaauacaagugggaaaggugucuguuauaugguagcaggacuugggguaugaccugcauaggagugaaacaguuguacccuuucuccuggcaacugucagugugugacagaaaacauacguggccggggcuaccaaagagggugcuuuucuuucuagaaaugggcuuccuguauaguccagacuggccucaaacccugguuuuccugccugugcauugagaauaaaugcugagauuacagucaagguaccgguauuguaauuaauuuuuaacauuuuucaaaagaauaugugcuuauuguauuaaauccacauccucuaagaaugaauuaaaaccuucacguuucuaauaccaguuaaaauucgauccuucuuuuuggucuuuuccaaagauuaguuggacaguucagggcguugaucuuaaaaagggaaauuaaaaccuguauaugacagaaaacaugcauggugggagccauuuguaaacuguaacaauuuguaauuguuacccaacugauauaauaguuuauauugcagauauagaaaaauacauaaacacuuuuuuaaaaagauaauugacuuaaaaccacugagcaaaaguuuucuaauuaucaugagaaucuuugggcguuagacaauuuguucuuuaaacauaagacaauuuuaauacuauuauucauaguauaugugucaguacugauacccaaguuuuguuuaaaauuuuuuuaugauauacuaauacguuucauaaugggauuuguuugcucuuuugugaugaugacauauguguugguugguuuuugucucuggacaagcuagggccaacacauggcuuggaucgcagcaacagagccugaaugguuuucuuuucuccccugagccuucguucauuucaucauugggccacucuugcucuuucacgccgugagcugccugucaccuggcccuggagaaacuguggugaugcacuuuggaguuucccacuuugucuucguguagaauggcucuuccugucugacugagcaccuauauagaagcguuuucaaggaaagauuccuuugguuuuacagcccgaguguugauuuuuaacugaaccagucaagaacuccguggauguuuauuuauugucuuuccgagugacauaaauuccuacuuaauucuaaugccauaucuauuuagacuguuggcuuugagguggagugacacuuaguauuuuaaguuucuuaaaggaaauuuguuggcuuacugcaauuuuaaauuccauguucucucuuuaggaagagccagaagccccagaaggauaacucuuuguuaaaaucugcaccuguguuguuguagcuuuugaagagaguaaagacacgguguuuguguguuugguuuugcuuucccuguaagacaaaucuucucuaguguggacacucagcagaucauagcuuuagcucucuucauguguuugcauucuuuauuaauauguguaacuguccguucagggcacuucuuuuuacucuacuucauuuguuaauccuuuuuucucagacuugagaaaaaugauucagcucaauauagauuaaugaucaccacugguucaugcaucuauaaugaagauauaucuauaaguuauguuuuuaugaacuagagacaagaaugcaggcuaacaguuuagaauaaaggaacaguuuucuguauaauauaaauuucuuuuuuaaaaauaccaacguagcccuaacaguuauaagcugccugagugugcaaagauccuuggucuugccaugguggccagagcuacccuaaugacuucauauuaaugaauuugagcucaguaauacuugggggauugugcaucuccugcacacagaaaaaucacucagugucaggcucaaagaaaacuggcauaaauaguaggcauggucaggacuucaucugauucacuaaaaaagugucugcacaggugacuuguuccuuugucccugugaagugauaacuccagauaaaaucuuaauagaauauauucagcauaacaaagaugaaauaaaucauacaucauauaagaauaguggcuugacacauucaaagugugcauaguucugguaaacgaggaagucuguuuacauguagaacuaugacguuaauuuucuuugaaaauuacucguggagaaaacaagcaagauugugaucucaauuuuguuuuuucuuguaaaggaaauauauaaggucuuucugccaaacuuuuaguagcaaaucauagccucaucauuuaugaugguuauaaaauaauugguuuagagagagagagguagguagguagguggaucucuugaguuuauugcauauuuuauuuacauuugaaauguuauccccuuucuaggucucccauuagaaacucccuauccguucccccuucccccugccucuaugugggugcuccuccuccaccuacccacucccaccuuccagcccuggcauuccccuacacugggggauauuugguuaaucuaugcuuucauuucauuggugauauuacuaugucauuuaauuucugaaaguucaccuuagaguaucucauguauguucauuacuuacuuagugaaucuguuucguugauuaaucuaaaaaggaaguucauaagcacugaaguuuuaauuauggaaaauaucuauugaauaguguaucuucaaauguguuuucauucuagaacuugggaaaccagauugacagugacaguuuugguagcagaucacauaaacucauugaccauuaaaggcagggauaaauguauuuauuaucuccaucccuucugucuucagaguccuuaguacuuucuacuguuuauugugcuuuugggauaaucucucaaaaaugacuguuuuccucuuuaauccuuaagaaauggaucaugugaucuacuacaagagaagcagcacauaacaauuuuaaauagagauagcugcuguuuguuuagaugauguuuuuaacaugcucaauaacgagacuuaaaaaaaggcuggucaggagucggagaauauuuaaguuuuaaucucauugaguccccaggaaaagcaauuaaauccaugaggauuucuauaauguuuggucugacuagguguuugaguuggaaccuuaggaggagauguuguuuggcuuucaaaacuucccaaaggguuucugugcugugauagcaacuuuauaaaaggacuuuguugccauucaaauaucuucuagacuuaauucaaauucuuagcugguacuggguggcagagacuugagcaguuuccuggaauaagagaauaucagaggaguguuugaucagcucaguaauugcaguuagaccagaccacugaacguuucugcauuuggagucucuugucuggggaggauagcgcagcauaccugugggauagcugcggcaguggaggcguccagugcucagucccugugccuguacagcugcccucuccugccccuguucuucucuuauguacacuaaggcugaucacaaagaacagauugcugaacucaaggcagcugagucucugucugggaaggauggcaaugauaccacugaaacaaaggaacuugggguugccaugagguugcuguguuaaaacccaguagacgccgaauugcaggauaugguccaagaaugcauguugauggaauggcaucauucauuucccaaaauauuaagucaugguggcuagaaaagggaaagauacagauagcaaagaagaaaucuguaaaguguuccaagucucugacaaggauggugauggccaugucaguccagcagaacgguaucaccugacaaacucagacaauuaacaaaugaaauggcuagagauucaagauauugauggggauggacagaggcaacagaacaguuugugcauaugaucauaugaugacaacaaaugaagacuuacuuuuagcuacuuucucccuaauucuugcaggaaaaaggacgauuuccugucuuuauauagcaaaagugaaugucagagaaccugcacauacuaccuugugcucuuguccccuaaggcugugccucacauugguuauuaaaguauaaaugauucgcuuacuucagggucgugugcagaaaugguuugaaggaugaucuugaaacacagcccuaguuguagaugguccucuguauuuccagguguuuuagccccguggugacaauaccacaccauggugacuugccucagcauguuagcuuaguucuaugugcauaguacuaccaaugucagguugucacauauuauuaguaaaucuuuacgagaggaacauguguggacaugaagccacacaguagacuguaucuguggacuuagcacaaccaucaacauugcuugcucuucaggaaaucaguaucuguuuuuuuuccaacuuguaaaugcucaucuuauuuuuuccaauuaaaaauaaaaaacuagcuugucuacuuaucaccuacuacaaagcugaagauuuuaugaaccaaaguacaaccacuacaguagcgugcgucccuucugauaggaaacuaagcuaccuucucaguuguugguguucucggucucccaucucccgucucccagugugguacuuagcagacccugcucugucuaugcucuguucuguuuacuugcagcagcacauuguuagaagcaacagauaccauugugggaguuaaaauaauaagcuauauaaacucauaaacggauaaagcagcccauaggcacaguccacugugucugcuggcuacuccugauacaguaggcauuguuguaguuguucaccuaaagauaguacugcucugcagauagaaugaggaguggaugcguggaugccuaacugauaaaaaaaugaaaauaauagcuuacauauaaaggaauggguuuguugaugauuuuguuauacugguaguuccuuuuagguuccuauuuuauauacaaacaguaugugaccagcauacugagcauuguugcuaggguaguauugaccuaggcacaaauuaugagucucauuuucaauguauaggaaacuucauuuuacacacacacacacacacacacacacacacacacacauaggaaacuucauuuuacacacacacacacacacacacacacacacacacacacacgcgcgcgccuuauuuuguggaaacauaaucucauucuuuagcugaggcuguacucaaacuuacuguggccucaaacucacagcugguccuccugccucagccucccaguguugaaauuccagauuugagcugucauacccgaccaaaguuaauauauuaauauuaacuacauuagguagcauuuuaaccaauaguuauuuaaaauaaugcuauuuaaaauacuucauugcaugccaaacaacaauuuauaaguuuagaacaauaagauucaggacuucagcucagcaaacucaaaugauacaaucuuaaaaacugggcaaaagauuauugaacaucaaaacacgggcaaaccuaacaaauuaauaauuauacaaguaaggaauuaugggaaguuucuuaacuguuguauuuuauuuuuauuuaugugcacauaugaacauguauguucaggugcccacagaagccagaagaggauguuggauccaccagaucugcagcuacaggcagcugugaacugccugaugcggguguggaaucuaaacccucugcaauaagagcaaggucucuaagccucugaagcagcucucuagucccuuagcguugaauugaauacacauuaacaauccuaaaugaagggaaacauuauauugacagcacucagcuuugggagaaaugggguauucaguugcuagcauuuuccuuuuuuauaauaugcaacaucuuggaauacuaaaagcagcuuaaaaucauuugaaauauucacaaucaccccuuuuagaguccaaaguuuagcuugcauaccaaaaacuuauauauuuuuguauguaaaaugcauuggcuuucgaaagcugagcagacuuggguuuagauucccauccugccacagcagcugaauggcuuggaaccagcuaaguccuuugugcuuuauuucuccuccugaaauggaaagagcacacaguaaauccuauuguuugugcaguuuacauuuuugaauuugcucuacaugcuaaaauuuuguaaauccccaagucaguacuuaaaagccuuuguagacaugugggguaccuuagggcuugggugcaaaagcgcauugucccagcugauagccagcgugugaguccugccuucuccauucagcuggacuucggacgcagcagagcgugcagagcuugcuucucacaugugacucuguuguugaggccacacuuaaaguagcccccuagcgguuggaaggggaaccuuacucaggcccaaaguuuaauguagcuccaaugcuaaugaaugcuacugugcaagaacuauggugauuuuuaaacacccagaacaggaagucuucaucaguuuacaaaaauguccaggagcacagcagagcauuuccagucaccguauucaguguuugcagcuucuuucuagaccaggacugcugcagguaaggagugucuaccaaaccacuacuguacacacaauaaaacaugcauaguagccgcagucccuaagauugucagggcuuuccuuggagcaguggcaguaucguugggcauuagaacuagagaaacagcacuccaggauuggcggagcagcuaucagucuaaugaucugaguuuggucccugggccccugugguaggagagaagcagcuccugcgagcgaguugucucugacuucacaugcgugugcauucacgcccacacccacacccacaaaguaaguaagaacgacuaaaacaguuaaaaaugcuaucuaaaaggaaaacagugcagugcauuguacuuggaaguguuuugucuuuuuccccuguaauuucaucagaaaccauuaguacauaguuuauauccguaagaaauacauuccuuuuaaaguucuuugguuaggccccgugcucauuaguauuuuauuauuuaaauagugggaaauuaauguuuucagaguguuagacaauguuuaugcauuuggauuauaacagugcacccugcuccugggaugaauuauuagauuacacaacauccauagauuucauaaaauaauguuagugagauggcuuuucacuaaugaaaacgaaugagagagauguuuugagaaagauuuacagguguuaggaguaaaacaguacgcuucucuucgucaauucaucuguacccaaggaaauaacaauaaacacuucagcuuuuuuauauuuccuuaaugauauucuaguuuucuucucaauauuuaauauuuuauuggaugaaagaauuaaaacucuagcugugcauaauuuccugccauacuacaaauuuugcaucuuacuucucuaccauagcaaaaccacuaauacuucuagaauguaucagcagcaauuuuuuaaaaaugaagguaaauuggucuagaauuguguuuuagaaauaaguaugcauucaaauauuuuuacuaaaaaaguccaauuacuuuugcuuuuaguauaucuaaacuaaaugugaaauguaauggaaauguuuuuucuuaaauuaccucugucaaccagauauaaccuguucuucugaagguuugcaauuagacuggccaagagggaaaggugagugucaagggcauggcugugcuugugucugacugcacccuugaccugagccccaccauugucuuucuaauagaaaugcaaguccuccugggcucuaaaaacugcugaguaggaggagaccugcccucucuccugugagugccucggcuggagcuuauccauccauccauaggacugccauccuucaugccuuggacaugaggaagauuucacaugggccuuugaaguggcuuuauaauggaguguuuauugacagaggaagagagagcuguggcguuagauucacuuuaguugagcacuccguuaaagccuuccaaauuuaaugaaaauugaagauuaguuuuugcaaccaaaacuuaaaaacguguucucuacagagccaugaguaauucauuuuguaaauaguagguguuuacaguacagcugcagaugcccuguggaggaaggcugugagcagugggcaacgccugcuuucuuuacuuaucaaugagcuugccauaccagagcucaaaccauguuuguuuucuguuaaggaugucaggaucuucaguuucugucccuuccuccauguguucagguuaacucauggauguuuuaucaucuuucuaguuugggguaauagaaaagaagccuuaaugaugggugccucgaagucuaggccaugccaaagugggcugucacucacucuuggaaaguacggauugucuuacaugucaccucuguccugucaauacggcuuuccucuucucaugcucacaagauucuguuuguuuuaaucacaacaugggacaguuguggugcugauggcagauugauacuugguucugggccaguucugcucagaagugagccucuuauggcccucugcagaguugcagacugagguguuguccuucaguggcaucuaaucacuggcagugccccuauuagaauguucauauauuucuagcauaucuuucuaauucucaguauauguugguauagauaaaguuuucuucuggauaaacauuauucagugguuuuuuguuugguguuuguuuuuaaauuguucauacuuuuucuguuguuuucucagugguaaaacucacaucuuugagugaaguaaucucuaagguaaauagaaaauggucuggauaguuuguuuuuauagugaaaauaguauauuauaagauccauuuugcaauuuuuuuucaguuuugugauagacccuuuauuuucaaguuuauuuauaaugccuuuacucaaaauauaauuauaucgguuuuccucuuccuuuucuuccuuuagccccucuuaggcacccuccuccaaaccccuucaaugucucccacucucaauugauaaucucauuugcuuuuauauuuguugaauacacagauaaauaucuguaugcacaaggagauauaaauagaaccugccaagucgguuuuuguuguuuguguaugugugguuucaaggcugaucaacccauuaggaagcucaugcccuggagaugcugauucuccucccaguaggcuauaguugccuguaauucuuuguuuagggugagaccucacaacuuuuccucuuccacauucacauguucauuguaguacuauggcuccugcccgcugucuauaagagacaacauacuuccugggauccugggucuuagaguccucuaccccuucugugauuucccugacucauaagaugcagaagcugugauguagauguugccaugggcucaccacaauaucuugaucucuguaucaucaccugcugugaauuuuugugacgguccuguccucauuugcuguaaagagaagccuuguugagcuuaucuguggguguaaggaucauauuuggaauaugguaaggaaucacucuggcugagcagagccgggguagaagauucauuauuaaguucaggcccaugaccucacuagccccagaaagcuggcuagguuuccucuggguacaguuucccuccugaugaaugggccuuaaguccaacugcacagcuguugauugacaucuuuaugcauauguugccaugcuaguaguugucaggcucauauguguuguagcuggguaguuuaauugccuacaucuuuuggcaacuugcauaguauuuucuggaaccaugaaacuuuuuugaaggaaagacacuuucaggucaaauucagcuuggcuauugauauauugcuuugaaagucacuuggacuacccugauauuccucagaaggagucuggugucuagcacuagggguuugguuagucugugguuuuucagguggaguauuaccagcccaacuggcuuaaccuccuuauguaugcacguacaaaaguauauauguacacacacacauguaugcauuuuauauauauauaauuuuagguaaauauaaaauaauauuccuugaggcuuuaucaagcagucuuggcauuauuugucccccaccucuacuccuccaucugcauugaccacucucccuccuccucgugggaacuccucccuguuacugcaauucccacuacauugcacuuauauccuguucucuaccaaggcucccccaccccaucuaaggucuauacauuccugaugucugugguuacgucauguuguguaugcaaucugaggugcugaggcuagaaacuguugacaggagaggaucuguggcauuugucuauggaucuagguuaccucguuuaugcauaaaaacaauggcugguauggugagaugggugguguuccuaauucuuuuuuucuuucauaggcaacaaagcuaaccuuaugaguuuaugaaguuuuacuaaagcaauaagucauuugacuucguaucucaaacuuaguuguaugcauuaaaccuagcaguaucucucucucucucucucucucacacacacacacacacacacaccccaccaccaccaccucuaccuccuccuccuccuccuccuccucuuccuucuccucuuucucucccuucuccuccuccacagguaagauguugcugcuuagguccuauucuccucuguuauuaguauugggcguauuauuucuagaauacagccaggcauugaugggugacugcugaugucccugcuuagggauuuccuauucacuagacagcaauagcucauuccuuuucagcuuaaacuauaaacacucuggugcaguccaucagaaggauucuuucuccagggaauaucaagccaacuccucuacaggagugcugucaguucccaggcagcucgugggcucugcucaguauuuauuuucacagguccugcuaagguccuguugugugguuggcugaggguggugcuguagacaaaagcacucucauuggaucacuggacuuuuuuuuuuauacucucuauagagguuuaacuaaaagucagugaugauucacuaagaccauuuacaggcaacaaauguccacauguucacaggaucacacaacacauaauggcauuauggucaaugcuggacuagaaacauacauuuguagaguaggucaauuuagugacaucauaggaauuuuaauuuaaaguguacucagcgauguuuauaaacaaagaaaucgccuaauuaucuacacuguuucucaaauuauaucuugauaucugagugccacaugacacguguguguguguguguguguguguguguguguguguguauguguguaugcacaugugucuuuguacauaugggcaugugggaucacuggacuuuuaaagaccaaccauacauguaacugccaaaaugagccaacauuuguuaaaugcucaguuuagacuggacugagcauacuaauugcuuaaaaucucacauaggaaggaaggcuuucuuccauuuauuuuaaguauagaaagcuagcuuucucauacuuucuuucuguuuuucuaugugggauguggugugugugugugugugugugugugugugugugugugugugugauaucacuauguguguaggugcagugacuuguguguucaugcauugaugccagaggcugacuuggggucucuuccucugucauccuccacuguauuuguuugagauaguuucucuccuagaagcuaucauuuuggcuagacuagcugaccacugaccucugggggaucugcuugcucuccaaacucuagcacagguacaagcugccacacccacuggggauccaacucaccuuccuaugcuuacaggcauacuguucaccugcugagcugucucuccagcccucccuuuauuauaguuucuuuuaguauaauugggguuggaagauuucagaauauuuaggccagccauaaagaagagacuaauuagacagacuucacauaugcucaugugcuacuuacuugauucuaccuuauuuuuugucaggggugaaagccugucuggacagcaaaguacgugagcaggaagaaaaguaugaaguuccuggagguccacagaggagcaggcucaacagagagcagcugguauuuuccuuuuacauacuugcuuguucuuagggcuucgugucauuaucaucaucgggaaaacuuugcccucucauccaguucaggugacugauuaaaauuuuaauugugcuuauuucaagcacuugauucugaaagaugaucacggugcgcaguaaaauccagaagguaauaauuucauacuguuaauggauuuuuggcaucuugaacauucccauaaagcuuucagaaucugagguaaaucucagauacaggaaguagcuugaaagaagacuuacagcugcugcucggauuuaguuaccauaugucuuuauugccacauacugcagcuuuaauggacaauauuccauuauucuguugauauauguaacuauaguagaaaugacaaagacaguuucuaauuggcucuuucugacacgugacuauuguucuuauguccuucauucauagacaguguuugaaaauauuuugaucuucuuuuaacaguuacuuucuuguuauuucaguugccaaagcuguuugauggaugcuacuucuuuuuggggggaaacuucaagcaucauccaagggaugaccuccuuaagcucauugcugcagcaggaggcaaaguccugagucgcaagcccaagccagacagugaugugacucagaccaucaacacgguugcauaccaugccaagccugagucggaucagcgcuucuguacgcaguacaucgucuacgaagaccuguuuaacugucacccagagaggguucggcagggcaaagucuggauggcuccguccaccuggcuuaucagcuguauaauggccuuugaauugcuuccucuugacagcugaaugucauaccaggugaacauuuuaaguuggacaugcaugguuuguaagaacaacggccauugugauauuucuggucauucauguuuuuaugaauagguagaaccauucauauuucuucccccuuugaauugcaaaauaaaacaauugauaguagauuaggaauucauuuugaugccuaaacugcuuuuaagauauuuuuguuguuguucuuuuuuaagggugggggcuauaacucaagucuuagggucuucaucaccuaugugggaggcacagguuccacacuaggaacuuauuuuacauguggccuguguuuuuuuuuuuuuuuuuuuuuuugauugaucaugucuuucagcuuucucaacaucugucgaagauuaauaagugagauagcaucaaacuacuuguuaaauccacgugguguauuauuaauuuagcauccuuuaguaaacagaauaucaucauaugauuuauucugcccuuuuuauaaugauaauagagcauuuauguaaaugugccaguguaggcaaaaagcucuaucuggaguuauccuuuucuuauguuguauuuuaguuucuuguguuuucuuggcuuuccauuguguuuuuuuuuuuuauuuauuuaaaaauaaucuuguguaugcauuaggaaaucaugauucgaagcacugaauguuagugguaaaaucagcgguaugcucucacuguguacauuugcugucugccuacugugcgcugugcacaccuuuuuucuguaacuuauuuuagcgucacugcuuagaaugucuugccaguuuagaacacugacaaauguuaacucauuagauuauaagcaaucugguuuugguaaaucuuucuggaaauuacuaaaauaaguccuugaagguuuuaaucccuucucucauucccuuucucccuccuucccucccucccucccucccucccucccucccucccucccuuccuuccuuccuuccuuuuccucucuccuuuccucccuuuuauuugugcuacuggguauggaagucaggaucaugugcaugcuaggcaauuaccuacuacauaacuauauccaacuuugagacaaucuugcuaaguuagccaagcuagcccugaucucacccagcuuuaauuuuuuauacagccucuagauugguggguaggcaaaaguuggagauugcuugauuuacuacauuuuuaccauauccgacacaaacccuguagcaggaaaucaggcagugggagugagaagagcuucuucuuguuacagaagcagccccagcagggguguggggggcacuccugagccugcgcacacugcagcuuacucugccuguucuguagguccucauugugaguggacagggucuauacuuguaaauggucuuaaagaagaggauucuuccaugcaucaucccagaagguaaagaguuggcagcauuaugguuugcagaaggaaguccuaagacaaccaucagcucuguuuuuaggagaagagggcagcuugacaagcccuggguggaguugccccagcucagaacaccaggaagcugggaugccagucauuucaagauccacuuacuaggaaaguuugagauucuguugaucauuugaaagugcaccuugcauaaauccuucuuugacauacuauuuuuucaugccaauaggcauguugacgugaacacaauguuuccccaugcuggcuucccaggaucaauaguuaggacagucuaauaagguuuugucuguguuugacacacaguuccuucugcaucuagggguggguagaagggugccauguggauuaagccauuuaggccugggguugggguguagggauaguuuucccuuuacuucacacacacauguugagcuccuuccuguugcguguggcgucucaccccugcccagggucacagccucguugcugugaagccuuugagguuccuguuccuauuuuuuuuuuuauuuuuaauuuauuacguauuuuccucaauuacauuuccaaugcuaucccaaaagucucccauacccuccccccccccccacuucccuccccacccauucccauuuuuuuggcccuggcguuccccuguacuggggcauauaaaguuuacguuuuaaucucuugccucaccuccucucgguuucccuucuuuccuacuaguauuauuuuugaaugcucugaaugcugguuuuuaaaaaaaauugucugaaacagaaauguauuuucagaauaauucacaaaagcgcaggucucacacugaaacuucaacuccuucuuccccuuucuccuccuccucuucucugaaugccagggagaaugcaguugaaggagaugcgcagucacaaugaccaacucuaaagacaaaagcccucagcauuacguauccgguuaugugaacagcuugacugaguaggguuaagauguugcagauguccugcuucuuuaagguggcuuuucagggcugcucagggagguaaggauggagugcaagugggagacaucuuuggcccacucccugagcuuaaggcuaaagucacacaguugugcauccauuuuagggacagcucaucaguguccucauaguggcagugcugccaggcuguuugccuuuguuuucuucagcugcucgcugucucacgcacuacccuucagcuccauuacugcuuucuucccacacugcugcuugcugccgagacuuggcaucaagggcuuccaagugcucuguuugcucuucucuccauuuagggauacuccagucucugaucgcaguagaccugcuucugagauagccgaauaacuguuuguuggcccauuacuuuccugguaguauucgccauuuuccuuccaucagcagcaucagcaguugguuuauguuagcuuuuaacacuugaggcuguacuuucuuuuauagaaauguguguaauuuuuauuuuuuccuaauggauuuaaacuuauaaaucauuaaaacuauuugugcuuguau

SEQ ID NO: 12274 - RNA, 16802 nt, Mus musculus
ccagguuuuucuuuuuuauuuccuuaaguacaaaaugcuaaagaggagccgagcucuuccacaucggggugauuuuuuuucccauuuuuuuuuuuucacaaacugguuuguuguucaauuuuuuuuucaaucuguuucaccaguaaaaagcauaaguauuuuuuuuuaagucaaaaccaacaaaauaagagaggacagagcuacggugucugaacguaacacuauagagagcuacaguaauaugugaugugguuauugcuguuguaaaaaacaaacaaacaaacaaaagaaaacaaaacaaaaaccaaaaacaaccgguaggcgucucggaaucugaaggagucuugucugaacuguacuauccgugugacaggcuacugugugacagugauggugucggagaugggggcugaagccggugacuagggaccagagaagugggggugaauggaugcggggugacgagggaccccuuccccucugacccucuaccuuccuuuuccccauccagagagacuuggagaggaggccagagucugugaaguggugaaagucuauacuccauuaaaaaaccaagaaagucugcucaaggaaaugaaaaccuaacagggaagagaggcgggguaacaagagugcaggaaacauugcacuuuagugguuuaaaaaauaaagacaguacaaccccuaagcuccccgggagaggucgacgagaccucuuucccuucuacuguguuuuaaaucauagccuucuuucucuugaaagccagaggacuacagggucucuucuccuuggcucacuccucucuuaagcuguaaaauuucaccuagaguccucuaggguucugagcagaaggacagcugcccugccugggaugggcaggugguugggagguugccauggcaacccuugguagugggagaaugauggugaggauguuaccauggagauaagucauggucggaagagggucuuggaaggagaagaggagugagcacagcugaccuccuccguauccuguggggcagauguucccaagccuugucuguuuaggccuggccgucagagaaacguagagucuuugucagaggaacguagagucuuuuauucuccagguucccugcuuuguucuggcuggucaagacuggcugggguggagaauagguccugguuaggucucuuuguuaccuggcaguagagggggaagagagcuaucuuuccacugcucgagugaggcauuugucaaaaaggggugggaagaaaccuuccacgggauaguagagguggggacaggccauacuugggccuacugcuguggauaaacccaacagagaggccucuaauggaguuaaaggcuagccugggccaaaagcuucuugcucagggcaugaugggaucguugcaaacuugccuucucucucccuaaccuggagaaggacaucccucuucucuugaugaccccauccauguccauggucucuguauccuggguucagccagaucucccauuuggaagguuuaguuccaucugucuguuaaaggcaagcuuccucuagaagacuugcugucuuagacaugccucuccauaugagcagcggggagacucacaaguuugggggagguaggcugaccuggggaaggcuaacugucuauacaaugaccuccaucuguggcucacagcgaagagcccacauaagggacagaggcucacucaaggucuaguaaguuguggggugaagagagcaccccucacaggaguuagcuccaggcucgggagggggagcgaguaggcaguuccuggcucagucuuuucuuggggggcagugguaccccaguauccacuuggcaaaucucagucagaugacugcucaagaugcggagaaauaauggcagaaaggagagacuuaggucuaggauacuggccuaagauauauugaaguuugaguuggggguuggggauguugugcggggugauggguauacugacccugcaggucugguaaguccuucuauugccaucccaucaggcccuuugucuuaugaagaucaauuuucucuuuccuucccagccaacuguccuguccaggcaacaggaggcaucccuuucugugcccgcagccacccauguccuaugagucgacgcacgucaguuucuuugcucucccuuuguguugcuccauguuccggguuggagggggccucuacuaugccaugccaucaagagagcgcaaagagcugugucccccgccaaaaggggccuccuguaccaauguccgagucuccucuccuggaagguuaucuucagucuucaaagacaguccugagccuuuuguuaagcaccucuuuguugaagaagccagugggcaaugagaugcuucucuuggaucaaaaucaggcuggcaaaugacaacagucgugaagauccgggccugaguuguccugggcuuucuaccauccuccaucacagggaaggauguuugagucgggcagaggagacucaugaagcacuugaaggauucuuuggccucaguuccuccuugggggccugaaguugaacugaaguugugcugucuuuccaaggcauccucuucacccuucaauacccagucaggcuaaccagccuuguuuccaaccgugugucucaagucuggauccugccucaguuacccaccaucugggcccugugacuugaacugaccucauuucuaccucaaguucuuccccugccuucuuuuuccucucaaaucucagagaguugauuagaugggagacaccaaggaaaauucuauugguauuuuccucucucugucucuuucuuguccuccccacccccagaccucugcuccaucuucuaugucucucuguggaagucucugcccccacccuccacuuccuccuccucugucaucucucauguuaguuucucucugaucugucagccuggcaucugagggaggcuuucaaaaugcaguucaaaaaaaaaaaugcagaugggaaaaaaaggucugggcaggccaguggguuacagauggaucuggcagguuuaugugguguggugugagacaguuacuuucugcggguuggaaggcugaaauggggugaccugggcuaugcacuugaugcacccuugggugcuggcaguuaccuggcuugguggauucacuucaacacacguuuggaaucaugagaagauccaaaucggugccccacaaaagagccacacuuguagcucacgagaaaggcugccuggacgcaggccaagcuggcguucuggguuguauuugugaaauauggauuuuucccagaaugaggaagaucuucaguguccuaaaaaaaacuacuuuaaagagguaaugcaaaacuucgaaagaaagggaaagggaaaaaaagguaaagaaaauagauuuauaugccuauaaagucuacauggagucuugugggugaguacaagccccuugguuuucuccaccucucauccuccuccacagaggcugccgggccagcuuugagucuagugaaaucaagggccgaagccacgcgcuucugaauugcuugucacccuggagaaucaagucuuuccaguguugggggugcguacugacuucuuaaaaaaaucuuuaacaagaguaaaauuugcacacauucugaguucacuugucugcugggggaaaaccuaucuucaaucacucacuuuuguuuauuuucagagggauggaaugcauuuuagucuuuguaaauuuggggaugaaaucacccugcacuuggguaagaggagaggagggugaggggucuagccauccacacugcuggcugcaggaggggacagacccgagaggcacugacacaccuuguuucuuuucuccccuugaccaaucuaaacugggugucacugaaugccacacuuuuucugaccccaggcuagagcugaaagcaaaagggcagauucagccuugguuguggaguccuuucugccuugcuguuucucucuucucucucuaauccuaucuguccuucccucuuuuccucuauuccaacgcuuugcuuucuuuccaucucucgcucccucuugcuucuucucuccuucccuucucuguccguucaacuugcuucaaaaaggaauacauuuccggggucaugguggggagugucuccuuagcccuugcuagagauuccgagguccucaguuuccucaaauauauauguauauauauuuccccuaaaugagaugaaaugagugacguccugggguggagggaggcgcuggcuggaguuggggcuggggggguaggauagggggaggaagggaggggacgcgucacucaacguuacugcugucgaaggcguggcacugaaaguccccauccacguacuccaugcccggcagcuucauuccguacuuguccacacaccagcagaugccacguuugcggccacgggagggcuuacacugggagagagacaagcggcugugagauacccgagcggcgguguaccccgaggcucucuucuggcucugaccuuucccgaugcacuugaggguuaaacggauuccgccuuuagcuaacucuugggguuuugcugauucuaucucaugggaggacccaaagaaaauaguuaguucaggcauccugcccugggauagguccugccaucucccuuucauuauuuacuuuggguuacccaucucacguucuccagggauccucaagagaggaccucggucaucaaaguaugaaacacuacucuggcuccaucacaggccaggcgaaguuuaacacgggucauuguggcaggagccgaucucagugcuuugucaagauaaaggcuuauuucuccccaucagaguaaaguagauugcuagucccaauuuuacaugagaaacuaaagacccaggggcuuuaaauagcugggccaaggguuacacagcuagaaauggcggggucaagauacacgccaaggggcccuagcuuguaacuguuaacuuagauuagggaucccaauuagaaaugcaaagcacuuggagucgucuggaacugccaaucggaaaccucagaggugaagcccggcacaggggcauguaccugcuuucucuuguagaauccuuugcggucacaguugggcagguacacagcacggggcaccaugcgugggcuggcuuugaacuccuggagggaagcuuccaugugucugcggcaggggcccugugaacacaggaggaacccagguggaaaccacucagcggugcccucugauggcucauguguggcauccaaagggacccgggagaaaaaucuaccaccuuuaucugaagcuacuuaggaucuuucuucuccuucaucugucugcugccuugguuguauaguaagccggcacguggguaggcagcaagcccugggucacuugcucucagcuuuccuacccuuccaagcacugaagauauacagcuuacauucucuaaaugugcuaggauaguguucagccucuuccugggacuggccauagcucuaggggucacauuccuggugcaugcuugcaguuacaauaggacauucuuugaaggagaacuaccucuguuuccacuaacuuggaucagcccucaguccagauaaauaaauucaaggucucaaaagcauccuuccaaauucccagcugagccacugugagcaauaggucuguugguaggucuagccugugcauccucuaugaccacagaugcuaaaguaagacacaugggaaaucagauugggaugguggccaggguauggggaagagaagccccugagacucacuuguucggauuccugucucaucucaggugcagggaugacucuggggugggcaguguucucugcaccccccacaaacuuggacugggucagcuucuuucugcgguccuucuucacagccucagccuucagcucggaaaugcgagugugcuugggccggaagaccuugggggaguaggucucuucagccaucucggaggugguggguuccucguguucccgagagucucucucuguggggagaaggaggcggagaaucagcuucuggggccagagagcagugucuagagaccagaacugggaggacucgggucagaggagucauggagacucagagagauccaaugaugaggucuaagaaagcaagagggggcggggaaaagacaucauggugggggguguauucuugacuacaccucacuaguacacaugggcaggcuagagaaggagacaggacaaggcucaaagcaggugaagguuauguaaaucaguuugcucaggagagaugaaguggcuggagacagaagguuaagcagucagggcuuggagagcugggccaagggaagaaagcagggcacaguccagacauaggcaagaacagccaaguguguccguccgcuuaaagaggucuuuguacuuucagaacagcugggcugaggggugacagauguuuggaccuggguguccagggacaggagcaguagagggggcagggggacuguggugagggcugggagaugggagaggcagaaaugugggccccggagaggaacaaauggaagcagauggaagacagaggccucauccucuuacaguggcucccaacuggccuugugcugugcucuggacccuuggaggcugggcauuccucagcccugucugagaggggcugacagcuggcuggggccagaccaguuauccauaggagcaacuuggugacuauacuuggugacagucuauacuuaacugacuuaggaccuuuagaaaaaagaaguaggacuuuguucaugugucucuuacucucucaacgccaccugccuagcccaucucagcacauauuuccaguaaggucuuuucucauaggugcccccggucuccucucagcccccgaccuugcaaccuucaugaguggggagaccuuagauggcugucuccaugcuucagaugacccacaagaccaaacgcagggucagaaagggguggaggacugggcuccaucaccuuuccuaauuaaauguucaaaaaggagagggagggcuuugugauaucucaaauuaauuaagcagggugaaggaaaacccaccgguccucagauaccucagauaugaugguagcugcauaucucagaugugaaagauaagggagagaauccaacaaagucgaggcgagggaaagagaagaagacuuuguggaaugucuccaagcucccagcccaaaugaagaucuggugugagugcggggaggcauguggagauuaggccucaccugguuagaagaacaaacggcaccacacacccagcaucugcuccucuagggcgugucaagcuuaaugaacuagauguuggcuccuacuaggaggaagccucuagggguuuucauuaauccugauugguaaugggcuugggcgaguagucacaagaaaggaaggggaggggugggaguaccugucaguguuggggcgggcucucccugagucaaacucucuguggggauaucagcccucccccugcacccccuccccccccccccagugccugacucuacgguaucagaaccugccgggaugccaaaucccaggcugccuguccaaagaggaaucucucuagggguuaauagaccguauuuggggugaacccaguuuuuuggguuguggacuuggaggacaggaugcaggaggaggcaugucuaguuuggggguucugugcagauagaagaguagagucugauguuuuuccuuaaggaacuuuugcaaacucugggacucacuaagcaaagucuaggcuccugggagugucuccucuccccuaauuuucagucgucuugcuugugaagaacaggcuuaaaauuuucauuugccucccaguucuugguguugcuuccugaaggacacaccaggaccuaggcuuuuagaaacaagcagggcuauaccucuagguggccaguagguggcgcaggagaccaaaggcgcucaauuugugcacauuuccagggaagaugaagguuaaaagcuggcacuuggcugucucccccuccuacuaguuugggaaucccaucaauccuuucccccucuuugugugcuugcagcaugcauuaagaaggugcgggggggggggaggacgacaaaggagcacugugcaggaguggaggacugcgcgagcaagucuuaguuguguguggcagaguguugcuucuuuauagugacuagaaagagaagagaaacacaucccaacacccuccucccucuagaugcugcugggaagguuucugcagaggaugagaaacguggggugcuuuuugguuaagguuuuucauugcagcaauaaagacccuaagacagggguguuauauucugguauuuccucugauguauguugugcuacggcuccagcuuuguaaugugccuacucugucacaggaauguugaucuauucaucccccccuucccaugacuuaggaccauggguacaucagcgucucccugggaacaggcacagcuuuauggcugcugagacaccccaggaagggcagcauugcacacagcacuacagcaccaugcacacaccuuacccaagcucaaccucucuaagcacacagucuggcugccgaugcuuuccuguagacgucuggcucuuuaccaacauaugaagacguguucuuaggaugccuucccauccaaccuugcuuccuaguccuucuaauagaugaauccaaugggaccuguugcuacuggaacuauuacuuuccacccugggcuucuugucauucuggcaccaugaauaauagccugauccugggcugcuauuggaugcuggcuugaccuguccucacaaacagaagucugggggagacuuaucugugaugauuucucuuccaucagaaaaccagcuaagcuuggaguucauggcccaauaggccacuuacaaucugcaaagagaaguucagccgagaaguaguucugugauauaaauggggcaacuuauagcuuaacggaugcuggggugggggguggggugggggaggccaucugagucaugccccugccucagagcaugauuacuuugccacaggaaggugaagagacaagcaguccaugaagaaggugccccuggugugugagguuucuguuuggcugaggcugugccauccagaagccaauguggcauuuaaaugaacaaauacauaauaauaauaauaauaauaauaauaauaauaauaauaauaauaaugauaauacacccagagguccucauuuccaguucuccccagccacacguuggcugcuacugggcuggacaguacagauauagaacacuuucaucaucacuguaaguuccacuagauagcacuggcccaagacauccaucaggacaaaaauagucagcuagaugcucugcccauuccguguccugucuuguuucccagccaacaggcagccuccugcucuuugcugcagugcuaggcuugggggagaaucagaaucuggcugcucauugucccccccuccccaauccacccaaauguaagcuguguuucagacuccccaagucucacugcuuuccagcugcagaugggugcuauuuagcucagcugcccugugugggugcauuugcauauagagagaaagaggaggggcucuggguagaggcuguggaguguccccuggccuuccuacuggcucacagcagcaucugccuggccccaggcucacuccugaagaucccauuuucuuuuucacuguggucagcaauagagggaguguccagggguucuagcaaccaggaugaugagcugacuuuucaagagaaaacaaacaucgacagcuguauccuuagguggggggagggccagagggcucucuuaauuucauaaaguuuaaauauaaauuuugaaacaagagaauuugcucacugggaauguuuuaaguauguuuggcagagcauaccauaaacuuuaugacauauacauauaugucauaugcauauguauauacguauacagugucuaauugagauuuuucucugaagguagaaaaaugccauggauuuaaaagacagcaagugaaagaaaguugaugauuucauugucauucuuuggguacauguggagaugauaauauuuucugguacgcucuguuaaaauacaccaguaaaauacauuuccucugcuucuucuuaaccuugaaaauuuuuggcugcuagaaaaaaaaguaugaaaauuguggucccuggaaaaugaaacguuauguaugugguuuguauuauauuuugguuggaugugcuagucuaaagacuccugaaggagacacgccuuuagaggggacagagagauguuccccauggaagcccugauggacagagcuuagagagcaaauaacuagauccuauauaaauucacagauugguagagguaucauaugaggcccuguucugaguacaguuucauugaaggccuuuagacuuggcagggaaaggccguugaucugacaguuuagguugaaggcuaaaguguaagauaaacuauuugguugagccuaaaggcucagcugguagacccuacugggaagauaggcuugcguuaucugcuuccuuccccaacaaccccaaaggaaagagcuuccucagccucuggggcaaguuagcaugagucuuggcauagccucugaguaacccgaaccccuaaaaccucucagccaaaggcaggccugcugaaaacccgaggcauaccccaguauguucacaaggcguuccugaggcuuccucuaucagcuuuccugauggauggucuccccuucuuucugauguagaaaccccguaguuacuucugucaguccacucuaccucaggucucauuaugcaguuugccagccccaggggagaccuaugccauuagagacaggcuaccacaggcaguagaccacggacugaaguacuauguucuccagagaggcaggaagcauggacaaccacagggcugcaaagaccugccugccacauuaggagaacuccuuguguucaggaaaugagguuuggcccauagacacggaggcugugcugaaugccgucccuucaaacccuccuugcucacuuucucuggccaaaccacuggccugagccagcugucugggagacuguguagaaaaggggacggaagaagccauuccuccaagaggguauuggaguucccacuuuuaggucacuuugauacuucucuggcccacagaauagagcaccccuaaguggagggguuuccucuuugcuuucagaacaccuaccacuggaagguagcauuuggcaauguuggccaagguugcaagguuagaccaggccuaggcaagagcccuagugacuagugaaggagccagaaauagcagaaauagcagggcagagugccucagccccuagggagaagccaaguucaaguccugacaaccacagaucuugucuugggcaaguggcuuacuguuuuaggucucaaugucuuuaucuguaaaguggggcccuugaccaugaggguagcccuggguuuacuuccagcuuuaagguucuuuggacacuauccagacaauuccuggagaguugcuaggacacagcuaagacauguggccaggcagaaaaggccacuucuccauacaaacaaaugucuaguuacucaucuggauuuauguuuuauaagaaaugggaagcagacauaugcaucacaguccucgguuauuugccuguuucugcagacaugugacuaaucuuauugccuugaauagucuacccaguuagaaauguaaugguagccuuugagaauugcuaguuuucaccuaauuggcaaaagugcaaacuuacaauggaacaaaaccccucccacuugcuagcuguggcuccugguaaccauccccucgcuucuuggcuccuaaggggugccccuuguucauacuugauuauauacagaguuccuccaccuucugaacguuguggcucuggaggguauaaucccuucuuucaauuuucauuuuucuccacauuaaauacuucaagguuucauaggcaugggcugcuugggugcaaaguaaaacuuuuuuuuuuuuuuuuuuuuuuuuugguaaaucuuuccgucccucuugcuccuccucccugaauuaagaaagcgggacccggucagcagggaaucuugcuuccguguccuccguucuaaccagcuccgugaccucuggcugggggaucagcuuggcccugcccgugcagcugcagguggcugcuugcuuaaagcgagagggcaaaggcggaacugcucagauuuaaaacuccgcccucaguuggggcguggacaugagggagggguuaggggagcggaggagaggcuaccgaaguccgugggggcgugggggaaagggacuuggaaagaaaagcagcuucauugggccagcugugcugucuccucuaagccuugcugacacagcagaaagaugggggcaaaggcaagaaacguuaaagccaucccucucgcccaacucccguuuugguuggcuucggcauagcccucacucacagacuugcuucagaggagggcgugcggcgggaaagucaucuggcuccuucaauuuuucauaaccuuguucaauccagacaugaauuuggccaaaaagucuuagucuggguuaacuucagcguggcauuuggacuaggcuuggagcugaagccaggucgauggagaccaaagccgcccaagaagcaaaggccgaauucauuuucauuuacauaauguaccccuccccuugguuucccagaagcacauuuuuuuuuuauguugcucuuugccuuauuucucaaugacaggauugacauucacagcccucugcucuccacaucucagauuuugcguuucugcuagcucaggagacacuccccagauucuccgguauguuaggcucccaccgcugaaagcacauuuucuagagaaugcccucaacacauuuuaggccuuccuugauccaucgaggcucaucuuucuugguccuagaaaccccugugucccuaguccccuuagccucacacacacugccuucuguaucuaucgcuggccccugaacuggccaaaagaaaaugcagggccaggcgcgcuccaagcccuggacaucuaggcgacucccucuccaguugccaagcaacgcaaccagcaaaaccccaggcuccgccugccugcguacaccucccucucccgaagcuuuggcugccagccaccucuccuucgcuccucacuucucaaucuagaaacucacuguacugggggguggggguguuacauaauauaauaauaugaauauauaauauauauuuuugguugcauaccaaauauaaauacaacauauguauauuauagcuuccaacugcgggagaagaggauuguccaagcucacacuacucagauuucaguggugggggagggggccuagggagcaagaauuucuccuaaaggacccagaagacaaucuccucucuucauuauccauuuuccuuucuuuaagaaugacgucaucuuuagcuuuuuuuuggggggggggugggcauccaaauaauggcucgaaggaucuucuccgagagccggcucccauucgggaggaagguauuaaccuuugccacuguggucggcagccagggugcaauuguaggcuguuaggcaccugccugacgcgggcugggguuggagugagggcgaggagaggguguugcuucugguugcuucggcugcagagaauucuaaagcgaucuggcgcgggacaaaaauaugguucguacgugugugcauguaugcgugcacgcgcgcgugugcacuggguccacuugggaaguaggaugcugccucuuugcugguccagcaucugcgugagugagugcgcacagagcucacuccuuuuauuccuagcuacucccuaucuaccgcuuggcugggcaaauaaaaguggggcgaggauacugcggagucauaacuugcgcaauucggcugugaugggauugcuagccaaccuuuuugucuccaagccaggugauggauuccuacggcuucagcaggcaaaaauguaauagaaauaaccuaaaaaaucggucucugggggcuuccgcgguuuguaugcccccaacccccucauuaugcaacuucucacgauagcucaaacuugcaauuuccggggagagaggcugagcucacgcaagcucugcuaucuacugaugggcacucacguacccuccuacgugguggaauccauaggucuuuagcuugcguucagaaaaauuacaaaccuccucacguuggaguaauggaggacgacagguggugagaagggcuuuaucuuuguaaggaaccgcaccaaauaaacauuuagcuaagucuuaacaucucuccuagcucagauuuugugcauuguugguuaagcuuaaauauuuauaauauauaaauauaaaaauaauuugauaaaaauauauaaucagguaacucccccaagaaaccuagcucgaggcaaaacuguuuugauugaacaagaagcucugucaaucauuuaaaccacagacuccaggcacggagaauuuggaggcggggcaagagggggcggggcaaacggagggguggcucccagagcguggucuuccugucuccgccccuugaguuuugcauucuguguuuccagggccccucacgcacuuagccacacucacuuuuagucugguuuaagugauggguggaggguggggcugcuggggguggggguggagugaggagagagggaagggagauggagagggccagcauccagugggaacuugaggaugucuucacccccacaucccucuucaccucucaaaccuguguccaucuuuuuaucuuaacuaaaaucugaauuuaggaggggaaaaaaaaccauuagauucagggacgaacauucagcacagaacaccaaacucuuucagcucauaccccacgcccuaccccagcccucccgaaguauucuuucucuuccugggaggaaaaaagagagacguuuuacagucuaauauguuucaucgaucauaaucaaucauaucaauucaaaagcagcaaguguacgugugggugagcucucaauaccuccacccaaaagacauuaguugucaagugggggggggggauguacgcgcguacgcgcgcgcgcgcgcuccugagcaaauaggaauagagugagagauaaauuuagaggcacugagaugggggcggaggggugaggcuuggagggaucaagguagaauuagcuuuaaagauggaacgcaucuucagauuccaauuaaaaugaccuuuuaacagaaaggauuuucuaaaguuuagggagaaaaguacgggguugggguggagaagggaguugauaauuuaaccuguucuuuuucagagaggauucucuugggauuuggacuuugagacucaaaaggagcucagagucagaauugccacgaguuaggagugggggagggucggguugggguggagaugaaguguaaacugguagagacgguuagacagccgccuaggauagcuugcucugccagggauucaagugugaggugcaaggacccaccccaucuacucucaggagcuacuagggucuaagccacuugcugcgcgcgcaaagcgcgcggguucccaaucgguccccgguccccacccauccaaggugccucccuccccagcuccugugccgugcaacugaaaccccaguagcgcucaccuaucuugguuugcucgccguagcucuuuucguugaggcaaaccccgcggccgugcagcagggcgugcagcggcuucuccucauccugccgggggaggcagcgcaaacccugggcgcagcgcuccguguagacgccacacgacugucccuccgccagggcgcaagucaugcagcagccacagccgggcucuuugaccagcucacagcccagagggcuggggggacacauggacagagcuuucucgucgcaggguucacagugcacgaaagaacccaggccuugagccgguacggcauaggcggccagcagcaggaggaccacgcugaucaccauuuucucggagucuggcuuuaccucggggcggggcaggagagcgagaguguguggagaaagagggagccuggagauuuuuuuccuuuuaaaucucuugcagguagagcaggugcucucccccaaacacuugcaaaauaugaggcaaggaggauucagaugccugcacgcaagucccaauugcgaggauuaaagacuugcaacagguugggggugaaaaaaagaggcgcgccaggugcacgcagagcgagcggagaccguagaaacccccaggcgggaucgggucagaauuggggguggugguggagagaaccacagaauugcucacuccaaagcaacagaaauaauuagcuuggaggccuugaaaagggaggaggugaagaaaaaaauggauugggcuuaauuuuccccccuuugcuuaaaaucuaaaacgcaaccccacuccgcucggucucagcggccagcugcgcugcugccgcagaacagguaagaggcgucggcggcugacaacaagaucgggaaaauguugaaaucgaggggggaaaaagggcaaaaacccagaccucaccaaaccuggaccccaacaccugcucugucaccaccucuucgaaacccgcagguucugcgugaaguccggagaagggugcagaccgaggggggggguaacaaaaaggaacaaaaagggggaaaaaagcccaaacagcuuugcagcucuuuccuagcucuuuu

SEQ ID NO: 12275 - RNA, 16802 nt, Mus musculus
aaaagagcuaggaaagagcugcaaagcuguuugggcuuuuuucccccuuuuuguuccuuuuuguuacccccccccucggucugcacccuucuccggacuucacgcagaaccugcggguuucgaagagguggugacagagcagguguugggguccagguuuggugaggucuggguuuuugcccuuuuuccccccucgauuucaacauuuucccgaucuuguugucagccgccgacgccucuuaccuguucugcggcagcagcgcagcuggccgcugagaccgagcggagugggguugcguuuuagauuuuaagcaaaggggggaaaauuaagcccaauccauuuuuuucuucaccuccucccuuuucaaggccuccaagcuaauuauuucuguugcuuuggagugagcaauucugugguucucuccaccaccacccccaauucugacccgaucccgccuggggguuucuacggucuccgcucgcucugcgugcaccuggcgcgccucuuuuuuucacccccaaccuguugcaagucuuuaauccucgcaauugggacuugcgugcaggcaucugaauccuccuugccucauauuuugcaaguguuugggggagagcaccugcucuaccugcaagagauuuaaaaggaaaaaaaucuccaggcucccucuuucuccacacacucucgcucuccugccccgccccgagguaaagccagacuccgagaaaauggugaucagcgugguccuccugcugcuggccgccuaugccguaccggcucaaggccuggguucuuucgugcacugugaacccugcgacgagaaagcucuguccauguguccccccagcccucugggcugugagcuggucaaagagcccggcuguggcugcugcaugacuugcgcccuggcggagggacagucguguggcgucuacacggagcgcugcgcccaggguuugcgcugccucccccggcaggaugaggagaagccgcugcacgcccugcugcacggccgcgggguuugccucaacgaaaagagcuacggcgagcaaaccaagauaggugagcgcuacugggguuucaguugcacggcacaggagcuggggagggaggcaccuuggauggguggggaccggggaccgauugggaacccgcgcgcuuugcgcgcgcagcaaguggcuuagacccuaguagcuccugagaguagaugggguggguccuugcaccucacacuugaaucccuggcagagcaagcuauccuaggcggcugucuaaccgucucuaccaguuuacacuucaucuccaccccaacccgacccucccccacuccuaacucguggcaauucugacucugagcuccuuuugagucucaaaguccaaaucccaagagaauccucucugaaaaagaacagguuaaauuaucaacucccuucuccaccccaaccccguacuuuucucccuaaacuuuagaaaauccuuucuguuaaaaggucauuuuaauuggaaucugaagaugcguuccaucuuuaaagcuaauucuaccuugaucccuccaagccucaccccuccgcccccaucucagugccucuaaauuuaucucucacucuauuccuauuugcucaggagcgcgcgcgcgcgcguacgcgcguacaucccccccccccacuugacaacuaaugucuuuuggguggagguauugagagcucacccacacguacacuugcugcuuuugaauugauaugauugauuaugaucgaugaaacauauuagacuguaaaacgucucucuuuuuuccucccaggaagagaaagaauacuucgggagggcugggguagggcgugggguaugagcugaaagaguuugguguucugugcugaauguucgucccugaaucuaaugguuuuuuuuccccuccuaaauucagauuuuaguuaagauaaaaagauggacacagguuugagaggugaagagggaugugggggugaagacauccucaaguucccacuggaugcuggcccucuccaucucccuucccucucuccucacuccacccccacccccagcagccccacccuccacccaucacuuaaaccagacuaaaagugaguguggcuaagugcgugaggggcccuggaaacacagaaugcaaaacucaaggggcggagacaggaagaccacgcucugggagccaccccuccguuugccccgcccccucuugccccgccuccaaauucuccgugccuggagucugugguuuaaaugauugacagagcuucuuguucaaucaaaacaguuuugccucgagcuagguuucuugggggaguuaccugauuauauauuuuuaucaaauuauuuuuauauuuauauauuauaaauauuuaagcuuaaccaacaaugcacaaaaucugagcuaggagagauguuaagacuuagcuaaauguuuauuuggugcgguuccuuacaaagauaaagcccuucucaccaccugucguccuccauuacuccaacgugaggagguuuguaauuuuucugaacgcaagcuaaagaccuauggauuccaccacguaggaggguacgugagugcccaucaguagauagcagagcuugcgugagcucagccucucuccccggaaauugcaaguuugagcuaucgugagaaguugcauaaugaggggguugggggcauacaaaccgcggaagcccccagagaccgauuuuuuagguuauuucuauuacauuuuugccugcugaagccguaggaauccaucaccuggcuuggagacaaaaagguuggcuagcaaucccaucacagccgaauugcgcaaguuaugacuccgcaguauccucgccccacuuuuauuugcccagccaagcgguagauagggaguagcuaggaauaaaaggagugagcucugugcgcacucacucacgcagaugcuggaccagcaaagaggcagcauccuacuucccaaguggacccagugcacacgcgcgcgugcacgcauacaugcacacacguacgaaccauauuuuugucccgcgccagaucgcuuuagaauucucugcagccgaagcaaccagaagcaacacccucuccucgcccucacuccaaccccagcccgcgucaggcaggugccuaacagccuacaauugcacccuggcugccgaccacaguggcaaagguuaauaccuuccucccgaaugggagccggcucucggagaagauccuucgagccauuauuuggaugcccaccccccccccaaaaaaaagcuaaagaugacgucauucuuaaagaaaggaaaauggauaaugaagagaggagauugucuucuggguccuuuaggagaaauucuugcucccuaggcccccucccccaccacugaaaucugaguagugugagcuuggacaauccucuucucccgcaguuggaagcuauaauauacauauguuguauuuauauuugguaugcaaccaaaaauauauauuauauauucauauuauuauauuauguaacacccccaccccccaguacagugaguuucuagauugagaagugaggagcgaaggagagguggcuggcagccaaagcuucgggagagggagguguacgcaggcaggcggagccugggguuuugcugguugcguugcuuggcaacuggagagggagucgccuagauguccagggcuuggagcgcgccuggcccugcauuuucuuuuggccaguucaggggccagcgauagauacagaaggcagugugugugaggcuaaggggacuagggacacagggguuucuaggaccaagaaagaugagccucgauggaucaaggaaggccuaaaauguguugagggcauucucuagaaaaugugcuuucagcggugggagccuaacauaccggagaaucuggggagugucuccugagcuagcagaaacgcaaaaucugagauguggagagcagagggcugugaaugucaauccugucauugagaaauaaggcaaagagcaacauaaaaaaaaaaugugcuucugggaaaccaaggggagggguacauuauguaaaugaaaaugaauucggccuuugcuucuugggcggcuuuggucuccaucgaccuggcuucagcuccaagccuaguccaaaugccacgcugaaguuaacccagacuaagacuuuuuggccaaauucaugucuggauugaacaagguuaugaaaaauugaaggagccagaugacuuucccgccgcacgcccuccucugaagcaagucugugagugagggcuaugccgaagccaaccaaaacgggaguugggcgagagggauggcuuuaacguuucuugccuuugcccccaucuuucugcugugucagcaaggcuuagaggagacagcacagcuggcccaaugaagcugcuuuucuuuccaagucccuuucccccacgcccccacggacuucgguagccucuccuccgcuccccuaaccccucccucauguccacgccccaacugagggcggaguuuuaaaucugagcaguuccgccuuugcccucucgcuuuaagcaagcagccaccugcagcugcacgggcagggccaagcugaucccccagccagaggucacggagcugguuagaacggaggacacggaagcaagauucccugcugaccgggucccgcuuucuuaauucagggaggaggagcaagagggacggaaagauuuaccaaaaaaaaaaaaaaaaaaaaaaaaaguuuuacuuugcacccaagcagcccaugccuaugaaaccuugaaguauuuaauguggagaaaaaugaaaauugaaagaagggauuauacccuccagagccacaacguucagaagguggaggaacucuguauauaaucaaguaugaacaaggggcaccccuuaggagccaagaagcgaggggaugguuaccaggagccacagcuagcaagugggagggguuuuguuccauuguaaguuugcacuuuugccaauuaggugaaaacuagcaauucucaaaggcuaccauuacauuucuaacuggguagacuauucaaggcaauaagauuagucacaugucugcagaaacaggcaaauaaccgaggacugugaugcauaugucugcuucccauuucuuauaaaacauaaauccagaugaguaacuagacauuuguuuguauggagaaguggccuuuucugccuggccacaugucuuagcuguguccuagcaacucuccaggaauugucuggauaguguccaaagaaccuuaaagcuggaaguaaacccagggcuacccucauggucaagggccccacuuuacagauaaagacauugagaccuaaaacaguaagccacuugcccaagacaagaucugugguugucaggacuugaacuuggcuucucccuaggggcugaggcacucugcccugcuauuucugcuauuucuggcuccuucacuagucacuagggcucuugccuaggccuggucuaaccuugcaaccuuggccaacauugccaaaugcuaccuuccagugguagguguucugaaagcaaagaggaaaccccuccacuuaggggugcucuauucugugggccagagaaguaucaaagugaccuaaaagugggaacuccaauacccucuuggaggaauggcuucuuccguccccuuuucuacacagucucccagacagcuggcucaggccagugguuuggccagagaaagugagcaaggaggguuugaagggacggcauucagcacagccuccgugucuaugggccaaaccucauuuccugaacacaaggaguucuccuaauguggcaggcaggucuuugcagcccugugguuguccaugcuuccugccucucuggagaacauaguacuucaguccguggucuacugccugugguagccugucucuaauggcauaggucuccccuggggcuggcaaacugcauaaugagaccugagguagaguggacugacagaaguaacuacgggguuucuacaucagaaagaaggggagaccauccaucaggaaagcugauagaggaagccucaggaacgccuugugaacauacugggguaugccucggguuuucagcaggccugccuuuggcugagagguuuuagggguucggguuacucagaggcuaugccaagacucaugcuaacuugccccagaggcugaggaagcucuuuccuuugggguuguuggggaaggaagcagauaacgcaagccuaucuucccaguagggucuaccagcugagccuuuaggcucaaccaaauaguuuaucuuacacuuuagccuucaaccuaaacugucagaucaacggccuuucccugccaagucuaaaggccuucaaugaaacuguacucagaacagggccucauaugauaccucuaccaaucugugaauuuauauaggaucuaguuauuugcucucuaagcucuguccaucagggcuuccauggggaacaucucucuguccccucuaaaggcgugucuccuucaggagucuuuagacuagcacauccaaccaaaauauaauacaaaccacauacauaacguuucauuuuccagggaccacaauuuucauacuuuuuuuucuagcagccaaaaauuuucaagguuaagaagaagcagaggaaauguauuuuacugguguauuuuaacagagcguaccagaaaauauuaucaucuccacauguacccaaagaaugacaaugaaaucaucaacuuucuuucacuugcugucuuuuaaauccauggcauuuuucuaccuucagagaaaaaucucaauuagacacuguauacguauauacauaugcauaugacauauauguauaugucauaaaguuuaugguaugcucugccaaacauacuuaaaacauucccagugagcaaauucucuuguuucaaaauuuauauuuaaacuuuaugaaauuaagagagcccucuggcccuccccccaccuaaggauacagcugucgauguuuguuuucucuugaaaagucagcucaucauccugguugcuagaaccccuggacacucccucuauugcugaccacagugaaaaagaaaaugggaucuucaggagugagccuggggccaggcagaugcugcugugagccaguaggaaggccaggggacacuccacagccucuacccagagccccuccucuuucucucuauaugcaaaugcacccacacagggcagcugagcuaaauagcacccaucugcagcuggaaagcagugagacuuggggagucugaaacacagcuuacauuuggguggauuggggagggggggacaaugagcagccagauucugauucucccccaagccuagcacugcagcaaagagcaggaggcugccuguuggcugggaaacaagacaggacacggaaugggcagagcaucuagcugacuauuuuuguccugauggaugucuugggccagugcuaucuaguggaacuuacagugaugaugaaaguguucuauaucuguacuguccagcccaguagcagccaacguguggcuggggagaacuggaaaugaggaccucuggguguauuaucauuauuauuauuauuauuauuauuauuauuauuauuauuauuauuauguauuuguucauuuaaaugccacauuggcuucuggauggcacagccucagccaaacagaaaccucacacaccaggggcaccuucuucauggacugcuugucucuucaccuuccuguggcaaaguaaucaugcucugaggcaggggcaugacucagauggccucccccaccccaccccccaccccagcauccguuaagcuauaaguugccccauuuauaucacagaacuacuucucggcugaacuucucuuugcagauuguaaguggccuauugggccaugaacuccaagcuuagcugguuuucugauggaagagaaaucaucacagauaagucucccccagacuucuguuugugaggacaggucaagccagcauccaauagcagcccaggaucaggcuauuauucauggugccagaaugacaagaagcccaggguggaaaguaauaguuccaguagcaacaggucccauuggauucaucuauuagaaggacuaggaagcaagguuggaugggaaggcauccuaagaacacgucuucauauguugguaaagagccagacgucuacaggaaagcaucggcagccagacugugugcuuagagagguugagcuuggguaaggugugugcauggugcuguagugcugugugcaaugcugcccuuccuggggugucucagcagccauaaagcugugccuguucccagggagacgcugauguacccaugguccuaagucaugggaagggggggaugaauagaucaacauuccugugacagaguaggcacauuacaaagcuggagccguagcacaacauacaucagaggaaauaccagaauauaacaccccugucuuagggucuuuauugcugcaaugaaaaaccuuaaccaaaaagcaccccacguuucucauccucugcagaaaccuucccagcagcaucuagagggaggaggguguugggauguguuucucuucucuuucuagucacuauaaagaagcaacacucugccacacacaacuaagacuugcucgcgcaguccuccacuccugcacagugcuccuuugucguccucccccccccccgcaccuucuuaaugcaugcugcaagcacacaaagagggggaaaggauugaugggauucccaaacuaguaggagggggagacagccaagugccagcuuuuaaccuucaucuucccuggaaaugugcacaaauugagcgccuuuggucuccugcgccaccuacuggccaccuagagguauagcccugcuuguuucuaaaagccuagguccugguguguccuucaggaagcaacaccaagaacugggaggcaaaugaaaauuuuaagccuguucuucacaagcaagacgacugaaaauuaggggagaggagacacucccaggagccuagacuuugcuuagugagucccagaguuugcaaaaguuccuuaaggaaaaacaucagacucuacucuucuaucugcacagaacccccaaacuagacaugccuccuccugcauccuguccuccaaguccacaacccaaaaaacuggguucaccccaaauacggucuauuaaccccuagagagauuccucuuuggacaggcagccugggauuuggcaucccggcagguucugauaccguagagucaggcacuggggggggggggagggggugcagggggagggcugauauccccacagagaguuugacucagggagagcccgccccaacacugacagguacucccaccccuccccuuccuuucuugugacuacucgcccaagcccauuaccaaucaggauuaaugaaaaccccuagaggcuuccuccuaguaggagccaacaucuaguucauuaagcuugacacgcccuagaggagcagaugcuggguguguggugccguuuguucuucuaaccaggugaggccuaaucuccacaugccuccccgcacucacaccagaucuucauuugggcugggagcuuggagacauuccacaaagucuucuucucuuucccucgccucgacuuuguuggauucucucccuuaucuuucacaucugagauaugcagcuaccaucauaucugagguaucugaggaccgguggguuuuccuucacccugcuuaauuaauuugagauaucacaaagcccucccucuccuuuuugaacauuuaauuaggaaaggugauggagcccaguccuccaccccuuucugacccugcguuuggucuugugggucaucugaagcauggagacagccaucuaaggucuccccacucaugaagguugcaaggucgggggcugagaggagaccgggggcaccuaugagaaaagaccuuacuggaaauaugugcugagaugggcuaggcagguggcguugagagaguaagagacacaugaacaaaguccuacuucuuuuuucuaaagguccuaagucaguuaaguauagacugucaccaaguauagucaccaaguugcuccuauggauaacuggucuggccccagccagcugucagccccucucagacagggcugaggaaugcccagccuccaaggguccagagcacagcacaaggccaguugggagccacuguaagaggaugaggccucugucuuccaucugcuuccauuuguuccucuccggggcccacauuucugccucucccaucucccagcccucaccacagucccccugcccccucuacugcuccugucccuggacacccagguccaaacaucugucaccccucagcccagcuguucugaaaguacaaagaccucuuuaagcggacggacacacuuggcuguucuugccuaugucuggacugugcccugcuuucuucccuuggcccagcucuccaagcccugacugcuuaaccuucugucuccagccacuucaucucuccugagcaaacugauuuacauaaccuucaccugcuuugagccuuguccugucuccuucucuagccugcccauguguacuagugagguguagucaagaauacaccccccaccaugaugucuuuuccccgcccccucuugcuuucuuagaccucaucauuggaucucucugagucuccaugacuccucugacccgaguccucccaguucuggucucuagacacugcucucuggccccagaagcugauucuccgccuccuucuccccacagagagagacucucgggaacacgaggaacccaccaccuccgagauggcugaagagaccuacucccccaaggucuuccggcccaagcacacucgcauuuccgagcugaaggcugaggcugugaagaaggaccgcagaaagaagcugacccaguccaaguuuguggggggugcagagaacacugcccaccccagagucaucccugcaccugagaugagacaggaauccgaacaagugagucucaggggcuucucuuccccauacccuggccaccaucccaaucugauuucccaugugucuuacuuuagcaucuguggucauagaggaugcacaggcuagaccuaccaacagaccuauugcucacaguggcucagcugggaauuuggaaggaugcuuuugagaccuugaauuuauuuaucuggacugagggcugauccaaguuaguggaaacagagguaguucuccuucaaagaauguccuauuguaacugcaagcaugcaccaggaaugugaccccuagagcuauggccagucccaggaagaggcugaacacuauccuagcacauuuagagaauguaagcuguauaucuucagugcuuggaaggguaggaaagcugagagcaagugacccagggcuugcugccuacccacgugccggcuuacuauacaaccaaggcagcagacagaugaaggagaagaaagauccuaaguagcuucagauaaaggugguagauuuuucucccgggucccuuuggaugccacacaugagccaucagagggcaccgcugagugguuuccaccuggguuccuccuguguucacagggccccugccgcagacacauggaagcuucccuccaggaguucaaagccagcccacgcauggugccccgugcuguguaccugcccaacugugaccgcaaaggauucuacaagagaaagcagguacaugccccugugccgggcuucaccucugagguuuccgauuggcaguuccagacgacuccaagugcuuugcauuucuaauugggaucccuaaucuaaguuaacaguuacaagcuagggccccuuggcguguaucuugaccccgccauuucuagcuguguaacccuuggcccagcuauuuaaagccccugggucuuuaguuucucauguaaaauugggacuagcaaucuacuuuacucugauggggagaaauaagccuuuaucuugacaaagcacugagaucggcuccugccacaaugacccguguuaaacuucgccuggccugugauggagccagaguaguguuucauacuuugaugaccgagguccucucuugaggaucccuggagaacgugagauggguaacccaaaguaaauaaugaaagggagauggcaggaccuaucccagggcaggaugccugaacuaacuauuuucuuuggguccucccaugagauagaaucagcaaaaccccaagaguuagcuaaaggcggaauccguuuaacccucaagugcaucgggaaaggucagagccagaagagagccucgggguacaccgccgcucggguaucucacagccgcuugucucucucccaguguaagcccucccguggccgcaaacguggcaucugcugguguguggacaaguacggaaugaagcugccgggcauggaguacguggauggggacuuucagugccacgccuucgacagcaguaacguugagugacgcguccccucccuuccucccccuauccuacccccccagccccaacuccagccagcgccucccuccaccccaggacgucacucauuucaucucauuuaggggaaauauauauacauauauauuugaggaaacugaggaccucggaaucucuagcaagggcuaaggagacacuccccaccaugaccccggaaauguauuccuuuuugaagcaaguugaacggacagagaagggaaggagagaagaagcaagagggagcgagagauggaaagaaagcaaagcguuggaauagaggaaaagagggaaggacagauaggauuagagagagaagagagaaacagcaaggcagaaaggacuccacaaccaaggcugaaucugcccuuuugcuuucagcucuagccuggggucagaaaaaguguggcauucagugacacccaguuuagauuggucaaggggagaaaagaaacaaggugugucagugccucucgggucuguccccuccugcagccagcaguguggauggcuagaccccucacccuccucuccucuuacccaagugcagggugauuucauccccaaauuuacaaagacuaaaaugcauuccaucccucugaaaauaaacaaaagugagugauugaagauagguuuucccccagcagacaagugaacucagaaugugugcaaauuuuacucuuguuaaagauuuuuuuaagaagucaguacgcacccccaacacuggaaagacuugauucuccagggugacaagcaauucagaagcgcguggcuucggcccuugauuucacuagacucaaagcuggcccggcagccucuguggaggaggaugagagguggagaaaaccaaggggcuuguacucacccacaagacuccauguagacuuuauaggcauauaaaucuauuuucuuuaccuuuuuuucccuuucccuuucuuucgaaguuuugcauuaccucuuuaaaguaguuuuuuuuaggacacugaagaucuuccucauucugggaaaaauccauauuucacaaauacaacccagaacgccagcuuggccugcguccaggcagccuuucucgugagcuacaaguguggcucuuuuguggggcaccgauuuggaucuucucaugauuccaaacguguguugaagugaauccaccaagccagguaacugccagcacccaagggugcaucaagugcauagcccaggucaccccauuucagccuuccaacccgcagaaaguaacugucucacaccacaccacauaaaccugccagauccaucuguaacccacuggccugcccagaccuuuuuuucccaucugcauuuuuuuuuuugaacugcauuuugaaagccucccucagaugccaggcugacagaucagagagaaacuaacaugagagaugacagaggaggaggaaguggagggugggggcagagacuuccacagagagacauagaagauggagcagaggucuggggguggggaggacaagaaagagacagagagaggaaaauaccaauagaauuuuccuuggugucucccaucuaaucaacucucugagauuugagaggaaaaagaaggcaggggaagaacuugagguagaaaugaggucaguucaagucacagggcccagaugguggguaacugaggcaggauccagacuugagacacacgguuggaaacaaggcugguuagccugacuggguauugaagggugaagaggaugccuuggaaagacagcacaacuucaguucaacuucaggcccccaaggaggaacugaggccaaagaauccuucaagugcuucaugagucuccucugcccgacucaaacauccuucccugugauggaggaugguagaaagcccaggacaacucaggcccggaucuucacgacuguugucauuugccagccugauuuugauccaagagaagcaucucauugcccacuggcuucuucaacaaagaggugcuuaacaaaaggcucaggacugucuuugaagacugaagauaaccuuccaggagaggagacucggacauugguacaggaggccccuuuuggcgggggacacagcucuuugcgcucucuugauggcauggcauaguagaggcccccuccaacccggaacauggagcaacacaaagggagagcaaagaaacugacgugcgucgacucauaggacauggguggcugcgggcacagaaagggaugccuccuguugccuggacaggacaguuggcugggaaggaaagagaaaauugaucuucauaagacaaagggccugaugggauggcaauagaaggacuuaccagaccugcagggucaguauacccaucaccccgcacaacauccccaacccccaacucaaacuucaauauaucuuaggccaguauccuagaccuaagucucuccuuucugccauuauuucuccgcaucuugagcagucaucugacugagauuugccaaguggauacugggguaccacugccccccaagaaaagacugagccaggaacugccuacucgcucccccucccgagccuggagcuaacuccugugaggggugcucucuucaccccacaacuuacuagaccuugagugagccucugucccuuaugugggcucuucgcugugagccacagauggaggucauuguauagacaguuagccuuccccaggucagccuaccucccccaaacuugugagucuccccgcugcucauauggagaggcaugucuaagacagcaagucuucuagaggaagcuugccuuuaacagacagauggaacuaaaccuuccaaaugggagaucuggcugaacccaggauacagagaccauggacauggauggggucaucaagagaagagggauguccuucuccagguuagggagagagaaggcaaguuugcaacgaucccaucaugcccugagcaagaagcuuuuggcccaggcuagccuuuaacuccauuagaggccucucuguuggguuuauccacagcaguaggcccaaguauggccuguccccaccucuacuaucccguggaagguuucuucccaccccuuuuugacaaaugccucacucgagcaguggaaagauagcucucuucccccucuacugccagguaacaaagagaccuaaccaggaccuauucuccaccccagccagucuugaccagccagaacaaagcagggaaccuggagaauaaaagacucuacguuccucugacaaagacucuacguuucucugacggccaggccuaaacagacaaggcuugggaacaucugccccacaggauacggaggaggucagcugugcucacuccucuucuccuuccaagacccucuuccgaccaugacuuaucuccaugguaacauccucaccaucauucucccacuaccaaggguugccauggcaaccucccaaccaccugcccaucccaggcagggcagcuguccuucugcucagaacccuagaggacucuaggugaaauuuuacagcuuaagagaggagugagccaaggagaagagacccuguaguccucuggcuuucaagagaaagaaggcuaugauuuaaaacacaguagaagggaaagaggucucgucgaccucucccggggagcuuagggguuguacugucuuuauuuuuuaaaccacuaaagugcaauguuuccugcacucuuguuaccccgccucucuucccuguuagguuuucauuuccuugagcagacuuucuugguuuuuuaauggaguauagacuuucaccacuucacagacucuggccuccucuccaagucucucuggauggggaaaaggaagguagagggucagaggggaaggggucccucgucaccccgcauccauucacccccacuucucuggucccuagucaccggcuucagcccccaucuccgacaccaucacugucacacaguagccugucacacggauaguacaguucagacaagacuccuucagauuccgagacgccuaccgguuguuuuugguuuuuguuuuguuuucuuuuguuuguuuguuuguuuuuuacaacagcaauaaccacaucacauauuacuguagcucucuauaguguuacguucagacaccguagcucuguccucucuuauuuuguugguuuugacuuaaaaaaaaauacuuaugcuuuuuacuggugaaacagauugaaaaaaaaauugaacaacaaaccaguuugugaaaaaaaaaaaaugggaaaaaaaaucaccccgauguggaagagcucggcuccucuuuagcauuuuguacuuaaggaaauaaaaaagaaaaaccugg

SEQ ID NO: 12276 - RNA, 3964 nt, Mus musculus
guuagaacaacucagcaaaauaaaauuccgguuuauuguuggacauuguuucacacauacaucaaacaggccaaaaaaaaauaaacagcaacuucauagacagaaagaaaaggaaaaaaaaaaucuuuuuaucuuuggccuuuuuaaccaucucauacaaaccaacuacuuauaguacagcuagguacauacacaaaaguuacuggaaugcucggaauaagauuguuuuuuuguuguuguuuuugcuuuuuuuuacaagguuuuuuuuuucuccuuugagauuauaaugaacauggucacaccacaaguaaagucugaaguaggacagaaaacgcucugaaggcugguuuggucacccguuaucauuaaaaauggcugaccccuaacaauauguacaaaaauauaaaauguaaauaaaaaauacaaacaaauuuuccuuuuaaaguauuuuuaagaaaaaaaguagggccugggaaguucugguucuuuuuuccucccauguugccaauucauguuguaguuuuggaggggugguggagagcgcaugucauaucuguggguggcauugcccgcugugggcgggcggggccugcuucucuacucgaaggugaccacguuuaaauucugagacgggaaguggagggugaauaggucacggugcguaagguuauuuuuccuuuugcugucuagucauccuccucggucuucugcuucuugguguccacaucgucauccuguagagaacaucaggccugugacuacacauaagcucccuaggccuuggcccacaacucccagagagcaaagcugggaugggguccacuaagaacccuucaccauuugccagaaacccccaaagcuuuuagugccccaggaaaggaaccucacacauaccucaucauccucagcuacccgcuugcccguaggagccucagcuuccucaucuucaucuccauccuccuccucaccuggagaaucaaucaaggcccacauaaaccacuauccucccagcugcagaucaagaacggccccaauaggaggguggaguacacugcaguucaaagugguccaacugcccagaaacccaaccucucccuucuggcaguaaaagccaaggaaggaaccugagaaaacaagacuacucaccgucaccuucuuccuccuccuccucuuccuccccaccuucuuccucuucuucaucuaccucauugucagccuccugcuccccauuuuccucauuuugcuuuaacagaaaacacaucugccauuagccagcucugaagcaggccuguauaucuagugcaccuugccccuccccacaccauacagcuaccacaccaccucccaaacaaaaaucagacaaguucccuugucugguccaacauccugaacuaagcugaaaauuuaaaaaaguauaaacugggaacacaagccccagcuacuuggacacucacagcguucccauuggcaggugcaucucuuccauucucugccuccuccacaacuuccuucuucuccuucaaguccuuuagaaggaagaggaaacccguuagucuucagaacaauagagggccacccaucagccaaagugcugaaaacuagacaaagcugguccacaggaccaaucugagucacuggcuacuuggccacccuaggguaaugucagcauggaccauaguagguacucaaggccuguaguccaaauccuaugcuuuccaucuucuagauacauugaaaacaaggcagacucaugugucgacucaacgcacuccucuaccauauggcaucauagccacaaacccgccaggccaggcagacaagcucgggaacuguagcccuuaccugcacgcccuuugccgccgguuuccagcuagagggagcuccaccccucagaaacccuucuuggaaggcaguggcugugugccuuaaauaaauaagguagaagggaggagccagucgacggucauucgcucaggaauggaugggagagucuggauggggaucggaaagcgccugggcaugcagaaacacccccuucaagucacaccagccaugcuugguacuagggaccuccuggccuccacagcccaaaggaaauaaacuagcacucugggcccugcggcuucggggccggaccacuggguaacuuuucccacuacgacggcugaacggucggcucggucggggcccaggaacaugguccagcuaauuccgccggugcaccgcuggguuaccugccggcaaugguggguucgcgcccaccggaggccugccuaggaccccacugcacccgcuuccgcccccuggcggccgaagcccgggggagugagugggggcgggguggcagcggugcgcaggcgcauagcucacccagcgaacuacgcgcgcgagccucuugcacgcaccgcgcgcaaagagcacguggcccggggcgccaagugcgcccugugcccuggagacccgagguccgcuuucauccaggggagcggagucacccacuggagaaagcccgcuccgugcugcccccugggguccugccugugaggggcaacacgcggcuuccggcuccgauuuuggcgccaagcucucgcgguaggucaccagggacucggagcuccucggcuccgacccucgagaccuucggggggggcgcucccuaggagcgcuggaccucgcgggaauucaccugagacucccgccgagggcggaggugggaccaugcuugcuacaaaguguuacagcgguggcgggcaucgcuccagagcgcgcucugcacggggucgcaccagccgagggagauggcgagccacgggaguuuaaagaaacaaggcgacugggacugaguccccacugcgggacaagcggggugcgaacaucgagguguuugaaagcaacgaguccgaaccgaacacggcugaggguggagaagacuccaccgggagggcgagccccugccucaggaccccagccaggaccgcggugcugcgcgggcuucuagaccgccacggcaccaccgcagcuggggagccgugggggggcguccagccgcuccgcagcuucacuuucuauuuccucccccucucgcgugggcucgccgcccgggcccaaccccgucagcaaugacugacccugcgacgagguccgccgccgcggggacaaacacgaccacccgcguucacccguggcugcggaccagacccuuaggugucgcggucagaauccccccagcgcagcacgccgccccauccgcgucaucccggauaaccgguggccggcccgcuauagggcgcgaacccgggcgccuaacaaagagcgacucggccgcgggcgcccucagcucgccggcgccgcacacgcgccccccacacuuccgacugcggacgcgccggaguuucaaaguuauuuccgugcgccgcggccccgcgaccccggccccgagagcgcucaaaccauucgcaaacaaguuucgagaauccgcgucucggcccuccccguuugcguccgaguuccgaggcgaccccaggccaucggccagcucccgacggcggcaccaaugcccgcgccgcuucgcgcccccucccccgcacacaaagaguguugcccggggccaucgcgccgcuggaggguggcggggucgccuggaaaagcguuugcgugaugcuuuccugaaagcccgcaaccacgcgccccaacgccgcccgggcgacggcgcgcagaccccgagggggcgggcggcguccagccucaccuugguggugaucucggagcugguauccacugccgcgucugacaugguggggcacgccggugguccgaugccgcgagugagggaauuaaaagucgaguucgaggacucuggcgagagagcugccggaguccgcgcuggaggaggcggugggcggcgaagguggcugcagcgagcgcggagcacgacccaggaacaaugcaaagauggcuuuucgga

SEQ ID NO: 12277 - RNA, 12287 nt, Mus musculus
ucucaguugcuacaaacugcucagcacugaaggagccugcagcgcucaccgucaggaaggcaaaccacagcccaggaagcccugagguaaguaagaaagccuugcuucugcgacagcuuugccgagcaacuacggcaaggggcaggacuccuguucuuacgagaacugggcuuuuucugagaacucuuggaucccugagcugggggcuuuagagccugcagguccggauuggaaagcucaaagcacgcugcaugccugcauugcaagcuacugcuccugauuugggggaucugaguucagucauuuguggagggaaaccucuguguauguuuguuugcuacuggacucugauuuguuucugugaguacuuaaguuccaggaagcagggaaacuuugcagagaaugugggaugccccauugagguugcccaaagccagcuuaggggugagcuuggcaucacuguuugcccacuccuacuucugguuaucagauuggcuguaaaaaccacaagcgcacuuccagaaaggcaugugauaugcccagaggcauccuucagcggaccagacaacugggcugagcauucugagucuaggaugaguuuaaacuccgugcucugggggguggggauggauuaauucacagcuccugaauucuggaaguuguaaauugaauguuagcuccucuucaucuuaucucuucauggcaccccugcuaaucuaauuuugaguauuuauuguucuccuagaaaguguuguccaacuucaauugggacaaaaaaaaaaaaaagcagacacuaagaaaucuaguauuugaauuuaaaucuacucuccaagugaacugugaguguugcugacuuuuguuagggugcauaaagguucacuggguggcugggagugagggagacucugaggucaggggauccuggucagccaagacuccuggcugcuagcuacuaggaaaaugaggcacugugaaaggcagacuggcugucucuuccccuuucucucucugucucuccauucauuugcucacaaacagauuaauuaauuguuucgaugugagguaggaucaagcaucuuuuuaaaggugucuuggguuaguggcaucccugagaccccagucugugcuguggccaguauggaaacuuuguuuuucuuugaaggagcagaugcuggcuuuguggucuuuauuuaguucaggagaauguggagcucaauggauaggaccagaaaggagggaugggggugguucuguuuuuuugugccuggcucguugcagauuguaaauggauaaagcccccaaguccccgucuuucucccaucugaauagaagccugccccaaaugaaaugaaaacccuguuucgaucgggagcugugcacaggcuccagcuuggaaacauuuugcucuaauuucccccagucugagcggugaacacuuugugcugcucucugcugagcucagcugcugccuccaggaggcagcaggggcuggaaggaucugucugggagcagagguguaaaagcuggggaaguccgacugcuugcuagcugccuguuggguuccuccaguuuguuuuuaaaggggcaugcacagugcaaucacacacauauauuuuaaaguuccagaaagcuacacggcugcaugcuugugcuuaacugagucagggcuuuggaggggaguuuauccaguauuauuagcaaacccuuagggagcuaagaaaguauuaugauuucuaaucagacccagagcuggccaaggguaggcuuucuaaaugggauaaaaaaaauggaagaagaagaagaaagaaagaccaugaaacacccugguuagucagaacaguggcuuuuugugugaggauuugaggcagagugcucuaauuuucaaaucuacacagggaaguugguugcaguuacucagagcugagucugaagggccacuccuuuauaaacuuuuagagucacggaggagggggaaagggccccaacaacuuuagaacuuuuacuuuucugagaucuuguagcaaacagaauggaauuugggcccccaaaggcauuuguacuuuucagcuaagcaaccagggauucuuaaggacaaucagguauuaaaauguuucuugucgccuguuaggcugggugcaugccugugauuccagaacuccagaggcugaggcaggaagauugcuaugaguuugagaccagcuuggguuauguugccuacacauuaugucucagaauaaaauaaacaauaaacaaacauaaagucugguaauugaaaucuaugugcuuagauaaaauugauagacaaguaguaaugacuguuuucaaacuccccaggcacuggggcaccucucugcuguuacaauggaagcaaacagccuaaagaaagaagcaagugggaccaggugucgggcaaggauauuuucugcagggauuagccuucugaugccuuccuuguuaaaaauccacucacuuagaauuguuugaagagagaugguuagccuacacucccucaaacuucacuuuaaaaaaaaaaauuguuucuuauaaacacaucccagagacuguagaauuuuauggugacaauuuugcagagaacaaggagguuggcugugggcaguguuuuguucucccagcccacggcugggagauauggagacugucucagguggccuugagccacuccagguggagcccugggcagcuugggaaagcugcguuugaaggcugugucugcuaaauagcuggcgucuuuuucugucaucucugccagccugaagguugguauauaagaagagccuaagcuuucuuaguguggcuugggaaccugaaccuccuauugucuugcccagguccuaaacuggugggaaugcagacucuggcucuauccugccagcuggcagccuuuguauguacaggaacaucuagaucucucugcuagaugcagcucugcucccuugggcugagcacaauggcucugauccgguuucuggaugggacauucauucuaucugugagugcucccaugguaguagaaggcugucucauguguuggugggaaauucagccaagaacccuggggauagguggccuguaucagaaucaggguguggauuuuucucuccguauuuauuauuucuuugaguuccugaauaauucaaagcaguuccuuacuuacaugaacugaggucacucagggccacaaugaauguguggucaggacagcauuguuucucauuggcucaguacugggggauagacaagagucccuuucugcacucaagacuaggauuugccugggugggugucacgcugguuggguguguguuucaaguagacuuaaguaggggggucgauuaaugggcaacauugcagccgucaucucucugauggacaguggccucacgguucugcaaaggugacagucagacucuccugcuucagugaaaggcucucuguagacugucccagccaaaugaaaacacugugccuguaacacaggacccaaguggaagcuguugagcacagcuccuacuggcuggagcauggacaagcuacagcccguuaguuacuaaugugugcaucccucguggcuuaucagcugcccugaacuguuuucaaagguguagauagggaagacaggcuggauaaauaccuaccuccagacuugaguccacagagaauuucuccaggaaguucucugugggacacaggccacacuuugcagaaaaguaaacuuuucuggaaaaaaaaaaaaaaaaagaguaaacuguaaaggaaguuuucuuguuuccuaguagguucuaagucccuggggcugggaucacauugucuuauguggcuucuguccaggcagcaagccuauuuauagggcaucugggucaggccuucucaacuguguggcacuucugucuuuaaaccuucucugucccaaagccauggcguuuccuuaaaccugcccuggcauagacaggcuaaggccagaucuccuugcccacaggucaaggcccaccucugcucucuucucuccuucauggagacagugacuugccucucaucgaugcucuaugaugucccuggcuugccuccauucuccugaaggcuccccaccuuacuacugaaggauguacccaugcccaggagagcaguaagcuuuugugccuccuggauagccuuguuuggaugguggguguuugggggagguggauauggcuugacagcuucacgugucccagagcagugccuucaagaggagaucaacugaugucagcugggaaaggguugcagcugagucucucuggauaaccagugcaccucaggcugcuggccucccgggagcacgacugacugagcgcuuuuucaggucacuuugcuccacugguugaacaaaggugaaugagacccaguagggaggaaguguagagguagcaaugaggagagcuuugugaugcauugggaugugaagccuguggaagggaggggugaggcagaggcaggcugagaaggcucuucucuucuccgauggggauguggcgaacacauugaggcaauuuggugaaccuuauccaggcaccugaacacacuuggcagucccucggaggaucuaucuggggauaaggacauauggauugcagcccaaaccaccaccccauggagacucuaaauuuggaugcuucuaauucuggugcugucccagcaugcuagggagcuuaggcgagccaguugaaaacagcuggauaccgcaggcagcuggguguuauccaggacauuuuaugaagaguagcgaaccuuagaagcgagagucagaucuuugaggaaggaucuuccucuucgcuguugguccugggaggcguguggcuguggacccauggcagaacuggacagaugggagugcugucugugugcagauaauugacaaagucauugacagacaagagugaaugagcucgguaggagucggccucuggaggaggcuuucgguuuuggugaagucuguggcccagaaaaacagagcaggaaccuuugaugugcaguggcucauucccuccccuguuaaaauuuacauaauuuugauguaagcuuugcaauaauuugggcguuucuggaggaaggcgaggcugccucugugauugccuucuauuuacuuucccugcccaaagccuuacccucauugugggucuuugugucuuucuaugcauguauuugcauauaaaacacucauaauuuugccuuuucucccacaucaaugggauugugcugagggcagcacaucugcuucuuagccuucugcucagcagcacacauucauuuacuccccuuguucuuaaaccucucucucucuccauccccgcccccucucugcucacagcuguguuguauuccacacauuagaugugcuugcucgucugcuauuguuggauauuuaugcugcccacgguuuuugcugguaaacaaaugucacuucaguagauaccuagaaugcaugguugagaccacgugggcaucucaagaagaaguuuguaaacuuguaaaaccauagaauaaagccaucauucuaaggcucccuaacucccugcaguucuuauccaggugugguucccaggaagcaucugaaaugggucucauccaugccuuccuagggcuggacuuuugaguguucaaagaugaggccacaugcagaggacaccccacaaaucacucuucaccucuggccuaaagacaucagggaaggaaccaggcuugauugcagcccugagugacugggcaggauggggaaaccuuuuucuggucuccuugguugucaguccuccguguggccagcauaaacagcaagagauggccaagagacauuaacuuuggacucaaggagcagguuuguaugaaauauaacuuguuccucaugaacuuccugggaaccccucugucugcuggagggaggccaggucuccaugcagggcucucugggaggucggcagagucucccuuuuccccaauuggccuucacuuucagauuucucugagagcuuuguccaggacuggaguccaaggaucaugggcagaugucccucaguuugcugugucaugauucuguuucugucaagaaggcugaaggucauuugcugagggauaagcaagaaauggaggagggcuauuggcuucaucaaggggcagacaucacugguguuaagagggcauacuccugaugucuugcauaggugcugugacugcagaccacacccaggugacacacaguuucuguuguccccaagaagauggauuguccugucauuggcucuuuucugaaaucauucuuauuugcuucuaaaaccuaaugcaggaaagauguccaagugaugaaggucaggcugagguggcccuuugauaucuucguuuuuguuuucuuuagucacuuguuugaagcacaaagggucugguugcugccuucugccuggucuccaggagccuucuguggcagggagggaacauccaaucaggcagcaguggucaggaugagguucucugccccuggacugugcacugcccacugaaggugacugguugucacagugccacgaggagucaccagcuuaagcccuguccuucagaaugggacgauaacagcuccgucccugucugagacuuuccacagugccaagggaccucagaaguagggacaaacaggaggcuggcgaucuguaccugcccccgaaauaccacugugauucugggacccaauggucaugagaccaagguucuuuucccaaugguaaaaaaacaaagggcuggauggggauccccaagccccugcuaccauccacugcuguucuggaaccugagagaagcugagauuggcaggugcacaugagaacgagaguugaaucugcagggacaguggagggaugcagaaggcagauaccaucuccaucuguccccugcaccgcacggggccuucuuggaccauuuccagggcuaggcgugccugggcacugaaggcaauggaggggguaaggggcugccuccugguguggagagaacaggaagacagguucaggacccaaggucaagcuaccuaggcuuggggccaguucuuucuuuugguuuucagccuccaugacugacuacuaaagccauagucuggaccaguagcucaaggacaggcucacaccacugccagucaagcauccuccggucccuagguccccauuguaguccuuccuuuauauagugugggccugggaaggucuuuuuuccaaccucugauguucucuagagacucugggucaggguagacugagaggucuguucaaaccaagucuccuguaguucaggcuagacuucuuagguagcugaggaugaccuugaacucucgaucuuucugcguccacuuccugagugcuggguuuauagaugugugucacccugugucuuauuuuaauguaauagaauaagaggaaaaaaggaucuuugcccuggagucgugcaggacagaauucuugccuugguuccuucccagucauaaguucagaguggaaagucagugccugugugugugugugugugugguaugugugucucuauguguguguguauguaugugucugucucucucuguguaugucuauuugugugagugguguguguguguggugugugugucucugugugugugucucugugugugucuguguauuuguguguguguguguguguauugugugugugucuguguguguauuguguguguguguuuguguguguauugugugucuguguguauugugugggugucuguauauguagcaguucuaggcaacuugggguuaacacucuuuccagaggccagucuggucaguuacagaggccccaucuuuuagaagguacucucugcaacccagacagcuguuguccucuuguaguucucaggacugggacuuaggacagaacuggcacuuucuaaagugugugggccugggguccacaugccaggacaucucugaggaccagcauccucuccuaccauaggagauccucugaauaggaagggaaugaagcugccacagaagaccagaucuucuaucagcagcugaggacacgggggucuaguuagguuaccaggaagcccccucagagcuugcaggcagucuucuuuaacugggauuuaggagugggucaccugcuguggguugaagacuugaggugaucauggguggcaucagaugucaucucuuuucaagauccuacugcugcugucuugaaggagaaagcccugucacuagcuauccuccaccagcccuugacuucccuucugcuggguccuuaauauuccuaagagcacauugcuggcauucuaguuaguggggcugggcuuuccuaaaggggauaauuggccacuuuaaacuggacaguccucucuucucuaguccuggaaggugcuggaggggaaguuguguggaguaacugcugcuucccagauucuggguugugcccucuguccugggacaguagccacgggugguuaaaucuuagcuuagacaugacugagaagccauaauuccaacccaggaaugugcaaauccuggauuuggugguuuuucauaccgcgggguuagccaccgccaccgaggcauugacccacuaaaugcuguccugugggaguucucaugcauaaccuggaguccaucccaaaugaaccugaaagacaagcuuggcucuauuucagccaucaccagugauaggugccaucauuaggaccggaugucucuccauucuagucaugcaguguggguugggggggggguggcggggaaugacaagggcaauugucccagaacuauggacagaugggcaauagaagacagcucccagcaguuccuauagaguauguggagaaaucacccuaggcauagugcuacccuggagccaaauucucacuaggugugaugugaugacagcuaaguguuggccucaggucaggcaggucaguggggacgucaaucaacagagcucaucaacccuccagagauacagcagguggcuggugguuuauauacuuccagucuuggcuccuggcacucuggagucaauugagugggcaaggaaugggaacccaggcgaagucugagagcuggaggcagcuggcugguugcccgcggcuaaaaacucccagcaagcaagcccugggucugcaaguuugggguacaguccuauggcggggcacuccacacuugcuggcacucaggggaagcagaggauccggagaggauccagguuggcagauggauauugcaaagggggcuaaagaaacagugucccacuuuuaaacgcaaaucgggagaggauuuggagugcuuccauuaagacaccaaagcagcacacuuaacaauucucaugccaggagcaaaccaacccugccucucuugggaaugucaguaaaauggcucuguggacuccuacugaaguacaggccaggccaucagcacugcuguggccagggcucuacuaucugacauuucuuuggacccuguaucaugcugauuucacaccuaggacacagccaagcugaugccuccauaacacagccaugaaaagccacagaaaacaaacacagccccuccccagcaccauguaaccuuagcugggcuguguuugauuuucuuucuugcagccuaaguuaguuguuuucuuuccuuucuuugugaagacaucgaagagcaaaagcaaaacccgugagcauccucaguguugacugagacccgagguuucucaugaugaucucuccugcuugccuuugcuguaggucacuuggucgcucuccucaagaccauggaugugcacuuguuugacuaugcagagccuggcaacuacucugacaucaacuggccauguaacagcagcgacugcauugugguggacacugugcagugucccaccaugccuaacaagaacgugcuucuguauacccucuccuucaucuacauuuucaucuucgugaucggcaugauugccaacucugugguggucugggugaauauccaggcuaagaccacaggcuacgacacgcacugcuacaucuugaaccuggccauugcagaccugugggucgucaucaccauccccgucuggguggucagucucgugcagcauaaccaguggcccaugggggagcucacaugcaagaucacacaccucauuuucuccaucaaccucuuugggagcaucuucuuccucgccugcaugagcguggaccgcuaucucuccaucaccuacuucaccggcaccuccagcuauaagaagaagaugguacgccguguuguaugcaucuugguguggcugcuggccuucuuugugucccugccugauaccuacuaccugaagacggucacaucugcuuccaacaaugagaccuacugcagguccuucuaccccgagcacagcaucaaggaguggcugaucggcauggagcuggucucugucaucuugggcuuugcuguccccuucacuaucauugcgaucuucuacuuccugcucgcuagagccaugucagcaucaggcgaccaggagaagcacaguagccggaagaucaucuucuccuacgugguggucuuccugguauguuggcugccguaccauuuugugguucugcuggacaucuucuccaucuuacacuacaucccguuuaccugucagcuggagaaugugcucuuuacagcguugcaugucacccagugccuguccuuggugcacugcugugucaaccccgugcucuacagcuucaucaaccgcaacuacagguacgagcugaugaaggccuucaucuucaaguacucggccaaaacaggucucaccaagcucauugaugccuccagagugucagagacagaguacucugcccuggaacagaacaccaagugauccaucauucugcagaggucggggggacacgugcauguugcaaauggggcggcuggguccugugguuucuucaagaaagcaauguagcuuugggucugguugcuugagugguaugaagaggagaaggcaugugaccaugcuuccugucucucauucuccagccaagauggcugccgccuggaugcccauccugacagcuggcagcuggcagcuggcagcuggcagcaggcagggcugugcugugcugugcugugcugcgcugugcugugcugugcagccagagcugcguaucaaagccagcaccaggacaggcucuuauggacauguguacaguagaaucuucuguguuucuucaaguuuuuacuuggugacuuuuuguauuuaaguuuuaagacuuuauuuucucacuauggauguaccuuauaaauguauuugaaagcuaaauauauuuuaaauauuguaugggagguguaaggcuguuguauucagaccauguaggccucagauuagcuggacuugaguuuugacuaaggaugacauuaauuguuagcugauuugaaauuauauauauaaauauaaaaauauauauaaauuuaugccagucucggcugaaagguuuuauuuacaauaguuuuauaucugugcaauguuuaaugcuggcacagcauaugaaacaacaacugcccagcaaugcaguuuguuacaugaaccauauuguagaguuacacuucgggcugcaaacccgugaacaagggaaacagagcguucuguugauuuguaaguuauuuuuuuaauaaagauuuuguuuccuaaaaccucaugugugcuuuggguuugaaagcauguuugggcuuuggauggcaugcauagcacuaacacauggaaaaacaugucagacacaggcaagaagaagauguucagugggagagaacggccagagagcccaaccaugggacuggguggauggaucugagcagggugggugcuauuccuugguuccugaaggaacauuuucaaaaacauuugaguucaggggaggaugagcaggucagagguaggugcauuucaauggcuguugagugaaacuugcuguaaaaguugugcugcccacugucuacucaggaaaucauguccuuaucuuaacaaacaucugccugccgucuuccccagccacauguccaucagaccauccugcugagggcaugagguuaggugucagcgagcuguguaugcuguaugacucuccaagcccaaagcaccuucaggcccagcacucuagagucagaggcagguggaucucugugagguugaggccagggccaaccugaucuacacagugaguuccaggcuagccaggccuguguaguaagucugugucu

SEQ ID NO: 12278 - RNA, 18137 nt, Mus musculus
uucuucccaaaaauacuuuauuaaacaauauauccauaauccaugauccaaaaauacagauauacaucuuuacauuauuuaauaaaaagauuuaccauaguaucucuccuuuacaaaggggacauagguaauaauuccuugaaaauaaaaugugacauucauguuaaagcuggaucauccugauggauggaguguggcgaagagcaacgaccacagcacauucugagggaaaagacacuucuuagaccuccccugcuuuaaagcuccuuugggcauaggcagugaagaccaaucaaucucuguucauagaaaacagaguuucaaagccugaaacaaagguuccucgcuguuugauuucaaacccuuaagacuuaccuaaccucccagcccucuaacagggccaacccuggcaccgugaucacauggagaaguugcucucuggaugaagcauccccgccaaggccuucuggggucaaaugagggauagaaggcaagaugcuguauacacaggagcaagcaggugcccacuuccccagccauccacaaaaccucacacuacagggcucuucacuguagaguggaagacacggcuggcagccugccuccuacugaucccaccugcuggauaggcgaauggucagugcugcuuggacccauuacaccacuaacauguucacagaucuaggggcucaauuuuuuacuaauucaucaugcuucuucuauaauaaacuauugauaaugugcacagaaaacaagaaagaugaccccuccucucagcaaaacacuccuguacuuacaaggggaauuacacagggaagacccagccuuggcucaggcaaagcagcugccagucuguugaugaagcaaggacagcuuaagagccaggucucgaccagcaggcaugagagugucugauccagcgauggagacacucaggcuucuggagcagggcugaggggugugcucguggcuucuccacaucugaggcggagcuggugccggaacgcgucuccugaaguucccucuuugcuuacacacagaagcagugggaacaagccuuccaucagaauaccagccacaacccacagauuuuccuuucuguuuuccccccauuuuguugccagggaucuaaccuagaccaucacuuuuggaaggcagcuuuguucaccuacauacagccaauaccacauuacacuucacacuuguuaggcaugguuuuccaccauggagguaaauccccaaacucacgaauucuguuuuuuuuuuuuugccaagcuauaugcaucuuauuuucaugacauuauaacugucaaaaaggagauaaucauaggaacucacaaaauaaauaaaaaucagaagccaguauguaggguggccccagguagaagaccucagggaaagagccagcaugaccucaggaagccagaagauggaacucauccagccucuaacaccgccaccaguaaacgccacuucuuccugaucaucaaaggacucagcugccucaggcugaaucucacauaguaacccagcuucuaaggcauuaccaagcaagaucugauuaaaaacguccuguaguuacagaaacuguaaaaagcaguccagacacaguggcggccaucuguggucccagcauugccuagcuccagcaagaugacugcaaguucaaagcuagucuuuuacauaauaaagcccugccucccaauaaauaaauaaauaaucuaaaauuuaagauuaaaaggaagcaugaggccugaccccaagcacugaagaaagagaacaaaugguagaagaauaaagagaaggcuggggugugacucaaucugcagaaggcuuaccuaacacucaagaguucuggguuggagcuggcggugguggggcaugcuucucuaguccuagcacuuggaaggcagaggcaggagaaucucugaguuggaguucagccuagucauauacacaguggguuccaggacagccagagcuacacagagaaaucuugucuugaaaaaccaaaaaaaaaaaaaaaaaaguucuggguuuggucccuaccauugcaaaaccagacagaccuauuggugcacaccuauaaccucagcauuugggaggugaagaaagaccaaaagaugaacguuauucucagcuacauugugaguucaaagccugccuaggauacaugagaucuggucuuugggggaggggggucccucacaauuuuuaaaggcuaaguuaugucuaucuaaucugacccugagagggguccccaagaagaaugccagccccauucccaaagcucuuccuagccuagagacaaucuugugcacuugccuaucaacgacagcuaaccugccugguaccuacagcccaggaaaggucaacgcagaccaacauauucaguagcacaaacacaagccacuccugucuuccucuuucacuaggauaggcugugcaagacauuguccaguaagaacaugaccauggugacacagguauggggcagagacaacacccuucugcuuuguuugugaccaucagaagaaaacaaugugccugucauuauauaaagagccggccucuucuuacaucagaaauugcauaacccagcucugucuugcaggucuuuuucugaggugaggccagguaccgguuggacucuuuuaauucuucucagagagccugaguuacugaagaacaugccagaggaguucuaagucaaccguggcuuucaggagccugucgcucuuaaggaacaccacagaugcaucucaacaggccccggguagacauccccccaauauuucaagacaguucaacacugguuuuguggacaguggucaaacaaagaguacacuccaguuuccuaccuucauuccagaacugcuauugggcacagagucacaaaucaugucacauaaucaucguccccuugaacauaagcugcuggccuagugggaugcagcacagcagaguucuuacgaucagcucacaguagacagacucacuucauagacacacagacccaugaccuucaugcuaguacaauaauuucaucuucacaguaaaaaaauauaggcgggaauccccagagagcuggaagcucagccuggcugucuggcuguccgcugcugggcagugcuggcugugguaacugacaguccaaggcuaacggaagcucaaucuccagggagggccguaaguucacaggaaaagguggugcacaaaacgacagaggguacuuccaccugggaagagcccccggucccuuccagacacgucagagggaucuuggccaagagugccuggucuccaguaagggucagagcacagcauggggcagugccugacaauacuuuacucacagagcaccagcugugcuuccaugcugccacagacaguccuggaaaccguggacacgcaaggcugacccucuagucacaaagcaguggcaguguaacagguuaaaaugcguucacccugcaccaugcacuuugccuacagcucaaacugacacacaucacugaugguguggccauucccagugcugggagguugugggaugggggagccugcuccuaaagucacuguggcaagucccugugagauuguucugugcaaauggugcagcggcuucuuguuuuaggaaauauccaaaauuacaacuggccacugaauuauuaaauaucagucaaaauaagguaguuuuaaaaugaaagaucauauugcaacaugagugaggaaauauauuagcuugcucuucagucuggcacaacagccucuucuuuacuucuucuuccucuuuuccugaacacaucguggacaaaaccugugacgagaaaagcguugggaucaucguuucuccuggagcacaggaccccagguagacuuccugcauaucucagggugucuggacucuaggaaccaagugccauagagcagcuacacugaguaagaggugcucuuuucucugaggaaagcugacauuucaacuacugguucgagcauaucugaagcugacuaauaauaccuaucagcgcagccuugggaucaaguugauaaggcuggccauaauaugagguguccacuauagagcugacaccaauagcuggcuggcagauuggucauacucaagaccacauguacagacacgagccuguaagccagugaacaacagcuccuggcacagcuggacugggcccuauaugggucacacaggucacacagugcuaugguucaagcacacagaacaaacacacaucagagacucaguguucaccaacacucaagaauguaauagccacucaugacccaaagggacauucuaauaaguuccccaugugagagacaacucuaacacacguaacagcuaucaucacaucccucuguacuaagacgcucugagcaccuaggccaguacuacagugacugugucucucugaggaagcccauucugguaagcuacacaaagacugcacuggaaccccacuccccaauuccucugucuggcuuugggcccagcacaugaggcggcugugaggccuccagacucucagagggagcaccccaacagcuuugccagugcgguuggacucccucaccuggaaaucccacaaacaacucacugcaucuaccuugaacucaaagucagaccccacgccucacagggucgcucuuucccuagcccagcuacacaccugcucacaugccuaccaccacugcagcccagcuacacgccugcucacaugccuaccaccaccgcagcccagcuacacgccugcucacaugccuaccaccaccgcagcccagucaauucccacaaggcacagugccauaugggucuuguaacaugagguuaacacucacaccacacacaucaucagggcacugcggcagggcaugcacucuccuuuccuagcugacucuccaacuggccacaggccgaucuacacacugagaauguuaccaugagaugcuccgagugcuccucugagaagggcuggguuccuacuacuucauuuuaagaauaugcauccguauuuuacucaagucaacaccaccaggcucucaaaccucagagacaagcugaacacuagucuacugcugagcagcuguaggacggggacaagaauacacaaggcuccucugcacugucagcuuuggagaccugcgggagcagcagagccuggccuggcauacuggcugcacaccaggauggagcccaaacagcucuucuucacagagugccaguauaaacggcauauaaacccggguaagcugggaagcagaucucucuaaguguaccaccaccgcagccccuccccagccaggaccaauguugcagaaauagagacauacaagacccagagcaccagacacacuugcccaagggcagucacuccauacuaaccacuuuccuuugggcuuuguggugagauccacgcaggcaaagugaaaccacucaaugggacacugcaaagcaagggggaaagccugugucacacccaugcaagcugcacauuaaacacagaaaggccaacacccacccaucucuacaacguuuguccccagguauauguguccuucacgagccacucacaucuggauugucacagccgaucaucuccccguaggacaccugguggcacaagcaguauguaggcucauucggauccacaggcauguccagcacaucagaggggugcacagauaggauacugucaguaaacucagaccugaugggagagaaaggaucugaugagcacagggcaccaggaagaaggcaggaaacagcauacaaggccacacugugaaggccacacugcagccuuuccaccagugucccagggcuccuuuacccuggaacaaaggaugcuugcagcuuccaaggaaagacccuacaaugacucugagcuaaugaccaugcauaaacuuacuucuaauuuucuuguuagccuaucacugagguacgagccucaaaucuuccagccaaaucucuccuaagaauuuauaaugagaauaauacggugugcuaaugaucaguugaagagauucccuuggacuauucccagccacacaccuuggggcagcagcaaacagaaagcacacugcccucacaccagcugaggccccagugaucacucagaacucacuacacaacaacaaccaucacugucuacuggggacauagaccccaaaaggacaaggcuacugcuuucucugggcccccuccugauagggacauggagcccuaucagcagacagcuaacauuugagaagaguccauuugugucucacccaagucuggccuaaggguugaggcaggcauucaccaggcuacgacagccaauaaacugcucuuucucccgugagaggggacagugcauccucugcacuuacacaggcauccucaccccaaacaauacacuggcagccccucuuaccucccuuggguuccacguaucuacccacuacucacccagcugcccaccaggguaacaagagccaguaugguacacacugcccugcucauucaugcccuaaugccuacagcugccuuugggccucuguacaguggccuagugagacuccuguccuguaauuucugccugcucaguccagcaccacccuccacccucacuguagagcuggacauaagacuugcgagggcagucuagacaguauagucccuauaccucuauuaccacuaucccuaccugucgcuaaaccaggaacauauagugauaaauacauguggccagucccuaugagggaaauggcaaacagcauagcugcccccuuucaauuuccaaaaguuuccccgggccuuugcaguuacugcugauacacgugggugugcaucuacgguccagcccagcaccucaggggcucgagaaguggggccuccauagcagggaaccaauaccuccacucacuugucucucugaauagaaaugucacaagaacauguccaaguccuagugcuccacaauacuguuuguaagcaacucccaagagguccuucaagcaggaaacuuucuuuuuuuguuuuguuuuuuuguuuguuuuuuucaagacaggguuucucuguauagccccagcuguccuggaacuuacucuguagaccaggauggccuugaacucagaaauucaccugccucugccucccaagugcuggaauuaaaggcgugugccaccacugcccagcaggaaacuuucuuuaagaucugugacucugugccuugccuccuggcuuucauggccucuggauggcccuaccaucaguagccaaggccaggagugugcucaauucuauuggcuaccucuguacuuuccuaugggaagcuccacccaacagucacagacagucagcuaucaggugaccuagagcucagcaucuccagguucagucagugagcuauggggucacccaucuuuaaggcagcacuuggaaagcugggacaagagaauuccaaguucaaagccagcugagcaaugaagaaaauucaagggcagcuuguacauacuagaaccuugucucugacagagaaaacaaaagacagaaaugagcagaagaggacgagaagauagccuaggaagugggaccuaaagguaaucucugucccuugggcaugugacuuguucuggcucuuggcuagguaagcuuuccucccagauguggccaggaaucucgcacuagacaugaccacuuaugugauucccuaacaauccaggucgggcagaagggacccagcugcuuguccaagcuuuagaauaaggacuacagaagaagcugaccccuugguuuccacacguaagccuuggcuugccagaaaauguggcccuggggcagcuaaggagcuggcuuugacuuuagcucacaggacccaagaugggaaacagauggucuaacaguccuaggagaggaacucugugacacccgucgucuggucaaguggucacugacccacaggaaccugacccagcacugcuccaagucccccauggaaaaugacagcuaucgccaagcuggaacugaaauauuuagcuuaucucaucuagguagugauagggaccaggacuauacagcacuccagguuagcaacaggcaagugaaagccuguucagguucugaagccacacuaagcuaccuccaagauccagcaagggcaggauuucaauaacucuuguagucuucagaugccugcucuguagucagauguuaaggcccaaccacaccccuuguuccucaagucugcccugucucaacacaaguaaauuaggauagugucuacacugacguucagagacaauauaaagucaaugcagagcaggugccgcaccagucaccauucaggcaccacagcaggcagcccagcaaaugggccuguaacaggauggcucccaucaaaggagaaagugaacagcccgccucaauugugcguuuuuaggagcaguuauaaugucugaggccucaggaggaugccagccugugggcacuggucucccuaccaccuagaaaccccucuucugggcucuucaugcugaggacacucugugaaacacucuguaaagagagcagcaagaacgucuaugcaaacccagaagcagcaaaaccacagagacucugggaaggagcaaagacaucacacugccaccaaaagcucagaaccaccucuucuaggcagcaggacacuggugaccuauagugggagagggcuuucuccaucugcugaauuuggcaggacugguggcccagcuaccaaugugacacuuuaggaccugcacauggcagccaucuacacucagaauauguaccgaaugugggaacuaaaugaguacacuuacacaaaggcagagugacaauucccucagcucuggaaucugugagaccaggaauuguuuucacacccagccuccuucaacccacaagugguaugggcaggaugaacuggagguaaaaaaggcagacugaaaucgagggcaaccugugggaaaccagaacucccaacugagagccagggcaaguucccacaauuccugaaggaggguguguggaacaguacuaggcagacccuggcucagucugccugaaccagagaggaagaagucacccuaagggaucaggacggucacucuacagcuuuuauaacuacagccacguaagucauuuuaaaagaaagcacugggcagugguggugcacaccuuuaaucccagcacuuggaaggcagcagcaagcagaucucugugaguucaaggccagccuggucuacagagcaaguuccaggacagccagggcuacacagagaaaccuguuucaaauaacaccaggcaaagcaaacccucuuacccgcuuuuauguuucuucuucuuugggguauccucuucugacguccgccggccucggccccgggagcuucuuuuuucuuucugacuccggccuucugaagaacaaagacccccauuauucucacagaacagaccaaagcagagcaagauccaucccgauucauugaccaucgugucccuaacacauuuagacgagaccucaaagcuacaaucacuaguaaacagaauggcagccaacuugcuuuucaagcuccgugcuccagugcucucaaagucacuuccauccauccuguccuucaggucagccucaaagcgcgccaggucagcaucaagucuucggauguguuuauccaccugcaaaaggacacuuaaaaagcugaccucaggguaaaaaggagggcuagggauacagcucgguggcucagccuuugcuuugugugcaaaagcccuggauuagaucccccaggaccccaagaaaacucgagcaaacaaaacaugguuucaccaacaaguaagagaaacagcuccccccacccccucaaaaaaccaaaaucaugggaagaggcccagaugaagacccccaguguguccucucuaggugcuccaaacuccuauuccagauacacauuucuacacaccuuacacauuuccaugcaccuuuacacacucucacacagccuuacacacucucacacacccuuacacauuucuacacaccuuacacauuuccaugcacccuuacacacuugcuugcacacucuccuucaggggcacggaaggcagcaggaggcugcacuggccccugcacucaccaucucguaggucugcauggccagcugcaccuugucaucacuguacuccuugcacuugcuguaggcgcucuggaucuucuggaggugcuccacacgcugggcugacgagagagucuucacuguggaaauauacucugcagccaggaugucgaucucugcuuucuuaucuaaugaggacaggugacuuccguaagaggcagugacaagcauucaggaagcuggcaagagcaucgcuggccaugucacuguacaauuucuagacagcagcacacccauauggucaccuugccugguuccuguugcacaacuuaagucacauagccaaaggagugaacaauacagcaugacacauagaaacauccuggaugcuuccaugaauagcaacagcagagacaugugcaacucuuugcucugacugagaagugggacucucugugguuucagggagagaggcuacucccacaagguuuccagguaccacggugggucucuccagcugagaggugggaaagagaagcuggccuaauggcagcuaugaacucaucuacaaacgcuuuauaacugucugaaugucagucauauuuccaagaagugaagucuccucguuuggaaaucagugcuucuaauuuguaaacagucccagcaaugagcaaugaugucccaaagaaugccccugugaaacuuaaaaaucucagagaagggcuggagauauggcucagcgguugggagcacugacugcucuuccaaaggugcugaguucaauucccagcaaucaccugauggcucacaaccaucuguaaugggaucugaugcccucuucuggagugucuaaagacagcuacaguguacucgcauacauaaaauaaauaagucuuuuuaaaaauauuuauuuaucuaucuauuuauuuauuuaauguguaugaauacacuauugcucucuucagacacaccagaagagggcaucggaucccauuacagaugguugugagccaccaugugguugcuaggaauugggaagagcagucggugcucuuaacugcugagccaucucucuagucccaauaaauaagucuuaaaacagaaaaaucucagagaagaaagcuggagagacgacucagagguuaagaguacugaaugcucuucuagagagccuggggguucaacugccaacacccacacaguugucccucuuuuccucuacuaccagggaguccaaagccuucuuuuggcaucagacaaacaugugacacacauaugcaggcaaaauacccaaacacauaaaaaaauaauuaaaaaaacauucacauuacacuggagaugguggcaugugccuuuaauccccagcacuuaggaaaugguuaucuguaaguaugaggccagacuggccuacaaagcaaguuuuauuuauuuacuuauuuacuuauuuauuuuuaaagauuuauuauauuuauaugaauacacuacugcucucuucagacacaccagaagagggcaucggaucccauuacagaugguuguaagccaccaugugguugcugagauuugaacucaggaccucuggaagagcagucagugcucuuaaccgcugagccaucucuccagccgcaaagcaaguuuaugacagccagugcugcugcagagaaacagugguugagauuuggucucuugcuauguauuguaaugcuaaauucuguaucccaaggucuaguugccccagggugaauucucacaaguaugucaucuuugguuguguaaaccuugcuacuuaaagcuauagguugaauaaagaugccuacagccuguagccaggcagaagagaaguaggcggggcuaugguuccuaggcuuagagucugaggcagggaucuugagggagagaggaaaaaggugcuauggaggagguggauugugagcacauggucaugagggcccacuuguuggaguagaaguaacccaggcaauacaugacaacuggaagguacugacaggaaguagacaaaauacagcacagaauguugauaucugcccagcucuagugcuuuaaggcuuauuaaaaauacaaagguuuugugucuuuuacugggaacuaaaugaucaaagguaggguagauauucccaaauaauauuuacuguaacaccuguuacaaaacaaacaaauauauauauauauauauauauauauauauauauauauauauaaauuauauacauauaaauuuaaaucucauugccaggcaguggucaugcaugccucuaaucucaguacauaagaggcagaggcagaccucugagcuauaggccagucuacagagucaguucuaggacagccacggcuacacagagaaacccugucuugaaaaaacaaaugaauaaauaaauaaaucucaaaagaaaagagaacauuucuuuucucauuuuuauaaagauuuuuuauuaguuuuuuuguuuguuuuaguuugguuggcuuuuugagacaaggucucacuaugcaauccuggcuguccuagagcacucugguuagaccagucuggccuaaacucucagagacuugccugccucugcuucccgaguguuggcauuaaagcucugccccauucucauuaguuuuuaaugugugcauguauggaguucucuggaguuccacacccagacaaacagcacucaaaugaaggcugcaacaacuacucuucacaugagugcugucaccggaaguucaccucuauggcaaauuuaccuguccuucuaagucccugucaaaacaaacggagcaaaucaaaagggaggacuucaggauccaaggaacaggguucuccaaagagaauguaaacagagauuuucaagagcagcaaagaaaggugggcaaacacacauuaaucaacagccugggaaauggggacccuccagugggaccucacucugacagucuagggguugggcgguggcugaaagcaaagggcagaaagugggaagcaaagaaaacaaaguuaucaguaacuccaaggaaaacaguuacucagaaaaauccuguaagagccaggcuuagaggugcacaacagcgccaggaggcagagaggagaguaucugugaguucaaggccaguuuggucuccagagugaguuccaggacagccagagcuacacaaaguaaaacugucucaaaacacaauaagucauguaagcacaacacaggccugcccugcaaacacacccucuucaccagggacuauaguagaccacaccccggagacagggaaagugcuagcgguccagaacaucuucguguucacucggcagcacauguacuaaaacugcaaugauucagagaagauuggaguggccccugcacaaggacaacaaauucaugaagcguucauacuucaaaacaaaacaaaccagaagacaucuucacugucauaacaacaccagucuggagcugucugaaaauaagaaaaagcaacaagaggauccagcauccagugcugggugacaggcaaguaaaggagcuugccaccaaaccugacaaccugaguucaauucccaggacacaugagggaaagaaaauaaacaccuucaacaaacuguccucuaaaccucacagagacuguugggagcacagguacacauacagacacauguacacaaaaucaucaaauaaaauuggaagaaaaagaagccuagugugguugguggugcgcaccuuuaaucucagcacucaggaggcagagacaagugcaucucuggugaguuccaggcuagccuggucuucacagugagauccaccaaagacagaaaggaaggaaugaaggaaugaaggaaggaaggaaggaacaagggaaggaagggugagcaacaagagcauguugcuuagaaguagggaguugaaagccuggcaggacagcacuuucuacacucccaguaccugagagauagaggagguaggauuaggccaugccuacacagcaaguucaagaccaacccaggcuaggagaccccauuugaagggguggagggacagacagugaaaauggcucagugguugaagguauuugccaucaagcccgaugacccaaguuucaaucccuagaaagaacagauucccaaaguuauccucugaucugcacauauguacacucugacagaaacacaugcguaugaguauacaaacacacacaaauaaguuaacuuuaaaaaaaagugagcuggcugggcgugguggcgcacgucuuugaucccagcacucgggaggcagaggcaggcggauuucugaguucgaggccagccuggucuauaaagugaguuccaggacagccagggcuacacagagaaacccugucuugaaaaaccaaaaaaaagaagaaaaaaaaaaaaaaagaagaaaaaaaaaagaaaaaccaauaaaauaaauuuuaaaaaauaauuaagaaauguuccuaaguaugaaaauaucaaaagacaaaacauuacuaacuuucuaaacauugguggaauauuccuaauccaccaaugaaaauaugaaaauauuuucauuuuauguacauguuucgccugcauauaugcagauacacugugugcaagccugguagcuggugaaggaccuggaacgacaguuggaugugaaaagcaugugauuccugguaccggacccucugagagaacacuucuccugacugcugggacaucucuccaccuccccugaaacugucugaacacugacacgaugccaugacgggagagcccacaccugaccucaggugaaggccguuaacaugcacuuuagcauaagcaugauuucacacacacacaaucaauagcaaggugacaaaacugccuuccagacacacauuuucauuuguuuacacuugaguugcacucccaagauaggucccuacacaguccaaaauugaaaaacauaaaaacccaaaauacuucuggcccaaagcauuugggauaaggaacaaucaacuuauaaacagugcagaaauagaaaagaacaacaaagaugcugacugcaaaggacaacaguugaagagguaagacaggaaccuaugugggaacgggagagcagagcagugguggacacaugaaaucccagcacuugggaggcagaggcuggugcaucucugaguccgaggccagccugggcuacagagcgaguuucaggccagccagggcuacaagagauaggcuagggagauggcucagaggcaaugagagcauacggacacaagccugaguccucuaggaccucaaggaccgcacuuaaaagccaagugugguaggacgugcuucugcgauuccagugcacuuacuggagaugggcggcagaaacuggaaaaucccagcuagccugguauauacagcagugaagaugacaagagacugccuuucaaauaagguggaagaugaggucugaacccaaggcugacccuacaagaaacuaacccugaauuaaaaguaucagcauugcuccuccuucccaaauacguggaaggcuauggaaggugcacugagaguucaaggccagccugggcuacagaguaagacccugucucaaaacaaacaaacacaaaaauuaggcaugauaguggacaccuuuaauuccagcauuccagagguagaggcaaguggauccgaguuugggccuggccuggccuacacagccaguacauagcaagaacaaaacaaacaaaaaacaaaaaaaggaccagcacuccuuccaagacacugugcaauguuaacccuccaauauacaaggucccuucagggcccugugacaccccacgcccgcuccugucucucucuggugaaaacccagcccaggcuauacccaccuucuguucucuggucuagcucucgcaucagcuggaaguuccucugaaguucacagggaagguucucaaugccugaaagagacaagaaaguugcuauacuucucaauaagacaaaaaccugccuccauggaugggagagagagauggcucagcuguuaagagcacuuacugcucuaccaguaaucucaaguucaacucucacccacaaaaaagcucacagccaucuguaacucuaguuugagggauccaaugcccucuuucuguccuuggagagcauugcauacaugugguacacagacacacauguaaaacacccauauacauaaaauauacagggccuuacaccaaagccuacaacagcaggcuucaucuauuucuguccuaguuuggggaccaaaugauuaagacuuuguaggggcuggaagguaccaaacagugagcacaacaggcugacaguuucagaagugccaaaagcuggaggaugcagaaaccuggcccccagcagacacaggccgggaagacagcucagacuccuccccugaaccacacccucccucgccucuaugucacacacagugaacuucauccucccaaacucaagccagaaccuuaguccuccuugaucucuccaacuuuguccagauuccuacaaugccaggagcugcagaccauguggucucaagacacuguucucucggcaaggcccaacauaccagucucuagucacacacugcuaugagcacuggaaaggcagccauuagcaccgagcaggucccacugugcagcucaccagucccugcgguucaagugagcuggcuggcaaaccaacccauguggcuuuucugccccacacugcauccccuaguacagauacaccucaguccuuaaguuuacagcaggcuccagcugccucucugggucuuucugcacucaaauaucuccacagccaacaaggccagcaauuuagggcuaaauuuuauaaaacuugcuguucuaagccuauaacuuccugagcucaccaagacauuccuaucuacagcuugacuccagcgacccugucagcuacuuaaccuucuacccuccagucgcccucucuacucucagauagagagaccuuuaucagcaguuucuggaucuauauuuaccccaugccuuaaucuugggagcuauauauauauauguauauauaugugcguguguguguguguguguaccccaacuaaucagugaguuguagagaaauagggcucuugccaacgcauggguggcacagggcagguggagagagcagaaaggggccaucacacaaugucagcagugaaaugaacucuccuugaacccuccucagaaugcccacuggauggacaucagaauaaagauaguucaccuuggagucccacugcccaggcccaaggagaaaaugggcgccccacuggcuugaucuaccucccuccaaagggucucaauucuuccacuauagagugggaaauaauccuccuccgaguucuugcugggagccaaucucacggucuauaaauaaacggaguugccaauuucugggaugucaaaggucaacccguuauacagagcauccucccuuaccgggcuggcucgugauagcacgaguucccucgaaaaaggcaccccacuagccuagaguuccuuccuacagcuccacaagcaaacacaguggcuuuggcucuacagagggauuugagcaccacaagccgcaggugaagaaggggcgggccuccccgcaaccuagaccgaaguagagaggcgggaacagaggcguggucagcgucggggguguggccgaagcggagaaggcgggcugagccccaggccacaccccuccgugacgcaccuggaauuggcgcggcggaggcggcgggaccccgcgccgcgccccacgcccuccaucugcggccccgccccagacccgccgugagcccccacaguccccaugaucaguccccauccuccuccgcaucccggagccucgcacggaucgcggugggccgggggcggcggcggcggcgcgaacccgcgcgggcggcggcucggccagagugcuuacuguccagauagugcuccaaguacauggcagucgccaucuucgccucggccacgcucggggucugcgcgagcgggcg

SEQ ID NO: 12279 - RNA, 4292 nt, Mus musculus
gagugguaugaaaggcgcagcccggggaaaguccgggcagagcccgagagguggccagaccgucaucaucguucuaauacagcuacuuccucagccaccgguaugagccacgggaagagaaccgacaugcucccggagaucgccgccgccguggguuuccucuccagucuccugaggacucggggcugcgugagcgagcagagacucaagguuuucaguagggcgcuccaggacgcacugaccggugagcacacgucggggucuuggaaccacucgggcgcggccacuucuugccuggggugucuuuaucacuguucugugacggggaccccuacgcgaacaacuccgggucucagaugucuuucucuaauuaaucucugaggccacugaugguccucugucccuucgguuaaguccccgucucccagcccuccaguccccgccucgcucccgaggcuccgacccucuuccuugaguacauucugagacccugacaacaccaugagaaaagucaguguguguguguauucagaguccgagcucacccuuaucuccgaaucuuggagaacaacagacccucaggggaugugaagccaggccaagcugugcgacuuuuaugcgcaauugaacuuucuagacaacucuugaguccuagccacuguugcuguauaguccugagccugucaucauacaggcccauucugccgcguguuuacccgcugcaaguuguaaucugggcccccuuuguauuuuuucuuuuuuggucccucuucaccaucugccaccuauuguaguacagaaaagagccugguagccuagccaacugcgagggcggggaggggguguguguguuauggaggcagggugugagggacggagguggaggagugauaagccacccuuuagccucuguccgcagcuguuauaacugguugguugccuugggcugcgauagccaucucucaacauguuggcacagaucugaggaccaacagcuguuucaucaaaacaaaaccauuuuuuauccccuuaccuuugcuaaagaucucaaaacucuucugaugcggaagggaugagaggccuugugacuuguugggcaaccaacaacauuggccgcuuaccuaccggcuuugaaauuucagugccuuggucgucagaggcccugccgguucuugcuagcccuuccugccuuaaacaggauugugccaaaaauauccaugaccaccauagagcaucuaccugaaagcucuggggcugcuuuccaguguacaaaaacuuggaaaggacccaggaaucuuucuaaguggcagggggaguuuaaggagaggcucuuaaauacugucgcugagaagaggaagucuccuccccagcccucuccccucauccuccccuugugguaaacaucagagaaugcuuucuaacggcgcaucuuccucuuguuuuuuuccacagaucauuacaaacaccacugguuuccagaaaaaccauccaaagguucuggcuaucgcuguauccguaucaaccacaagauggaccccaucaucagcaagguggccagccagauuggacucagccagccccagcugcaccggcugcugcccagugagcugacccuguggguugaucccuaugaagugucuuaccgcaucggggaggauggcuccaucuguguccuguaugaggaggccccgguggcugccuccuaugggcuccucaccugcaagaaccagaugaugcugggcaggagcagccccucgaagaacuaugugauggccgucuccagcuagauaggagccacccgacccuggcacucuacuguucucaugcugcccugacaacaggccaccguauaccucaaccuggggaacuguauuuuuaaaaugaagagcuauuuauacauguuuuuuuuuuuuuuuuuuaagaaaagaggaaaaaaaccaaaagauuuuuuuuaaaaaaaaaagaaaaagaaaaacaauucuuuaaagggagcugcuuggaaguggccuccccaggugccuuuggagagaacuguucuugauugcaucugugagccaguguuugccuaggggaauggguuggggauuggccuagccaagguaaaaggggauucuuggcugauccccccaggaggugguggaagggagcaagguuagcaacugugaaugagaggggucagggucugcucuggguuaccgucccagcugggaugccuguaugccuggucccucucuuacucaggggcauucaagccugaucuuaaauaauacuacauugccuaaucuucucuuuuguuuuucggcugagaucaggggcagacugaaaggccucuccugucccuucuguucuaagcagucucuugaagccgugucucguuucugagucuacccuugggggccugaagagcuugcuucccagcccggaaucugucuaaacauuuuuuggagggugggauguaaggcaggcgcgcaaagacuuuggggcuaagauggagaggaccugcacaaaaccuuugcuuugcucugugcugcuuuguauggguggauagugaauaauuuagggaugauuugcaauggaauuuugggacccaaagaguauccaauggggguaggucuuuuggacccaguccuuccuuuugggaaccacacgacagucugaaugcugcuaccacuauuccuuugagagguggcucaaagcuccagggaacuccaaguccuuucuuacugccuucucuucaagagcaaccuuccccauuuuuucuuuccccuuuccugcgguuggguccuggagggcccuauuuccuaggacaagcguucucagucacugugcaauagucccaggaugcucugagaccggaccucccagccccuccugaugcccugguagguuuuagggacccauucuucccauucuucuagggguucugacuggcuggugggccuugcggagaucuuccugggccacagggagggcaccugugcacugcaggacuaccugguauucuuguagggcugccaugaagagucaaaccuugggcacagcuuuagcuccuuggugcucagagcaccugugggggagguuaccucucucucucucuuaguaaaauccaaauuuauuuguagaugugugcaauauuuacuguucuggguuggagaaaauugggaaacacugggaagaaauggcuuuccuucagguucagugacacugaugagggcuucuuagaaggccucaagucucucaaacugaaggacagagcuagagcuagcccgucaccccuuggugaggauucccuuccccguuucucuccaccgccauggcauccuguguccuagauuucucagcuccucaguuucugcucaaaggugcuauuuaccaaacucucugccugcccgggcagacaggccccagcuucgcacagccuucccagguggcuucgucucucuugcuuuaaccuuaacucugggcccacagaccugagagcuguggccuacaacaaagcugugaauuguuccagaugguucuuguguuuuguccgcacacaggugccugccguuuagaagcugccuccuggucucaugcuuaaaucuucaauucuuuacuguccuuguucacuuuagaaaugacaaacccuagagcuggacuguugagcaggccugucucucuuauuaaguaaaaauaagaaauagugguaaguuuguaagcuauucugacagaaaagacaaagguuacuaauuguauaauagcgcuuuuauauggaagacuguacagcuuuauggacaaauguaaacuuucuuuuuuguuuuuaauaaaaauguagcagaucguguaauguguagagaagguggaauuccauagcgcugacuggcccucuuagauacaaaccccuucguguuucguggacuucaucaguuguccugagcuccgucugcagcaugcagacguuauaaaagauacccuagguuugugacgagguugcuuccauugcauccccucuccuugggaggcggcuccauacuucuguccuugugaauauugucacaggucucuuaaaaaacaaacaaacaaaaaagcccaaaaaccaauauguuaucugcacacucugcagccaguuccauaguuuugcucuuggccauucagcacauugaagagcuggccagcuguguccacaucugcgcaagcaagccaccacggcuggaaacuauauaaagaaaagaaaccauccagaaaguuccaaagacacaagacuuggguuuggcacacacuaagcacaccagugcacucgaugcgacugc

SEQ ID NO: 12280 - RNA, 72702 nt, Mus musculus
acgucgucggaggaaggcugaaaaagcccuagguguugccguugcuaguagaagucggaccugucgcccgagcugugcgucugcacggguuucggacggagcggagcucgcugccgcgguugcggagccugcccugugcucgccccugcccaggucgcggugauggagccggccaccacgcugcccccaggcccgcgcccggcgcugccccucgggggcccgggcccgcugggagaguuccugccuccccccgaguguccggucuucgagccgagcugggaagaguucgcggaccccuucgcuuucauccacaagauccggcccauagccgagcagacugggaucuguaaggugcggccgccgccggugagucagccagcaccccggauccugcucgcggcugggggagggagcgaggacgcgcggcccgggaggccggaggcgcgggggcggggagcggucgucccgcgggcccggucaaguuugggguggcuccgagggucggagaugcggcggugggaggaaggcgcgggggcccccgucccgggugggaugugggccgugaggaccgcgggcuccggcggggcggccggagggggcuaggucggugcggcuccgggggcuggugcgcugcaccgcccggcagcggugcgggcuggagugguuggcagccgccgggguggucgcuggggaguccucccgagcccggcugagacgcgggcgcggaggcagggcucugggcccgcacggcuccguggcugguccucgccuccuucucggggugcgggggugugugaugggugggggugggggacuugcgaguugucgugugaggaggaaaguuuucaauauggcggcgggagccccugguccuuugugugguggcggcgucggcccgaagcugcccucaccugagcgccccacccuccggacccgggucccccaccaccaccuggucccucggccucugggaguccccagggcgagcugggccagggggcggccggcgcuacugggggaggggaggagccgcugggccggucuggagcggcugguugagugguggugggggugcaagggucgggguggggggacgacacuuugaggauggugggggcaggccaagcggcgggggcccugaugcucgcagguccuggcggacgcucccacacggacuuggggccggacugcuuugcucccggcgcgggggggggggggaggccuggcuggggcugagguggagaggcugugcuuguaggggagaugucagacgagcucuuggagauuucauccuggucccuagcuuucccuacucggccuucccggcgggggcucuagcgccucgagcuuggggggcucugaggggugggguguccccaagacggcccuaacggcugcaacguccgcggagagcccggcccacuccuuccccguccccgucccccuccccguacccccuccccccgcagccggaacuggaugcgcugcgacaccccagguuuuucgccuaccuuuugggaugaccugagucugaguuggccuaaacgaccguuggaccggccgggucgguuggaaagguuuaacugccuugccuaccguuuaagaauuuucuaucuuucccugcucucaagugaaaaagacccccccccacgccuuuuaccccuuucucccuuaaacuugcucuauguaauggcauuuugauuuaggggauuguguacguagacguucuagaaaagauguuugcgagagaucccugaauaaagccuuauccuuucacuacccccacgaaagaaaaauuaaaacacagauaccauauuuuaguugcucuuggacaacuuugaaagcagaaaugaaaugccucagaaaauaacuggccaggucagcuaguauggggggaaauguuuggaaauagauucauuucuucuggugaaauggacagaggcgauggaagguuucuuuuacuguagaggccugcagaaguuacacccuugccugguuagaccuaggguuuugauucugaaauguggaccacguuucaaacauugagcgauuuagcuuuaucuuaauguaccaggaaagaugaaugugacuguugcaugcuugcauuaaugggauuuuuaucuagaaauuaggaaacuugacaaaguuauuagaaaccaaaaucuaagaggaguuaggauccugugaguugcccuccauguuggcauuguggcgcacuaggacuggguagguccuuuuucuuaccgacuuugccuuuuauagagcuauuuucuucgaaaaauaguugcuuugguuagguuuggcuacccauuuccucaugugggcuagcagcuuaauggcagccuuuaggauuugugcauuuguuuugcuuuuucccauucugaauugucacacaugauggccaccauuuucuauugagacuacuauauacuacagccugagaggagaagggguaaagaggaagaaauaauguacaaacauaacuguuuuggagccuccuuugugugaaggggacuugcuuccuccuuuguuuaacaaacuccugugucaguguggaagaguuugccaguauuugcuguugauagaaccacaaaaagaaaacccagaaguuguagcucuugaacagagggguccuggaacaaaggcuucuuaagagaccauaaacagucuuuguuugggaaauguuuuguguuaggaaagcuggaacaagugguuucauauaguugaaauguggcaacaaaaaaaaaccucuaagaaauaagaaauauuuuuuuauggugcagucuuuuuuuauaauuccucuaucuaaauuucuguucauugagauuuuggaacucuaauggcaaaauuugaaugauuuggagguugugguauacuuuuagggggagaauuauaaaagcguuucuauuuccuuuuguucuuagcuuuaauuuuuaauuaauaguacuugaauagcauuggucuguaccuagugagggucuuaagcuucuuugcuuuuaaagcuuaggguguuuacauuauuuuguguaugaguacauaagaguuaacagaaauuuguggaaauacaaaacagcaagguagcugaugaaaugaugagucaagacuguaugcaaaccaaguuuaagacaguagccagaagagugaggagagcuagacguacuuuccgaggugagacauugacuuaauuuuacuuguuuuuuauuuucuauaaaaugcaaguauuaaauguuuaaguacaaauguuauuuucacuguguaguauuuggcugcuaaguagauauuuucuugauuuuuuuuuuuuuccaaugugauagaagugugcgauagcguucagauaccuaacagcugcaguuaggcagaguccacaaaauucuccuuccuuaaaggaaugaccaaaagucagauuuaaaucaagccccagauggcacaauaaagacuuuuuuuuuuuuaaguuuuuaacuucuuuugguuguuuugaauccucaucuccaucuuuauagccauuacauauaagacuguuggaaugaaguuggcaucuuggagugagugagcuuguuaauuccacuuggagaacaaggaggaacuuaaaauacacuuuguaagaaaugcuaauuacaacauugcuugagggguaggagcgugucucauuuggcugaauccuugaacucaggccugcugggguuaaaggugugugcugggguuaaaggugugugccaccacaccuaccucuuuuuuugggggggcggugucaaauguggaacccugccuguccuggaacccuaucuauagaccuggcuggccuugaacucugagauccaccugccucugccucccuagugcugggauuaaaggugugugccaccacuguucagcauuuuguuuuggcuuugcguuuuguuuguguacauuugcauacaugugugcauaauauacugcagugcaccuguugaggucagaagacaguuuguagauguagaacucuggacugucauuuggguucuguaaucaaauucaugaacuugcuuauuuaauuuggagggcaguaaaagucaaggauguuuggaguacaggaguggguaggcaaaaguuugcuaaaauggcaacuuauuuuuagaguguuuaaaauauauauuaaauacauagauaugcauauagccauauauagucuguauaguuuaugugcaaugaugggaucauuuuauagacuugccaccuuuuauuuucuuugugauugauuuuuacuuuguguuuggcguguauauaugugaccaugggcauggcuguuguccagaggccagaaaagggcaucggacggaccccauggaauugaguuagagaggggagugaucugccauauaggugugggaaccaaacugggcccuuugcaggaccagugcccuuaguuauugaagcaucugugcaaccacucauugcugucuuaguggguuuacauuagcacuuuagaaagaagugagggcuuagugugacagcauaccagccugaucaguuccaggcuggagcuacauaguaagaacccaccgaaaaacaaaacaaaacaaaaggcuggagaaaugguuuagauuaagagcauuuguugcucuucuggaagacccagguuugauuaccagcauccacuugguggcucacaaccaucuuuauccaguuucaccagauuguuguuguugccuucugacuucuacggguauaggcacucaugugguguucauauauacgugcaggcaaacacuuaauauguguaagucuuaaauauuuaagggaugaagaguuggcuguaugauuaagaguuauuuacuggccgggcgugguggcgcacagcacuugggaggcagaggcaggcagauuucugaguuugaggccagccuggucuacagagugacuuccaggacagucagggcuacacagagaaacccugucucgaaacccccccccccccaaaaaaaguuauuuacugugugugcaaacaugaggacuggaauucuuaaucaaauauccaaacagccacauaacaaauugggugugguccauauucucuuguaacucuagcacugagugggaaguagacaggaggauugcugggguuucccuggcuuccagcccuuugcagaaagugauggaggacuguacuugguggccucuggugcaugcuguagcacacacacaucauacaugcagcacauucacacauguacacacauacucuucuuacauaagacuuugaaaaucauuuaaaucuuuuuuccuggauauaagaauacuuuuuugauaaagccauaacuaccaggguagaaaugaaguuuaaguguuuauuguuuguuugugccucuguuuguguggaaggaagugagcaggugcacacguguccugcuguccuguggaggucagaggacagcucucaggaguuguuuucucaguccacuguguuuuggagccaggugcuguuucugccaggugugcuucuggcuagcuguggagaaggcuucagagugcggugugaccacagagacaugccaccgaaucuggguuuuauaugggucccagggauaaaccucagguugucgggcuugugcaacaagugaaaaguauuuucacucacugagccaucuagcucucaguccccuaacuucuuuuuuuguuuguuuguuuugagucagggucuuucuguguaauagcucuggcuauccuggaacucuguagaucaggcuggccuggaacucagagauucacuugcucuggccguccugagugcugggauuaaaggcaugggcuaacaugcccggcucuguuuuguuuuuuuuguuuuuuguuuuuuuuaaagaaaaaaguuacuaguauggaaaauaauugcuguagcuauuuuucuagauaaaagcaaagggcaguauuccuggaaugaggaccaagcugauugauuguagagaagaugagguuuuguccuguugcgguuacacagguaacauugcagcaauucagagugagcucucuagucuuuaaugcgugacggucacgugccuaggugagcgugggguuauagugccuggguuuuagccagugcuuugguugccuuuuacaguuuucagaacuuguaaagaaacuugaccauuuugggaacaacuguuagcagguguagagguguggggaguggguggucggauuuccugucugccuuguuccuuugcuggaauuggccauauuuuauaucaacuaguuuggaagggacuuucugcacagauuagcccuuuugucugacagaacaguugagggucaggagugcucagggaagagaaugaaguagccuuucuaagauucuuaaugugugauuagguucuuagguaacuuuucuucugugcaggagaguaguuuagcuuucagcauugaugcaauuucugugaguagaauugcuaguuaacauuuuauaugguguuaguuuuuucuuccuuuggugcuauuggaaguccuuguucauguuuggcaaguucuguaccaucaagggcuguauauucccaguccuuguuuuguacuguuuugagacaggauauugauauuuuuauuaagcuagccuggaauucccagagcaguucaggcuggccucaaacucaguacuuugcuuugaauucuaggauuacaggaguaucuuaacauacugggcagacauccccuuuaauuuuaauuuucuuuuaauguuaagauaaaguuguugccaggcauggugaugaugcacaccuguaaucccaguaucauaaggcaagaggagagaauguuuaaagccagcugcucaucucuuaaaaaucuguuucuuccaagaaauauuuuuuuagggauaaacauuuuaucaaaucugugcauguuguguguauucuuaaaagucaguuuauuauguacaaggaagggcuauuuuaaaagcugccuagaguuguuuuuuugugcauccguauucauauucgugccugcaaaugacugugugcucauuucguggcaugugcacacggaggucggagaauaauccuccugcguguguguugguucauacuuuuuuuaaaaaaagauuuauuuauuuauauguaaguacacuguagcuguccucagauacuucagaagagggcaucagauuucguuacagaugguugugagccaccaugugguugcugggauuugaacucgggaccuacggaagagcaguuggcgcucuuaaccacugagccaucucgccagccccugguucauacuuuuuguuuaagacagccuguuuuucuacuguguaugccagguuacuagucuucacacuucugccucuccuugccaucuucccauagaagcccuggaaugaggaaugcuguuuccaugugguugaucuucauguuugugcagcaagcuauuuuacccacugagccaucuucccagccagcccuagaauuuuuuaaucugguugcaucaugaccuuggauaaagucuguuuaccccaguguguauaccuucucaucugcucuaaagggaucugacacugaccgagggcuacugucuggguuaauuaauggauugcaggagcuuaaaucuucaagucucccuuccccccauccccacccccuuccuuugcuaagaagagucugggaacagauguagcaagacagaaaagucugggacaaauacauaucccucauuuuccuacagagaagaauugauuuuagugaaauuaggaaaggcaaaaaagcccaacaccaucaaagcuagaauaagaacugggcauggucugcauuccugucugcuuuaguuuagaggcaggugaucaguuagaggccagccuggcuuacucauguucuagguuaguuuuggaaauacaacaagaccucccaaccccauuucuaacccccaauccuaggauauaccuggaugugauagguuauucccagcauccaguaggcagagacagaaucaugaguuuaagaccaacccaagauaaauagugaaaccuugauuuuaaaaaauccaaacuagggcugggugguggcacacaccuuuaauuccagcacuuggugggcagaggcaggcagaucugaguuuugaggccagcuugcuucuacauaguuaguuccaggacagccugggcucuguuacaggagaaacccugccuugaaauaaauagcaaccuccccccccccccaaaaaaaaaaaaaaaaacuaguggauacuggggagguuaacugaagggcagccaugaggaagucauggcuggugagacucuucagugauggcucuguuuugggguccuguaaguaaccccucaaccauuaucugggaagcccaauaaaugcacugaaagaaaacccacacagagaagccuccccccacaugaaucuaacaaguauaaucuuccuuuuugcuugcuugcuugcuuguuuaugagggguucauguaacccaagguguccaugaacucccuaccucccagguauugaauuguagcuuugcauuaucauauucuaguuuauuccuuguuuuagauguguaaauguuuugcuuguguguguguguguguguguguguguguguguguguguauacguacuagugagugccugaugcuuaaaguggucagaaaagggcaucggauuccccuggaacuaaaguuacaaaugauuaugagcugcuucaugggugcugugaauugaaccuggucuuuuggaagaacagcaagugcucuuaccacugaaccaucucucuuguuuuuauuuuuuaaagauuuauuuguaugcauuuauuuuggucuaugugcaugaauaugcauaugugugugggaauucagguacuuaacuugugcaccuguagaggccagaaaaggacauuagagcuuuagaacuuggaauaacaguguugguggauauccugcuugagguacugguucugggaucagaaccccaguucucaugauugugcaacaagugcuuuuaacugccgagccauuugcuccagcacuguugcguuauucuugagacagggucuuacugugcaguucaggcuaacaucuugguugauucagguguagauuuucucaguaccugaaucuuuaauuugaagccugccggaucuauaacugaaaaacaauuuguguaugugugugugugcgcgcgcaugcacacacaccuguauaguaacagcaauugaacuagggccucacucuugcuaggcaagcauugugccagugagcuacagccccagcacaucugccacuuucugugucacaguguuuuaaaaaauagacaaacuuuuucaaugaaaguaacuagaauucgcaaucagaaaaacuuggaacucugagucuggagauuuauggaucuuauaaagaaccccauuggguuccuagugcccaugucaggcuucuaacugccuauaaugccagcuccaggaguccaacuccucagacuuccagggacauuugaagucacaugcauauagagacacauaacuaaagccuuggaauuauguagucucuucuauuacuucuuagguggaccuauauuuuauauuuuacuucucuuuggugggccuaugcauuguauacuuuuacuguguuuuuacuacuaugcuuuugugaguguauguauuagucuuaagucaaacuuaauaauguuuucuagauguauguaaguacuguccagcugaagggauggcuugcucauuugauacaaugcuugucuguaugaaauaugagagccugaguuugagaccaagaaauauacaaaaucuggcuguguguaguagccuauucuggucauacuguucauugcuggggaagcagagaacacaggaaggugcuuggggcucacuagccuaucagucuagccuaauugucuaauuaucagucuagcugcuaggucaaccugacacuuuuuuuuuuuuccuccagagacaggguuucucuguauaguccuggaacccacuuuguagaccaggcuggccucgaacucagaaauccaccugccucugccucccaagugcugggauuaaaggcgugcaccaccacgcccgacuccugacauucuuuuuaaaggaguuaaauguuauuucaaaggaauugacuguccucucugaccucauacacuccucaacacaugugcaccugcauacauacacacucauuacagagacacuucgaugauaguaaggccugccugcucuuaguguguuuguguaugugcaugaugugugugggugcacguacuaugccaggccguggaggucagaggguaacuuugucaagcugauucucgcccucuaccuucauauggcuuccaaggauugguuuguaagguaaaaacuuaacuguggaguuaccacuagagcccgccccauccauguacuaaguuacgaucuaugucuucaaauguuaggcauuuuaguugguaucucguaguuuggcuagguucuuuuucuguguucuccauguggccaguccucaacauuccaucuccgguucuuugucuaggauuaagauaucauccuuauucaggccuuguuuaggcagucguguugaagagucucuauggguguagcuucucuuaccaaacuuccuauucuucugguucuuaagaggucucccacuuccugcugcuaugauuccugacccuuuuguucagcaguuguguugcagauguaucaguugggcugggcaccgcacuuguucuuugcacuuugagaggcuguaguuuucuguagugaucucucuguuggugucucuuugagagaugagacccacacugaucuuuuucuuaauguccugugugacauugacauguauccuguaggcuacaguugugaaacacuguuuuacucuaauuguauaaugccaggaacagaacaaauccccgcuacaccuccauacuuagagagcuuuaggcaggagucuccugguuucugugugguuguaccaggucaucauuuggagauauuucagccagauggcaacuucucuucuuugccagacuauauuugaagguagaagacaaaguagguucucuuucuucacaucuauacucugguccuuguguguguguguguguauguguguguguggggcaaggaggaagaguggagaauggaaaagguguguuuuuugaaguauaaccucuacuuuguaaaauucaaaguauuuaagauucucuuccuugaggcacccauccacuaugaugcuguauuuggacaaauugagaagagucacuagauuuuccaguaugaggagagauagcuucagggauauguagagauuggguuuugauuuuauuuuuuuauacuuaaauuguauucauucucuuaguuuuuucuuucauuguuaaucugucuuuuacuauuuucuguuuguaaaauaugucuuugcuauaaauaauggguaauuguuaucagauuuuuuucuuuuuuagagaacaguguuuaggauuugguuugggugugguguguguuuugugugugcaugcaccacacacacgugcauaggacauucuuaggcaucuaguaaaugaaaacuugaagagaaaaaguuauuuaguaaaauaaaaauuuccuggcuucuggugacauuuucauuauuacguuauccuggacccagacuauuuucagaguuuuuuuuagcuugcuuauaaaagcaaaauaaugcugacccaucuuuacauccugaaguuggaaggaaagagauagugugugguggaacuaggauuugagccuagacaaugaaggacuuuaguuagugaucauuuauuaagaauaaagaaauagagacaugaucuaacuuugcagcccugucuggucugaaacucguccugcuggcaugaagcucugucugcuucugccucaggagaagccacggcacccaguggcuuucucuucuuucuguuuuuaaagacuaauuuaucuuuuuaguuuuucaagacuuuuuccucuauagcucuggcugcccuggaacucuguagacuaggcuggcuuugaacucagagauccaauugccucuacugccaugagugcugggauuaaaggggugugccaagauuaauuuuucuauagcccaggcuggcuucaaacucaguuaucucaucuuaugcaggagaguauucaugcuauuguguacagcuuuuuuuuuuuuuuuccuuuuuuuugagacaggguuucucuguguagcucuggcuguccuggaauucacucuguagaccaggcuagccuugaacucagaaauccaccugccuuugccucccgagugcugggauuaaaggcgugcgccaccgagcccggcaauuuauuuauuuuuauuauauguaaguacacugucuucagacgcaccagaagagggcuccagauauuguuacgggugguuguguggcugcugggauuugaacucaggaccuuuggaagagcagucagugcucuuaaccucugagccaucucuccagcccauguacagcucuuuaauagguuuaauaaaugcagcuuuuccuuucuggucacugaaauauaaagacauggcaauaguaagguacagauacagaacguuagagugucauuuuguauuuuuagggaguccuaacuggccuugaacucuuaacagagagugacuuggagcuccugauucuaaugcugcuaauauuaggacauaaacgacaacaacagaaaccacaaaacaagcagaaaagaaaguguguauguguguguguguguguguucaugugcacgggguacauaugaucaucagagcugcagucaccucagcuugucagguuugacagaugcuuuuauccacugagauaucacuuauacaguggaucauugauaccaaacagccguuuaaaugauggccaguuccuuuggcugcaguuuuuucauauuuuaggcuaauaacuuauuuuggaaauguagcaguggauggaagaaguaaacaacugaaaguuggagacagcguuuaaccagcgugauggaaggaagcugcuguuggauggcagggaaaugcccacuuacaucuuuaauugggcaugcucauuacauccuuuucacagcgaugcuuacagacuguaauccuacacuugacaggcugagucaggaggauugugagccccugaacuauguaugaccaggaaacuuugccucagaaaaaaagaaccaaaaauaaacaaaaaauaagcgggugggugccuuaguguauuugugcugcuauaacaaaauauuugauaaggauacuuuauaaguaguaguaguaguacaaauucuuuuuaaauugucaaagcuggcaauuguagauuagacucuccuggguuuccugucuuacaagggcaagcuaggucucuauacucaaguauagaguaguagaaggagaucuagacuccuaggagauaagaauaagagaaagagccuguguguguggggggggggagggaggagagagagagagagggaggaagaagagggggaggaggagggggaaggagggagggagggagagagggagagaaaaggagagagcagggagcccaaauugucuggguuggaaaauuuaagguugggggcagggugugcuagguagggacugaaggaugcugggagaaccuggagaccaggucugcuuugauauguaaaauaugcaccccagucccuugucccagugguguauaaccaaacagguuuaaauucaguacuauuugggaucauacauguuuauuuaaaauaauugucuccauccuuaauguuagcauuacauuuaauuuaccaaacguguagcagggcuaaaucucuauacuucagaagaaaguaacgcaacuuuuuuguuuuugaugcuuuuauuuuuauuuuauauacauugauugguauuuugcuugcacauguccgcgggugucagucagauccccuguuuuuguaagaugccacauggguucugaguguccuggaagagcagccagugcucuuaacugcugagucauaucuucagcccuacugucuuuauuuuuaauuaauuauuuuuuguuuuguuuuucaagacggguuuuuucucuguuuagccuuggcuguccugcaacucaauuuacagauuaggcuggcuuggaacacagagauacaccaccacugcccagcuugguuuauauuuuugagacaaagucucacaauauauauauauauauauauguagacuagucuggccuugagcucauaggcuagacuaucucugcuucucuagugcugggauuaaaggcaucaauucauugggaaaaaaaaaagguuguuuuuuuuuuuuuuuuuuuuuuuuuuuuuuggauagcuucuuauucuguagcccaggcuggacaggcaccuaggcuggcuuugaacuucucugagcugacacucuuucucucccaacuuucugaaugcugggauuaagccauaccugauuuagcuagcugacuuguuuuuguuggagaauacacacacacacacacacacacacacacacacacacuuggcagugcuuguaaccacucagucaucucucagucccugguuuaugcauuuuauauauuuuauuuguuuuaguuuuuccagacaggauuucucuguguagcccuagcuguccuggaacugggacuugaacuccuccuguuucuauuaccaaguaguaggauuaaaggccugccaccuuuaaaaaaaaauuuuuuuuuuaaauucuuguacaugaagugcuucuccuuaaggcagaguucaagagaucagcauugaaaaugaggaagacaaggauuuuuuuuuuaaagcucagggguaagggguuuccgaauggaaaauaggaaauaggggauuuggcaggcaaauagguuguguuaccugggcagagcauuggguauaaaaaguuaguuucaacgaccuccugaacaaagacaugauugcacaguaggcgugaugcacagcauagcaagguggucacagaaccuuugaaauaaagaaaggguugcaagaugguuaugaacaacguuguaaaacaaagacaugauugcuauuccuggaacaggcaaguacagaaccguuuguaguuaaggguuacaguagggcauagcccaauucuugagaaacauguuuaauuauaaacagguaugaaccuaguuugucuuuuguuuuguuuuguguguuuuuuuuuuuuuuuuuuuuuuuuuuuugguuuuuuucuuuugagacaggguuucucuguauagcagaccaggcuggccucgaacucaaaucuaccugccucugcuuuucaagugcugggauuaaaggugugcgccaccacugccuggcuaguuugucuuuacgauggcuuuucaguuuaggauggaggcaggugcuucuucaaagagcagcuaucaagcaggagucaguggugacaugggucucucuugguuuuuucugcaguguauuccaggguagcucaccuaacaaaggggcaauuccccugucuuuaccuuccaucucugugcagggaugcugagucacaaaugugugccaccuucuccagccuuggguuccuuggguuguauuucgguuguuagguuuguauagcaugcacacuuaccaucuucccuaaauguucuuugagacugaaguuguuuaaagcugaagguuuugggccucagugaauaaggcuaucugucaccaagccuggcaauuugaguucaauucccagaacccaaacaauggaaggagagaaugggauccuucuugcccauuauuuccugaguguucaagaaaaccaaacugguggcuuguugacucacuguauguaaucuuugcauucuagaggccaaggcaagaguauuauugaguucauacucagucugggcuugauauugagacuuaaagcaaaacaaacaggaaaguuggcuuuccugggcauauccuauuaauuuguacauuuuauuuuugcacugcuaaggauuggacuccaggucuuuugaaugcgugguaaacugcauucucugcauucucccauauuuggauuguauuuccuuccuuccuuccuucccuugccuccuucccucccucccucccucccucccucccucccucccucccucccucccucccucccuuccuucuuucuuuuuuugagacaggguuucucuguguagcccuugcuguccuggaacucacuuuguagaccaggcuggucuugaacucagaaauccaccugccucugccucccgagugcugggauuaaagacgugagccaccacgcccggcuuuuuuuuuuuucccccuuuuggagacagcgcuuuacuauguagcucagauugucuuugaaguugugauaguucuuauacuucaguucuccagugauggguauauaacaccaguuuaugaguuagaauucuguuguugacaggaucucaugaagcucaagcugaccuugaacuucuuccuguguugcagagguugaucuaaauuccaguguugggguuacaggcaugugccacacuacuccuaguuuuagguuuuuuugcuuguuuuuuuuuuuuuuuuaaauaguugucuucuguuugugcuucucaaguccuuaugguaauuugugucaccccagcugaaaggauugcuagucuagcuuaaaauacucccuaaaacagauuucuuuggaucuuaacaauuuuguucugaaguuuuguguuaauuuuuaaaaccuauaaacuguaagaauauagauuuaggcaucugcucuuccaucugcuggcauuggauuguaauccugugaauacauaauucugaugaugaaaaugagauuaauauauaaguaaguaaaugcaaagaaaaaaaucaaacaccuuccauaaucuggaugacaguuucauagaguacaauuagaacaauguuucaguccuuaauguuauuuuuuguacuguuagcaaauuaauaagaauacgcucuuauucugauaaguuuuaaaauuuauaaucauuauuaccaucaucaccauugucagcuuuuugagaccguauuucucuguguuguccuugaacucacucuguaaaccagucuggccuuaaacugccuaccucugccuacuugagugcuaggauuaaaggcacaagccacuaacaccuggucaaauuuucuuaauaucauauguucugauuauauucuuucccuccuuaacuuuucucagaucuuuuccaccucccucccaccuaacuugauguucucucucuucucucuagcucucaaagaaaaaaaaaaccaaguaagacaacaacaaaacccaaaauaaaaccaaaaccuaguccccaaauacccgccaaaccugggccuaggguuugccuugauguaaggucaguagcucaugacauuagcugcagaaaaugggcucuccucuccaagcacauaucgaugcacagagcuucuuggcuuaggggucagcuuuuuuuuuuuuuuuuuuuuuuuugucccacuucccuaucucaugcugggauuuugucugguuugcugaggugccugugagcucuucuguguagcauccugcuguguuugggaggcucuacuucuggauucauucucuacuucuggcucuuaggaucuucccaccuuuucuuccuuuauagauuucuugugagaaggguuugaguuagacauuccuuuuuggacucggauacgugcuccaaacccucuuacacuucaggccgucccgcuguggucccaggguuaauuacugucugcugacagaagcuucucugaguugagccaaugucccuaccugguguggccacugugagucauagacucacagagacuggcucugagggucuggcaggaaggaggcagaaagcauggagauguccuagaagaaaggaaccaggagaagccuaggucuguccaggaggcugcaaggcagccuccucaagaauggucuguugacaccaaguuuuuaguugguuugccuucagggcucagaacacuaaauuguguagcuucuauugagcauacuuucucauuuugcuaauuauuagaccucaaaaugacgacagacuuucuguaauuaaaaacaucuaauauguuaaauauauguuaaauauauggauacuaauaguugguuaucucuugugggcuaauuuuugcuuuugaaccguuacaguuaaaugugccuuaagugguuguugcuaaguuaguacuaaggaagauguuuacuugcuuuucaguccucucucaggaccuucagucuucagcuguuugucuucccaaggaauacauuucugacugcuaaggaaaauaauugagccuuuuaauaauacaauucucauaauuucuguuuugaaagaguuaaagcuuuuaucggguggugguggugcacuccuuuaaucccagcacuccaagaugcaaucagguacagguggaucugugaguucaaggccagccuggacuacagagugaauuccagaaacccagggcuauacagggaaaccugucucaaaaaacuaaccaaucaaccaaccaaccaaccaaccaaccaaccaaccagauaaacuuguaaaaguaaaggaaaugacaauaaaucucagcaggauauuuauguagaacugccuuuuguagucuauaaauuguuuuauuuuacuuuaaagaaauauuauuuaauguauaugaguacaccauugcucucuucagagacagcagaagagggcguuggauggcauugcagaugguugugagcuaccaugugguagcugggaauugaacucaugaccucuggaagaacagucagugcucuugcucuuaaaagagcagucagugcucuuaacuguuaagcccucucuccaguccuuauuucacuuuuuuugagacaggguaaugguuuguauucccgccaggccuaguacucauguauagucuagcuugggcucaaacucacaagauaucuauccuccagccucagccucccaaaugcuggcaugggauugagccauauuaucccuggcuuacuauaaauaaacuccuauuguuacucauccuugcaauaggaguucuguuauucuguguaagagugaguuaugauccacauuuugguaggggauaaaaauuuuaccuuuuuuguuagauuaccuagacuuugucagauaugucuucguucucuugauaguugaguaccuaaauaguguguaguuugaauuuuaggucagguaugguagugcaugccuccaauugcagcagaggcaggaagaccacugacuuaaggucuauauacauagcauuccaggucagucagggcuacacagugagauucuguuucaaaaacaagaaccaaaaaaaucaaccaaccauccaaaagaacccccauaaacacuauuaagugccuuuuuauaaugauuuccuuucuauaaaguauauuuuuauuuauaugacugugguaaguuaagaggauaacuuuuggagucuuuuuuuuuuuaagauuaaaacacaacaaaacaaaauguguguguugguguugacagaagccagaagaggcagucagauuuccuggaacuggaauuacagaugguugugagcugccauguagaugcugggaauugaacucacauauucugcaagaguagcacgugcuuuuaaccacuggaaauucucuuccacccuucauucuuuccuucuaccauggugcuagggcucaaacucagcuuaucaggcugugccaugagcauuucuacaagcugaaauauuuugccagccuguaacuucacaauuuuuccacuuucucauuuaaaacagucauaccagaggccagacuuugccaaggaugauuuaguucuuuaugcguaucugaauacguauuuauuuauuuauuuauuuauuuauuuauuuauuuauuuauuugagauaaggucucucuauguaguccuggcuguccuggaacaauauagaccugcauugccuugaacucauaaaagucuaccugccucuucuccuccugagcgcugggaauuaaagguuugugccaccauacgagggccuuguuuguacuugacauugacguaccauuuugcuugaucucucuucucugucuaucugucugucugucugucugucugucugucugucucuguagcuacaaaagguuugaagugauugguauugaugaaaaauggucuuaagcuauuuuauaagaacaccugcuacucuuuuuuuuuuuaaagauuuauuuauuuauuauauguaaguauacuguagcugucuucagacacuccagaagagggcgucagaucucauuacggaugguugugagccaccaugugguugcugggauuugaacuugggaccuucggaagagcagucggcgcuguuaaccacugagccaucuugccagccccuuaagcuauuuuuuaucucucuucuaaucaucuuggcaacuuaauguuuuccuuuugauaugucauuuugagaauuaauuuuauuugaaucugcaaacuaagccugcauaauacaugcuuaugaaacuuuaucguguguguguguguguguguguguguguguguguguguguguuucugugcacgugcaguguguacuccuguacuucuguggaggucagaggauaacuuuggagaaucaauacuuuuccuucuguguacccagaaacuaaacucaggcauucaaggcuugugugacaaaugguuuuaccuacugagccaucucugggccacauaaaacaacuuuuauauguuucugagaacauaaucuccucaccccuccucagcauuucuuauagcagaggcuggccuugcccaacccugaucguccuaccugugugccacaggagugcagugccauaccacaggaauaggacauuuccacaucuuuauguuuuaggauaggaaagcaugucaggaggcuggccagucagcgaauaaccugucuauugucuuuaguucuuaguguauacaaguuucagaccacaaggacagaacaugguucucugugcugggaaggugacucagcagguaaagacacuagcugccaggcuugaugaccugaguuccacucucaggacccauaugucuuagcuuuucugauacauuaucuguuauguuuugaacuuaaccuuuaacugugaccaguuccuccuuuccucccccauucuucccucccucccucccucccugccucccucucucucucccugccucccuccauagguucccuccucacuacuuaacugggguugaaucuggaaccucagguaaaccaggugaguguugugccacuguacccagcccagcccuaguccuuucugaaagccaguagcuuuuguaaaguacaagagagcaaagcucugaacacgucuuucucuuacuucgacacugugcaucaagaagcaguguguuucccccccccccaugacaucuuguucuguauaauuuaacacaucaguaucuaaacauaaacuuuaaucucuuugauucaauggaguauuuucuguuuuuuuucccccuacccagaaagaauuuugcuauguaguucaggcugguuuagaauuuguugccuucuuauggaagccuauugagcacuuauguuuauggucaugcuggcacaccugggcauggaauacuuugugguuuugauagggucucaccccaggcuggccuuugcugaagaugaccaugaacuucugauucucuuuguacuucccaggugcugggauuauagaggucaucaccaugccuauuuuauuguuaugcaguguaugcuggacuuguaugugugcugugugcuugcuggugcaggcuucucuggagacaaguuugcacugagaugacuucugggaucugccucucaucacagggguuacaaucaggguaacugugcucagcuguguucuuuuuucuuuuuucuuuuuuuuuuuuuaaauucacuuuacauuuugaucgaugccuccuucucccaguccucccucauuucuccuucuccucugagagggggaaagaccccauccuguguaccacuccacccuggcacaucaagucuucaggaagagucucaggaggcagaggguacaaggcgcucaggagaacuggauccauagacagacaacagaguuaggaauggcaucuacuccaguuguuuguugggggaccuccgagcugcacaucuguaguucagcccauguaugcucuuugauugguccccuuuuaggggaucccccaagcauccccagcuuuuggcucgacucccgaggguccagauuaguugacucuggucuuccuauggaguuccuauccccuccaggucccucagucuuccccccagcauuuucccaguggugggcugugggucucugcaucucuuucagucagcuaguggguggaaccucucucaggacaguuauccuaggcuccuggcugcaagcauaacagaguaacuaucauuacucaugucagggauuggugcuugcccaugggaugggucuuaaguuguugccagccauugguuggccauucucgcagucucuguucuguuuuugucccuauauuucuuguaggcaggacaaauuuuggguugaggguuuugugggugaaucggugucuuuuauccacugggaguucucccugaccacaggagguggccacuucaggaugcauaucccccacugcugggagucuagcuagagucacccuaauagcugucccccaucucaggucucugcaacauccuagagacucaccccagccacugaucagcucucuggcccccuggccuucucuccugucccucccuacaccugauccugaguucccccaacaucccccaucccccuuccauccccuuccccacccaguucccuuccucccucugucuccaaaggcuauuuuauucccccuucuaagugagauucaagcauugaaucucaugggccuuccuuccuucuuguuuaacuucuuugcaucugugggguauaucaugggcauucuguacuuuauggcuaauauucacuuauagugaguacauaccuugcauguccucugggccuguguguccagcuuuuauguggguucuggguaucugaacucggguucucacagcugcagcacaguaagcacuuugcagggaacuacuuaccagcugcuccagccuagauuuuaugucaugguggggauuaaagccaugucucucucugugguugcgcgugugugugugugugugugugugugugugugugugugugugagagagagagagagagagagagagagagaugguugguuagucuuaguugucaaacugaaaaucaccuguaugauaggacucuaggcaugcauggggguggguuaucuuacauuaaguggggaaaaaccaucuuaauuguggguaggaccauccccugagguaaaucuuggacuguauacagugagaaagugaacugaguagugggcugcauuaauuucucucugcaaacaggauguggugaccagcugcuucaagcuccugcugcuuguacuuagggccuauacucauaaauuguggguugaugaguggaguggggugggaugggggaaugcgugucuccugcaugugcagacuucucagaauuggacuucggaccucccaguuggauuugugggucuacaggaacuuccaguuuguucugggugcugggaucuaugcuuaauccuuaugauuccacugcaagcaagcauucuuaagugcugagucaucucucuaguccaagaguauuuuauugaagcagcaggacaguaaaguaagcucgacaggagugagcacuucaccaucugagacacauccccagcuugaacacaccucuguguaggaaauuagaggguaggcugugaaucuccuugaguuaacauucucauaaucuaauauacuauuuaaguauuuuggauuguauuuaaaucaaguaaagaagaaaaauuaccagucuuucuuucccugucaauaaaagucuaucuuacacuguuugucuuuccuugccaguuaaaguacacacuguaaaaaucacuguagccaccaagugcaugaguuuugagccuuggugcuuaaggcugugugcaugcacagucacugucuagagcuuucacuauuccaaagugaaguccgaaaacagcauuuuauccuuucaggugcacccuuauuuuagguauuaaaguuaucuuccuguuucuuucacauuuagggaauaauuuauacauaauuuucuuuuaaugggcugcacucagcaucuucccacauuaagcaaacauucuaucaccaagccacacccucccuuuuuauuuauuuauauuuauuuauuuauuucuggcuuuaccagacaggguuucucuguaugucccuggcuguccugaaacucacuuuguagaccaggcuggccucgaaaucggccugucucugccucccgagugcugggauuaaaggugugugccaccacgcccuagguaccuuccaucauucucuacauuuuaaaaaacgaucuguuuaguauuuauaugugggugugguugcaugcaggccaccguucauguguggaaguccauccucuccuccucuaucuaccgcaugguauauaaagaccaaacucaaguuuucaggcuuggugguaagcaccuuuacccacugagccaucucgccagucccucuacuuaaguuuuaagguggucucuuacuggaugugaggcuaaucaaguacacuaguuggccauugcauuccaccuuccucugcugccccugcugucguuguguagacacacacaugcuugucuguuucuaggggucugaacccauguugaaaagucgccaacuuagguaaaaaugauucugaaguaucucuacaaaacaguauaaugccaaaauauuaugccggauguaccagugucuuggguggauuuacauacuugucauuuucuuguagaaaacugcaccacucuuacauuuuguuugauaauuuguuaaauaauuucaaguguuaaguaauuauaucuaauagcucuugcuuuccccuaggauuggcagccaccauucgcuugugaugucgauaaacuucauuucaccccgcggauccagaggcugaaugagcuggagguagguugugucuguguuccauucuuugaugaugagucugccacuaacuaaugucacagucuuagugaaaugagaacaugguccauaaugauaaucauggcacagaaagcuggcaguauguagcaagccaaaucucauuaaagguacugacuuaugucugucuccucuugucugcuaaguaauacauaugaguuaucguaucuuuagauuauaaucaauggaauuuuaaguuuugaaaauaacuuuuugaaaagaauguaguaggacagguuuuauaucccuaauuuucuuuuacacuuaaaacuuucguuuaauuuuuaauuuuuaagcauuuuauuuauguuuauggauguuuugucugcauguauaucuguaccauagcaugccuggugcccuuggaggucagaagguaacaucacauucguugaguuacaaaugguugucagcagcccagagaagauuguggccuaauuacacugcuuuagagugcacauacaguuuuugcucuuguauuuuaacuuuuugguuucuauacuguagaaagugguuuuuuuaaaugauuucuuucuuuauacuuuaugugcacuggucuuuuccuugcacauauauuaagagccugaagcuggaguaguuacugaguuacuggcaggugugaggugccaugugggugccgggaaucaaaccucaguccucuggaagagcagccagugcucucuaacugccaagcaaucucuccagccuacagaaaguuuuaaagugcagaugguuuaacugucacagcauuucuuuuucuugcagaggacucugguucauuuucuuuuucuuuucuuuuuaaaaaguuuuauuuauuuauuuuauguauaugagaacaguguagcuaucuucaggcacaccagaagagggcauuagaucccauuucagaugguugugaaccaccaugugguugcugggaauugaacucaggagcuguggaagagcaguuggugcucuuaaccacugagccaucucuccagccccucugguucguuuucuaacuauuuauaacuccaguucaagagaaucuugaugcucucauguccuucaaggcauuuggcaugcauguuguacacauuuauauaugcaaacaaaacauucacacacauaaaauaaauauuaaaaauagcacaagcuagaaaauacuagguuuuugauaacagagucugucuaugucaauguuuuacacauuccuuuuucauuuuuaauuuuugagacauguagccuaggcuugcaugagauuuacuauauaguauauagucuaauccagcuucuaaacuggccauccuccugccuuaaguuugaaagugcugggauuacaaguaagaaccuuucaccucugguuuuguuuuuuuuuguuuuuguuuuuuguuuuuuugagacaagguuucucuguguagcccuggcuguccuggaacucacuuuguagaccaggcuggccuugaacucagaaaucugccugccucugccucccgagugcugggauuaaaggcgugugccaccaccgcccggauguggagcugaugauuaaaaccaaggccuuuacaugguagggaagugccucuaccaguugaacuucaugucugucugucugucugucuuuuucucuuucuuucucuuucucucucucucuuucucuuuuaauuaauuuauuuuaugcauaugaguacaucaccauuucucuccucagacacacagagggcauugggauucauuacagaugguugugagccaccaugugguugcugggaauugaacucaggaccuguauaagagcagucagugcucuuaccacugaacuaucucuccaaccccuugaacuucauuucugucccuuaagcauuuuauuuuagccuauuuucaaauuuguaguugcauguaaagguauagguauuauucaggugugguaccagcuuuagaggacauagagguauagaggacagcucgaucuauguagugaguuccagggauugccauugggauuugaauaugaaugaaacgugccauuuuuucugugauuuuuuuuuuuuuuuaaaugccauagcaguaguaguugggucuggugguggcacacacuuuuaauuccagcgcuugaaaggcagagacaggaggaucucuugaguuuaaggcuagucuggucuauaggccugcaaggacuugaggggaaauaaaaggucacuacaagccauuucuuauuuuaaccaauagcauuaaauugugccuauagugauucuuaguugagacauuguucagaaugacuucauucuguaugcuuuugccuaugucuguguuguaugcauuaaauauuuugagugacaaucuuuuaguaauuauauuuuuuccacagaauaauaaaauauaggaaucuuaagcaguguauguaacaauauuuuccuuagacgcagacagcacauacuuuuaaaauacaacuuaggcaagcaaacacuuuuguacuuaauaauuuaaugaauagaaguuaguuuuguuuuuagucuuaagggugaaaagguaacucaggcuuuaaagcaagacagcaccaagugcagagcugugaugugccagcaguguaaccucucccccacccccuucggaugaccuuguucacggccacagggaaagccuuaggugagguuaaaaugcuuuucuuugacauuuaggcccaaacacguguaaaauugaauuuccuggaccagauugcaaaguauugggagcuacaaggaaguacucugaagauuccccacguggagagaaagaucuuagacuuguuccagcuaaauaaggcaagugcuggggcagcuauuucuuuuuauuuuuuuuauuuuucuuaacaaccuuagaaagaagcuacuuguuugaaauugguaaaaugagauuuuuuucuuguuguuguuauaaguaucagagcuuuaccuauguaguuuguaagcuuucuuuuauagaagaguuuguuacaauuuaucuuucacugcaaaggguccuucccauuuuaguuuaaaucaggaagaaccuaaagcucagggaaguugaaaagacguuagcugcaaaggcugagccucaguccaguucuggguuccacuucauuuuaccacacacgauggcauucuugcugccuuuuuuuuuuaaauagagacuuuuuaaggguaacaaggcaggaccaaauaugggggcuguccuuaguucagauguaauugucagacaucgucuucucugggaagugagaaggggcuuugagaaccagugagugacucuggacugaccacacugucaaaggugcuguucuuauuauuuaccuucaaauuaauagcuuagcuggaaguuuguuguguguuuuguuuucuuucuuuugaccuaagaaguaaaaaacaaaaaacaaaaaacaaagcaacuauaacaaaaguauagcugggaguuuuguucuuagaaucuuaccuaggugugagggaauuagaaguaaauuucucuaauuucuucuucuuucuaauuuuuauuuauuuuuuugcuauuauuaacaguuagucgcagaagaagguggguuugcaguuguuugcaaggauagaaaauggaccaaaauugccaccaagauggguuuugcuccugguaaagcugugggcucacauaucaggggacauuaugagcgaauacucaauccauacaauuuguuccugucuggagacagucugagggugaguauuggagcuaccuucuccuguuuuauuuagcugcuuauuuauugguacauugucuuugcaauguuuagaaaaacauuguuaaaugauuuuuuuuugagaaaaaaaauccuaggacuuugguuuggggagcaacuguauuuaaaaguuuguaucagaaugaauaagauuauaaaggaaauaccuuuuuacggucaaauacagcuaaaaucuguauuuaaaucacuacagaaugaaauacucuauuaaaagcaucucucccugguugucacaugaaaguguaaccugggaauuaacuggcccaacauuugucuauugagauuuccaaggaaguugucagauagaauauuuaauaaaggggaagaacuuagugcugcaaagcacgguccucucccagcuguuccuaucugcaagccucuuuguuugcaggcagaugcucuaaagcccucccauauuuuucaaggcucugguagaaaggagugucuuaauccauucuuuugagauacucuaaauacugggguaauaaguccuguaacuucauuucugugcuguggaaagauugaggauacaguuucucaggucaaaacaaacaugaaaauuguacccuaauacuauaaacuggcaacagugcaaugcuaaaucuuaaaucauggcguuuuuuguuuucuuuugaaaccuucuugaaauucuuuuuuauuugcuuacugguuaucaaacugaaguucuaccacugacuguaucacccagucuucaaauuggaauguuguuuguguguagcccuggccauuuuauauuugucauuuaagcuaaacuggccaugaacacacaagagaugucugucucugucuccuaagugaugauuguagguguggcuuuguuuggacagggucuuaugcagcacagacuggccucaacuuguuguauaccuugaugaccuugaacuucuacucaucuugcuucucccucccaagugaugggaucacagccugcaccaucaccaugcucaguucauacaaaagacccaggacuuuuguacaucugagccaaguacuuugccaacaggccuacaccuucaucccucuccccucuauaaaaugcauguuaguguuuagugagccauggaugaugucauucauuugagacaguguuuugcuguaugaguucuugugaguuuauauaguccaugauggcagggaagcacggugucagaagcaugauggagagguggucauguuguguuugcaggcaagaggcagagagaacuaaaugcuccugcuuauuuugugcuuucucuuuauggguuguaguaucacaguuccuggaauggugcuauccacaauuaguguagcucuaccuuaauuaaucuagacaauuccuuauggguuggaaugcagcgugucucuuaggugauucuaaaucccgucaaagugacuuuauuaaccaucacagugugcauccugggcugcccuugaacaugugcuucuccugccucagccuccuaaguuuuggauuacaguuguggaccacauacuagauuuugcucucuguuuuauaguuacacccuauaaguauuuaguugccuauauagguauagaauaaaacuuaccuuuugaauucuucuaucuauggagauuauagugaguaaggaaagcaaagaucuuuccugauuuaugagucgcagccuuuuagaaccuugucaguugccuagggagccaucguagucaaaaaacaaaacgaacaaaaaaaaaaaccacuugguagagcccaagcuuauauaguaagguccacucgcaggcaaauaagggguagagauuauuauguugagacuuaguggauaccaguaucuucuaagcacugguacauuuuccuuguagaaaguuuuuaaagggacugagaauguaacucaugugcugugcacagggcccuggauuuaaccuguagcacagacuggucauggugguacacuccuuuaaucccggggacucaaaaggcagaggcaggcggauccaggguuauuguuggcuacacagugaacucaaggccaaccuggacuacaugagacugucugaaccguguacuggcauaauggaacacaggcuuacucuugcaucacccauguuuucugaaugccccgaaggaggacaguggucucugugggaugaggcgauuaugguauaaugaucucuuugcaagaagagguuaaaguccauauuaguaaguaauaagccuugggcuuguguuuugaauuauuguuuggaacaaaagauagauuucuuuauucuaaaauguugcuaagauugguuucugcccaguguguaaggucuuuagaguccugaauauagaugauagaaccaguaagagcaguggaaauagacacuaaauuugugauagaauaugugaauucggucauuacuauuugucugguuccauauaauuuuaaccucaaauaaauucauauaauuuuuguuucacaaaggucauagaguguauaaaaaguauuacaaauuuuuugauuuuguuuuuggaagacaagaucucauguguccuaggcuaaccucuaauuuuaacgguauagccaaggauaguucugaccauucugauccuucuggccucgccuccugggaacuaggcuuauagguguggccaccacauccaguccaugguugcuggggauugagcucagcaauucaugccugcuguguaagcacucggccaacugagagcugcacccucugccccacgcugucuucugccuuuuagaaauguguacucauagaaguuuauugagcuacaucccuaguuagcuucauguaucccaugccaagcguaaaugaugugccauaccccagauggacuuuagauaauugcauuguggauccuacuuucaaaaaugcuucccaugggggcugaagagguggaucaguggauaagagcacuugcugcucuugcagacuaccugaguuuggaucucagaacccauacaguggcuuacaaccaacuguauguccaauuccagggaaccugaugcccucuucuggcuuccucugucauuagacuuauacacaaugugcaugcucacauguaggcaaaugcucauccaaaacagaucuuaaaaaagauccuucucauaaauuuauuguccucuuacaaaauagaagugcauaauugagaaauucacguuagcuucaguaauaauaauuuguguuauguuuugccauuaaauauugucuuugucagcuuagugaauuauuccccuuaaugaaauugaggggaaaaaaagggaaaaggaaauuuuccugauaagaaccauaucacuuuucuugucccugugacugaacaccuaacaguaagcaaaggcaggaaggauugaguucgguucacagugugaggguacagucauugcauccuggcuggaagcaugguguggcucauggcauugaggugguguggcagggacuccucacaugguggaacagagggcaagauuauaaugagaccaggccuagaaccgauggggacguuuuuaugucuaccauuauauaaauaacuuuucaguucugaaacaguuucuaugaagguuggauggccuggaacuccuggaguuuacuccuaggcuugguugaccaccugccucugcuucccaacugcugggauaagguuugcaucaccaugccuugcagagaacuagcaauuuucugugaaguacuuauuacucuuuguuacauagucagaggaccuauuuucucaagucaggacauuuuugauuauagcacuauuaguuauaucagaauccgcaggauuguacauucaugaaguaauucauuuugcuuuuuauguuugagacagcuucucacuauauaagccaggucagcuucucgaguguuccggguuacagauaugcaucuccaugccuggccuaccauggcuuuuuaaaacccgaggagauaagcacuugaauaaauauaaauuaaaaaucaucuuccugucaguuuaggauuaaauuuuaaaaagaaaagaaaaaagcaaaggaaacaauguuaaaaaaauuuaagguacaaaaaagauuagacaaacuguaaauguuuuuagauuugauuuuguuuuuuuuuuuuuaagauuuauuucauguaugugaguaugugguuauugucuucaggcacaccagaagagggcauuggauuccuauuacagaugguuuugagcuaccaugugguugcuggaaauugaacuugggaccuuuggaagagcagcuaguguucuuaaccacugagccaucucuucaguccccauucuuuagauuuuuaaaaagauguuuuguuaacuauauaaguaauuauacgggaaagagaauucauugguccaaccguuuucuuuuuagugucuucagaagccuaaccugaccuccgacacaaaggacaaggaguacaaaccccaugauauuccccagaggcagucugugcagcccgcagaaaccuguccuccggcccgccgagcaaagcgcaugagagcagaggugaguauuuuauuggauccugaauguaagugcuggaagcaugguggcucauggcagugagcugcuguggcuaggacucuucacaugguggaccagggaguagagggcaagauuauaaugaugagaccaggccuagagcucauaugguucaccccugauguggaggccccaacuacuaaaggcuaauuuauacuaauacuaauuuauaauaauaaauuuuuauuauuauguauuuugcuugaaugucugugugcaaggaaaauguaccagugcuuagaauauacugguauauaguaauucuaaacauaauaaucccucccuuuauuugcuuaagagugguccuuaaaaagccugggcuuuacaaaaacuucuaguguucuaccaagugguuuuuuguuuguuuguucauuuuguuuuuugacuacacuggcucccuaggcaacugacaauaguuuugagccuugguacucucauaagggaauaugccacacugcucuguguuuaugguggugucuguaaaggggaaggaauggaagagcgccuucuggguugccugaaagaugcuuaguuuacagucaaaaccagaaaaaguauugucauucucgggcuccuauuuaagggcggacagggucuuggucccuaaguguggagucaggaauguauauaccgugaguguugacaggcuaucaaucgggaauguauagaccgugaguguugacaggcuaucaagaugccuugcuuuaggauuuuucuguauucagaaagaagagucuucuucauacucuguucccuucgagaggcauaaagacuugauaggauguaaguuuuagggaacagcuuaaugccaaggagccucagggcagaaucaggcuucagagucaauccuugacuauuuaaugaucuuugacaaauuuuuuuacauuauguagaauuuagagauuccauauuucucaagaaaagaaaguaaccauauaggaaauuaugauuauuuaaaguacauguuuaaaacucauuaauuuaaaaccugauacuuauuuuuuugagcauauuguuuugacuuuugugacaggguuacacuguauagcccaagcuagccuugaauuuccuaugauccucuuuccucagccuuccaguugcuaggaauacaggugugucccacaguguaugacuuauucuggaccuuuauagauguaagguguucccuagugcuguggaggccugaggucugcauugaugauaccaaauguaaugcuaaugcccacagaaaaaauacauuuggcugugaacacacggguaaauucauaaauaguccuacuaacauuucaguguuauagaucacaaagugguuuuguuuaucaguaaauaucauucucaggagcaagaggacugagccugacucagugagaauuaagguguucuacagcuuugugauguuagauauagaacuuacucuugagauuuaaaauuuuuauuuuuaugucuuuugcuugaaugucuguaugccauaugaguauacaguccccauggaggccaaagagagugucagauucccugggauugcaguuaaagagaguuguuagcaggcaugugguugcugggaaucaaacccagguccucuggaagacagccagugcugcauuucuucagccccagagguauaauaacaguaacgaagcuagagaggugaguguagcagcuacauuaggcagcucacaauccuguguuuccagcuccagagaagcuguggggggcauguagaaaccccuccacacaaacauaaauaaaaaguaaaaucuuuugauuuuauuuguuuaagaaaaaaaaaaaaaggcaaagccugguguggugguacaagccuuuaauucaguacccaggaagcagagugaagcagauuugaguuugaggccagcauggacuacagagcaagguccaagcuagcccaggacacccuguauuuuaaagaaaaaagucauugaagauuguggaagccagauuuacacaaguacugcuagaccuuugaagagcuuggcaaaaguuuagauuucagaauuaacgaaaaugcgauguuuuuauaauuguuuugaguuuaguaauaauuaaagcaaaauuucuagaggaaaauaaaggccuuguuauguccauuuuggguguuaauacgacuuuuaaguugauccagugucugcuuuuuucucucaaaaguuauguuauuagagaauacucuacuaguuuguaauuuuaaaaaugcgaucugcuaagaaaagaauaaagugucuuaugaauuacuaaguaaaaacagaaagaagagaauauucaugucuaugacaauauauuuuuaggcuaugaauauuaaaauugagccagaagaggcaacagaagccaggacucauaaucugagacgccgaauggguugcacaacuccaaaaugggaaaaugguaagagauuuuuacauuaaugagaaaaaguaaaugaugauagcaauuguuauuucuuggucacuugguaggguuugagaaauaaaauacauccgucuuuauucucgcaauuaacaggugguaggacaaaacuggaaaaugcauauuuggaauguaggagaauuucucgguuucaucuggcgucugcuuugaaauuuaguucaguaaaucacuuaaaaggugauucaaaaaguauauagguuccuuuuuauuucaaagcaggcagaaacugauaacaguugauaaugcuugaguguauugugguugucccuguuuuccucccuccauucucucuuccuuucuuccuguguauucuuguugucuucuacguguugacaguaugggcaugugccagcaugccuggccagaggucaguuugcaguugaccuggaguaaguacuauauaccaugagcacagggcaucugcuaggccuucauguguuagugcgagggcaacaugguguaguggggagugaaccuuugagucucaguccuggcucaaccacuaacgaguuguaagacuacagagaagauucuaaccuucuuugaggaucauguuccucgagguaguuuuguuaugaacgagucacaugaaccagagcaucaucuuagauaauggagagaugguguauaaugugguagagauacagcuggugaguugguggcaucccuguccuuagcaagagaaacauacaugucuuguucuuuuucauuuuuucuuugagauacaguuucaguauguagcucugacuguucuggaccucacaggccacacacacacacacacacacacacacacacacacacacacacacacacacacaguguugggauuaaauguauaugcuccuugggccuggcgcaugccuuauucuuuuuugguuuuucaagacaguguuucucugucuagcucugacuguccuggaacucacuuuguagaccaggcuggccucgaacucagaaauccuccugccucugccucccgcgugcugggauuaaaggcgugcgccaccaugcccggcgccuuauucuuuuuuuauuuguuuguuuguuuuuuaaaaaagauuuauuuacuauuauaucuaaguacacuguagcugucuucagauguaccagaagagggagucagaucucuuuauggaugguugugagccaccaugugguugcugggauuugaacucaggaccuguggaaaagcaguugguguucuuaaccacugagccaucucucgagcccuacuuguuuguuuuuuagcaacagugucucucuauguaguccuggcuguccuggaauucacuauguagaccaggcuggcucugccuccggagugcugggauuaaaggcgugugccaccacugcccaacugacauguccucuuaauuaaagaagacuuuuuagcucccguuuugaagacuuaggcuauucauaauagcacucacaugcuaacauuuaauagagguuguuuuuaucagucagcauugaguucuuguaccuaguaacacuagguguuaauaaaaugagaauaaacggggaaugguauuuguguuugguugucaguuagaggggaggaagacaaugagguaaaacaggaaacagagauaagcagagugcauacagaaagaacuaacuuuggauugcuuccugcagagaaagaaaugaaaagcaccaucaagcaagagcccacugagaagaaagacugcgaguuagaaagugagaaggagaagcccaagagccgggccaagaaaacggccacugcggugaguggacacugccugugaucacuccauguccuuauuuaacacccucaaucacucuaaacaggaucucucccuaugccagucccagccuccugaguuguccacccuuccuuccucuuuuucuuccucucguacauacauccuaggcucgaacuucaccauguucagcucugggaaaugagcagaguauuuuuuuuuaaacacgugcucugcaguugagacccuagccuauccucuuccugauagcaccacugguaacaccauuaccgauaagcauaugcuuaugugcauuacuuaguauuaacaaaggaaagauauuuuaagggcuguuuaugucaguuuagaaguaaggaacuaccugcaucuaguaagcaucaucaaugauuuuuuucuuuguagaccaggcuugccucagauuuagagaugcauuugucucuguggcuuuguuuucgcauuugcucuucugugaugaggcuggcauuucaggcuaguagcucuucugcccgaguuugcuacugcugugauuacaggcagcugccacuacaccugccuccagaauauuugcuuaauguaguagugauuuggcuaauaauuuauuauuuaugaggauuaucuuuuuacgauuuauuuauuauguauacaguauucugcauaccagaagagguuacuagauuucauuguagauaguugugagccaccaugugcuugcugggaauugaacucaggaccucuggaagagcagccagcacucuuaaccucugagccauccccucucuccaaccuggaggauuauuauuauuuuuuuuaaguuuauuuuauguauaugaguauacugucaccaucuucaagacacagcagaagagggcaccauaccccacuacagaugguugugagccaccaugugguugcugggaauugcuucuggaagagcaguuggugcucuuaaccaacugagccaucucucugcucugacauuuuuuccuuuauauuauauaugggcuguagagauggauuauuauuagguaaagacacucaaugccaaacuucauggucagacuucaaucucuggaacucugguagaaggugagacuucugauuuggacauuuaagguauauaauuuuucccacuccuguuguuucuggggguuggcgcauguuaaacaccugccuagcuuuacuagcacccggaaagccggguauuggggcugccugccagugcuuagauggucaaggucuaaggucauccuccacuaagcgauuaagaggcuaccugcucacaugaagacccugucagaacaagagaagacaaaaugaaaacagaaacucacaaaaugaaguaacaauucaaacucuucugcucucuguagguggaccuguaugugugccucuuauguggaaguggcaaugacgaggaccgacuccuacugugugacggcugugaugacaguuaccacaccuucugccugguucccccucuccaugacguucccaagggagacuggagguguccuaaguguuuggcucaaguaaguauuaaugacugagagggagaacuacuuugggaagauuuuccuuugccuguggguuuuagauucaucgauaauaaguccaugaacaaaacaaggcuuggaagugaaugggaaaggaaucuuuccaaguuccucaguguauauauguucuucagauacauuuuacuccuuuaaucaccauguuaucaaaugcaauuuuuuaacgcauguucuuuguaggaauuuaugagcacuuaaaaaacuuggaugauuucauaugacauagaaaccguauuaauguuguagugugaauucaugcagauuuuuuuuuccauuucuugcuccaugugugugucugugucugucugugagucuaugguuugaguugcaggaccuuugaaucugucacagugcauguauaugugcguuccucugugacagggucucugauucugaagcugucacauucauauggugacagcuaugcuucagcuaucucccuaucuccccuacccaucaagcgcuaguggcccugccuuugaguuccuugauacaaacucuuaaugcuucuguggcggguacuuuaucuuccuagcucccgacauuuuuuuuuccuauuuuaaacgaauauuagacaauuagacaauuuuagaaauauacuuuuuuacccuacguauuuucaguguaguguauauagugcugauauuaauacaguguagcaaaauuugcuguuuccuauauaaggaagugcucagucauuggaauauuacauuuguguuagaauuagguuauaccacuaagaaagcuuuuauguuuucuguauagcuauaguguaacaugagaagaccacacaaggacagguuauuauggaagucagauagcuuccaugguguuagauaaauauuaauauuuaaauguuuaaguauuuaauaccuguguagagaugaccuccucguuaaauggucugaauaugcaaaccuauuugacuccauuguguuggcgaguuuuauagugcaucuguaaccucuuaguguuuugguuauuccuuucgguagcauuauuuggcuaucauuaaauguuucauucugagagcuauaauauuucaucuacuuacuaauuuuuauuuugguaaguuuaaguugauuuuuauaguuuaaacucuugaacauuaucaauccccuuguuuucaguaaugaagacauuugaucaugaaaauaaaugaagguuaaaaaauuguauuugauaaaauguauuuuauuuguaccacuggaauaaucucauucuucagacauauuugauuuuucuuauguagacugaauuuaaugaaaaagaucuuaaaaaucuuuuuaaaaauugcuuuugugacuguuggcuagauagauuagucauuugaaagugucaccuggaaaacagcuuuucuucuucccaugcaggaauguaauaagccacaagaagcuuuugguuuugaacaagcagcaagggacuauacacuucguacauuuggagaaauggcagaugcauucaaaucugauuacuucaacaugccaguccauguacguagauugauuuagaccuuaaacauuuuuuuguuauauguguguagcgggugcucaggcaacacugaacauguagaaaucaaagacaccguguagaaguugguucuuuucugcuguguggguucuugggauuggacuagagacauuugcccaucuguaacuuacguuuuauuuuauguuacuuuuuugcgaucagacaucauuuauguagccgcagucagccuggaauucacucugugaaccaagccagccuacagggccacuagcacacauggacuaauuacaccuuuuguuuguuugcuuguuuuuuguuuuaaacgagguagcuggugaggaaagaguuaauauggauaguguauagacaguuucucugcaacuccauuacuggauaaagaaaagcuucauuuuaauaacagcaaacaccaauaugaaguccuacaguuccuguaguccagcaguugcaacuuaaagaaagacaguaucacaacacugguggaaagcucgcuguguaucaaguaaugcagcgugugcugugucuugcacccuugcugugucuggugcacucuguugucuaaucuuagacuguaaauuuuacuauaagacuccaugguuacuccuuguuuauuuagaaacauaagcauaucaauauucuaucaaauaagucaaaauuaaaugguuuccagcgugauucuggagauuugagaugugauuuuucucaugugugccauagcagacagcucaugcaugagauuacggacauuagauaggaguuuugaucccuguggaauuccagaaauacauagucuuuuaugucauggacaucagcuuuuacuuaccuaaauauuugcuuuuuaaugccuauuccacuugaaauuuuauuuugacucuucaugcauuuuaguauuuucucauauuugcacaaucagucauguuuaacugucuuaugauauuucuucucggaugucggaaaacaugaaggguccguacucagagcauuuccugaugccugauagcuuuauauuguuggacacgcugaggcaaaggucuuuuuguucauacucugcaauuuguuuuauguuauuacauuuuuuaaaaaguuuauucauuuuuguuuuugaugcaggagucuuuagccugcauauaugaaugugcaacaugugugugcuuggugcccauaaagggucagaggagagcaguggauccccuggaucuggauuacaggcccacguggguccugggaaucgaacccaggaccucugcaggagcaaucauuuaaaaacccccucaaacuguuauuuuacuuucuuuggccucucuuuguaauuguggcuagguucaugaucagugaacaugaauuuuuaacuuuuugcaagacaggguuucucuguguagucuugguugcucuggaacucucucugaagaccaggcuggcuuugaacucaaagauaccccugccucugccucccaagugcuaggaucaaaggcgagcaucaccacugcucagcuaauuacaguucuuaacuuuaaaauuuauuauagaaaauggaguuguugccuggauagaguuauucaccugugggaaauuaugaacagauuuuuuugcuuagaaguuuauucugugauuuccaucucuuaacuaguuaaacaguuugugaaugaaaaaauuccucuuuuaauuuccuuguacuugcagaugguucccacagagcugguggagaaggaguuuuggcggcucguaagcacuauugaagaagacgucacgguggaguauggagcugauauugcuucaaaagaguuuggcaguggcuuuccuguucgagaugggaaaaucaagauuucuccugaggaagagguaggcuccagcuuucaggacuugugugagguggagcucugugucgaaagcacagccuuggacucgugacauccucacuaagaacagcagccuugaggauuguuagugaaauucuguuuggcuagcuugaaguuuguuguuguuguuguuguuguuguuuuuuuuuuaauuuuugaguacacgguugcugucuucaaacacacuugagggggcauuggaccccauuacagauggcugugaaccaccaugcaguugcugggaauugaacucaggacuucugguagagcagucagugcucuugauugcugagccagcuccccacccccugaaguauuuaauuaaaauuacuuucagcacagccuuaacuacuaaauuuauuuguuuguuuguuuguuuguuucaagacaggguuucucuauguagcccuggcuguccuggaacucacucuauagaccaggcuggccucgaacccagaaauccgccugccucuggcucccgagugcugggauuaaaggugugcgucaccaccgcuuauuuauuuuugaucauuauuauuuuuauuuuuuauuauuuauuuuauuuuuuauuucagguuugggagaauauuugauuuguugaaaaauuugccucaaugccuauauauauguauauauguauuucccuuagaaaauauauugcauuuauauaaguagaacaacaaugguuaaguuucuucuaauucauaccacucauucaccuaaagugggggguaugucaaagauggcuauuuauuucauuuaauuuacaggugugcguuauuuuaaacaaaugacaucacuuguguuuacaaguauaaucuguaugucuucacuggcauggcugauucugauggauauuacuacuuuuaucugacuaggagaguagaacaucuuuauuuuucuuuuauuagauauucuuaauugaauuuauuaacuucaagaaaaauuaaguucucaaaaacccuuaguccgggcuggugagauggcucagcgguuaagagcaccgacugcucuuccgaaguuccugaguucaaaucccagcaaccacaugguggcucacaaccaucuguaacaagaucugacgcccucuucuggugugucugaagacagcuacaguguacuuauauauaauaaaaauaaaauagauaaaucauuaaaaaaaauaaaaacccuuaguccuggucaugcucuuuacugagguggugaggcaaagccacugcugcccuuucagguuucaaguuugaccucuuuuaaaaaagaucagucaaggccuuauuuaauuuucauaauuguaaguguccugcuuuucaugcagcuggcuuccugaacccacacgauucugucugguuuuggacagucauauuuacuuuguauaugucugugguguucauuuuaagccuuacauccauauagagaaguguauacacgugugcagcuugaucaguccucacacacggaacagccacacgcucgcucauacccagcucuagaagaggaaggcuaagcccuucauuuuauuuugaaggaguucuguagacaacuuacauggaauucuagggccuggagaaauggcacagcaguuuuaagagcacuugauucucuuccuuaggaccccagcuguuuccuagaccagacugcucacagcuucugucucuagugcccccuucugaccuccuuauacuuguccacaugaaccacccccaaguaaauacaguaaaaaaaaaaagguacaaaaccauguuucugaacuguuaguaugauauagcuaaaacuuuaucuuuuuuuuuuuuuuuuuuuuuuuucugacucauuuuaggaauaccuggauaguggcuggaauuugaacaacaugccagugauggagcagucuguccuugcucauauuacugcugauauauguggcaugaaacuccccugguuguaugugggcaugugcuuuucuucauucuguuggcacauugaagaccacuggagcuauucaaucaacuaccuacacuggugagaauucuuuauggagucugugaggacuaucuaagcugggcaggaaagaaaacuuuuucuuucagaaauguguucaugacugagaauuucaaguuccauuuguuuuagcuucuguuaccuuagguuuccuaucugauuaggucacuugacuucuacauaguccucugaaaucauacacuauuuugcaaguauaggauguuucuaggaauaguauuuaugaacaaguuacacacacacacacacacacacacacacacacacacacacacacacacaccgcugucuaccagaauucucauuugaugucaugguaaccucuauaucccuuuggggaggagcauggacuugggacuaucaguuuccuuuuguugugcugauuuuuugacaucauaacacuuagaauaccucucaaaucugugcagacauuuauuacuuuauuaucuaaacuuuucaccuaaagccuuuuuuucccuacagcuguaauacccucaccuuauuucuucuacuuucacaugcaaaaguauuuuaaaauuccuaacucacuugaauccuacagaaaauguaccacaagaacgagagcuggcacuuggauggucaacaugauugugcuuccccuggcauuacccagcuguaacaggaagaugauguuuuauauaccucacagagauggcacugauuaauugguuaacaauuuaaaguguuuugaagaauaaggguuguuuagaaauaauugccuuauucguauuugauguaagcuuuuuuuuucaccagaaugggcaaggaaaaagaagauggaaguugcaggccuucuugguugcuguagggagggagcuguaguaacugugcugagucaaaugugauuccuuaucuuuuuagaaacucuaaauucucccauguuuguagaguaggaucugggaggaccucaaucccaucuucgcaguggugggaaaugcacugaguguuccacuccugcuuguccugauacuuguuugauuugaacguuuguuuguaggucagaagaauaugaucuaguuaacuguugcuguguguuaugcuacaaauuaauggauucugaucuuuuucuaggggugagccaaaaaccugguauggaguuccaggcuacgcugcugagcagcuagaaaacgugaugaagaagcucgcuccugagcucuuugugucccagccggaccugcuccaccagcuggugaccaucaugaaccccaacacucugaugacucaugaagugccuguaugucgugcugaccuucuugccgccccacccaccgugcacagcuucccuagcaccccugcuuuucuucuuaaaguuauuugguguuuucccccccauaauauaacuugauaacagaagcagcugcugggugcuuuauagcagucucccagugggccagaugcguagaaacucuaaacuccuacauuacuaaugacuugcucggcagaugaguaacacucacuuuagucuaccggucagugagugggagacuguauagccauggccacuaaugguuucuguucuguaaggguuuuuuuuuuuuuuuuuugguuuaagauuuauuuacuuguuuuauguaaguacacugucacugucuucaucuucacacaccagaacagggcaucagauuucaucaaugaugguucucuccagccccuguaaguuuuguuuauaaguuuaguaaacaaaagauaaaaagugaccugucaaauggaaaugagaauuuacuaugagaauggcuagcuaguuacaguuagagcuaagcucagguuuuaaaaucuuuaauauuacaaauuuauaaagcuuaugaauauaaaaauauaaauuuauaaagugcucuugacugagccauuuuuccaguucuuggugucagucuucuaugccuuuuuccgcucuaaaagaggaaguuuaguagggauguuugugagugcuuaucuaauaagaacaggcccuggauuucauuuccaauacagcauaaagaagugacagugaggguuggagagauggcucagugguuaagagcgcugacugcucuucugaaggucuugaguucaaauuccagcaaccacaugauggcucacaaacauccauaaugagaucugaugcccucuucugggaugucugaagacagcuauaguguaauaauaaauccaucaaaaaaaaaaaagaagugacagugaauugugggaucucgugauuaaccaaaauggaaugcuccccaugacucauucugacgguggugcugggaauugaaccgagagccuuagaauugagauacuagguuuacauuuuguccuggugcugcuucguugccagagcuguuuuacauugcuuacugaguccuccacccccucaaccccccuuccucacucaccuacgguguugugugugugugucugcauuuggcuguuguuccucggggaucauccaucuugauauuucagacagaaucucugaggacuuuauggagggccauuaagaguguauuuguggaccauaaaguaaugacaaaagaacaaaacauucacuaugucuucauuguuaacauuucucuuugauuuuucaaguuugucaauauuggaauaaaauguaggggcuagauuuagggcuuugggaaaucaauggauugauuuuucauuccuggucuggaacuugcuaugaagucuagauuguccuccaacucaagagauccucuugucucugcuucacuuacggcugaaccuugggagauuccugauuguaucuguaaaaaaagauguuucuugccucuuagaugguuucuuauuuuugugguaagagcacugacuucaguucagaggcuauuuaguucuguuagugugguauaccacuccaucuuguggcagaaaccagaugauucuaacaguaauuuuuucccccucaguuuugauauaagguguguguguguguguguguguguguguguguguaguccuguccuauuugucuagagaaaucaucugauaguuuaugucuaaauugccuuugagaauguuacuguaaaaccuuaauugcucauuccugucucuguagguuuaucgaacgaaucagugugcuggggaguuuguaauuacguuuccaagagccuaccacaguggcuucaaccaagguuuuaauuuugccgaggcuguuaacuucugcacuguugauuggguauguguuauguauuugagcuuucucaaaucuuaccauuuuuuuguggaaauagcauaaaaugcuuuaaaaacugucacauauccuugcuacucaucuggauuccaugcaaaaucuuuuccauuuuacagugagauaagacacuggauaacacagugugugacaacucagacaugcacugugugcaugccuaugugcaugcacaugccuuuggccagagaauuauagauagcugugaguagccugacauagguacugagaaguaugcuuugaaucucucuaaaaaucagcacuugcucuuaagugcugagccaccucucucaagauacuucuuuuaaauuguacaaauuguuaaugaaauuuuaggggauagagcagugcuuugccuuuuuuuuuuuuucccccaguguugccauggcuaguccugaguucuuuauuguaaaccacccugcuucagcagguuuugggaaaccuaauuuguagcaagagucuuccugaagugucuuuuaaaauggcuaaagauuuuuuuaaaaaaauauuuauuuauuauauguaaguacucuguagcugucuucagacacaccagaagaaggugucaaucccuuuacagauugguugcugggauuugaacucaggaccuucagcaaagaauagucaaguguccuuaaccguuaagccaucuuuccagcccaaggcugaagcuuauuaaagcuugcaaacuaguaacaaauauuccagccuuaaaacuugguaggguuucagguuagcacuguuguuugaggaauaguacuaacauuaccaguuaaacuccacauuacucgguaacucauuaucaauauaucuuuuuccuaaaccaguuuucaaauaaguuaccuaaugugauagaccuuuagagcacaacaauagacccagggcucugggaaucugagucuaauuuaggguugauaagugauagguguuuugaccuauauuguauuauuugguaauaugauauuguaagucagaagucuuuagaaauuaaaaaagacuaugucauuuucuugugcccuguguacagcugccauugggccgccaguguguggagcauuaucgcuugcugcaccguuauugugucuuuucccacgaugaaaugauaugcaaaauggcuucuaaggcugauguauuagacguugugguagcgucaacuguucagaaggacauggccaucaugaucgaggacgagaaagcuuuaagggaaacuguucggaaauugguaagauuucuggaaguccaauuccaugucauuaacugugauuuucuaagucaaguuguguuuucuacuacuguuuuaagaagcuuuuccacguuguauuuaauggcuacagagcugccgggagcccuccuccggccuggagaggguagugguauagucacagaguaggacucuggugauggcuuuaaagucugagggccccgggcuuucaagcucuuuaacuguacugaaaagcuaaaaacuuucuugcucuuucucaggguaaaaagacugcuggcuaaggugauuaacacuuacagccuaacaaaggauuaagcaguguggccuuuguucuagcucagcaagaacugcugggcucuaacugcugggccugcuaguaggaaguugcuggaagaaauugggacacuuagagaggugguuauagaguuuauacuaaguuguaaaaaguuuccuaugaaaacuaaggggaaagccaaaaagauccuaagcggggacuaaguguggaaaggcaaaaaauucucucucuccuuguccucagcacuuauacaucuuucagaauacaugaucacaugguacaaaguucaucacaaguucacacaaaaagaucaaaucauaaauugaaauagaaguuuacagcagagaauguuuacauucauauccauuaggaguaauuaucuggcuaaacauuuaucaccugucucagaucuacagguucacugaagguuuaaaaccauaacuaauuuauuagugaaguuuuguauaaauaaacccagucaauauuuuaucuuuugucguagcaucuauaauaaauagcuauuucccuuuuuaugaccuuugguuaauuguuuuacaaccucuuggaaugugcucugaguaggagaaagucugguuacuaagagcaauuaacuggugacacuugggagacuggcagaguucucauugcaguuuugacucucagaagaggaacuaauagccgucccucuauagaagagcuuuaaucacagacauaauguuaggaauucuuaaggaucaucauuaagacuuaagucaucuauuugucuauauagcauuaguacaaaacaguaaauuuuuguggaucugcagagaucugcuccaaaggggugugcuacuacuuagugauuguuauauauguuuaauaauaacaggaaaagcauauuaauugcaggaaucuuuccuaaaaugaaucccuuacagccuugcuuaauaagggugcgccuaucacagaucauauaauauccaaagcaggccauuucaggauauucaccugcuaguuauuagcuugucccauuaugacucuugacaaaaagcaauucuaauugacguguaguaauacuuuauuuuauuuauauugaccuuauuuuaucccuuguaucaguuucuguaaaauaucucuucacaugguuugucuguuuuaauuauaaaauuauauuauuucacuagugcugcuuuccgucuguccccucccucuuuccaucccucccuuccucuccucuaauaguguuucauguauccuccugcuucuacuuucuaaguacuagauuacaagcuugccucuuuuaaguuuuguuuauuauguguccuacuuaagacauugugcauaauaaagaagcagagucacaaggauuuucuccaguaucucacacuuuuauaauaugaauggccucgggaucauuuuaaguaacuuuuauuuguauuagacacaagucuaaaguguuguuuuuguuuauuuuugcauauggaugucuaguugccccuucauuaugucuuaaaaacuucucucugaauugccuuaguaccuugguuuaagaccugcaaauuuaacuuguugcuaguacuaaauugcuagugauuacuuuuauaauauucucucucccucucccucccucccaaccucccacccuccuuucucuccugucuccucuguccguucguguguuguguguguguugugugugugugugugugugugucccaguuaagaaugggaugucaaguauaaguuacaacagugguaagcucaguaacaggagugcugggcgcugaucuuguguccuugaugugcacacuuaucauugcuuucgcuccagcccucuaaaaggcuuugacaaaucuuuacguagacaagaauguccuugaauucugaccuuccugcccaguuuuagaauuacagguaugcuagaauucucaguuuuauucaguucugaaauggaaugcagggcuuggaacagcacauaaggcaagcauucuaccaacugagcuauaauccuaacgccuagcuuuguccuuuauuuuaaaaauuauuuuuaugucuuuuaguucguuugcauuuuccuguuaugauuuugauuuaguagguuuuugguuuuguuuuugauucuuuugggucaaccacauauguaaauaaucauuucuuuuuauaugccacuguguauagaggacuggaauguugucuauugggagcucauuauggaccaccagcaggauaucuauuguccccugauauuuuauuguuggagaaagcagugccuaguagauuuuaagugaccugccaaggucuacaucaauaaugguagcuagugauuaucuguagaauaccugccuggcgguguagguuccugcucuagcugaacuucuuuuagcagcugauagcugcuggaggaggucaaguagcuuuucuuaggugcugugccagcgagagguugcccuguccuguccuccacucauggccccacacucuugggcaugugggagugacuaaaaacaaaacaaacaauggacauaaaccuuggaaagguauguugggaggagguuguaguagggguagauguaauuaaaauacacugguagccaggugugguggugcacgccuuuaaucccagcacuugggagucaaagagaggcggauuucugaguucgaggccagccuggucuacagagugaguuccaggacagccagggcuacacagagaaacccugucucgaaaaaccaaaaaagaaaaaaaaaaaaaagauaaaauacauuggugcaaaauucucaauaauaaugguagcuaauuucugcaacuugaaaaacuauucuugaccuguggaauguggaauuuacaaguuaaaauuguguauaaacuauauguuuuccauucucagcaaauucagaguugguauuuggucuucuuuaaccucaacucuuuccagaccacagaaguccuuuucagugaucaugauuaaaaugaaaaaucuguucauuagcauuuuuuacuuugucuugucauuguugauuuaacguguaauugucagaaauuauuaaaauauuaauguaaaaccaaccaaccuuccuucccucccucucucccucucuuccuuuguccccuuccucccucccucccuuucccauuuuuacuuuguuuguaaaguauguguguugguagaaggccuuagaucucugguggcagcgacagguacagguggcugugagcuaaggucaucugcaagagcuguguucauucuucuuaauccuagagucaucuuucaagugccucuauguaugugucuugaagaugcuagggaucaaauccagggcucucucugugcauuguaggcaagugugccaguguuuuuacuuuuccuuugugauagaaagcaugugucuuuagcucuuccucucugugccccaaucuuucuguaagguaaguuugguguaagguugcuaacuucagcaguauucauuuaucaacaauuuuauuaaugcucaaauagaaauaagugguuagacuugaggaccugccucauccaaagaaggauucuccuuggacaaguagaauaaugugcuauuauuauuuuuagauuauuuaguucuuuuuuuuuuucauguaugugaguauacuguuucugucuucagauacgcuagaagagggcaucacauuacagaugguugucagcaaccauauaguugcugagaauugaacucaggaccucuggaagagcaguaagugcucuuaucugcugagccaucucuccagcccgguuauauaguucuaaauaguacauauuuucuugggucuuuuagauuguauuauccuuucaaauccucuaauauagauuuuguuuuagggaguaauugauucugaaagaauggauuuugagcuguugccagaugaugagcggcaguguauaaaaugcaaaacuacaugcuucaugucugccaucuccugcucuuguaaaccuggccuacuuguuugccuacaucaugugaaagaauuguguucuugccccccguauaaguauaaccugcgguaaguaaggaugaguuuuuuuccuuugggaaagcauccaaucauuuauuuugagugugcaugugcauaagugucuuuuugaugcccuggcuugagugcacauguaugcacgugugugaucauauuuaugugugaaugugguuauauauccaaaggcagaaggaagagagagacacugggccuuucuugagcaauugaaacaccaaaguccagucccacugacacacuuucaucaaggauucaccucugauucccucucaagucacaccacuccaugaugauuaagcacucaaauauuugagccuaugggggcccuuccuaauuagaucaccaccacacauagguuuuggggauugaaacucagguucuuguucuuguaaguaaauugcucuaccaauugagccgucuucccagcccacacugagucuuuaguuauuauaggucucugaauguugaggauauaacguccaguuuuuuccacuggcccgucucauugcuguuuguguucuguguccagguauagauacacucuggaugaucucuauccaaugaugaaugcauuaaagcuucgagcagagucuuacaaugaaugggccuuaaaugugaaugaagccuuggaagcaaagaucaauaagaagaaaaguaaguaaugcagaaagugguacucaagcugcaaagucuaguuggauuuuguugcagccaacguuuugaaacagccuaauuuccugcuuaaucuuacauccagguccuuggcagaagguucuagccaagauggaugaggcagauggccucaacaucucagugaagccuggguauauagguuauacaagaugguuuuggggccagcgagguggcucaguauacaugccucucgggcccaaugaucuuggauuagguuccuggaacccaugugacaucugaaccaguucaccucugaccuccauauguacaccauggcucacauuuccccacuuugacgccccacccccuguagugaaaagaaagaaaggaacaaacuaaacuucuuuaaaaaaaaacaaaaacaaauagaaagcagggccgugguggcgcacaccuuuaauccuaccacuugggaggcagaggcaggcagauuucugaguuugaggccagccuggucuacagagugaguuccaggacagcuagggcuauacagagaaacccuaacaaaaaacaaaaaaacaaaaaacaaauugggggggggggcgacccagaaaaccaaaauagagcuggaaaguuggcucagagguuaagaguacuguuugcucuuucagaagaccgggguucaauuccagucauucacgugguggcucauaacuaucuauaacuacagucagucagaggguguauagugcuuccucuguccuccccagccacuacauacauaugguguauagagauauauguaggcaaaacaccauacacauaaaaauaaauaaaucaagccggaugugguagcacgcaccuuuaaacccagcacucaggaggcagaggcagguagucuggccuacagggugaguuacaggacagccagggcuacagaguaacccugucuugaaaaccaaaauaaauagauaaaugaauaaauuuaaaaaucuuaagaauauaauagcaacuuuauguauuuuguuaaaauggauucuuugaaaugcaguauaauacuaaaauguuggugaaauguuggcuuaacauuuccuaguucuaaucaaaauuuagugucccuggcacuuaucauuauuuuuuucucucuucuauauguguguguuuugccugcauguaugugugugcguguguaucugagccuacucuguugugugccugauaaacccugaggucagaacagggcugggcuugaggaugauugugaguugcucugugggugcuguaacugaaccugaguccucuuuaauaacaaguacucuuagcggcuggguuaccuccagccauucucccuccuuuaugguguguguguguguguguguguguguguguguguguguguuuguaugggugcuuagagaggucagaagagagcucugggucccugggucugggguuauaugcuccugagucauuaugcggguccugggauccaagccuggcccuccucgggaacagugagggcuuuuagcugcugagccugcccuccaccauucccuccagacucaguucucugcacucuguacaucagcaggucccucccucccuuuucauggaggggaagggagcaccaccaccaguuucuugucaacuauacagugaaguaaagaccacaaaguggguuaaaccacaguagaucucuauuacuuuucuuucacaaaucagcagauuuucacuuaaaaaaaauucuaaacuuauauccugaagacccaacucuauaaguacccuuugucagacuauuccccauccccccaaucagauaaacauugcuuguguuacauuucuggguaagaauggacagaaagucuucucugcucuguaauagugauuaugagcuugaucacaggaaagaugacuuguucuguuuuaggucuugucagcuuuaaagcuuugauugaagaaucagaaaugaaaaaauucccagacaaugaucuuuugcgucaccuucgacuagucacgcaggaugcagaaaagugugccucuguugcccagcaguugcuuaauggcaaaaggcaaacaagguaucuauuucugacuguaugagaauggacucugaggcaccugaaccuaggaacccauuggcaucuccgaguaaugaaugcacgugucuucauggcuuucuccggcccuugucuuuguagguaucgaucugguggaggaaagucucagaaucagcugacggugaaugaacuuagacaguuugugacucagcuguaugcucugccgugcguccuuagucagacaccguugcuaaagguaaccauauaaagaucuguaggacuucagguauauuuauauacucaauugacaucauuaaguuggucaguuggcucuuuggugguuaauuuguuauuguguguguguguguuucugcagaagccaaaggagagcaucagauauauuaaaucuggaauuaacaaugguugugagccaccuguuauggggggcugggaacugcugcucuguccucuugaagaguggcaagugcuccugaccugagccaauaauucacaaauauuugaauuuuuguuuguggaauagugggugguuauaaggagauucuauuaaaaggaagauaaaguugagauuuuuauugugaaagugaccacugagucuagcauggugaaccacacuuaaaauuucaacauuuagaucccaaggcaggagaacugccauaaguaugaaggcagucugggcuccauaguaaguccggagcuggagagaugguucugagcucuugcuacacaaucaguaugaccagagguugaauuuucugugcauguuccaguuccacuggggcccagagcaggauuauggcuaaggcguguuggcuuccuagcugaaaaaauugugagggccauguggcucagggagggagccugcuuuggagaaauagggaacucuuuuuuuauuuuuuuuuuuaagauuuauuuuauuaauauauguaaguacacuguagcugucuucagacacuccagaagagggagucagaucuuguuguugucuuggaugguugugagccaccaugugguugcugggauuugaacuuuggaccuucggaagagcagucgggugcucuuacccacuaagccaucucaccagcccggagaaauagggaacucuuaaugcccucuucugcucaucacaagcaugaaugccugaaggugcagauacccucugaaugcacaugcacauaaacucacauagacugauacacagaaaaaaaaaaacaaaacuaaaguaagaaaaagugacuaccagccaguucuucucauugguauaaauuuuauguuaugaccuccuauuugggcucucaggugucauuuacguugcuuuguuuacucacauuauuacugacauaacaugguuugguaaagaaaguuacaccucuuuuuccuuuuucuauuuucuuuauuauuccucuuuuuuuucuuuuuuucuucucuuuuuuuuuucuuuuugguuuucugagacaggguuuuucuguguagcugucuggaacuugcucuauaaaccaggcuggccucaaacucagccugccucugccuguugaggccugggauuaaaguugcccaccaccacuacccugcugaacuuguauucugaugguaugacuuugauuguuugccuuugucuucuuuuaggaucucuugaaucguguggaagauuuccaacagcaaagccaaaaacuacugucugaggaaaugccuagcgcugccgagcuacaggaguugcuggaugucagcuuugaauuugauguugagcuuccacagcucacugagaugcgcauucgcuuagagcaggcccgcuggcuggaagagguucagcaggcuugccuggacuccagcucccuuucuuuggaugauaugagacgacucauagacuuagggguggggcuggcuccauauucugcuguggagaaagcuauggcccgccugcaggagcugcuaacagugucagaacacugggacgacaaagccaagagucuccucagagcaagguagacaaacacaaggcagucucuagagcuuuggauaauagaugaaccuuuaaguguaggacagagagaagccacuauuuggcaagugcuuauaaacguuugcuguccuuauagaauacuugugcaaaaagcugaucuguuugggcuugauuugaacaugaguaaugaaaauuacaggguuugugauauacacuuuuaaucccagcacuugggaggcagaggcagguggauugcugugagugugaggucagccuggccacauagugagauccuguuucagaagagagaaaaaucuuaguuauuuuaaugcuuaugaaauaaauuauuaaauggaaaugaucauuguaaagauaagguugaaugagauuuuccuauagucucuaauaauacuaucuuugaaagaagaaaaaguuuacaaaauaaauaaguagauaaauaaaugcaaaauaaauagaaucuagagucaugaaagacaaaucaaaugucugagaguugacgcguucauucugugcaaugauguaauacagaauauuuuaaguagaaauuacuauuuuuccucuugcuugguaggucuggaugcuucauuuguuuuauaccuuuggacagaggugugauaggcgucugugcugggggugaaaaugaagucauuuccuaacccuucuuucucuguggcaaaucuuuauugguucgguaggcaacauaggcaguaaaaagucuagguuacagauacuguuuugcauucuuaagauaguggucauugagcugagagggugugaaauuuuuugccauuguguuuugaguguguuaauguuuuagagaauuuaaauuuucuuaguuuuucugauucuuaacauuuuauuuggcuuaacauagaagaaacuaccaguuaguaacuaguauuaguaagcuacuuuuugcauuagaacuuuauuucauaaaaucaggaacauguagaacuaauuauguuucuagacucugggaauuuaagagauggcucagcuagcugcuaaaagugccccugcucuguuguagggcacaagcuccagagcugccugugcccucucugcaaggcauuucugcaugugcacguacaaugaugaaagccauaccugcuuucaauaacuugaucauuugaaaugagugaacuugauaugcagugauuagugccauuacgguuuuuuuauuguuguggugaauuucuuccuagaaaugaucuuccuagucuuuuggcaucuauaagaaaaaugcaguuuguggcuggagagauggcucuguaguuaggagcacuggcugcuucucuagagaucccaguacccaugugccaguucaccacugucuguaacuccaagggauccaugacaccaggcaggcauguggugcacauacaugugcgugcaggcaaaauacucauacacauaaaguaaaauaaaucuuaaaaauaagagagagaaaaggaaaaugcaguugugaaaugucugugcaguuggaaaugucucuguuuugcuuucacagaccacggcauucuuugaguagccuugcuacagcagucaaagagauggaggagauccccgccuaccugcccaaugguacaguccugaaggauucugugcaaagagccagagacuggguucaggauguggaugcauugcagguagguugaaaaagaaaaacaacauccugagucugucugugcuguuagugugauuuccuccuaccuggacaggccuggguaaggcuuucagaguuugacagcagugagcagaagaauaggcaggcggaagcaggagcaggaggcuguaguccucccaaccuggugucuguggcccuugaugcuaaagguucaguagcucucagucaugugcagucucggccugcaagcuggcuucuuagagcuguugucccucaucucuguguuguuuuuggcugagauguuuggugugugauuguugugugugugguuauuuuucuugaguguguucacuugucauuuaguucauaaauguauuaaagccuuuuuaagauuuguucaucauguguaugacuguugugcccuuaugugugucugugugucauauggaugccugguuccugaggaauucagaagaggguguuggguccccugggacuacacuuacauguggggccugggaaucaagccuggguccucugagccaccuccccaaggacaguuauauaaaucuuucuuugacaauuuccccaacuucuucucccacuccuuagacaccucuaguggguccccucucuuuuauuucuaacccauagaccuauucgugacuuacugaaucagaaugucugggaugagaaccaggaaacuguguauaaguaaaugggcuuuccacaugauucuuauaugugcugauguuuuaagaaacauuggguuuucuagcuuauauuuuaauuuccugaguaauuuguacugacuuguuuuaggaagucacuagugacaagugaauuggaauaaaauauuaucuuuaaaagaaugcaagucaaacucacucuaguacaaauauuucuguugagauaaauuucuuugauacuguucauagaaaccaaugugagagaccuuauagguauaaaaaauuuauagauggauauaaauaaacagauaaaagagauaauugugucacuuuuuuuauccuuuggagccuagcauuaaguguuugcccacccuugcugaauuuaacauguuuuagucauggagucauugaccaugagcuacacugaaguauacuuuuccuauuuuauguagaaguauccuuuucuuaauuuauuaggcaggaggacgugugccaguguuagagacacucauugaacuuguugcaagaggccgaucuaucccaguacaucucaauucuuuaccaagauuggaaauguuaguagcugaaguucaugcauggaaagaaugugcugcuaaaacauucuugccugagaauucuacauauucucuguuagagguaaguuugcaaugagcuugugugcaggaacuuugaucucuaguuugaaugaguuuauagcaagcaaaagugaccucauuggaucuaauugugaguaguuuuuaagcaaccuuugaauguuuucuggcuucauuuaggauauaguugagaacauuuuuuucauuagguuuuguguauguguguaagauaagucucucuguucucagggauucuugaauuguggcagucuucugcccugccucuucaguucagggcuugcaggugugugcaccuccgcagcuggcuguguaacaguuucuauuuaugcucaaauuagacuccaguccuggcuaugauucaccaccuuuguuucauguguauggcuggcuugccugcauguaugucuggguaccauuuguguucagugcccauggaaucuaaaguuugucccuuagaauuggaguuugauagcugugaaccuuaugggugcugggaauuggaaucuggaagacaguugaugcucuuaagcacugagccaucucuagcccuacugcccgcauuuuuaguaaaccugagaugugaccucacugaguuuucauaaaaagcuuaagaguauuuuuauauuuuuuguaagcuguccauuaucauuggaaucaguauauccuuuuaaccgauuucauuaaaucuggaacaaaaggcuauguuuuuggagccugcuuuuccuccugucacuuuuucucuuguuuaaucauuggugugugugugugugugucuguguguguguguuguacaugccugucuaugaguagaguuuuuagaggcagcaugcuucaaagaaaauggacugugagaaacauucauguacugcucaggccuuuaauuugguuaaucugaagucuguuucaccauuggcucuguuuucucuuacauuagguucuuugcccucggugugacauuggccuuuuggggcugaaaaggaaacagagaaaguugaaggagcccuugccgaguggaaagaagagaagcaccaaguuagagagccugagcgaucuggagagggcucugauggagagcaaagagacugcggcagcugugcguacaggguuucuucugcucuaucuugggggaggguaguuccuuacuuuuucaggacuagguaggaauagcagcaugguuagcagacagcauaacuugaaaaaugcuuguguuugccaaaagaauuuuugaaaauugugaaguuuaaggauagaguuggugagguauguuucagugguaaagcccuugccuggcauuaaugagugccugaauucugcaaaauuauaagacacaaaacauccccacaggugcauaaaauuugcaguaacccugguugucuuggaacucacuauguagaccauaauguccuugagcuugccucugccuccuaagugcugggauuaaggugugugucaccaugccuagcucagucugagccuugaauauugagagugcuuauggauuaucuagaaguacuagcuaaggcaaucaaggcugccaggaaggucaaacugcaaaguuaacuuguuaacuugccacaggaaacacaucaaaagcaucuaggagcuggguaggguggcuagcgcucaggaggcagaggcagauggaucugaguugcaggccagcgcuacaggacgagacgcuaucucaaaacaguuaaggaaaaaaaguuaugcugaauaauugaguccuugcccacguuuuguaagcauuguugauucaagauagugcccaagaagguucagcaguaucuggcugacauuuaaugagcagagucuuggugaaaggacccagcugugugaucgcugggcugcugagcuggaucagugggugaaggcccuugccacaauguggagcauaacuaaggauagaguuaagugucacagaucagugggacacauucuggggaauguguuguugguggguuuagucauugucauaccaacucaaacuagucuguaucaaauagucugcauggugguagacaguacagugucaccaggaucucuggauuauacugugcauggugaccgagacaugagugcacagcauguacugaacuugacuguggggcuaacugaaugggcucgucuuugggcagugcaguguuucucuaguagcuaccugacaugacauaaaauugccuugguuuauuuauaaauuuugaaaccuagaaucuguucuuuauaaaaagacagucaaauuuauggaaagucuguuuuuuguuuuuuucccccuuauaguauguuuguaugugucugcuacuugaguacuguucaggcaguuuauuuuaugaagacuucauagaaaguggugguucucuccuugaaauacacaaauaccuaugccggcuuugcaugcguuaucuuucauagacucuagugucuguguguacgcaggcuaugaguaugcuaugguccucauuugcuuuccauugcugagcugagggaggggaccuuguaaaugcauaacauauacauacaugcauaucuauuuauaugaacauuacauucaacaagaauagauguuauuuuaauaucccuuaagucuguuaugguuuacuucuacaccuguucccccuccaaaaacaaacaaacuucuuuauuugugugucuacugaaaaucugaaaagagguaauggagaauuccuucuauccuuaugacucagacaucucaccugaugaaucaagauugaucugcuuugguucuuaaagaauauguuucaucuguucucuccuggugcuuucccuugagacaguuggccaguuaaucuggacagaucccuagugucuagagaaaauguguuuaaaauaucauacagucuuaagacugaaguugauccugucuauguauuuucaggccucuuuauaagguuaagaggcaugugcuaccauguccaguuaauuuaugaagugcuaggaauggacuacagugcuucaugcaugcgagggaagagcucuuuagcuacaucccagcuccaggugguuuucuauuuaaggauuuuuuuaaauuauuuuuauuuuuuuauuuuauuuuuugucagauacuaauuucauagccuauuauugcuguguucaucaccucuaggugcuuuaccagugaaccacaguaagacauagaucagcuacugugcaguggcuucuugagccccacucacccccgacccauuguaguugaggcucgauugaagcucaggcugcacucaguccucuugccuuugccuccugauugccacgcuuucagucuugagcuaccacuccuuuucuagaagagcacagaaucuaagggaauggaucuaguagagaagguccgaagugagcagacauagucuuuucagcgagguaaauauucuaggcaauauaugucuacagguuggacuuuaagagguggugcaacauguuaaguaauugcugaguaaauaguuguauuuacuaugugcagaacagaguguugugucucaucucaguagggucucaccauagaccuuguuggcuugcaucuugcuguccuguucauuuagccauaguagauuguaacuuagccagaggcagagcuugcuuuggacuggaaugcagauagguucuacucuguaaccuaucuaauuagcuuuuuaggaucaugaguugugaaggaagggauaguucugugacagugucuuuguuggccuuuucagauggcaacucuuggggaagcucgccuacgagagauggaagcuuugcagucucucagauuugccaaugaagagaaauugcugucaccuguccaagacuuagagaugaaagucugcuugugucagaagacuccagccacucccaugauucagugugaacucugcagggaugcuuuccauacuaguuguguggcagcacccaguauuucacaaagcucccgaaucuggcuuuguccucacugucggaggucagagaagccuccauuagagaaaauucugccucugcuggccucccuacagcguauacgaguucgucuuccugaaggagaugcacuccgauacaugauugaaagaaccgugaacuggcaacauagagcccagcagcugcuuucuucagggaaucuaaaacuugugcaagaccaaguggguucuggacuguugucuagcagauggccagccucagcaggacaggcaucagcaacagacaaggugagccugcacuuugugggauacuguggucugcauagcucugugguucugucugguguggccauuccugagaccauccccuaccggccccagcauucacgacacuggccucuccuuuuaccuuaccuggguucugaggaaauccgaucaucaggcuuaggcagcacaccaucuugcuagcccugcuuuuccuguuuugagcagaagucucagcuggcccagaaugguuuuugaauuuacuguaugugaucuucagcuacuguccugccucuaugcuggggcuaugggcggcaugugagacuguuuaguucuggggccugaaaguaggacuucaugcaucagacacuugaggaagccaaccgaauugcacccccacacugaggagucugucucagacaugcuauuucuguuguaccucuucugcauauaauucuacuucauuaucuguaaguguaugcaugguuaguuuaugcauauacauuuuugcuugguugaauuuucuuuuuccuuucauguaagucccgggcuggaaagggaaaccgccacaugccuguccuuuaagggagaauaaugugugcagaguucagaugcguuuacacgcuugugugcguaggccucuguggagcugucuacuuugguuuuuugagucgggguuucuucacuaaaauccaaggcugaccgaccagugagcuccaaggaccugcuuguccccuauuccaucgugcugggacuaagaacauaugcuaccauaccgagcuuacuguuuuugucugcuugcuugcuucaguguaggugcuggaaaucaaacucagguguuucaugcuuaugcaugaggaacacauuauaaauugaaaugucuucccuguucacgaucuucuuauggagagguagaaccuucuaccaguuacccugcagguggucagguucccuuggcuccugugugggggcugcaggaagaguggugguaaggagagugcaguuagaauggcaguagucaguucccuccuuuuucuuuagauuuguuauuuauguguaugcauguuugccacaugugugccugguacugacagaggucagaagaggacacuggauccccuggaacugggugcugggaauugaacccaggacucuacuggaagaagugcucuuaacucugagccaaccccuacagccccuuuaauuuuuuaaacaguuccuuugauccugugaguccugguuauugaacucaagucauuaaguuuaacggcaagcaccuuucucucuuuaucugcugagccauuuugauggcccccuaucccaauauauuuucuguaacagauauuuacaaacuggguauagugcuauucaccugcacccuuagcuauucugcagggugaggucacuugagcacaggaguuuagaccaggcugucccugcaucucucuaaacagcuugaggacagauaagucuaguauguuugccuggggucugaccccagcaaagcaucacaaagguggugaaagguucaggauucccaugccuggcugaugacagcuccagaauugggugauucccagggcacagguguagggacuggaaacagccuguccuacuugagcuuuuccucugcuggcaucugaguagcagcaccugaugaaauauugcagaguuccgugcacuucuugaccagggguguucugagagguuaauuugauugauuauaaagggaaaggacaaaguugugacugguuucugagacaggguuucauagaaccauggauguccucaaccuccugauucuccugcuguucccucccaagugcuaggauuacaggggugugccaccauguccagcucaugacgguuacacgccggcugaguaauuugucguaaaguuacacaagcacugaaaggugguaggaucuucucucucuggggucaggcugaguuaacuuggaaaguuggauggcuuuguuuccaugagaguggguuuggcuggguuuuaggugcuagaggagacuuacugaaaaaaagaaaaaaagaaaaaaaaaacccaaagccuccuacuaagguguuugucuuccaucaggugucucagccuccuggcacaacauccuuuucauugcccgaugacugggacaacagaaccucauauuuacacucucccuucucuacuggacagaguugucucccccuccaugguuuguauuuuauuuuguacuauuccuagaugauacaaggccaucuggccuaggguuuuauaauagaugaucuggcauccuaaagagcaaguaugguuuuacauguguguaccaugagcauuguggaggcagaggcgggauuugggcuacaaagcaaggaagacauauuacuguacauuuucuaauguugaucauauuugaagaucuauaaacacaaaggauaccuauucugauuuauuuugacuacauuuaaguuaguccugugccaucuagcaccaagcaccguguauucagggcagaugcuaagucauggacgaccuuguuugcgauucuggaggauauugaaagucauucauauuuuaaaucuaccucuuuccauucccuuauggguggccuuaaauuuaaucuuuagucaaaauuaucucuuuuuuaaacauuuguuuuuuauuuuaauuuuguguguauggguguuuugccuaccuguaugucuguaccauguguauguggugucuguagacugucagaucuccuggggguggaauuacagacaguugugagccaccauguuagugcuaugaauugaacccagguccucuggaagagcagccagugcucuuuaauuucuaagccaucucuccggcccuggaaaaugaucuuaaaguucugguccaugcuccuguugccaagugcugagaugacaggugugagcuaucacaccuggcuuuuuccucugugugcgugcgugugugcaugcgugugugugaugagguuagcuaauguuggucacaaacuccuauguagcugaacuccugauccuccuauuucuaauucugaagugcugggauuaugagucuguaccaccaaucauaauccucaauucuuagaauuuugccuaguuucaacuggaaucuacauccucagccuucuuaccucaggguguucauggucagucucauggucugagcuccuugcuguccuccaugcucuaggagauagugaaaugugucaguugugauggaguggguguuuccccuguaacgcaguagggaaucugcguuagcccugcucugguuuaggggcauuaagaccuaacaaaccgacugcaguuaaaggaggaaugguggaaggcggaguggaggugguuuucugucccugacaggcuuaccagugcuuguauuaaaugucuccguuccuauucugauugucuguggucguuaacagguuugaguccagaagugaaugaauugcugauggaagcccagcugcuccagguaucccuuccugaaauucaggagcuuuaucagacucuacuuacuaagccaagcucuguucagcaagcugaccgaaguucaccaguuagauccagcagugagaaggugagugagucgaagauguauagcuugugcuugccaguguccuucucacuaauuauuuugcaaaggggguggcugugucuuugagccacgagagcacacaaacugucugccucacagcuauguucuacaaaaggacagacacuggcaccacugguagcaauuugggugucacagcuuagauuucagucauggauuuuuacaucuacauuuuucuuuuuucuuuuuaaggaacucuucuuauugcucccaaaugguaauauugagaaguagaccuauuuuccucuauagaagcauugcuauaaagaugaaaauacaauuauagcugaaagggcuuuuuguuaauaaauguuuuaagaaugcuagcgagcagacgcuucucaucucuguaggucagagaucaguguagccagagcugcggcuguggaggcugagcugcuuauccuagaccugacagacacuggaaugucugcugggccccuuucauucauguugcagguuuuguuuuuguuucaagacaggguuucucuguguagcccuggcuguccuggagcucacucuguagaccaggcucgccuugaacucagaaaucugccugccuuugccucccaagugcugggauuaaaggcgugcgccaccacugcucggcucguguguauuuuugugugguauguuuauacuuucacauguguauguacaggugugcgcgcacacacacacacauaugcuugugaugcaguuccugguguuaauguguagaauuguggauugcucuccaccugauucauugagauuagaucucugaauuggacucagagauagcagaugacuaacuuuuuucaggaaucccuuaucucugccuugcaaggcugaaaccacagacgagccaccacagccucagagcauugacauugacauuugggguccucuugcuuuuauggcagaggacacauuaaccgcugagucaccuccccaggcccuguagcauccccucucucagcacuguuaagaagcuucugcucguagggcgugguggcgcacgccuuuaaucccagcacugaggcagaggcaggcggauuucugaguucgaggccagccuggucuacaaagugaguuccaggacagccagggcuauacagagaaacccugucuugaaaaacaaaaaaacaaaacaaaacaaaacaaccaaagcagcagcagcagcagcuucugcucgguugugcucugcgcagagccgucaccaguguccccaagaguguaaucaggaugaaacacaccagggaagacugagucacagggaacaagaucugggugaaagguacccuaaaauugaccacagccaaccuagucgucacuccugugagguugcgauagauagccuucacaaaugcuuacucaccuaaggauuugguaaaauggacggucuguguaugucuuuucucugcuguuacuagcaggccgcauugaaguuugguauccccagcucgccaacagugcugagcgaagggaguuaagcuggcuguggagacugaagcuguggagaugguagcagcgguuaggaugcaggguucucauuugcacguuuuucuuuaguucaguuuugguaaugggcaaauuucuuuaguucaguuuugguaacgggcaaacugagagcuaacacugaauuugccaucucccacacagaacgauugccuucgagggaaacgagaugcaaucaacaguccugagaggaaacugaaaaggcgcccagaaagagaaggccuuccuagcgagcggugggaucgaguuaaacacaugcggaccccccaaaagaagaaaaucaaacugagucaccccaaggacauggacaguuucaaguuagaaagagagcguagcuaugacuuagugcguaaugcugaaacucauucccugcccucagacacauccuacuccgaacaggaggacucugaggaugaagaugccaucuguccagcugugagcugccugcagccagaaggagaugaggucagugagguuugggccauagaggacgcgcuuuccccuaacucagaaacccuguaagcuagaccucgucuccuugggucuuucucuucugcuugucugcuuugagcugaucugaguggauugcucaguucuccccuccugauaaucucugcuuuuaacaucguccugggucuccuccuuuucuugaagaaacucucguucuuccuuuuauccuucucucgcuccuccagcuuucaccgucccggcgcucagaaggugggagggaugcugauggagugagugcccuuuugcuuacugucacagggcagcacugucuaccccaaagcaggcacaaccugaagagugacucugccucccagcuacacuccugugguuagcuguugugccagaggccccagugcggggacaguggcaaacggccugcccgauuuugaauggcauuguuuccucugaaccccccaucucccugcucuuuguaaccagguggacuggguccagugugauggcagcugcaaucagugguuucaccaggucuguguuggugucucuccagagauggcagagaaggaagacuacaucugugugcgcuguacugggaaggacgcaccaagccgaaaguaaaaacaaaacacacacucacuucauguaauucaggacuccaauaaagaagauuuccucaaucucagcaaagcuacaggacuggggucgagccagccuguacacggugcuauuucuauuccuuaugggaucauuuuuccagaacucuuugaaaaaaagaaaaaacaacuaaaaaaauuuugacacuuuuuuguaauuuuuuuccuuaaaagcuguuugugguuguugaaguuuaaaaugcugacuguuuuuugcaggggucucuacugauuacgaagguauuggaguuugcaccuuuuuguguacagcaaaacauuguacuucugccugggauaugccggcuuaagaguccaacucaguuucagagcccagcaggggcaccagaauuccaguaacccucacagagcagccgcgcuccuuugucugucaccacauuggggggauuuuaaguuuuuacuuugggguuuuuguuccuuucuuucuccccuuuuccuuucugguaggcuagguuuauuuaucucagcaauaacuucuauguugguuucaguggcuggaauuaaaacaaaacaaacuucuaaacaguguguuggugcuuuagcauuuggcucauguacagaaagcaaaugucuaguuucuggugucacugcacuagugauuuaggaagagacugcgcuguaaguaaucgcccgccacggcuguauuuuggcuuucucccuacucagucccccacccccacccuuuuuuuuuuuuuuuuuuuuugguagaauguaucaaauguugcaguuuauauuguggaauaauaaauccuugguccuauucuaacacuagacuacagcuucuucugcccuuccaccucgugggccugcagaaccagaaggguugcuugcuucugcuucuucccaggcaggcagccgcagaaguguguuugcucuaggagacucuguagccuuauucucugggugggccugugccuucaugccccacuaauaaagaaucccugucuuuaaagaccagagccaguccuuuaagccauguucuuuuucaguaagcccucagaauauuggagugguccccaaaucacuccagacuguaagacagcucuccuauggaaugcuuuuauugucauugaauugacagggaaguuugguugagaugugguccaucaucuuagaggcucagaucuguuguaucaguugagggggaccuugggccugccugggauuucucugccaucuauguaauuucaucagucucucugguuguggacagccgauaccaguuuccccugaucugcagagaggaagacuuccagugagcagaacaggcucuugcucacuuuucuccuaaguuguugcaagcucuuguuuuccucacugucuguagccauaagccugauggugggcagaguuagcagaccuuuaauaaaacaucaaaaagcaguuugugaaauagcgaaaauuuaaauguacuguccccuaugcaauccagguaauuaaaucuguuuaag

SEQ ID NO: 12281 - RNA, 11526 nt, Mus musculus
agcgucauggcugcccgugcuccugagcucgcgcguucccugcuugcugcccuucuggcgcccgcgcugguggcacuacuggugucgccggccucgggucgcggaggccgggaccacggggacugggacguggacaggcgauugccuccgcugccaccccgcgaagacgggccgcgcguggcccgcuucgugacucacgucucagacuggggcucgcuggccacuaucuccacaauaaaggaggugcgcggcuggcccuucgcggacaucaucucaaucagugacgguccuccgggagaaggcacgggcgagcccuacauguaccugaguccacugcagcaagccgugagcgaccugcaggugagcgggagcgcggcgcgguuucccagacccggcagagcaggaaaccagcgucuccaguuuagcucgcuggggagagcgugggucuuagagauaagacuuuugaacccagcucacaugacugucucuucuggccugcgcuggcuaggcggagguuguagcaucccagauguuggggaacuaccaggaaguuccuacuuacccuguuacuggucuaagcgcuugggguaaauucuuugccaguaccuggagcacuucacacccuucagauagucaggcguccucuuuaggcgcugucucugcauaaacugcacucuugugaucuaaaggcauacagauuguuggauaguuuagcguuuggcuuaugugacuucggagauucucuucccuaccuuuaccuaucagcagugggaaacuacuacacagcauuauaguugacugcggaccuggcucugcuuacagcucagguggaaacagccugggagggaaaggccacacaggagcccagaaaugaagccugacucgguggagggucuguggcaaaacugagaaagcuuggugucgugguaaacagugagccaagagacgccgacgcuuuaaccaagcccuugccaugguaugugccuagggcuuuucgguuccaccuguuuucauucauugucucuuguaguaacucuuagaaacaggcauggcuauuccggguuuacagaugaagacaugagguuaaguaauuugcgcaaagccagggggccaacccuaguucaccucagacccacuugucuucaaagcacaggccacaggacugggacccaugugcuagaauagaagagacccguuuucuucagccuccacagaguucuguauuguucuaaacaaauuuaaauuagcuacugccuuuuaaaacugcaauccuaggggcuagggaaauagcccaguugguaaaauacuugccauguaggcgcgaggaccuguauuugguccucaguacccaucuugacagcuugcacgcacaugugauccuacacuggcucaacggcuugcacacacuugcacacacgugugaucuugcacuggccagguggcuagcucccuggccugccagccaagcggagucagugagcuucagaccgcagggagagagagccuggcucaaaaagccaguuggauggcuccagcuucugaggagugaccuccaaaacugaccucuggccacaccauacacucauuaauacccaaugcaccuguggugcaccugcacucugcacgcgugcgcacacacacgcaggauaaaauuuuagagaacaaagucuauugauuugcucuuuaaguuucuaacucuucuugaaaagguuaaagaccuagcagcacugggaguggggguggggcuauauuuuucugagagacaaaaguaauagaagccgcugucccucccagccagauauauugaccccaacucgccccuuuuuuuaaccagcccguuucacuucucuagaaucugcuauucacccguucucucuaccccagagguggcacucaagugaccugcguagcacuugcagagaaguuuuaaaaugcacuaccaagccacuuuauucuagaacaaugcccccuacucccucaaacccucacuggugauccuaauaggaaggggacagacugagccucgccccgacccaugaucuuauuacuaucugugagguaucuggggugucauuauccacacugccgaaauggggagcacugaggcuuagagaugggggcucacccgugaccaccuagcugauggccaacagguaggccuccagugaaguauuuccugguagaagagaggcagauucgaggagccuccccaggcucucggguuucugggaugguauuauugaaaagacguguggacacguugggaaugucagccuuugucuggauacugacucggccaauuaaccagccgaaacugguuccuauuacgcguuuccucuuccagcaaccaagagucucuucaugaggcuagaaagagccaggcugaggcuugagaccacuugcccgguguaaaaugccggccaucucccucacagacaaggggcggcuugggugugugucccguaagggugucccucuugucuaguuguuuuggugugugauauuuuuguauaaugaaucuuuagaggaagaaucuguuucugcugguugguaauaugguaccaaguuauguuguagagccagcaaguccacaguaaaauuggcagggugcuuaccuaggcugugggaagcccugcguuguauccuggggcuuggugauaaggcccuaaauauacagucucaggauuuggaggcgggggcagaaggaucuucagcucaagguuaguuuucucuguuaucuggugguuuccgaccuggcuggacugucuaauguccucucucaaagcaaacaaaauccuuuuaccucuccguccuucuuggcgcugcucucuugugaucugaccagguuacuccugauuucucuuccccuuugacccauuaaaaacaagucaacuuuguuaugugcacagucaugguucuccuuucaguuaggauuuacuuccgcauuggggugccuguugggucuccucagagucuuguauuucuuucuuuuuaaagauuuauuuauuuauuuuauauauaugacuacacuguggcugucuucagacacaccagaagagagcaucgaaucccauuacagaugguugugagucaccaugugguugcugggauugaacucaggaccucuggaagagcagucacuguucuuaacugcugagccaucucuccagccccgagucuuguauuucugauggccuucauuaaguaucuguccagugaaagucccauuuuccucuuguucuuggaaacccauagccccugaccggcagcauccuggauuguggaauuauuuucacauuagaauucccauugccucuccacaucuccgucuuucuucugcugucuuuguuaucaucccugcucccuccucuucagucacaccaugcuuaggcuaaguccucgacaccucaugcuagaaagugcucauacaacuuuuaaauuaucugucugaaccauccugcucaccagaacuuauaauaacaaaaauacagguugcccucugcacagaggacuuaaacacuccugcuccuccuccuccugcuccagcuccugcuccuccuccugcuucuccuccugcuucagcuccagcuccugcuccuccuccugcuccugcuucuccuccugcuucagcuccagcuccugcucuuccuccugcuccugcuucuccuccugcuccugcuucuccuccugcuccugcuucuccuccuccuccugcuccuccuccugcuccugcuccagcuccugcucuuccuccugcuccugcuucuccuccugcuccugcuuuuccuccugcuccugcuucuccuccugcuccugcuucuccuccuccuccugcuccugcuccuccuccugcuccugcuccagcuccugcucuuccuccugcuccagcuccugcucuuccucuuguuccugcuccuccuccugcuccagcuccugcuccuccuccugcuccugcuucuccuccuacuccuacuccugcuccagcuccugcuccugcuucucuuccugcuccugcuccugcucuuccuccugcuccuccuccugcuccuccugcuccuccuccuccuccuccuccuccugcuccucuuccuccuccugcuccuccugcuccuccuccuccuccugcuccugcuccuccugcuccugcuccugcuccuccuccuccugcuccugcuccugcucuuccuccugcuccugcuccuccuccugcuccugcuccuccugcucuuccuccugcuccugcuccugcuccuccuccugcuccugcuccuccugcuccugcucuuccuccugcuccugcuccuccuccugcuccugcuccugcuccuccugcuccugcucuuccuccugcuccugcucuuccuccugcuccuccugcuccuccugcuccugcuccuccuccugcuccugcuccugcucuuccuccugcuccugcuccugcuccuccugcuccugcuccuccuccugcuccugcuccugcuccugcucuuccuccugcuccugcuccugcuccuccugcuccugcuccuccuccugcuccugcucuuccuccugcuccugcuccuccugcuccugcuccuccucuugcuccugcuccugcuucugccgagcuucaaacccuggugucaggucugaggagaugggucaucaggaaaagagcuugccaugcaaguaucaaggguuuugaucccuagcacccacguagaaaaucagcugaacuuccuguacucccacugcuuggcaaauggaauccccuggggcaaguuaaggaguuccugguucauccacacuuguguaucugcccacauacaugggaacacacacacaaacacacacacacacacacacacacacacacacacacacacucacacucacacacacaggugcacaaguaguaaaauaaguaaaaccuuggguacagauuggugcggggacucagcauuuuaacagacucgguaugggauucuagaaagcacugcuuggguauugccugcagaguucacaguagggaaaccucacccaaggcucccucuuguuuuccuccuuggggagguugaggcgggaggguuccucuucuuaccuaacagcuugcagacagcaaauuccuuagcuggagugaagguguguacuucuuaccuagcagcaugcccagcaagaucgucuuuauuuuugauuauguguguguguguggcuaucucuguguauguauugaugugagugugugggggcccucaaaggccagauauuggauccuuuggagcugaacuuacuuaaaagugaccgugagccacugggcguggguucuggaaggggagcgugggccuuuggaagagcagucacacuccucccugcugagccccuccccuccccgcuucccugagcagcucugagacucaguggguuugaugggccauugugagaugggcgcaugcaguugugagugugcaguagucuggaacaauggugggugcuggagagaaaccaaccaggaaucuuuuugccuuggguuuggaaucugagguaaaaauuuucaugugacagaaagaguaagcaacuugagaccacgugacaauuucugcagccaagugauagccacucagcaugauucagcuacuuucuuguuuaaauugugcaauuaggccgugcgagcaccuguggucauuuuaugcaguuuuucuuuuuucuuuuuucuuuuaauuagagcuuaaucuuguagauauuccagcccuaguuuaggggguacuuuauuuauaauucugauaaguauggaacugauaggacuagcuaugcuaaaacauccucuacaguuuguuaauuuaaaacaugacaccucuccacacacacuuuguggggaugggacagguuuuuacccaugggucaccccacccccaccccaguggguuacaguucacuguuucauggaagugagcugcagucaguuccaggggauaguuugacugcgggcuguaaaguguguaccucuccagaaacuguauuuuacaaugaaggauuuuuauuuuucucucuucaggaaaauccagaggcuacgcugacuaugucuuuagcacagacugucuacuguaggaaucauggauuugauccccagaguccccuguguguucauauaaugaugucgggaacugugaccaagguaaguuccacgaagagagaugggcuuaaaagaaugugguggcauuaaaaaccaagggaggggucuuuggagaauaaaacgcaauugauuugugagugggcagaugguaagaauauguccuaacacagauuucaacaacuaaaggcccugaccagggucugucauauagguguguccaguaggguacuuauggggcaaaggacccuuguccuggagccaaauagauguaacaucuggaaggcuccuuauaaaacacucuggcuaaaaacagcugcucauuccgaaccauugcucucuaguuucagggggcuccuuguccucgugccucugccucccaagugcuacuucuaagcacuuuugcccuucuugcacaugcauugaauagaguaggugugagggcacuuucaggccugggugacagccagugcuucugggccauggacagugcuagcuuggaaugacuguugaacagccaagcuccacccccaucaugguuccugcuuuauuugugugugucauuacaaguuugaaagggcacguuucucuguuuucuuuaggcuuccuguacgcucuugacucuuaagaucagaauuugcaacggaacgaggugccaggcaguuuguggugugagaaccaccccuucuuaguaagauaaaaguguccuuagaacggccuguuuaucuccuguuuguccuucaggugaacaagacagaagaggacuaugcaagggauucgcuguuuguucgacacccugagaugaagcacuggccuuccagccauaacugguucuuugcuaaauuaaaaauaagccguaucugggucuuggacuacuuugguggaccuaaaguagugacaccugaagaauauuuuaacgucacgcugcaguaaguaauuauacauuuuccaccauugccggacuguagcucuucccagcacccccaaggcugagccugcuaggaccaccucucaaaauuacaaaacacaugggauuacaaagacacuaggcauaggaacacacaccuuuaaucccucucaucagugucagaugcagaauuaguaaacucaccuguaacccuagaccuugggagacaagggcaagaggauuagcaauucaaggccagccuggaaggcugaaaaucagcucaaguuacaugaaacuguguuugaaacaaaaacaagcccaacaagggggaccuaguaacgggccuguagcucucagcguagugaagccuagggucuauauuuuaugacauuuucuacacccacaacuauaacacaauuggaagggaucuguggccugcagagguaauggaguugauuccaaaggggcuacuggagagaaaggaaaagaguacgggagguuuaaguucaaguuuagcaguugggcccugggguuugggugugaaucucagcauugcaaaacaauaauaaaauuacuaagggcuggagacauagcucagcccaagggccuggguuugguccccaguacaucuagucuggaaguagaaaagaacaguaucuaaagauggccugggccgggaagaagggaguggucagauguggagugaggucaaaugaggucaagggucagaggacagaaugggagggacuagaguguucccuaagugacacuggauuuugcaauauaggacaucuaucuacaagcccaagaggugcuacagcagcuagagucuguugagcguguuuugcuggucugugcuauccuaaucgcuuccuguucguagcugaaauucucaccacaccccugugaagcgagcgcugauugcuaggcuguaaaacaagggccggccugggaaagggggcgcuugcauaacgccuuucagccagcagguggcagugcugggauucaaacgcugggcguccuagcccugagcccucuucugaccccuaaccccgugcuggacgccagguucaucuuuuaguucacuuccuguuugcaaugacugacaacucuguggagagaugggggaggauaguaggacuuauaagucaagacggaaugaguaugggcgcaguaaagaaaccaaaguagccgaucugugggugaaaagagaaaacuguauuccaauaaacagccaaggcugucgccugggaaagcagggaaggauuuccaggguuagacgagaacaagagaacgggggugggggugggguggggguggagugggggugggggugggggaagacucgagagcugggugggaucugugagccaggacugagggugcccagaggcuagcaccgaccuugacaaguucuuaggugccccagcguaugcuaauggagacacacuuguuccuuuugccagagauaaggagaaagcaagcaggaacuuucuucaagucccaagggaauggcggcuuuuguccaaacgcccaaccuugggaaaagguuauuucuuugugggaccaaggaaucuucagucccggaccuuaaauucuuagugcuuauguguucuuuguuuucaugcuauuagagaacagcucauauuaagcuauguaacccccuaaccaccaccaccccgcucccugccguaaauguacauuuuaacagcaaacucgggguuguugguauuucuguauuccgagcagggucgaggguggugcauggcccaugguagguguuuugggggcaguugcauauagccagcugauggaaacacagacuuucaaauugucuaaagaauccaguugucccaguauugauuuuguggccgugugcgugggaggagaggcgcaggcugcugacccucccggggcugaccgagccuccuccuugauaggauuuaggagguagcgauugucagauuauuaccagcaagcgcguuauggaggagaguggcaguaagaaugaugggcuguucugugaggucagaguuuaccuucccaggacaucacaaucuccgaagagcaguuaucucuguguaaauaacacgcccugggcagugcuuacuuuaauaacaaaauaaaauuaugauuucccauaagucuuugcucugaguguguaaaauagaggcucccguucuguuauguagccggguaagugcuuuucugcagcucaaagauaaggcagagagccuuugcucugauuggggguggggggagugcagggggagagugcaggaggugggagugcgggguggggaggaugaaagaccagggcaaggcaucccaccacaguggcagaguaccagggaaggaggcuccuguccccaaguaccucuggccacucauugccacuucagagucuaugaagacuggggucugcacauugucgggaaccaccaauggggucuuugugguauccuaggcuuuccccaggucaccuugccaggcuugcccacauggaccacagaagauacuguuucucuaauuagcacagugccuucuguagcuaauggccaggacacugaaaugaucccaagaaagcauccacacggggaccgcucagucagggcugccgugagaccuaauuaagugcuuuguguuaauucacuggguugccggacccagcccgugugcgcuuuugcacguggagugaaagugugagcauccucuugguguguuuguugacuuccuggaugcagccaugaucagaguaggcguuacuuccuaucaccauggagccuggacagcagcaggccugguccagggcucacuguaucacucacacgaauccuaccaagacagacacggaaaaagguccccagucucucacuugaacccuuaccuggguguagauuuccugguugaaugguaaucccagcugggaauuaacuuaaaauaguaaacguuucggggcuguguuucucucgucuucucggagaaugaaugacccuuuaagucuggccaguccagcucaugagauaacggucucucuuucccucucuaggugaagcaggauaugguggacugagucacaccagagaagugucuucggaggcucaugcacacuugaaggguuggcccugcuugggacgucuccagcugucagcuuacucugccaccucuuguuuuaaucuuguuugcuuguguuaacagagaguuguccgucagaagaugugguugcuggauuuuuaaaaaagaaaaaaaaauguauuuugaagccauuuucagagaaaaaugccauucauuauaaccaaggaaguuuucuuucagccauucccgguggcuuuuccucaguggugcccacagaagggcaacauagaccagcuguagaucgcccauuggcucuggaggaagagaggugcaggugcuuugugcccgacggccacugugccugaggggugcuguccucacacagcugccucaggagucugucagaggggccuagagucgggaggccugggcagggcgugggucccggauacagagugcuugaaugaauccuucagucgaggacagcaauggccacacacggagcuucccacucacguccacccguacagcugauccaucacaaggcaaaacuggguccucuauaaaacuccauaaacaucauacauccuaaagucauaguuacccaggacaaaauaagacaaaaagauuuuccuguauucauuuuccacccaaguagacuguauauuuauuucucauccuucaaaacacacacacacacaggagcuggggugcagcuuucuugguagagcgauugucuaguaugagaccauagcucucuuccccagcauugaaacaaaaacaaccagcaauaacauuuuuauuugcaugagaaaggaaccgcaggaauuuuacauauguuggguuccuuuuuuugacccaacaccaaccauaaccccagcccuucucgggcacucuguaucuccaggcuccuggcacugcagcccggaguccuccaugggagauaaccacgguaccacggcauagaaacaaacuacaacaacaacacaacaugcuucuggccuagaggguuggcucagcacuuaagaagauugcucuagcagggacccaaguucaggaccuggcgcuggagucagacaggcacacuggccaucacuccaguuccaggaaaucauauaccucuagucuccaaggucaccugcacucaagugcacguacccacgcagacacacaccgacacauaauuguaaaccaugcaucuuuucuucagaagagguacuacuuaguuuuacuacguguauucaugcucuuggaugacguaagaguccuuuuaauugagugugcguaucagacuucuuaaacagcaaaagaguugaacaugagccaucauguuggagaaagagauagaaauccagcaagugacuucucaguaaaaacccacuaagcagcaagaauccaguuuuuuucaaaucaauaauuaaaagcauaauucuaa

SEQ ID NO: 12282 - RNA, 3384 nt, Mus musculus
augauuauuauauuuuuuuuucaaugccagugcugcucagcccucagcauaacuucaguuuucaugaaauaaacagugacuauauaaaaucccacuuuucugaaacugaaaucugaggucaggucaaagucucuucuuucccauggacuugauuaagccuguguuccauuaagagagguuaaaguucugcaagugaagggaaccgugcuuguguccugccuacaagucacaguagcaucaccucccaguuggcugugucugugucuuaaccaacagaaguuaaaagcauuaagagaguggaugacccagacugccauagaggucaggucugcggugcuggaacacaggcagguguuggcgcaucuguuguagaaaguggagaucaauucgagcaaggcagaggccuggucccucggagcagcgggccaccacugugccccacgggucaaccaccaugcuauggccauaacuugcucuuguuucaugguggcguccacacugcgcugcugcuauuacauagcacugagauucaauggcgcgggcccgcagcagcaccugaggaugagacgugcguugacuccagaacauacagcguuuaauaggcaagugacaagaagcgggcacugugggcccaaucuucucacuaaccaacuagaguuaauaacuaacucuuuaacaugacucacaccuagcuaagaaaugaauuuccucaccagaugaaaaggaagaaaaucaaguagaaaggaggaguguuuguguuuuguacuuuugagauaaggucucccuguguaacccuggcuggcuuagacccacagagaucugccugccuuugccucacagugcugagaugaagagcaugcaccaccaugccccacucuuugaagguguggguugcuuuuuuguuuuugagacaggguuucucuguguagcccuggcuguccuggaacccacucuguagaccaggcuggccucaaacucagagauccaccugcuucugccuccugagugcugggauuaaaggugugcacccccacugcccagcuucuauuuuguuuucuuuuuuagucaaggcaugcuggcuuugaaccuguggcuauccacugaagugcuuggauuuagguuuguaccacucugcucccacuacuaaaaguaagguuaaaggaggccuauauguuaugaagaggcauucucuuaccucccagugggcuggaccuguaacagauccaaaggcugaaggauaaguaaguauuucugccccagcuugagccaauuucaaagaaaguucagggaaccgcaugucauaacagauugcuagaccaaccugaaaugagaaacaacccacucaucuucccugucccauucaacagaacacugagugccuucauuagccugcaccaaugggggguguuaccacuuuucaacauagucccauuuccuuuccaaacucccaccuugccagccggugucuugacagguggcucaagagugccuccaggcuugguauaguugcuuucucucaucggccccugaccugggaucucuacaucgcacagaugugucuuccuguaacuggccacuacugauccuagagagagagagagagagagagagagagagagagagagagagagagagagaaaauacucaguacagacacucuacaaguccagcuuagcucuucucccaaagaguaacuuguaggcugagaacagaagcauaaaaccccaaggccaagcaguugagaaagaaaugcugaagaucugaguugaggaaagguagagaagccugggaagaggcaaacuaagggcuaugacgucucacccuugcuguucaaaagcacaugacaauuguagauuuucugauucugcucccagucuuggccacgcucguggaaaccgcccaaggacagccagauuccacauucccuggggggggggggggacacgacacacacaacucuacccccucuguggcaauccaggaacacugcucaacagggaguucuacacacacaacccccccccccccaaacccuacccuuguaccuggcaagcuggcuauauuggcccaaaagauccccauucagugguucggacaggaguaaugucucggcaggguuucgugcaauaaagucaaaugccucaggcagaaaggccaggcaagcacccagucuggcagccucuugaaccaacucagcacauguuuuaaaguucucuugcuuguuugguguugauguuaccuggcacacagccaccaggggcagcucccaggaaguugaugaggacaugguucugggccugugaaugacacaggcaguauccucagauuuucuaucuaggagaaacucagaggcucaaguggggguggagccagaaacuuuauuuucuuuugacuuuuuucuuuuuugagacacggucuuuuguagcccagacaggccuuucuauguaacuggggaugaccuuaaacuccugguugauccuccuuuuuuucgagugcuggcauuacaggugaccccagcaacuuguuuucauucuuacagagcauaauaacccuagagcuacuggaguucacucauuacauguuuggagauaucuuugucucccacuaugaaguuaauaaacacgaacuaagcagcuaugcgccagagagagaacauuacgaaauauguuaccugggcugaguacaaaguacugggguucgaaguaaucgguauccgguacacaggaguuggugaggaggccuggugaugaagcccagccugaagaaggugagaaaucaggacaccuaacccucuuucaagccguaaguuucuagaauucucugccauuuccaggccuggccaguaauccccucccccaaggcuucgaaaauacuuuuuacuacuaguagcuaggaaaagauauaaaaugggaaaaugggagaggcgacuaugaucggugccuuaauaccucaacuuccagugaucucacauuaaaacugaagcccuuuuuccuuugccaaacguuuccgcaguucaagucaucucauggaaccuuccucguuuccccaauucucuucucggcugugccaccugcacagcuuuauagacucaacacguaucuuuccccuuauacccgaaucucagaaggaaaguucacccucccuagaucuccaccaucucaugguggguagauggguacaggaccagaucccaacccgagcccccgcccucugauuagcgcguccuuccccgccucucccccccgggcaagaaucucuguugcacaaguuaaagcaucgcagguggaauucaccgcagcgggcaggguuugggaguagguccuacaugaagacacagccaaaaccauucacggggucggaucucaagagcugccaggagccagg

SEQ ID NO: 12283 - RNA, 3384 nt, Mus musculus
ccuggcuccuggcagcucuugagauccgaccccgugaaugguuuuggcugugucuucauguaggaccuacucccaaacccugcccgcugcggugaauuccaccugcgaugcuuuaacuugugcaacagagauucuugcccgggggggagaggcggggaaggacgcgcuaaucagagggcgggggcucggguugggaucugguccuguacccaucuacccaccaugagaugguggagaucuagggagggugaacuuuccuucugagauucggguauaaggggaaagauacguguugagucuauaaagcugugcagguggcacagccgagaagagaauuggggaaacgaggaagguuccaugagaugacuugaacugcggaaacguuuggcaaaggaaaaagggcuucaguuuuaaugugagaucacuggaaguugagguauuaaggcaccgaucauagucgccucucccauuuucccauuuuauaucuuuuccuagcuacuaguaguaaaaaguauuuucgaagccuugggggaggggauuacuggccaggccuggaaauggcagagaauucuagaaacuuacggcuugaaagaggguuagguguccugauuucucaccuucuucaggcugggcuucaucaccaggccuccucaccaacuccuguguaccggauaccgauuacuucgaaccccaguacuuuguacucagcccagguaacauauuucguaauguucucucucuggcgcauagcugcuuaguucguguuuauuaacuucauagugggagacaaagauaucuccaaacauguaaugagugaacuccaguagcucuaggguuauuaugcucuguaagaaugaaaacaaguugcuggggucaccuguaaugccagcacucgaaaaaaaggaggaucaaccaggaguuuaaggucauccccaguuacauagaaaggccugucugggcuacaaaagaccgugucucaaaaaagaaaaaagucaaaagaaaauaaaguuucuggcuccacccccacuugagccucugaguuucuccuagauagaaaaucugaggauacugccugugucauucacaggcccagaaccauguccucaucaacuuccugggagcugccccugguggcugugugccagguaacaucaacaccaaacaagcaagagaacuuuaaaacaugugcugaguugguucaagaggcugccagacugggugcuugccuggccuuucugccugaggcauuugacuuuauugcacgaaacccugccgagacauuacuccuguccgaaccacugaauggggaucuuuugggccaauauagccagcuugccagguacaaggguaggguuuggggggggggggguuguguguguagaacucccuguugagcaguguuccuggauugccacagaggggguagaguugugugugucguguccccccccccccccagggaauguggaaucuggcuguccuugggcgguuuccacgagcguggccaagacugggagcagaaucagaaaaucuacaauugucaugugcuuuugaacagcaagggugagacgucauagcccuuaguuugccucuucccaggcuucucuaccuuuccucaacucagaucuucagcauuucuuucucaacugcuuggccuugggguuuuaugcuucuguucucagccuacaaguuacucuuugggagaagagcuaagcuggacuuguagagugucuguacugaguauuuucucucucucucucucucucucucucucucucucucucucucucucucucuaggaucaguaguggccaguuacaggaagacacaucugugcgauguagagaucccaggucaggggccgaugagagaaagcaacuauaccaagccuggaggcacucuugagccaccugucaagacaccggcuggcaaggugggaguuuggaaaggaaaugggacuauguugaaaagugguaacaccccccauuggugcaggcuaaugaaggcacucaguguucuguugaaugggacagggaagaugaguggguuguuucucauuucagguuggucuagcaaucuguuaugacaugcgguucccugaacuuucuuugaaauuggcucaagcuggggcagaaauacuuacuuauccuucagccuuuggaucuguuacagguccagcccacugggagguaagagaaugccucuucauaacauauaggccuccuuuaaccuuacuuuuaguagugggagcagagugguacaaaccuaaauccaagcacuucaguggauagccacagguucaaagccagcaugccuugacuaaaaaagaaaacaaaauagaagcugggcagugggggugcacaccuuuaaucccagcacucaggaggcagaagcagguggaucucugaguuugaggccagccuggucuacagaguggguuccaggacagccagggcuacacagagaaacccugucucaaaaacaaaaaagcaacccacaccuucaaagaguggggcaugguggugcaugcucuucaucucagcacugugaggcaaaggcaggcagaucucugugggucuaagccagccaggguuacacagggagaccuuaucucaaaaguacaaaacacaaacacuccuccuuucuacuugauuuucuuccuuuucaucuggugaggaaauucauuucuuagcuaggugugagucauguuaaagaguuaguuauuaacucuaguugguuagugagaagauugggcccacagugcccgcuucuugucacuugccuauuaaacgcuguauguucuggagucaacgcacgucucauccucaggugcugcugcgggcccgcgccauugaaucucagugcuauguaauagcagcagcgcaguguggacgccaccaugaaacaagagcaaguuauggccauagcauggugguugacccguggggcacagugguggcccgcugcuccgagggaccaggccucugccuugcucgaauugaucuccacuuucuacaacagaugcgccaacaccugccuguguuccagcaccgcagaccugaccucuauggcagucugggucauccacucucuuaaugcuuuuaacuucuguugguuaagacacagacacagccaacugggaggugaugcuacugugacuuguaggcaggacacaagcacgguucccuucacuugcagaacuuuaaccucucuuaauggaacacaggcuuaaucaaguccaugggaaagaagagacuuugaccugaccucagauuucaguuucagaaaagugggauuuuauauagucacuguuuauuucaugaaaacugaaguuaugcugagggcugagcagcacuggcauugaaaaaaaaauauaauaaucau

SEQ ID NO: 12284 - RNA, 30874 nt, Mus musculus
ugucccagggacagcaucacacagagcccuacuucaguuuuaggagacugacugucaucagucagccuugaugccauugaaaacaaaaugaccuuauuugauagaauaacagcauuuauuuuauaaauuuuuaggauuuuuuucucauuguaauauuauuguacaguuuugcauggccucaguguaaucauuuuuguucagaaaauuaugaccuguguguguguguguggaagggaagauacugcuuuggccucuuagcacucauuugguuugguuuugucccuagauguccuagggaauuuccugacaguaucugcuaccaaacuauaacauggauucuuuugcacagaacuauuuaaggugggguggucaaaaauguaacaaaggauuucucaccaauauuuuauguugguaucaccuaauuaaccagacuuugauguucugcaauaaaauaaggaacugucagcauugaguauucuauuucuucccguguggagagugugaggcauucuuggcucgcugaucucccucuggaccucuucucuaucccagaggacacaggucgguuugaucggguccuggagcucagguaagaauaacauucaaauccauggaagugcucaacucccuuucucugauaagaacuccccgggcacugcuuuaggcccccagggcacacuccacuggcgcuugagacucgggguugucugucugcagcauuaacguaggaguuggaucuguucuguuagaauggugcagcugacacacaggcaagguugggugaccuuaucagagaccccaaaccugcaacugaaaucaucacccucuuagccauugagacucuuucagaucuuucaagucgcacugggccuccaaggcagcaucugugaagaccaagacuuggcaaaaauuccacaaagaaauggacaagaacaccacgcaguaaaacuuaagcucggugagccuaguguggugcagggguggcagugacccaggccccuagccaggacagacagcaugcauggguuguaugggcacacuguuccugucccagauccagaucucagugucuguucuguagccacugaaccccacaagcuguuuucucuaaaugccuaagaagcuugguggcuuaaacuugugauccuaauuacuuggggugagggggaguuaagcaggaggauuacaaguucaaggcuugccugagcaacuugaugagaucccaucccaaaaguaaaagggcucaggguacaaccaaccggugguagagcacucaagucacucugcaaggcauuaggcuuaaucuccagugccauuaaaguccugagucagagacacacauacauggaaaugcuuaauaucugccuauguugccauguucuguccccaucaagagcaagagacagacaaagaccacacauccaggucauaaguggggccaccuccuucccaggauucacggaacgcauaggaaauggcaguccccaacgcacuucuuuauugaacgcaaagguaugaauguguaauuacaagacauacaaacaaagagccugugucgcuccccugggguggggugauagcucccucuccuggggcaugcuggagcccugcugcucauccaaugucagcccugcuuuuaaaagggucuguuguccaugcugagacugagcuaggguggcuacccugcuguccugagcuucuagcuccaggccacaggcugggguggcaaagggcagggacauaagcucacccagaaacacacaauucauucccauggccaacuagaccccaaagguggcuguguugaguuuaguacugcauugcuccuguuccugguuguacauccacagcagggaggagauggcaaaagaagccugccuuuuugucuggacaguacagaagcaauaggagggucuacgcaacgcucucuuccuauucauagaggccguggcucccuuucaacguccucccucugcuugacugagccugaaggagggcauggccccuaguuagccuggaccacaccucaccuacugcagcccagacuucauccugcaguaguuacuguacgcuuccucgaacauggccuuacaggggaagcgggccuucagcuuagagcagaugaggaaagagccacccaucuugcggugcagagaguaggucuccucugggggugggaugaggcggugcuucagcaugacgggaaucagguuguggaucuucucaguagugcucuggguaccgaagucgaagggcucuucggaggcaaaggccucccccaggaugagaauagcauccaggugagcauccuccauggccugcaucaagaggaaggcagagaugacugggucagaagccccagacccaucuccugccacagcucuccaucucaguacccaguucuaggguccgaaggacaucagaggugacagaaugauguuggucguaaaccgugucaacagguaacuaacgucaacccucaggagcugagcagacacaagaccacgugugacacacaguagagugcaggggccuuccuuccucucacagcauccacgucugucuuuacaaaguuguucuagccaaaaacacagaucacaggauaggcacuaccggggcucagccacuguggagauuguggugggagccugccuaguuccuagcacacagcaguagucaccugccaggcacaggaugcaugagaaguaacugucaccagcagagcacuggagggacaaggggcacccaggucugcgaccaaucaacccagcuacacagaggaagcagguggcagaccgugggaaggauaugaaggagggccauccauccugauggagcacuccugcuaggcgugaaccagaaggucagggagggucagcucucugacagcugcuggguagaaagguucucgaggccuggauucucuguccauccagccaagucauccccugccucuuggugaccagagugugcagacagcaccaguuaagcccuaagcagaacaguccugcucuacccuacauacuucuacugcagcuuucagaaugcugggccuacagaggccuucaagggcccacaccggacccccaggaguagcugguucuuagguaccaaaagaagacacagugguuccuacaagaagcugggccugaaucucccaauaagccugggugauucacucaccuugaccucauaaccgguaaggaacuucaucucuauggauuucuuuagcacugccucccuguccuggucagcagcggcccggaugaccuaggaagaacagagagcuccaaccuacccuaccacaguccucccaaccccuggccugggaucagagccagcuacauggaccugacaggcuguggccagcuccagauggcucucccacacuuacaagauauacauaggccagggccccauuccuguucuuaccugaauguagaggucaguaaaggaucugucauauucucuaguugcgccgaaguccaggagagccaccuacagauggagacacaacacugaagcuucgcccuguggugcugguaagcacagagcagagagaaggaggauuucuucaggguaggagcccgggucucugccgagagccuucacaugaggcucaggcugggcuuaccuugugcugcugagggucauaaaagaaauuggaccaguuggggucagucugcaugacauggaacucaaacagcucucucaggcacagcaccaaaauguuguagcagaucuggagacaggaugggggcccaggugaggcagcacagacuaaaggcuuggccuccugaaucccacccuaacugcucccggugugcagccccaagagaaagacgcagucacuaccccuuguccaccccccaaggaagggcuuagggucucuggucacaccauuagguucccagcacagcagucaggacacuagggcgcaccucauuccucacuuccuggcucagcccuucugccugguccaaggggaagccugauaugagcucuguggucagcacauggggacugcacaacucauccacaaucucaggcacauagaagaagggaugguccuucagcaguucccuguguggagagggagcucacauccaucuugaccccacacacaccccaaauggagagcccaccacggggaaaccuacucuguaguggggaggauauggccacacccuggucccagggccauccacccuuaaaaacagauaugccugcccucuugggugccccucagccucccgggguccucgugaaagccgcaccugaacuucuuggcauaggcagccucccgcugguagucacacucaaggguaagcucccgucucagcacaucaaucaggugcucagggaacaggccuguggcagaaucggggcaucaggugggagaaggagcucuguagggcuuuccccuggcauucccggaaccaaacccaagugccacccaccccucccacaccucaugccacggcccagccugaccuucuggaagcauguuacucauguucagcacagccaugagguuguugacgucacuguuaaugcucugggccacaccaggguacugcagggagagaaaggacauuaccuggggaggcagcagggcaggcugucccugcucauuagugucccagccauauccggccagcuaggaugcaacagagccaagacuaaaggcuguucuccauucuccucauccuaccccagaaaaaagcugcaggcuccagccuggcccccaggaggccauccugcaccaagacugucagaggcagcucuguaccccuaacucaucaucuagcaaacacgcuccuagcacccagcgcagccaguacuaaaaacugaaagacggugucuccagagaccuguaagggcccacccucaaguccugugaggacacucagaggcaucuaccuggaucuucauggccaccucacggccacccuucaugcgggccaggugcaccugcccuauggaggccgcugcaaagggccgcucuucaaaguacuccagcuugucccuccagugggggcccaggucgcuguugaggguuuucuggaaagaggccagggaagacaggaguacacgcugguuaccugggcuacccugauaugcacccagcuugccccacagcuugcuccuagaugcccaggguugagcagugguucccccagcccaccuccugccagccucaccgucaucuguuucaguggcaugaagucagcacucugccucacccgcucaaagaucuuggccaggugaggguugaugaaggcaucaucuggaagacaagagaggucagagugggccuucuguuagggauguacacaggccaguacacagggcugcccagguaccguguguccauguggccuccuggguagaacagggccauuaagcuuuacccucuguuauccugggaccugaaacucaaccaaaaugacagccucagccucagcuuccuccuggcacacagacuccagaccaggacuguaaugggggcaggggucuuuauaacuaagagagauuuaaacugcccauaaucugacugugcccuuccuuccugccuaauguggcacugcaugggccaucaugaacacaccugugggugguuuaagugacaauggcucuuguagccucauauauugaaauacuuaaucccuggcugguggaacuauuugggaaggauuaggagaugggucacugggaguggacuuugagguuucaaaagcucaagccauucccaguuaggucuccuucuucuuccuucaccucuuccuccucuucuuccuccuccucuuccucuuccuccucccucuccucuuguuucccccucucugccucaugcauguagaucaagauguaagcucucagcuacugcaccaguaccauggcugccuauugccauguucuccaccaugaugguuucauacucagucuccuccucuaaguugucuugguguuuuaccacagcaauagacaaacaacuaugacagugcccuccccuccccaugugcuugcuuuuucaaaagcccugggaguguaagcaccauuuagagcuacugcagagcucaauucggcuccucacccuugcucugccagccuagucucuccucccugcucccucugaggucacacacugguccccaaagccaaaaugcaagcuccucuacuaguucccagugaccaauagagcaggcaguguggcaggaccaggcugccaugcuuagagacugccucucaguuucucaaaacacccacccagaagcaagaaacaugccccuguuugaagaugacauaaacauccccaugucccagacugccacagcagcucuguuaacacaccuugccacucugcccgccacuacccccaccuggauauccccagcuggugcaggacugagcccuccacucacccuggaugcucagcaucuggcccagcuucagugcggccccacgcaccuugcacaguguacucacaaugcgcucugcauuugccucugacaggaaggggcuagaauccagcacggcuuuuuuuccuaugggacagaaggacucaucaugcauccaggguuuaggaagggagacuggaagaaaccuucaugaugccugggcauagggacucaggcgaaauacacaacuguuaaguguccacagaaacuggaaggaaauuucaaaucccuaugcauauucucuauagaccuccaaaguuagggaggccucccuuacuagugggucaagucuggcaggagguuaggagaagauaagcaagccucuacccuacuuguccuggcugacgagucucugggucugugcaccauaccacaugggucuuggcugcaguaaggacucuaucgucagggucaaggacagcacagucuuuggguauuguuucuccccucugccccacagcuuggcacagccaacuggcccaaagacaaccccuucuaggacacagagugguagcaacagcuggaugaugacuccagggagcuggcagugccaaaugcaugcugcugccagccaucagcauggccaaaaggcacuauugcuucugcccacaugccaaauccacccuguggcaagggaggagcacuaacaggggucuaagcuaccaggucucccuguccuccccagccccucagcaccuggaagcuccuucaguacauagccacgagccuggaaggccaagggaagaggacuuaacaacugcccuugcaucaggcaaagcccagccugcuucuggcaagccagagaagggggcuaccauggggagaagaauuauagagcccucaacugccagcacccaguggcagacacacugaggacuuaggcucacucccugguccaaacaagagaacaagacaugcaguguaggagggucgguccacagaagucuaggcuauuccaagaccuacuuaaacccugguguaggaccaauccaggacaagugggcccagaagggaccccggcaacagcagaaggcagcaccaagaguggggcagcccuccccuguccuccccagguccugggacucaggauuaggaagacaggagugaacacaggcaaggccacuaauucuaggacaaaggaggggaaacugucgcucaccuauacacaaaccauaccucagcugagcaccaucuccugguacuuggagauggugucuaacccaacuggcuuuuucugggcgucuccaccccacagugggcugauccucauaggcugacaugucucccacccagaauggcccgaaccaagcaggacaagccagaaauauggugguaugcccaaugcaggacagggucuccugggcagagcuuacuagccuggacagcagcuuaaagaucagggcacuguaggcagauuaugagccugaguagguacaucucccaaggccauuuacucuguaaugccucaggaccuacuggcaaggcuaaaggaaccgaagccuuagucucuagagucccugaaaaaggacaccagcuaugcccuugaagguaggcugaccucucuccucuuagacgagguaggauggaaagugguuggcaggaggugcuggaucuugggaaagcuagcuucucaaccagaaaaaaccacggguuucacaucccaaaguacuuaagcaccagcacuaaaaauacccacgcuaaauccccuguucucuggucccuuccaagaacacacaagguguccauccuaggacuggagccugagaaccccgugagugaagugcugucuggagagcugguacacccccucaggccccucagaccaugaguaccaagagguccugugaaugggugugagagcugugaggaaccuucaggagaguaugggaccagaaccucagaugcacuuggaaaauccaccgauuaggaaccccuaauggcucugcuggguaaacucccagccaucuacccucagagaggggcucacacggcuccuuccccagccagaauccgagcaucaggaaaccccucggguuugguggggacugaaugcagaacauucucuagauuguacagccacaaguggucacugaacuuguguuccaggcaaggcugaugggccagauccugggcggcagagaacagagguggucuggucuuugucucuggaauggccccagccucucugagccauguucaaugaaggaaugauacaauacgucuguccccauaccuauaucccuacccacggggacaaaggagcuuugcauuugaccucggcagaucacaauucauagguccucgggagcagggcaggagaggagagcaggaacgaauggugggcaagcaagcaaguauggaggugcacaugcuggugguaacaagagugugggcaugcuaagggagccagaggggcuggggggagggggucagcuggggcugaaggcgggagccaucgccaauucuccaauccuccaacucucuaagcaagucagucuaccaaucacucaaccgcaggaacuacauccacaggaacuacauuucggaggacuccugccugaggaagcucugggagggcauggggugguccggacaaugacaaugaugaccucacauaaucauccacccuuuguacacagggcccugcucaccuguggaguucucagaacgcagacucuucuuggcaacuucagccaacgccccaauucccagaccuacagccagaccuggaaggguaagaaagcaggugcuugaguggcugggaccacccagguagguaccaggccuggugaccagcaggcagguaccacugcaauguacuaacauucgcuggguacucccaauagggaguaggaaagaacacacacuggugguuguaggacagucagcucugagcaagugcugccugugaguuugcgcagcucucauccaucaccugugacaacccacacucgcgaaaacacaggcagacuccauauuggaaggaaccagcacaaauaggaagacagagcaagccuggucuguggaccacuuccuggaaauacaacuauagaagacagccacucacucaagucugcaagagcauccaguagucuugaaucacuguaucgauaugcaacagguagcaguaaaaccugggacguucaacaacagcaaaaacacggggugucccagcugaagucccuggggccagaacagaacccccccccccacucccaugcuggcagcacugauagugaccgagaacaauagcccuugggucuucccucccaggagguauggcugaggccaggcagagagccugggagucuggcucagggcccacaccuuccuggaagcucccuucccaaaggcuguacaggacggcauaccacucagagacggggcaagggcuaugaaacucuucuccagucuuucuacaauaaucaaugcauuacagaaaaacgcuggauuugcugaaaauguauagaaagaaauuuaggcuguguguggccacacaugcugucaucccagcauuuuggaggcugaggcacgaggucuaacauaguucaaggccacccaaggaugcaaagcaaauuccagaauauccaggaguauauaugguaaccuugucucaaaaaacaaaaacaaaaacaaaaaccaaaaacacaacacucaaguaacuuuuuaaaugcuuuuuaauuaaaagguaauucuuuuacacauuuaauacuauauuuauuugccacuagguggcagugcaugcucuacuuugcccaccuuaccagccguuccuaucacagaggucacuaagagaaccaaaggugucaagugcccacacucucagguccaagacauggcagcaaaacagcuuguuuauucaaaacaaucaggcccauggugacaaaggaagucucgugucaacuacaugcaugacuuuuaagauuucuggaggccauuaaaaaacaggcgagaagaaacauggagagugaauucuaaugcauuuagcccagcauaguuaaaauaaaaaucaauguaaaaauugaaagcacuuuccaucucgggugugugcacugucuucaaauccugugggaaggcacaugcauuggacacauggggcagaacaagccaaacuggaagaagccacagcgacaaccaagacaugcugguggugcccugggauagggugcuacuguggaugucugguggggcaggcaccagcccuuuaacacuccgccuacccaggccagucuggauggcacugggcacugggagccagaguccuaauuaaacauuaacuucccgccaacugucuuccucgcccuaccuaacacaauaucuaacuuagcaaaagaaaggaggacaggcagcauucagucaccaaggucccuguggaguccuuccagcuuagagacacgcccacagaaaaggcagacgacauccagccgcacacacagcagucagagcccccuacaccuacccccggccgcacagcgcugggucaaacugucccugccugcuucugggcucccaggcaaagcacaaacucuaccacggggguggggagacaguuauuaaacaaaugccugaaggaacauucuagaaaggaggccucuggcuccaucaguagcugcaccagaccuaggagcugccaagagaggggcaggcuccugcagcaggcagaccaggagggaagaacaagcucacccuaccagugaucaugaucuccccgguucuaugaacccagaauaaacuggcuccccuucaugggccugguauaaugagauucuuggaauccccugcccagcucagcuucaccuagaaccagguaaaccugggauaacuaacucugggaaggggaauuccaggcugggauuuuucugccaucuucagauaccuugcuucugcacccaaggaccucacacagcacugccucuucuacuguguguguucugugucuagaaggcuugaucuccacaugucacugagaggagagaaccacuguuggcagccugaccuuccuccuggccugugacggcacacugcccauacacagaaaguuccuaauacuucucauuaaaagugguuuugccaccaaggaagggaagugacagggcacagaacucucccgcaggcaaagcagagguccagcgggccuguguccaggcugggagccuauucuggguaacucaggagccucaccuagccuccccauucaggucccucuggaagucaccaaagaaacagucacuccacucccuaccagucaccacagguggaaagcaaagauuuuaaccacaggagccuucaugagcaggcuggguagcauugagaguggaacagcaggcuaccacuccugcuggugcugcucugcauggugaaaucccagggcuuguuuacaacacguggcuggaaagggccucugcauaagcaaccagacaagaguacugaggaaccaggcacuguagaccaggccccaccuguacucaggagggacccagggucuugugugugugcuaggccagaucuccacucccugaaccacauccucagcccuaaaguccacuguaauuaauacacauggcucacucacucugcuaagaaaguccacauagagcagacagacagacauggcuaauguccucugcguggguacuaacaguguacuucuagauaauacuggcauccaauagcagccucaucccccaggcacugcagcccaggaggaagagggagagaaacaaaaagaaagagacaaagcucccugaggugucuucuccccggggaagaccuaacagguccucugcugucuauguaggaagguaggugccuacucauaggacaggcagcucagaugucccugcacaagacagaggucugugcucagcuccuccucugaaacugcacagaacagcagccauucucagcagguuccucucacacucgaugaagaaucugcuaccacauacacaagcaccaugacagaugcuucacugcaggcccagaaacugucaggacccacagccugaaccuucugaaacugccuguugcuucugccacagguuuuggcaaugguagagagcagagaaaguaacugauagagauggacaaacaagaggauauacuuuccaggaaagggaagacagaagguccugggccucccuaaccaacucaacaccaggaccaucacugucauaaccuaccagaacuguuauuuagcuaaccacugguccaaggccaguaugugaaacaagccagcaaagcuauucuuuuguaguuuacauugccugaaccuggagaaccuacagagcacagauaaaccuucauaaacugcaccuccagaaacccacaucacagcacccugcagcaaauggccaagcacucgcaacaggaccucgcagacgagcagugugcacaugcacuauguaaauguccuuccagaagagcacagguaugguagggucaaaggcuacuugcauaaaagcaaggacaaauaaaaugcccaggccugcagcaaucagcuuuaacuguuggcagcaaagggccagagucugucaguaccacacuagcagucagacuauaggaucugguaaacagguuccccaaauggcuggucccagaccaaaaggcccucuaucuagggagccaaagggcccagugaggcaccuguauucaugaccggucuccuuccagcaaagacugccccaaggacuagccaacuagcccaagcuguagcccauggcaagauacagccacacaccaggcccagggauaagccaagaugaggcuggaauccaguaaugaggucaucacccacaggaaaacacucagcagcuacuucaugggcaacauggccauauaccacccaguacuggggcacggcuggauucccaaccauuuccaccuuaauguacauuggccaccuccacucgaacaggacaaacagggcagggcagggcaguagaggaggggcagcacgggguacgugaccaccucaccuccaaaguuggccaaccgcccaauccggguaacuggcaccuuccgcucccgagcccgcucacugagcugaagggaaaaacaagagagaccuauaggacugacaaaacuaacaaaugagacaagacagccugaggcucaugcugucugugccuccccucuccacucccacuggcagcacuguacaaaaaggcuuccagguauuucuaaagucacagcaugggagguuggggggagaugcggaccagccccagccccacuaggaauagaaaccacccaaguccagccagaacgccucucagaccuaccaucugcuuguguggcuugcucucagggcgagccuuggccugccgggccuuuucaaugucuucagccgugaggccucccacggaggacugguccugguggaaggaucuucgcuggaugccguuggccaagaacaagucucugugaucuacaaagagccuuccauugacucugcccauaggagagguggccuguccagggagcccagcuucccugaaaggcccacuggaagcauaggcaggggccggucccugacugugggauggagacagugacugguccagggaagaggccgcagagaaguccagggagguuccagcugccugugguguugagaacugaacuucggcuuccagaucuucaaaguucucaguggcauaugaaucuucaugcuuauccugacccugcgggggacaaaggccagugugaggggcagggcugggcuggugagguacuugcaugugacugcccaucagcccucucuaacccuccaaaggaugcugccuaagaccugagguccacuucaaaggcuaggaggcagcaaauagcucucacaugcuucuucuagaagccugcugugugaucucaggcaggaugcuauacacuacugggcacuuacuguaggcccagccagggccagggaagaugcacauggcuguagcaacaggcuccucaucuauaaagcagggccagcacugagcagcacguggggcuuuuaggagagaaaccaggacaaaagcugaggaaagccugcagaagcauaagucacagagcagcgagugaugagaggagagcacaggugggaagcacggagccacagcaccucacagcagacaaagccuaccaucaacccggcaugcagcuacaguucuugccagacauggucagagccuggcuguccuugccaaucugagauacagagaaagggggcagaggacaccccauguuuccuuuguacaucauagguuuaaccuccaagcccagauuccuucuaguuuuuaaccuggaaugaacuuggacaaguuccuaaccacucucagugacuucuacaucugaaaauagggcccccacugucagacagcaacagaguuacacccaaggucacagaaacugcugguaaaugcuauaauuaaauagcacuguguccuagagagagggggagggcaggccuauggccauguucacugguccaaaugaaaucugagcaaaugccauggccuacgugcuguccggaugccauacagcaacacagggagaccugcagccccaugcacagcuaccugagaugcccuaaggacuagagcccugcucucccaggaaguggguagacuagaagcuacacucacuucacaauaccuaacagacuaagaacugaugugaccgguaaagggcagaaggcaacaggcagcagagcagggguccagagccaaggccagcucugcugccccaaauccuagaacagaacaaacacagcacacugaggcucuggagcccucuacagccagggaggccuaguacgaugagccugggucagaauccccuccugucccacaacucccacaauaaccuccuaaucuugugugacugcuauuacaguagcuggggguucccaacgcagcaaaggaccccuagugccugaaagggccccagccucccuaagcaccugaugagaugugugacuaugaagcacauggguucccagagcgaucagaucccucagaccuccaggguagagaaaagcugcacaaaucuaagcauucgggauggaagggaacccaggaggccucugugcccagggaccuccuccauggcacugagcuaucugucuucugccucaaugucucacuauacaauguggggacgagaagucccgggugagaguuuacacacuggugaagaaacccagucuagaauaccgucuucauuuggagugacccagagcaagcucaucuuccaagcuuucuagaggacuaccacccaccagccaaccucaauaccaggaggacaaagacucucacccuagcacuugacguaaucucggagggaguaaguacaccgcacaugagcaguaggggaccucaagaaugcaggggagaaagacuuaaaaucagaguagccugugggaugaagaauacacacacacacacacauauauauacacacauauauacauacauauauauaugcauauauauauauacauacauacacgcacgcacgauacauacaugcacguacgcgcgcacguacacacacacacacacacacauauauaugcuugauguuuaagccucccagucuguuaucuucuauuauuauaacagcucccucacagagaaaccugaucucuaauaugacaacaggacaugccacaggacagaaauggcacggaaaagaggcagggcaaucucugcaaugcaugcacacaaggguaugcacacaugcuugcauaggcaugcaugugcacgcacacgcgcacacacacacacacacaccuacacaccuacacaccucccuucaggguacugaguugcuaagaggcaguacuacaguacagccaggucuaugcugacgcugccuugguuuagacacaccccuugaucuaagaugcugagguuuccuggaccuuugccccaacagcaugaggggaggggagagacagugcugcccuccccagggcucugagagcugacccucuggaaaggagcgccuucagcacauaacagaucuugaugaggcucaggaagccuugccuauacgaggagccuucaaaggcuaaagcuggggcaggcugaucuacaaaugggcccugcuguggacugcaugucugaaaccuaacccauugcaugccaguacauggaaggagauuacaucaugagcacagagccaggaaaugggcccuuauuggaugccaaaucuacuagagccucaaucuuggccuucccagccuccagaacugagaaguaaguagugucacuuaagcacccuagucugguauucucacacaauguccuacccuacgcuaaaaugacagugggacacaccagccacucuagucucaucuacaacaagacaggaggucagguuucugcggccugguucauucccuggucacauuaagagcuccaagucuggcucugccuaccagcaccccacacccauggcuggaagggccucucaccugcaccuucccgaagaccaugcugaacugcuccacagcuguagacugcagggcccuggccgccaggaggagcuccccaccaaggcccagguucugcaaguggguuuccaccgcugcuugggucagcuuggcaaggccuuuggccaccaugauggcaucccccaacauagcagccauccuucagagcuggaagaaaagaggccaaaucagggaccggguaccgcaucugacacaggaucguauguacucgccccgacucugagcggaaggcaaaacugacgguuugguuuuucugcugaucuucccuuucgauugaaaacugaagcggcaggagaggagcagggcccagggcaaugaccaaguacuuccacgcacuuaccaaugcccgagcauuuccucaccugugcucaagagcgccucugagacaccucagcacagaagucaaagcgcuguggcagaggcaagacuuagcaugugcacugacuccuagucuagugcucuuccuucugaagcacaggggaggcugaagcaaacguggccccuccccaagcagcuccuugcaggaaggccuaggggucuacauaggacaguggugccucucuccgggccccaagagaugagggugucugccucuuucaaaucccggaugcacuucccagugaagcgggaggcagcugagggaacuccccugaccuacagaucagccagggguuccacacugcaauucagcacugagaacaacagacaaggcacacagggcaaguaaaugcaaccauacaccacuguggaggccagcugcccgccucuaugcgugccuccuuugcucucuauuggccauagcagaaaguguuucugaauguaggucagggucagagaugcugagacccaguaucuacaguauaguuagggccuggccuaguugguuauuaacuacccccugaggcauguuuauagguuaagaucaguccuguuaacuugcuggaagcuaaagaaaaaaaacagggagagccagagaucucacugcaaguagcaccaugaccaaggcagggagccgaacuggguagaccagguaagaggaaggugaagggaacuucaggcuggggacuggcauaggagcaggggcccugacucacagacaucggaagagagaggacagucaaaggggcaccucaauuccaucuuucacuacaucgagagaggcacagauggggaagggcacacaggagcacuggcaaggguccugaccagaacgaggggacaccugagcacaggcacacaacugccuaagagugaguugcaggggagagaugccucuggccugugcuagcaucugcaucaugugcacacauguacacacagauacucuggcuuuaaagaccuuaaaaggagaauuguuacagcacaaacucacuaccaaacaggcaguuaugaggcuguguuuauaauguacccuugggugguaacuuuccuucaaauacuagcaguuagcacaccuagggcuaagacuuucuuacgcaccucuuaauacuuauaaacaauccacgggcaucggucagugagaacagcagaguuagagaaagaacuaaguagccagcuaagucaccaccaauuucucaguggcccugggguugggggugggguacccuggccuguuuagugccuccucaagcacuuggcucacugacauacaaggacaaggcacuguuuggucacagcuuacugacccuccagucuaagccaguagguuuggagaaaauuaccaggucacacccuagguuucugcucugcacuccucugauuuaauggcaauaaacaggugaaugaacccacaaaucaaacagcuaguacugguaagacagugugcaaucggagcucaagcaggccugauagcagcuccugacucaacagcugccaccacccucaacacacaccgaugcaucuuguccacuacccugaagucuagauacuacucagguuucccacgagggaccuggagaacauggaaaggguggcuggauuuuaaagaucugugccagaaacacacuccuacuacuggagauggcucagugguuaagagcuauugcugcucuugcagaggucccagguucgguucccagcaccugugucagacagcucacaacuuccuagcuccaggaauuccacacuguccucugaccucagugggcaccugcauacauauaccauagacauacacccauguauacaggugguuguauguaacucaagcuuugggagaucugacauccucucuggcuugaccacacacacauguacauacccacucagauauauauaauauaauauaacauaauacauauauauaauauguguguguauauauauacauauauauaugcauaaacaaaagaaaauccuuacuuaaaaggauugaugcuuaagaaggcuggagagaugacucagugguuaagagcuguugcugcucuugcagaggacccagguuuaguucccagcacccacaugguggaucgaagccaucaguaacuccaguucuacagaaucuggucccuucuucugaucucuucaagcaccaggcagguucauggugcauauacacacauguaggcauacacauaguuaauaaacauuuuuaaaaauuaaugaagaaugaaucauacguucuuuccugccugaacaguuguauaugaaauacuagugaauuucaaaauggugccaaguccugcccuagauacugcaccccagauucccuuguagauuucugcuuuccucaaguuggcagugccugcuaacgagcacagccuacucuuuaugagcauguagacuucaaaguugcugugauuaguccacggccaccccuuggguaaacauuacuuacucggugugcagggcuaugcugggccucgcucacaggacaaagugaaccaaccguucacagccuuaucauuacaggcagcguccugcaagggguccccguccccugacagcaaagaggaggggaggagcaaugacuagcagaaggcagcugcucuccauagcucuucucucucugcuuuucaaacuuagggccuuaaagacccuauuaauacccaguucaccccaaucccaccgugaccaauaauccagccaagucaggcacucagcuaggaggcauuuauaucauaguuuucauccaaagcccagaaacccuuucacacacaagaaccauaccagcaccacgaugucagggacaaguggggaaugucagccccacuacccuccccacccuccgccagcccugacaacaguacccugccgguuuggggacacuguuccugaguaaauguucuacucugaggggaacaaaggauccagcaaccucaaguaaagcugugugagagaguagauacucauacccagagaagaacugugccagcauccuucacgcauaucacuguaccuggcuugucccugcaggcccugaaccaauguguccuauccaugugcccauagcacaucuguaacgggcaccaacaccagguaagcacuggaggcagaaacaaaggaggugccugccuugugaaauaccaucuucagagccuagacauggcccaguccugccaccaccagccagaugacucagauucuuauacaccucuucuguuccuaauguuaaauuuguaucagaaaaguaaauaaagacaucuccaacagaauugcauugaagaagcuuucccccuggggcacagagacugagaaagagacacaggcagaccagaggccaauguccccgaggcucugggaggcuuuccuacugaccaucauuugccaaucccccuuuaaaaaaagccuuccagagcuaccuccuuggagccacauccuggcuggaaguuaucuggcgaauuggggaccuucaaauaaagucaccaggacugacaaacgugcccagggaaugcaggccuguccaaauauagaaagacgugugagcagaaaagucuuuuuuaaacacgugaugauuccaacaagcacagaccugacaaagccucaaauggagacaucauccacuggagggagcuuuaucuggcuggagaguagccauaugcacuccacuucauagccaggauauaccaaacugucacugcccucauggugagagagaacaaccugagauggucgaggaagauuucccaagucaauagccuucauaacuacagggcaucauggaccagcuccaggacagugaaguggugguauucacaccucugagaucaaggguggacccuccucuggcccuucucugucacagcugccacuaaagacuugggaugguugggauaagaaccuaaacagaaacuacacaggaagucuuuggcccugagaagccauccccagccaguacaguccccugaugcauauacauccucggggcccucgggcacuucaagucuggccugucuaaagucagcaaccuugaugcccuagccacacacaacagcugugcucaccacccugccucgccuuggacuucccaugcauucccaggcugccagccagagcaguuucuuuaaaagaaacacccugccuaagugcucccauaccccacagcuucucugagaucccuaagaggcagaaagagccuuccugacccagcccucucagccucaccagccuuaggcuuacugugcuccuuccacugaauguguuccagccaggcuaaaccacucauggacuucauggggggggucccuccugaaggcccggguuccuugagcaaagggaacaaguguauuuccucccuccucaggggcaucugucccagcuuccuauaccgugcucuccagaucugucuaguagcuaccuugcuagaggcugcuagccacaggacaagaaccacgucuaucuuccugcauacauuccugacccuccagcaccaaaggguacuuuacagcaauaaauaccuagcaaguuagaagaauuuagcugguuccuccaaagcuugaaaaagcuugagaaaaauggcuuaaaccuucuugcagcuuugacccacaaauggcaaccaaacacuccaagagcucgucagaaacaauacucccccagcugcaggcugcagcagaaggaaccggagaguuuaacagacagcugccacacucccaggauucuguguuucuagcaaagugccauaugugccaacuuugauagcccuagucauucuaaaaaagagggaaaggggacaggggugacuggcaccacagaccaagcaggaagccuccacugagagauguuucuaaaguuuccaccugcugcucugucuccgaagcgcccggcuucaccacgacacaaaccuuucagauguucaauuuuccaugauuccuucaagcccuugaaaaggagaccagaagggaccauacuuaaggacgauggccccagagccaacaccaagaacucucuggacugucacuucaaagguucuuccuuucugggagcucccacgaggccagugagugccuucucccccuucccagugaggaaccuucuuuuccuuuggacagcaacauguggauuucaacccucuaagggaaaugaaaagucccauuacauccuuaacauuuucccuuuucugacaaaaaggaaagaauguaaggacgauuccuccaaggagucagaaggaaugcaucagaguaaacaagcuucagaaccaagguccucaaaucccugcuuauuagaucuguccuucgccuacaccguaaaagucacacgucaaggacgagcagugaugcaccucagucacugaacuccgggccucugucugcaggucaagcaauguccuacagugcuaacaucuuccaaaggcaacuuaauacuagauagagaaggaaaaggaaauggaacagaccguccucugcucuuccugucagcaagcaacaauaggugucaccagggaagccaggccucugcuuacccaguuccucacacaaggacccacuccaagaaucucugccccuucuccccaguccauccgucugauaacaaccccaaaauccuuccccgaucccucaaauuacauuguuuuaaaguggaugugugugguaauucggcucuaagaaugggcgucacgacacuuuuggaaaugagucaggugagugucugaguuacccucuuguacuguguuaaagacaccauggcuacaagcaccuuugggggggggaaggcuuuauuuguuugacacaucucaucagagcccauccuugaggaaaccagggcaugaacugaaguaagaagaaagccggggcacaaacugaagcagagaccacggauggaugcugcuuacuggcuugcuccucaggauuugcucagccugcuuccuuauacaaggcagaaggaccagcuggccaggaguagcacugaccacuguggacuggaccauccuacaucaauuagacaucaagacaggacccuaacaugccaaucuuaugggggucuuucucgauuaagauuugcccuucccagauaacuccaggucucugucaagcugacaaaaaaccaaucaacucaguaaacagcaguauacguguaggguggaacacugugguaacuuaaauaucacagagaaaggauugacaaauaagaguauacugcaugucccuggagggaaaaacaugucaucacagaacauuuaaaagcaugaggcuuuugcugggaugccagagucuucaaaaauucguuuucuaaaauuuuguacagagaacauguacuguuugaauaauauuaaaaauguguuuuuuuaaaucccuuaaauauguuguugaagaaaacguuuuaaguaagcacacaaauaugcauguuucaaaaacuauuccauauucuucuagugccugucuaggguagaauagacaguagguuaagggacagaucaaaagguuauaaauaacacugcucuggggcccuugguuagcccuggucuucagaagacaccucccccaaacuggcugccaggcacauaaccuguaggcaucuuacuuuggggaauaagguuccgcugcccuucucagaaggguggugaggaaaucacuuggcacagacccuuccuccccacuggcccugcaccagaagguagaaacaguuaaugagugccaacucuacacagagucucuggaaugccuaaguuagaucgaguaacaaguacgguaaccauauuuucucgggaggaagacagaugaccucaguguccuucagggccagaggguaagugaaccaagucccagggccauagcuagucucacuguaaccagcaagccuggaagaaaugaggauauuucuaaauauccucuaaaagauaaaaagaggcaguuguaccgucucuaucuggucuuggggaacaauggacucuaaugaucuagaauccuccuagaaauuucacaucaagaaaaaaacugccuuaaaaccugggcuacccacagaggaaacuuuucucucagggauuuauuugcaacuugucagcccuuguugcaggaguauggacccuaggcaguggacagugacaggcagagcagcaccuuggccggaacggcuugagaauaaguaucucuugccuuagccgggcggugguggugcacaccuuuaaucucagcacuuggggggcagaggcagguggauuucugagucuucuauuuaagcucucccuucacauaaggacccuagugagggaucagggaauggggggaggaaggugaucacuggaucucuucuaaugaagaaaucucuuuuuuucugauuuucacuguuauuuuuguucuuuuaauuuggcuuaucaaggauggguggcugagccuggcuugguagagcagccaagguauaaaccgugacgcuaacucuaauaacccaacugccuauuucuguaaauaaaguuguacugagucgcagccauguacuuccuaccauggccagccauucccauuucuuguugguuugguugcaagagagaccaauggcccauaaaacccaaaauacuuauguucuguccuucaaagaugaagucuguagacuccaauucuaggauaacaaacuauaaccacaauuauuccaggacaucaccaggaauuauaaccuaacaggccacugaggaugguccugggauaaggauccccaacacuaucaagcucauguccugauacccagaaauggaccugacccaccaccgagagcccggagaccaccuuuuacuggauuaccuaggaagggaaccccaaaagccgcucaugagugggagcaggagggagcgucagaugccauccucccugaacagaugcuucucccagccccuaacuguuaaccaccuguauucuccuccucaccccacacggaaaagccacugucaguccacggcuugcacucuuacauggcuaccuaccucaucuaccaccucaucaacacuuuguuccuucgcauucacggucucucuaacugguuccugcagggcaaacacugagaaagaaccaccagagagcacagggguguccucugguaggcaggcagcagacagggaugcccccaagccucaugcaaggcccucuugacuaugggacagaggccaaacacuggagagccacacuggauggccagccugcccuacacaaguagccaguccuccucacugcucaccaugagcuccagccagauguagcccugguagcacguauuauaauuccauaccacucuggaggcugaagcaggaggaucauggguuugagaacaguuuguacuacauugcaaaauccugucucaaaaaaaaaauguauguauuaaaaaaaaguauuugacucagguaguggcccagcaauuaggucaagaccucuguaauuggucaccuggcucggcugccaacuugcaguuaaaauuauauaagcuuaguuuugucccucaguuuucucaucugcacuugagaguagauuagaggccucacaugaaaguauuuaagguauuuacggcaugcacuggguaucuagaaccauuaauuggagugauuaugaacauugugaccaugcagguauccugcuauagacccagugaaagcaaaaaagagcacaaauaacuaauaucuuuuuuaaaaaagaaagaauuaaaagcucucccuauaaaguccaggaucacuucugagucagggagacaggcagugcugggaaaggcuggguugguccucaccagagugguuuauuuagcaaugucggaugaggcaccaccccagagaggugguucagcgugcugccugccagcuuggaaacaugguggacauaaacacgcagagaaagacacaccucgcaccacugcacauacacacguucucugugugcuucacccacuagcacauacacacaugggcauggcaauagcagagccgacccccuccccaguucaaacucaguuuuuaugagucaggcugcgugagucuccacgcugacuucaugagucugcagacacaagcauguuuuccuagauucaucccacuccugucuacaacagggaagcggggagagcggaggaagcaggcggcuguugcccaggaagcuagucugcucuggcuguugcuguucacaggacauucucaacuaaccuggccgcagcaaugcccagccugcccuuugauggccagugguagcuaccaacaccucggggagcgagaaccacucaguuacuuuucacuuucucaaagaacggaguugucugugagcacugucaaaugacaaccauuggcgaacuaucagcaauuggcucugccucccuucuccaugccaagaccuggcauuuuaugcaaacaagucuccaggacauaucaccagcccagugaacagcaggucuucuagcuccugggcacuuaacaaacugcaggcugacagacagacugacaacaaagaucgguuuccagcuucagcuuaaauacuauguuugaccuccaggccaccgggaccaguguggcuccugggaccaguguggcucacuuccucaugcauaaaucaagacagugugacuuacccucagaggacagaaugaagacaaggaaccccacagagcucuuucugaaguggucuuuucagauuuaaccaggucuggagagaauaacucuuaaaggaauucggaagaauucauguagauauucuaugaaaacagcaggggagguacagcccugugcugacuucacacagaugcgagcagaaagucuauaugccucagggaaagcccagugagguacagggguagaaaacagggaaacaucucucugguguaaacacacauacucucuugcauacacacucuuacaaacacacuacacacacacaccuuucugcuguaaacaaacacacacucaugcacagacacacacaaacauaucugcuguaaaacuaacuccucucucucucucucucucucucucucucucucucucucucacacacacacacacacacacacacacacagagcgcuuucccucucaguacccucgggauucccugucccucccacacugagcccaggaccuacucccucuguaacaaccccauugcuccuucuacucuagaacaugagugaugagauaugaaccuucaaaucuuggucccucaucucagacccucucucccaggccuuucuugugcauguccucuuuuagauaagcccuuccucucaaucccucaauucaugcccagccucccugcaccaaacacagggaagcaccugcagacucuguucuccuaggaagagagcacacacacccgcacaccccgcugccccucugugacaucggaagggcaagccagugggacuccucaaccgaccuccaccucaacugcacuuccugucggccucacacauucccacaacucuccccucaacuuccuucaucaaaaucucuucacccguuccacagucugcagcugagcagcucacacagguccuggcccuccugcuuccccacucuguacugucugcugggcugcuuccuucuguccuugagcuauucaaggcuuccccaugcucaaggcagguagacucucugauccgaguggcccacaucugcacugcacacccaucccaggccuacaggcagccccaaggcacacacgggaacucugaaggcugaugaaacuacucuaacuuugacugugcuugugguuaaugauuuuuuuucaauuguguggaauauggguguacuuagugcaugcaaauuuuaucuuaauaaaaaaggauagaauaaaauaguuccaaagccacucagccccauuaugucugauacuaacaucgucaccuucccccaaguuaguuccuucucuuaugaccucuauuuccaguacugacaccauuacacaacuucuucaccaucuagaacucugacccacauauccuaccuguauauauucaguccacacgcugaguucuauggucccucugauucuacuaccugugacucaggucacccuguccuuaaaggcugccccucccaccccuucacgcccauucccaucauacaaccaacuagagaagaagcaggaucuuugagcgcccccgccacuaccuccuuucucacuggcucuccccaguucuugacuguuaacaggaauguuagaacuauucccaguugccaagccaaaacaacacuuauaauauuccugucuaauuuugcacacggcucugguuucgacuggcaaagagaaugacucaggguccguggcucuuaacggaaaauuauccugccaagcugugagccucccaauaauaaaccucucuuaagaaggaagugacuucccuuccaggucuuuuucuguggguaacaaagggcaccccaaaaccccuacuuggaaugcuccuccuuccccagcugcagaauccuggcacauucccacaaaaauacaaauucacugcaaaggcuucggauauuuuucuuuuccagugcaucaucuuucaucuucuccgaacagccaucauuuuaggacuuaauacuaaauucuagguuccacagaaagcaaaauguagacccaaaagcaaagccucucacucuacacaaaagaagaacuggaccaugguuucuggugcuaaucaacaacaaaugcauucugcaaacugcgugugugcagacacugcacggaaacaccugcaugugugugcauguauacguguggugugcagccagacacucccugcagacacaggcaugcucuccuuccacauuacaacacacgcacauggcuaagcaaacugcguggauaagaacagugcgcccucagaaagucucuuagccagcauuuagcgcccacuuguuugcucaccguugaagaaccauccuauggugguucccugugcuaacccgccaaggcucccaauguuccuaggggcagaaacuaccaguuuuccacaucuucauaauuugugccuacuuagucacauucaucaggcacaaaggcccaggguuucagccgccaagucucccucagaauguuucaccccuaccacccagugcacucaggguuucaccuuuaaagcccccaccgaaugccuuccaccauuuguuuacagcagugacuguaacacugucuuaaacuucccaacuacuugugggcaaguugcacagagguccuggcagcauggggugacccugucuagaguccugccugcauaguucucaaccaaauuugcucuuggggguauuuugcaaugucaggggacauuuucaguugucacaauuggugggauuggguggccgugggggugucacuauuugucuaguaguacaagccagggauucagcuacacacccugcauaagauaagcaggcacaguaaacaagauuagguccaacauguuaauagucuggaguugggaaguucugucucaggugguucauuagcucagagaaugcacagauugccugccucgcuuuugcuuugugucaccugguccacaaguggucacaauucagcugucuucauuauucacaaggcuaaauauagcauccaaagcuacccucggagucguacagacacugcucuuguaagccaacaaaccccucuagccucuucucagaagugccuuccucacuccaaauguuucccaacaaccucccugccagcauggccgccagccacagcacaacuggaugucugucaugaucacuaguccaaauccuccggcaagaagguuggccugacacaccccagcuccagagucccguuccacagacaccaaguccaagugagccuaaaucaauuuucuacagugcugcaagcccaacccagauuggaugucugcacacagccucugccccuucaggcugccuagccaaugaagggucccagaacccagacccgccccuacagcguucucccucuguccccucacacucugaagguggcuugguugaguuaugugacagcuucugugcaagagagugcaggagcugucaaaacugguaguguggccaucagugucugggaaaaacaagaggacggaccaaaaagaaacgaagaaaaaggaacaaggaagggacuucuucccagacuucaccccagccgugaaacccaacagcuggcucgggcuuagaaguuguaguucugacacaaacugcagccagagcacacaguucgagggucugagaguucagaacauuauugggagaaaggcagccacgugcguggacgacgcagaggccacaagcaacccucugcucgcugagccagacccgggucgggaaagggcugcaccguacgcaggccgcacugucacuugaaaguauaagaagggaccccggggugcugagguuagcagcgggccggcaggcgacagccuuaccgggcugcaggaagguagcuccuccguccgcaacgcaacgccuccgcgcgcucgccccgcugcgagcgcuccgcacacucuccgcuucuguuuaccuucuagcccgggugcgcacgccgcgcuccgcuugccccgccucc

SEQ ID NO: 12285 - RNA, 13038 nt, Mus musculus
cugggauugguaaccuggaguuaagcgggcucccugccaacgcgagggcuuuaaaaggggugaugcaacgcgcucccagccacagucucacucagcgagacgccgcgcacggugcuuccccaguggagccaaucggcuaacccgcgcuccggcagaguccuuggcgcucgcccgccggcgggacagaccacccgccucuggccgcucucuggacccuggccgccccgagcgaagacuggaggugaguuagagccacaccgaggagcgcugcccuccucacccuaaguuccccucuggugaccagucccgggacccuugcgccaccggagacugaagcccuaguguccgugccacagucgcucggcugagccgcucuuugccgcugccguucuuagcugguaaaaaguuucugguaaagugaaagaacgaacuuucucuuuugacucgaggcgugaaagaugcccagggacggaggaguugcgcucucaguuugcaacuaggagaggucgucuggguggaaggugggugcuggugcgcggaggugacucacacucuggcgaucgggguccccucuuccauccaucacuucuugucccggacccuggacucggagcgggucccuccuaaguccgcguagaggcgcaguggccgcggcuuguugaagcgcugcucccgguaucgagcuaaaugaaugaagaccggacgcucgaacggagguccggcacagccgcuggaggucgccuugcgcuccccggagcagagaucugggcagcaugaccgcguagagcgcugugagcgaaaguguguuaggauaaguuuggaggcggcgagcccugguguggcgcugucccggggcugaaggccgagaggucuccgcaccagcuaacuucggaccgcuagguuugagacgucacuuccagccucacucgcuguugugacuugcugugcucuggcugacuuuuaaccggcccuugaguuucuuuauguauuggaagggaagcgaaggaaucggaucaagcggguggagggaccaggguguggaaccacuuguacuugggggggggggcgugcgggggggggguuguuuguauucucgugacagagucucacucuguaauccagacugcccauaaaaacuccggccaauccuccugccucagccucccaagugcugaaauuacaggcccacacgcccagcaccuuucugugcgcugugugcuucagauagccagcuuuugacagauuuguuucuagacuaaaauaauuaaaguaaaaggagccagggagggauguucaguguggaggcucccccacccagcguuccuagccggucucugagacaggacaggaaagggggccucucuuacaucucugucuccuagcucucucccguuggauugauucccugcuucgaccccaugcucauuuucaacucccauuucuguauuuuccucuuagccauuuuauuugauuuaaucauguagcucacgagcuuucuuauaaauuaaaggaguugccaagcccgauuauuuaaaagguuuauucuccccuccuguuguuccacucuuuugagacaaagucucccuauguaacuggggcuugcuuuaaacuuauggcagucuucuagccucgguccccaagugcugagauuacaggcaugugucaccaagaagggagcacauguuuugcauguugcauuuguuaugggauaauguuaccacauacaggcucuugcuuggagcggguggggcugggguggggguugcuguugcuucuaucaagagguuucagaggcugcugaccagguucccagagugaagaaggcauugcccagcaccuguggcuaucuaaaucccuucuuggcacaccaguuucuucuggucuucauucugucagagccuccucuaugaggggugccagguaugggucucuucagcccucaguugccccccuggcaggcagcucucucugugguugcuuauuugguugaucuauugaacuaacugauggguccuccugguagugcagaaugaguagagggugggugugggcagcuuggcuggacuggaccacacccaucucugugaguuuaguuaggcaagugcuuuccuucugggaccucaguuuauucaaugacaaaauggggguuugagcuagacaauucuaaugcugggagucccguugaguuccuuuagccaaagucugugauucuuuaaggaacuggcuacagggguuccuugucaagggaggagggacauagccaggaccccccagaaacuucaagagagaaaugguuuccuaugugagaacucacaaucuuggccaauccaacccuaauggaggaaugcugaugucagccaauuggguguaauucaccuggugucuuaggaacucgggggucaaccaccaguugugacagacuggcuugaaauucuugaggguuccagucaauuccugaugacuagaacuaaacugaacugaacuagaucagggucccugaggggcagggagaaugugaauguauggauccuaauuuccuuauguuuuaaaguuugugcaugugauguguuguuccccacagcccugggagggaacuggucaguucagauaggaacugaaggucagaaagccucuggcucgggagugggugcccaacuagugagaaccagaggcagaccuggaaaugcugucucugacccucaagcccagccucccgccuccagccuucaaacaggagaaaggacaggauguagagucaggaaggaguacugguucccuaguacuacaggacaguuugcagacagcuugguggaaggaaguggaaaucaaaagugaaaauucaaagccaucauaagcuacuaggagauaaaaaucuaggagcugaauuuccaguuaagugagggaaguuucauuuucuugaaaauggcgagauugccgauggugcggcauaauuucugguuggaagucaugaagcagcaucuggaagcauaucugaaagacagcuuuaugaucaguguagaaaguucacucagcucaccccaaaucuccccucuuuggggccucagcuccugaaaucaaguugaaacuuucaacuuucuuucccuggaggacacagccuggcucugccugacucucuggagaccucugugcaagacaaaccagaaaagacaagagcccaaaucuuacagagugugcccccaugggggcuucuuaacagcuuucuaacaugcuuguguccccaaguaagccccacccccagcucuucacagaaacauuccauaccacugacauuccucaguuucuuccugacuuuacacuaagaaugcuguugggggaaguccuauacagcggacuuuaaccucaaagggcucguuaauaaacuuaacugggcugcuaaaggcucaugcucaacugcuguggcucaagcuaguuaaguauagaugaacuaguuaaguauagaugaacuauucaguccuacaaaugauggccaggccaguggcagcccugaauuccaccccuggacuguugggguuuuuguuuguuugucuguauuuccaauaaaaugcaaaggagaauauauaggaggaugccgagccucuggcuucagaagucauagaaacaucccccagguacaagguuacagcuuccaauuaagagaccuucaguucuuacuccugucuggaaaagaauuguauacaucuuuuugaguucuuuuacugcucuggaauuucugccuccaccagugggccuuaauauccagggaaagggaucuucaggaagggcucaagaaggugaccagaccccagggagucuccguaggagagcagccaucccucugugggagcuccugggagacccagaguagcuccucauggcagaaugcuuuccagggcauuucuuguauuauuucccaaauugcuuccaccacucuuggggaauuaggguacucauuaccagccuuccuuuacagaagagauaguacaccaggguacuaucaccacacauaacugagcagucuucaaaucucaguuaacaaacaaacaaacaaacaaauucugguauagggauuuuauggaaggcugugaguucugaaaccacgcaaaacaaaucccagugccccauacuaucccauguuaaugugaucugacuaaaucucaguaaguucaugucuaaaaugggacuaguuuucacaacgcuggcugcaaagcucaagggagacaagguagauagauuucuccuuaaauguuagagauuugccaaaaggcucacugcccucugggacuuggcugaugaccaguguagccgaggacggucccuauaccgcuccugcuuugggaaaaggcccgugggggcgaugggggcagcaagucugcagcagaaagaggcaccagaacacucuuccuagauugcuucugcccgugguucccccugucaccccuguggguuugcugaccuauagacugaugaggucaucugcuucggccaccucggcugcacuuuauuuauucaguuguuuaacuggccagccgggacagagcuucagcaaugguuugcucgcuuucucagccaacuuccacauguagacugagucccauagggccaaauugccugcuccuucauccuagaucuuucuuuggcccuguuccaagcuuugcuccuugcaugucaaagcuaaacaacacccccauaaaaccagaacuuugcuccuggcuuuugccugcugagugagguccuuugcuuugccagccaucucguuaagaaggggcuccguauuccugcaugaccugaguuaccaccacuaccgccguucccugccagugacuggggcaaagaaacauaccccacgguguguuuaccuucuucauucggacccaguuuccuccaggagaaaguucugccacagaguuguugaauucagggccccagcuuccacuggcuaacagauguggcccaauucaagugucuucccgauucuuuuugaaaggagacugaaaaugggaucacggcaggcgcuguacuuuuuuuuuccuuccuuccuuuugggaccgaggccacauuuguauauucugcauaccggccacagaagagccugaaaugaggacccccuugagccuuauuuuagaugugucucugagcuguguguuuuaaggaucuguuuuacucacagugaggauagcauaacauuuuuuuugauggugcauugaauuuaauuagcauuguuugcacggguguggggauaguuauuggcacaugggcaacuuaacuacugaauaaauguucccuuuaacugucaggguucacugcuaauagcuccuggguuaggguugggacugcaucuucccucuacagguccugugcagguaaccagagcugcuggguucaugagagaaacugccgugucacauccagaaagcagcacuucccagaagucuccuacccuccugagcuuaccuccuuuuagccccgauguucccugagcuaugaaugugugugugugggggggugcuguuuaggaugggacauggaacagccacuuauucucagcaccuuguacaguuaugaaucucugcauuagcugcugccuguugcaaaaggaaacugaccaagguuguauugcuaaucugugggccagaacauaaaggaggcaguuuuacaacacauauguuuagcaaaacaacaguaauauguucuccuuuacuuccuauaauuucuccaggcaugggcaaggcaugggcaugggcauaaaguaauaagaaaccugaagccucagggcugaugggauuuguuucugagguaggcugucagaccccaugccccaggacgccugaagcagugugugcuuauucuuuuuucuuucagcaaaaugaugcuucaacauccaggccaggucucugccucagaagucagugcgaccgccauuguccccugccucucaccuccugggucacugguauuugaggauuuugcuaaccugacacccuuugucaaggaagagcugagauucgccauccagaauaaacaccucugccaucggauguccucugcgcuggagucaguuaccgucaacaacagaccccuggagaugucagucaccaagucugaggugcguucugcaacacaugauccuuucuucagcucaugcuugucacacaugcuccacauuccagcacauucagaaggcuuaaaguuggggauaagaaccauccaaagcucugggcucugggagguuaaagucuaaagauaacagaguaaagacuauaauacacgaaugagcagguauagugugcacccgagaaugggcagauagagugugugcaugugugugugcgcaugcagguacaugcauguguaugugucugugcauauguguguauggaugugcauacaugugcgugcgugcaugugugugugugugugugugugugauaucaagaaacugaaacaggaagaucaagagaguggugaguuugagggaaaucugagguacauuuccauacugucuuuuagagagagagagagagagagagagagagagagagagagagcacucagcaguuaauagcacuugcugcuccugcagaggacacagguucaauucccaguacccacaugguggcucacagcuaucuguaccuucaauuucaggaaauccaacauccucugcaggcaacugcauaaacaugucacaaauacauaaaugcagguaaauacucauacaugcaaaauaaaaauuaugucucuuuuaaaacaacaacaaaaggaagacagaagcaagcaacugcacaaacucagacacacacaggcaaaggcuggugugcacagaagcaagcaacuacacaaacucagacgcacacaggcaaaggcuuaugcacauacaaauaaacuuuauuauuauauuuuaagaaaagaaacggguucagagauuagcucgaggugaaauuuucauuuuagauuaggagacuguggaaagcuugccuggucauggccuacuagcuaagacuugaggagagggaguugugugggaaggguucucucauuaggaagaagacugugggcugggagugaacugggcaugucacacagaagcugcugugucaagaguagaagggaaaccacugggaggcuuuuggacagagaagaagcuggucugauacauuuaugugguucccuggucugauacauuuaugugaugcccugaaaaccguauuggguaggccacuggaugaguaagccagagaaguaugcucagaaaugaaacuaugagacccugcacuuacacggaggaaggucugggauauagugcugaagguggcuggcuucuggaccuaggccagcugucuuagguauggcuaugguuuuuggaaagaugagaguauccauuuguugcaggaacuguagaaggccaggugggacaagaacagaacuuauguccuuggaagaugucaaauaggcaggcacagaugugagcugggaguccugggccagagauccagggcugggaaguaucugacuguggauggugcuugaagcugugaguuuggugaggccacagucugugcagaggcuuucuaaagaagcaaggaauaugguggcgauuuucaucacucaauggauccagggaccaaggauuagcccuacccuuccugauaacaaugcucacagaugugguacaccauguguuugcucugugcucacacauguucacacacauguucuguguugagaaaccuuugcauaagacgccuggaguaacagacauggcuacugagcugugguugcugguagcucuguugucucaagagcaucagaggugaacacuuguaacuuugcuaggcuuucuuaguuaggauuauuuuaaguuuacuuaauggguaugauggcaacuguggaguaaggagugaaacuggcucaaaagaugugaauuuaaaaggagcuugaggucugggguuguaggucaguggcggaauauaagacauugcauuacauuggggauaaaaagagauugaucaauaggacugacauuuguggaagucugaggggaaccugaaucauagcauuuaguagaugggaaugaacuauuuaugaugcuguugcuauggaugccguuaggggcauuagcugugcuucaagcuagcucagaggaggucagagaggguaccacaaaacagucauggcuaucaaguccaauacuggagaguuagagccugggacauucugggagauauuuuuuucuucuaaugaaauaguuugaaauaagacacaguaguagggauagacggggaagggaggcuagacagguggguggccugggaagagcaguuggggaucucuagagggagaagagugggugggugaugcucccaggcauuccugacucuagggggaaggauguauuuaugaaauauucuuuguccaguucugaauuacagggaucaguguuuuauugguuguuuuugguuuucaagacaggguuucucuauguagcuuuggcuguccuggaagucacccuguagaccaaacuggccuugaacuuauagaucugccugucucugccucccaaaugcugggauaaaaggcaugugccaccacugucuggcucacaaaggccaauuuaaauaucaaaaccuuauuucaaaauccaaauaacuuuuaaaguagacacaaucucaauuucccacauuaccaguguaauuccuuuuuuuacuuguucuuugauuuucaugauuuucucuuuguauuauuuuuuuuuaauuuuauguaugugaguguuuugucugcguggauauaugugcauugugugcaugccugcugcccacagaggucagaagaagguuuuggauccccuggaacuagaguuacacuugagagccaccaugugggugcuggaaaccaaaaccaaguuuuccauaagagcagcaaaugcucuuaaccacugagcuaugucccugucuguguccguguccguaugugugugugucugucugugucuauauguauguaugcaugugugugugugugucuaucuguguguaucuguguguguguaugauuuuuguauuucuugggacaguggccuugaggcaugaaggauagaaauuugggguuagauuccuugggcuuugccucuguagguuguaaauacuuccaucucaguccaccaugucuucugauucaaaagaauggggaaaggucaggagugggccagucauggcaucccaaagcuggcagggucugcacugagcaucccacggggagaguucaucccagcugugcuuuacagaguccauggcuggaugugcucacugcucgucgguucauagaccaucagggucagggugaacguccacggaggaccauagccaccaaagcuggacguggcucaguccucugagcaccccaguucuggcucagaaggaggcgcagggaaucagucugauuuguuggccgaaucagcaggugguucaggacucuacccaucaauagcauccggcuacgggcucauucguaccaucugcuaccacuaauggucucaagucccuccuccaggagcucacugaccucauggaaaggauguaccaggaugcucuugguaaagacagaaauaaauguugguuguuuuucuggaacuguggucacaugguugacagaagucaugggaagaaguuugauuuggcucacacaguugaggggauacaguccguugugcagggaagacaggcagccagggaagcuccgugcccaguggugaaaacgugugcccaauugugagagcuugugcaugguggugagggcuugugcaugguggugagagcuugugcucagugguaagagcuugugcucaguggugagggcuugugcucaauggugagggcuugugcucgauggugagagccugugcacaucuuucuagcucaagaagcaaagcuuagauaaaaguagguuccgaguucaacaguucccuucccuuguucaacaauccaccccugccagccaugucucccaccccaaagguuucacaaccuccccaaacagcacuguucucaggagaauguggcuaggggacagucuggucauuccugacuccagagggaaggacaacuuacaaagucuuguguguauguguguguguguguguguauguguguguauugauuauaauuagcaucagugguuaucauuuuaaaauucaaauucuuauuccaaaauccaaaugcauuuuuaagguaggcuuuaggguuuuauaaaaagauuuauuuauaugaaacacugcagcugucuuuagacacaccagacagaagagugcaucagauuucauuacagaugguugugagccacaaugugguugcugggaauugaacucaggaccucugaaagggcagucagugcucuuaaccacugagccaucucuccagccccagguuuuagguuuuuaaagcagcuuuuaguuuacuaauuuccaauauaauucuauuguacugaacaggcuuuagauuuuguuauucauugucaagcguuugcaugcacaugugugugaaggggauucauacagaaacuuaagucgugaggcuggagauggcuuggugguuaagaacacuugcugcucuucccgaggacugaaguucccaacacgugcaguagguggcucacagcagccuguaacuccagcuccugaagauccauccaacacucuccucugguuucugagaucaccacgaaugcacguggcagacauacacacagacaaauauagauaugcaaauguacacauaagggauuaaaaacaagcaaacccccacagccuugauauuuggguucaugguggcuuaaaugugugccuuuuggauuuuauaggcggccccugaagaagaugagaggaaaaggaggcggcgagaaagaaauaaaauugcugcugccaagugucgaaacaagaaaaaggagaagacagagugccugcagaaagugaguccugccugguccagccuguccuaggggauggaaagccuuguggguggggcagaaaugccagcuguaggcagaggauggagcaaagcuauuagcauggcagaagcggcucuggagauauauguaucuacacacacacacacacacacacacacacacacacgcacauauuuauauacauacauacaaacauacauacauacauacauacauauguguauacauauauccagggccagcaacagcuugccaugaaaccuggcacccuaguuugauacccagaacccacuguggaaggaaagaacugauuucuaaaagugaccucugaccuccucaugcaugcugugacacagacuagucaguccacaaacccccagcaguuucgagacuuucgagucacaccaacauaguuaaagagacuuuacucaccgguuuuaccaaauacaacaaaacuauaaaacccugcuauugccuuuggcucucagauuucuuuuccaugucucccaacuuccgaggccucuacaggguucauaccaccuuccaccuaguuugaucaucccaucuuugugguacgaugguuccucuagcaggucucucucucaguuugaggagccccaagguucccagguggucccccaccucccugcuccuuggcucccuccauugauuguccucucuugauugucccucaggagucagagaaacuggagagugugaaugcugagcugaaggcccagauugaggagcugaagaaugagaaacagcauuugauauacaugcucaaccugcaccggcccaccugcaucguccgggcucagaauggacggacaccggaagacgagaggaaccucuuuauccaacagauaaaagaaggaacauugcagagcuaagcagagguggcacggaggcaauuggggaguucuuacugaauccuccuuuuccaccccacacccugaagccauuggaaaacuggcuuccugugcacuucuagaaucccagcagccaagagccguuggggcaggagggccuguggugaccuacugcauugacccacucugcccccgagugaaccguggagcaggcaggagcauccuuugucucaccaauuccaggauuuaggccuuaucaucccggccagucucagaugaccuagcuggccccaggcugggguccuaugcaaagcaggaucccacuaaugggauucaggcagaagugucuaccuugauagguggggugggaccacauccuccacuguggcugacaacgcccuuccaagggaauauggaaugagaacauucauuauugagguuguccaauggccaggguaugcuuucuagaaaauaugcuguucugucccagaaugacugugcauaggguauccguuucagagccugguguugugcuauuuagauguuugucuugcacaacauuggcaugauuuuuccgggaguuucaucagaucugauuucugagagucuggggaucugccaugguggaaagugccccucaaaagcauuuguguggccacaugaacuggcuggcaccaggggagugaaacuggcugaugaccagcugagccacuuugugccaacagaggauggacgacaccuuucccuguacccacugcagaggaagaacccugggcacagcagcuuuguccuuggcuacaaacuguuacaacgucacacaaugaaggcacaaaguccaacuuucaaaggguguaggacuccauacucagugacagggcaggaagagccaaagauaaccacagccacagccuguggagaccaggguuggaagccaggugcagggccaggcaucugcauugugggauguuaauggcacuuuugucuuguagcuauuuugagaugugguccagagcauuucagcugggagaucucccucuggccaccaggacucuggcuacuguuaaaauccugauguuucuguggaauccucaguguuuaaucccacucaauaguaucauuacaguuuucuguaagagaaaauauuacuuauuuaucccaguauuccuagccugucaacauaauaaauaucggaacaaaaccugguaaa

SEQ ID NO: 12286 - RNA, 39741 nt, Mus musculus
aguagaaacgggauuuuaauauaauauucaagucuagcauuuucuauuuacaacaaauaaauauugucccaccccaaucaguaaacuuuuuacguuuuauacaaauguucaguugucuuccuccuccccacaaaccucccacugcgugucgucuuguacagcccggaugcagcgguggucaauggcacuuucaguggacugggauucaauaccaaccgggcaguucacgagagggcuucucucucugauccaagggagggcuugggcuccuggugggcgaggcucccucacucuguaggcccugaagguggaaucuuuggugcagccugagaaaggcuagagugugggaggaaaggcuaggaccuccaugaaagucccaggccagugccugugggcacaaggagagaaugcagucggcagcccugcuggguguauguguguccuggagcauccgggagcauggguggcagugaucugcaccuggggaggugucagcaaagugugguggauaguguccagggcaggcaaggucccaugcccaguuggcaacacuccuuggcaaaagucagcuaguccucugguuucagagagcagaaggcaccgaaggcggcaagugguccccagaggccaggucagccugucaguggcaggugucaaucccggcagcaggagagguucagggugaaaguggaguagggggguagccuggacuggcaggugggcagagguaccuguguggccagggccacucuagucuguaagugcuuagucuccagccagucagcccgucccaggagacguccuuagaagaugccuuuggcaauccugagucccuucugcuucauacgagggaggguggagcuggcuccaugcuugacuuuagcccccuuagugaagguccgcuucuuuaggaugaagucauaguuggcgguagaguucauggcauagaacacauuggcguuuucuggaaucuucagcucuggugggagagggacagggaguggugcuuuaugcggcugagaugcccccaccuccugagagccuccucccggccaggccacagcagggccuugggaguccuccaauccagcuccaacaaggaccucuccugcgaccccaguagaggucaaugagagccuaaggaagucucuccacaccaccuuuacggcucucucugcuggcuaggacuuccagccagagcagguuuccaggaauccacacugccuuccaugaugcuccacugcuacucaccaaggcuccaaggaccagcagagggcagaaccuuccucuggguuccauuccacuagucaccucuggccuagaaucuguccaucauuaccaagcgggacuuccugcugaccccgugucugccucuaguuccugagccucuguaggccugccuucuggaaggaaggggcccccucacccuguccauauaaccaaaacaguggagaagcugagaggagguuugcaguagaacaucuagguaucuugggaguuacugcagacagcagcaaauggugagauggggguguucagcucacuucagcagugucuguggugacagacauggguggccucuguggugaugucucucucuaacauuaagcugcuggccacagccuccuuuuggggaaaaggacauaggcacagagccccugaaauucuccaagauccuugagaauggccugauuuuucuauuuaucuuuuuaauuacauucaugcaucuauggaggcccaaagagggcaucacauccuguacaacuggacucauaggagguugucagccagcuguggagaagcugagaggggggaacugaacucagauccucugcaagagcagcacacacuuaggggauuauaaguaaccauguggguacuagguacugacucaggaccucuggaaaagcaucaaguucuaacugcugagccaucuguccagcacacaguagucuguacacuguaaccacuaggcugucugcccagcacacaguacacuguacacugcacacuguacacuguaaccacugagccgacuccccagcccaggcuugugacuccauccuucuuucuagaaugcugacucgucugugcgcuuuuuugcaucucauguguggauuuuuuuuuaaagauguauuuauuuguauuuuguguguguugguguuuagccugcauguauggcuaggaaggugccagaucuaugcaaaugaagcuacagugaugagcugccauguaggugcugggaacugaaccuggguacccugaaagagcagccagcgcucugaaccgcugagccauccagccucucguguguggauuuuaaacugagcauucuuccugaaguaccugcuuucuuauuuuaaccaggcaauguccucucugacaggcccacgcaugagccucucuccucaacucuugucucuuauggagaggcccagcagcaggcucuggggaaggggccggugcugagccgccccucagcccuggccuacaguugacugacuuacugugauccucugagaugaucugcaccagcucauaauccuccggcucguccucaucuagguuguguuuguccauggcuuuucggaugacagucggagccuuauccuggcuggucaccugaauugggauggggagcaggcuaucaggacagggcacaguguccuacaacagcuugccaccaacuuccacauggucuuggggagcuaugugccccugaagcaagaggaaccaauaauuuccacucggaugauaaggaggaagcagcugaugcucacuggccucccaugcccagcccugcccuaaggcugcgguggcaggcagcacaggcuacuagcucagaggguucagacauggggucacccaggugaacaugacuaagcaccauuccggcuccuggcacugaggggcaccaaggggccgaggcccuacugggguggguaugguaggguaccugacccaguguagcggccgucugcagcuuaagcccuggcaggugggaaaggcccuccguguacugcccauccauagucugaguagaucccaucccauuggcuccauguucaaacaacauccacaccuuggcacuacugagucuggccauggcuaccagccugcuuugguccccgccuuccugagcuuggacuacaacaagcuccuaagcagucugccuccaucuuggucagcagccuauccccauggacacacccagucaccacuggcuucuguuucaacccccaagagaaagucaagggccuuacaggucaacggguccugaaugacucuccccuaaucccuguccuguugccuugggacugaugcccuacaggcuggcccauuuccuggggugggugggcauagugcuccugucccuccucaugggccagagugcugacccaggucuccagguauuucucucuauucuuuuuuaagauaguuuaagaugauucaaauaccgacaacaggcagguaucugugcacgucugccgucuagccaagucaggccccacaggcacaugggcugcagcucacucaccaggaugcucuuguacauguugccguuguccacauccaggcugacccugaugaugcagcagucgcccaccugcugguuguagagaggcagugaggagcuguagcugcagaccccugagacggagcgcuugugggugcgcgugguagacacgggcgugguggaggcugacgaagaggaggugcugcuggaggcggagcugaugccagaggucucuggggacgacugggaggcugacucccagaacugugggcgacagcagugucaacagcagccugaaccacgaagggcccugaaggccagcagccagcuuuggggacuucugggccccuuguuggacaaagugaggauggguagaggagggagcauggguggucaccuucuuuuccuggccaucaggagacucugggacgaagcucauguugaucuccuccacaucagagcuggaagagccagcugagugcacacugagcgcgucggugauguccccgcugccgagguaagggcugcaccgaagcuggucacaggacuuggagugggcacugcuacuggugcugagcuccgugcugggagccuggcggcuacaggaaacacuuggcuuacucucagggucuucccaggggugccaaccuugacugcgcucaguucuguuucccuggauaucugaggggccaucccaucucauagaggugaaaacugaggcccagaucgcugacucagcucacucugugaagggcugauggguguuaggauuaggccccagcacuuacucgcuccagcgcuugacaauggcugugcuuuucuugcuccucaggguguugcuggccgacucagacgggggcuccagcucacacgacaggguguagcuaagguagacauggcugugaggcuaccaggagccaagcuggggcucccaaucgggguagcccccaagcuggagccuggauacgcagcugucaccaggcaacagugaugacaucaugucccucccccacaacccccaccccacccccacggccagcauccucaccucucagccucacugagucgcuccauagcucggaaccauguuccaaaguguucuuccggagcaaugcuguaguuguugcaggcugacuguagcaacuugaucugggcaaugacuucgaacuccuggaucaaaagacaauaggguggugaagcuucugugucuuuaccgccgccuuacacccacucacgcgucucccucuuuuuacacaggaggcugucccggaugucaucaccccaagacccuuuucuauggaauagccucugaagaguguaccaacuaucaccauagagcaacacaaggacgcacaugccuugcccagcccacgaccucccccgcccccugaagcuggcagcuccucaccuuccuucucuuuucaaaguugaucagucuccccuagaagacagaaagccaauguccguaagaaaacaggcaccuucgagcacugccuaccuucugcacuaccacagacacccacuagggggcaggaaguacccacgccuggcucuaggcaauagcaaggggaaaacccuaagggcagagguuguagacauuuuuguccaacccacucugaguucgagggcccugccuggcccacaugcugucuguccagcccacucugaguuccagggcccuggcuggcccacaugcugucuguccagcccacucugaguucgaaggcccugccuggcccacaugcugucugaccuuggaguggcaagcuucacucucuugcccaugcaugucuaguuuggccaacccucauuucugcugucagaacucuguagucuccaagggggcaaccuccaagaucucuugagaaccagagcucagggggcucuguccuccuugcccuucagaccccaccacaggcccagguacacucacauagagauaguccuucauggcaguguccagcaucaccaggucagugaggaaugugcccagguagggaacggugcccuggaugacucccuggggcaucagucaggugggaaagaagcgaggccuggucagggccucuccacggcucacccgaccccagccaggcccaccagggcucuccacuuagagcagcucaagaaccuuugcugcuuccagcccaggguccccugcugcccccagcccaggcugcagacaucuauggucccugcucauacccuucccaaagagcucugccacgcccugacucugauguccccaaagaucuagcaggucaccuugccacaggagguaagggccaaccaagggagcccuuccucucccaaccucugggcgggccacucacugucuccuucugccgccucugggcucuccuaggguucaucuccaguguggcaaacuuggagguuccuuccugccaggguugaaugugaagucaauaacauuuucuucuucucccaagcccaaccuaugcugcgauccugggccuggcugggccaaugugucuguuuccacauuugauauuucuagaucaguguccuguuuuaacacucacugggugggggagggagggccugggccuggccuuugugcaccucaccuucaaaguucccggggacaggagggcuuaauuucuggccccuagugccaucuugacuggcucccugcagcagugagggguaugcagcccggugaccuccugcacaccccucauuucccuuagacccauuguguccugcgagcucagcauccuccauuugccagacaagaaaacagaagccugcacacuggcagcaccuggcauggaaccccacagggacccaaaggacugcaggcuacugacucugaguccuguucuccggccacaugaagcaugguaggacggucucuaacugagcugucauaugggagagggagaaggcggggccugagaccaaagcuucccaguuccacaggucccauagcagaugcuuuguucucuaaggaucuuggccugcauagccagagcagggcccacugauaacgcucuucuuaugugguagcuucuagggugaggucaucagcccccacccagcuaagcugccgggacacccuauggccucaagggaugaagcagucaguccaccaccguuccucaugcuggucagcaguugcugcuucagggcagcggggagagccaccuauacaagcauagcugcacccugggacuagauguuuggaauggaggaugacacccaucccagguagccucucacugggacaagccuggccccacagauagaacaggcuggcucagggaaguagcacccucuuccaucugccaucagucugccaguggcuaagccacagcaggaagcuguagaccugcuaaucuggcugucucaucuuccugcagcaggcuggcuggcugucccuacuacaucagauuaccagaggccuacuguuccaccaaaugccugccaccuguccaagaacaaagucauccccuccuccugucuggucuugacaggacuggaaguuggccaaaagcuuucagugaggagaugaaacccugccaucuccugcccccuccccccuccuccccuguccccuuccuccaacacccugucugccaccucaccuugaugagcagcucucugcucagggaguaguuguucucaucagagaagaucuccgacaguuucuggaacacucgaaagcugucccugaaggaggcacagagcgaaggcggcuguagggaaggcugugcacuggggcaagcaccguggggaacccguuuuccuuuacaacaaagcuuccgcgcugcuggagaagaacccuaaauaugguuccauggaagccuaccagagcaggcaaaaccguuuugcucucagcuggguaguucugugcugugugcaagcacgagauacuuaccuggcucuaaucagggugagcacacugagcugugccgaccagugagccuacccuucucuuggucucugcuguugggccucacuaaagguagagccagccugggauacaguaggguuggggauggggagaccuaccuggagaccucuucccacgucuucuuuaggcgguggauggcauugcucuguagagcagagaggauggcguagagggaggagaaauucuugagcgcucugcacuccuggggacaaggagucugugaguggagcccauggaugagcccuuccugaugccaggaagcucccagagggcaugccagggacacauguucacacagcgacucaaguguacagugccuggagcgaguauacaccuggcuguguggcccugaggucuaugaagaaaaagaagaggcccuccuguagcuuacccuggccaccucgauccaguguuccaccacccgggcccuguccggagccuucauacucugguccccaaggcagguaguaaugacacaguuggccacguuguugaacugggcgacaguggcgcggaugguaggcgcgaggugcuccuugcccuucuugucccguugggaccagauggagcccaggcagugguagggcacgacuuucuugaauaguuccuagggagggggucagugucacagccccgcacagcccaaaggcccaagcugcagcauguaagagugaggauguggcugagccugugggacccucaccccuucaccugacuucugaggguacccagugcaaggcaaaccagguaaagugaagggagaggaaacacacacauagcaguggcccugccugcucaccucugagagcaucugcugccccucgcuagcaggcacgccugcugcuauaggcccaccugagucucagucuccagugcacagugagcacuucauaaaugcugagguuagacgggcuucaggguggaguggaggagggggacccaggcgcaccuuggcgagcacuccuccaucucucagaggacacacacacacacacacacacacacacacacucucucucucucucucucucucuuucuccccuccccccuuuccaugucuaccacgggggugggaaaucaaugccuuggguuaaguaguaugcucuaaucacacguuuguuaacugugaagcuaggacuugcccugggacaaaggcucugaaccagaaaacaggucuagacagcggaggauaaaaggaagccugccuugccccggccccaagccacucacugcauccaucagaguaaacuguucagccaccaagucaggagggaacagcagaaggugaggcuucucgguuaguccauucuccguggcuucaggcagagaccaggaaggcucuaaggcaggagugggcacaggagcugacuccaguuccaggcucugugagacggcgggcuccagcucuggagccagugcuagggauggcucaggcucuugagguggcucuggaacugguucuagcucaggagcuggugccaccacugggcuggaggccagcacuggcacuggggccgcagcgggcucucguacuggaguugaugucaccacuuggcugggcgucagcagcagugcagguucuagcugugaagcuggcuucagagacagcacuggagcuggggacagggcugcaggagauaagaugcccacuauggcugccuuguccagagcauuucaagaccgagaaucaccgacugccagagaacaagcccccaucccaacaacaagaugguaucccagacucugguguacuaccuacugggccccaggcuugcucuugcuccuggcucgguggcuggagccucucugugguagaaacuuuuacugacccuccuagcaggcucuguguggcuaccccugguuccucacccucagacucagccucacugggcuccagguccuccagcugggccaggagaaggugagcgcggcgcuccagaucugagccaggcauguugagcuguacauaagccaccagcugcuugaggcagggaaaguccggagguugacagaaauccucugaguauugguccagccaggugcccaggauggaggagauggcacuggggacacgcaacagagucagaggcauggucucuccucguacccucccacagcauccuggugugccuccacccacaaguccccuuuggcuguccaaguaacuagacagaggcuacagaggguccuacaggaggcagcaaaggcucaucaaugggaugguggcucacccgguucccacuccugcccaacucuacuggaauggagaugcccaaagggccugccauucaaccaguggcaaggguuaccucaguaccuauucuuuguaagccagguauggguugcauuuuccugagggacucagggaccagcuaaaugcccauucuuaaggagugaggcugcacgucuauugagacaggcuaugcuagggaaggauuuucacagugacugguucugaaucaaucaaucaaucucucucucucuuucacacacacacacacacacacacacacacacacacacacacacacacacaccccuccucuuccaucugacacagggguagccuuagaccuuagcccagcaucaggaaccacaugugugggccuauaguuugcucgacccuuguucccuaaaccuccccucuggacguaaagccuacuuacuuuuugaguugguccugcgguccgccguccucacuggaguaggggaggaugcagccauaucuagaggaggccgugagggcgucacaucuaccguaccugcuuaugaugucuaguguuacuggucaacucccugaugggaauggggcccagggaggcagggacucagcuccugucacagaguuaggugcuuggcaacauggcuacgcacagcagauugcuuuagaaaccgaggcacuucagcagaccugaggucucucagucgauuaccacagggccguccuugcucuguguucuagguugagguccccuccuuucuauguagggaacccacuuaaccugaggcugaggagaggaaggcccuggcagcccacccugacaggagccugaaaggaggcuuauccccaagcugggcucccccaaggugcggccggcaggaaggguguccugggucuggcggcagugcucaccuuuugaacagcaggucuagcaccugcugggugguagugaaggcucuguaggugcacaggaagacagugacguaggaaaggucacugcccuggaaggcaggcaccagguguuccaccagcuucuccagaguaccagccuucaccgugcgcaccuugcaggucucauagagguucagagccgacucguucucacacugcggggacaggagaagagcgaggucaguagcagggucauguucucagggacgcuggaggcuggagcucgggucaccuccuggacacccucagcagaauguggcccaaacugggacagagggucucucucugguuuuaaagucuuggauuuucaagcagaguuugaaguguugagcccuucagggcgguuucuuaggugagugacagcauucucuaacauacucugugggagggggauguuuccaaacugaacaguccauccuagagguggaaagacaggcuuacuccgggggcgggggugggguggugguggacccagaauguucccugagcaaguucaaugaccacaggaaagaaucaugcuggaugcaacaguggugaagcauggccguguggcggcaucagcgcugucuucuggaauguuauguggcugagucggucaggcucagcuucuuagcucaagggacccacaagacuuguucugagacagcaaguugcagagaaguguauacauguugaagaauuuugucaacuugauacaucugacaaaauuagagucaucugagaagagaccccccgcccccaacugagagaugccuccuuaagccugcuguggacaagacugcugggagaggguccagcccuuguggguggggccgucccugggcuggugagccuggguucgugagacagcaggcugaacaagcaaugggagcaaaccagucaggagcucccgccccuccauggccucugcaucagcuccugccuccaggcuccagcucuccccuccugacuuccuucagugauggaugaggaugccaaaaugugagccaaaugaacccuuuccuccccagcuugcuuuuggucaugguguuucuuuauagcaauaguaauccuggugagauggcucaguggauaagagcacccgacugcucuuccgaaaguccgaaguucaaaucccagcaaccacauggcucacaaccauauguaacaaaaucugaugcucucuucuggagugucugaagaaagcuacaguguacuuacauauaauaaacaaauaaguggaaaaaaaagaguuuaaaauaaaaauaaaaaaaaaaaguaauccuaagacagaccgcuuacaaagccuaaacuuccauucaaugagggcaaagggcaguccugcugugagaggauuucugacacuaggaggaagaggacaggggaggggaggagugacaugugaggacagcuuuuaaaccgagcaaaauauuugaauaugcauggccuuaugggcaaugagaagcaaagccaauggcuucucuucucaccuguggguagggaugucagcaggaucuuugugcaugggcuggggaagggagggaggcucagcccagagucgcaagagggacuggggcccucaaacagaaaacucuggaaaggagucuggcagggucacccuccuggucuccucuccacacuuaccccuagccagcgcuggcccuuaguggcuccuugguguagcuggaccuugcgcagggagauggaguagaugaccccguugaucagcuccuccccaaucuccugcguggagcucuggaaagacaaggcccaagagccaggccaggccaucaggggucugcuauaggggcauggcacagacagguggcuucuggacuuccagggcgaagaaaauggagagccaggacuccccuucccaccuggcuccucacgaccuuaaggucaacaucucaggaaccugcuccuacuuaguacuggacagcccaacacagucuaccuggacaguacuguuauucagccauuucagagacggguaaguggaggcugaggcagccaaacugucugguguauaugacagauccccuaugccaaggcccuagcauggucacagguggcacuggccucagaacccaaggccagggucacccacacucuucuuucauugucccaucugagguuccaggcugaccaggcagcagcaggcagcucuuucuagcccagugcuggagucggcaccauggcucuagggcaggugcagacgcugaccacaucugaggccacuuccuuccccuucugcucauucaugcugcugagacuucuuggguaacauggggguucccagcuggcuguucuuccucaugugagugagugggguacugcaacagugcuggggauccacagaaccccaaaucaugaggccuauauggagaagggggucaugugacugcuucucagagccuaaagcagaaaugaaacauucacuuccuugcaccucaggcucucucuacuccugcccucuggagaagggauagaggggaccugauuccuggaagucaguggguaacaagaaggcucaugacccuaagcaauccuggccuggacccugugggagugucauguguuccucagcgcagggaacuucccuucagacacuaguggcacugucaucagcuaaccccugacccaaaucuagaaagucuuucagcaaagauaaaggagaccauggcucuggaacacccacugugucggcucagcguucuuaaaagucagggcuggcagagucuuccuucccugaggagccuggccguacccagcaucagcagcagagucagggucacacaugaggcuccugccauacaacacugggguucagccuggggacccuaguacagugcuacuuuguaacagguuuuuaucgaugcccauuagacagaaaugugcccuggccaggcacacccgcggccauagcuggaugcgagcagcaguggccaucccugagcagggcucaaaugcaaggcuuugcuuggccugggcuuccgcugacagcccagcagcuggccugggcccugugggagugucaugugaucccuguacccuucccccaaccgagggggggccauucugccagcuggaugggggugggggugcagacaggcucugagagccauacaugucuuccucuggggagccgacacccuguugcacagaugggaacuguuccagccaugaggagcuaagcccauacacucugcuuccuucaaacaaucacagcagaaugaaucagaccaccucacaauacugagugugggccccuuugcaccagauacccagagaagacagagauaccccaggccugguuagaaagcaacagagaagagcuucccuccccagucuaaggagcuauccucaggucccucugagguuggaagggcagggaccauguaaccugaggcuaccuugagcuaccuuucuaguaggcagcccauguaggaagugucauauucaagcaguccagggagaggaggggguaagcuggccugguaaacagcugaaacagcaaagaugucugccagccugccugccuagggcaggcauccaggaggccucugagcuccaagaaaggaaugccacaugguuggcuguguccuuagagaggaucaucuccucccaacaccgccccccccccccaggcccucaaaugugcaaggcccccagggaccuaggaugaagcuggcuguugucgcuugagggugaaagugucccugggaguccugggaguaagccguccccacaaucacagucucuucagagcucccagaaugaggugugucaccugaucaaaguucucaggguggcaggccagcaggauguauguccccagcuaaaagaaagagagcugcaggccaagcccagaacagcaaggggcucaauaaggauggggaugccaggccugugucauaucucccuagagagcacugggugguggugguggccgggccuggcagacacugcugcuucugcuuuggaaggccuuggcagaugugguagaguucaagcaugagaucacaguuucucucuaugugugcagaggccgggugauucuaaccucaccacaccuaccuguaccacagucaccaggguaccccagggcucuagcaggucccuugcagauccccuacagcucuggacacacagaguccacaggaccagacccagguacuguaucucaggaggagucucacuccccagcuuagcucagcaagcuggccaugggcugagagaacagcaguagcagcuaacagguggcacggugugggcugcagcugacuaaggauggcagacaacaccugggacagcacaggaacuggugauguacgagagucgcaccugccugaggaccaccuggacuacuggauccagauggcagcucacucagaguccuaccccaugcuuggaaaggagcuuccagaacagggaggggcaguccagauucgagugagccaucucaggcucuugucauggagggagagcaccuuccaguuuuacagguggaaacaaagcccaggggaggguugaggugagaauccaugauuucucacgcccaggccaugagcuccaaaggaguggguaaaauguaaacaucaagcauuagaacccugucucagccccggcacuggguggacagccucgaugcugugccucuguggcagcccucagugaucagaggaagcuucagcuagggacugcacaaggagccugguugccauggcagcaggagagcaccaagaccaaagaaaagucuugggccugugcagagcucccaccgagucagauucaggucccaggaacccucccugucagccugaguccugcuaauggccaaguuagcauuucaggaaagaaaacuagacucaagugugggagggggcacgccccaguccucacaggguauaaagcagacccagcugacggcagacucacgccagcccaugaccaugccauccagcuaacacgggcacuuccugccccugagcuucuguauauuuagugcauguaauuuaguguggugccugguggaugaagggacaccagguagacagguagagcuaggaaauagcagccaggacaaggauuucaccccuggccuguaaggacacacccaugguacacagaugcaggggagaggcugaagacugaaaugacuuccucgggcuacauagcagauggaagguggccaggcugguggcgucacacaggugccucugagcagaggcuuaaggacgaguccuggggaauggauccugcaagccuggcuccucugcuggcugucagucucacguggccaacuccacaacuccuuuuuguuuguuuguuuugguuuugguuuucaagacaggguuucucaacucacuccauagaccaggcuggccucaaacucagagauucgccugccucugcuuccugagauuaaaggcguacaccaccacugccuggcaacauguccauuuuacagaugaagaaacuggugcucagaggggcuagccuuccacagagcucaagcucuuugccuauuggguucaaaaggacagauggggccugcaggugugaccuguaggacaacagcugcaggaaaagguaucaaaaggaggggagcaugccaacagaacagccauggcccagcaguucuggucccuguguccugcucaagugagcagcccccgggcugucauuucucuggggaacugaguuugcuuggagccccagcuccuguuuuaggaagcaauucaucucaaucgcucucucucacugggcugggcuggcucacuccucugugguauauaccugauaacacagcauuugugaggguaucagaaguccgggucagggcaggugcuaaacugugagacccuucagagugaagcugaagccccuccagaugcuuccucggucagagccagcaagagaucuauccagagucuugaaaacugucugacaggaggucccuguuccuguccugcuagcaaucugguuccuccugcuccagagcugccuagaggcuccuaggaaaugggccagcauccucucucucucucucucucucucucucucucucucucucucucucucucucucucucucucucucucucuccagccaucuggcccuccucauccucagcuacugugcuucugaggaaagcaacuguaaguaggaggagacccugggggcguggcuuugauggcaagucuccucaccaacacaacaggcucuaaaguucuugaaggcugcccuuuuagagucagccaggaaguaucucuagaacauuaucuugugcgagcgagcgugcgcguguacacacacacacacacacacacacacacacacacacacgcacacacguacacgcacgcacgcacgagcgcgcgcgugcacacacacacacuauguaccuauaucucugaguuuucagggucaagggaacaaaagaacccugggguaaacuacgagcugcacacagugugaucaagaaagcagacggcucggaggaagaaaccuggccucacuguguccaacccacacagccuucaggcgacacaggcaagcagccaggauaagacgccugccugccuggccucggccucugcaguugaccagcuuguugagugcaaccuaauuaguuguuucauuuguuaaaugggcuauuaauagcccugaaccccucaaaggacaaaaugcaugcaaauuauuuagccuaggcucuuccaccaagccccagcggcuguuagcuuuuauguuaagccccugguuacaguucccaaggucucaaaaucugagguacucucaccuucuccuggacucuaagccuccccaucacucacccgacaaaggcuuuuuugcagugcuugggucaagcucuauccacgaccuuugcgggcuucuacugcucacuagccaucucugcuggguccugcuucuagaucuuauauguaccagacacccuacccccaaccccagggaacacugugcugaaguccugucugcgacccuuucugacaauguauuuauuuaggucagggacuucaccucucuggccuccagccucuuagcagauggcacuggcaucugagcuggaggucugugugagccgggaggaacacgguauuggugccugcugccugugaaugcuacagauucacagucacucucgccaggaugaagcugaagcaagccuguggcaggagcauaaaccucgugaccucuauaaagcagacuggggcaggucaagcuaggucggugguggcuugacuuagaacugagagaguaggcagaugcccagaugugugaggacaucuggcaaccccaggcugauggaaacaaaugacagaagacgaaaggcaaagacagagagugcagggaccuuaauuggauugauuucauuucuggaccugggucugcuaccaggaaaccagacucaggauggggaugggagggaauuauuggcaaaacagacagggauuucccugcccccucccccaggcgaaugcuaaauggucauuguguucaguuuccggcuguggccuccucuccugccaggacccuggcuuuccugacccagccagaagcuucccucugauuucuaaacggugaccaggcugcaugacaacacagaggccuggagagagggcagcagaggaggcacagauagcagcaacccaugcaggaacagaaccuuucaacagcccugccacaaaggguccuuagggauguagccagacagagucagagagaagcuugacaccccccuccaggagugaucaggcuaggcccuuccagcacacaaagccggagacucugccagacauaaugaaagccagaugagugcagggcugguggugggccgcccaccaccaagcuccccggagucccuccccagccgccuccaggaugagaccacugggugaaugagcagccuggcuugggacaccugccaagcacaagaggccuccuaggccugggggccccaugaccagaaguucccgaguaugcuuugucugagccuucucuaggcagagcaggaugcagggcugccuugggauuccacuaccccuggggcaugguggcagguguacacuaaggugaaaggaagagggcacugcugggugucccugcccaggacacuagaaacaagcuccuacccacauucacuauucccaccacccacacauaagggcauggucucugaaucuuccagcccaucccacucccuuccugccacugccuccucugaacagccucgauguucccgggucauuagaccuaugucugacucagugauggguauucaaaggccccugaggucccacucaccucuggggaguuuagggcugugccaccacaaccacuugcuggcccacuauauuguggccuccucgugucacgcgccccauugacaaggguuugaaaugaggauaggcccucgugguuggagcauucacacaccacaggcguguaaauagugacagcauggaggggcuuaaagguuugacugacugcaguaauugggguugucacaccugugaugagugggagcagguacugggaugaauugagggggcacgggaauucagcucugauuccccaccuacugcugagggugugcuggaagcuguaaugcccaacuggcugccccagggcugauacagcagggggacuucugaggaaggaaccccccagccacacacaaugcugcaaaggacguugggcucacccaccuccaggcgcggcagaucagggucgagcugcgugaagcugugcagcaccacugggcagcugucggggacgcccaccuccaggcgcacggcgucccacacgcugcggcugcgccgggaaccgggaaacaacggcucggugcccccuaugggcccggccgccucagcccacaugcgcugcaccauggacgacucacgguggcgcggguggccggcgggccgcgagacccggggcagcgcggggcgcagggccggcgcggcuccgcgcugccugcgcucugcgccagaggccgggccucgcugaugucagcugggggcgugggcugcugggggagugguuucagagggggcgugggccuccucuaguuggcaggccugguggacagcgcuugcauacacagucuauguauugugugggcggcccgugaugcuguuuugcugaaaucagauccacuucccgggaauuccaguuacaacacccccuagcucuguagccucaguuucuucaccuggaaaguauggguaaugaaaaugacuuccuccaagagugugacugggaggaugucaaugaggucacugacuaugugcucauauauuagaguauggggaagggugacccugaggauugauugggcucaguguccacagggcguuggcauccaguccaagcuccauugggagagggaugcuuccagccucagcuccagucaccacagucaugcacaaacuagacaaaccuacuaugcaaaagcaaugcugguuaccacuaggugagguggcguacuuuuaaaggcuuguuuauuuuauuguauguguacuguuauuugccaugcauguguguacauugcagacaugguagacgcugaugccugaggggaacaaacugugaaugcugggccaucucucccgccacaaggccuaaauuuucuuugaaauuuuuaauugucagaaaguauuuuuaugaacaggcuccagugaauaugauuuaagaaaaagauaggcagauuuggcuagguguggagauccccuaaggcugcucagaagcccgggcucugcccuaucuccaggaaguccaggcguguggggguauaucacaggaaggcaguggcucccacacauucuguaggcuuuuccccagccccauuccugggccaaggacccggcagcagcucagcuuuguuuccugacccugcugcucucuccuauucuggcuuucuuuuucuaagggccacuucucucugauacuuaguccccaggcgucaacccugcgggcaggccgucggcaggcaggcugccuccagacacacuaauugcagggauggacgguggcagaggugagguuccaucaucuacucugcuuuucugguugcuguccaccuguuuuaucaaguuccuuuccugucucgcucugcauuucccuccugggaagucuguucauggauaucacaugcacagacacagaaacacagacacacauauguguaggcagauacacagagacauaaagccacacagacagacagacagacagacagacaagcuccucacucccauaggccaacagcucaagccuuuuuacucugacccccuuucaccaauauaaguguccccauguuccugccugcugcccuagaccccacagggcucacacccucagcauccccagcaccagcugugacuuuuuagacacuucccagaaagcagagcccuccccaaggccuccuaagcauucccucaugauuagcccccagccuacagggaauauccuuuaucaagagcaggcccaucaaaagagaggggauaaggacagcauaugugggauagugaagaacgucuugcaacccacaccuaaaucuaaccaucacuuggggaacaacaggagucagaaggauagccuccacacaccaccagccugcaaccuauggaaauccagccuauaggacagacagacaaacagguuuugcuuugcuaacaaauauauggggguguggagguacacagaaagaagagauaccagccaguauguggguuugugaaccugauaugaacaaacugacuguugaguagcaaggcgaugcacucuaggauacccagcaggauccugaaauaagaggaacagugaaccacaauggucagagcaaugacccaggcagccagguugcucccuaagcaagcacuguuugaguauagcgggcaaagggaugacuucacgugggaggcguggcgaggggagaaaaggcuugauuucauuauguugcucagaacagcaagagaucugauucuagaauuuuccauuuaauauuuuuggagcagggucaaccuuagguagcugaagacuaccacaaauugauggcacggaugcugcugcuccuccucuuccucuuccuuuuuuguuuuugaggcaggguuucucugcauagcccuagcugucccggaacuuggagauccgccugccuugccucugagugcugggauuaaaggugugugccaccaugccuggcuggacacggacaucuggacuuggacguuguuucuuagcugccacuauggugugguuacuguugagaguuauauggcagggugggaauuuaguucagugauggagagcuugcccagcaaguguggggcccugggcuccauccucagcaucaagggggaaaaaaaagggggcguucuauggcugugccugggauuuucagaugaacugauguuauuaaagccauauuaugccauauucccuaccuugagucuauuugggaucucuccauaauaaaaguuaaaagaacaaaggggcuuggcugaagacucacccucugagaccccuggugggagguagugacccugggcuagaucugagccauuuccuaugugcuuuacucagcccagucacugacaggauccugagaacaaagcagccucaggcagugggugcccagggaacugaguccugauguucacauauucuuaauggaggcuggggacagcccuggugaccaggagugagaccugggcugucacacagcaugcucaccucugcaagaaaagguuacaaggaacuggucucucuccucuuccucaucccagcccuccugggaacgcagcuggcccucacugggaggcacaacaaaccccucaggaacaaugcugacuuuacacaguuggacgauguuccucagagagcaaggcucugagcugacaggcaaagacuagagggaagccaagagcgccucacacauguauuuuguuuggacugcaaaguguuuuuaaauguuugagccaacaguaaaaggucaggugauuucacauaaaaauccaaaauucaggcgucuccuguaacucugcgugaccugaccacaccagcuguguuccugaauaagacuagaggcugggugggagcugagcggcucggcaccugugggcucuaacuaccccuggacaccauucccugaugcucagacaaaugagccccacaacugucuaggucccuggagucuggcuuccugucuucugaaucuuccucugacuaggaugaaaaugcguccguccucacaccacuucagugagugcauugcuaguccuuucaugcugccaagguugccccugccaugguucucaggggccuaguuccaugucugcuggguagcagacagccagagccagaccuggacaccaggcaaugucaggacaaccacagaaaugagccaacacuuucuucacacccaggcugggccacagccagugaggacagcagccggggggacccugguagaaauccuuuuugucucuugucuaggcacaauggccaacaccugcaaccccggcacuggggaggcuaaggcaggaagauuaucaacuuggaaucagccuaggccucagagcaagacccugcuucaaaacaacagacgacuucucacccccggauggcagguaaaggccugcccgcauggcgggaggacacugcuaagguguggcccagcccagcuccucugucauuucccgacuagggcaucaucauuccuggccugccuggguucugggguggcccugugugggcgugugagcacacaccuuggcgggagaugacgcaccugggccugagugacccagcucaacccugugcccugcagucagucucaggagccucuccacacaauggaggagagaaccgaaaauagcaacucccccaggaggucauacuggguggagggaugugacaugauuaccccaaaucucugaccucacauagaguugcuguccaaggaaaacuggaacaaaagcagccugaagcucaguagauccggaacccaacuaaguuccaagcaagcugucuccugaccaccacccauguacuguggcacacaugcccacauacaucacacauacaugcauacacaauaauaaauaagaggggcuggagugauagcucaacuguuaaaagcacucacugcccuggcagaggaccuaaguucaguucccugcauccacagcuagcucuaacuccagccacaggggaucugacaccccugacguuucugauaucgaauagcuauacccacaugcagacgcacgcaucuaaauauaauuaaaaauaacaaaaaaguugucuguguauacaugcacacuaaaugacuaucacacacacacacacgccccacaacaucaagccuggggcaauggagauggccccuguaaggacacaugauucuugauuagccucucuggcuucagccucagggaauucaugcucuggauuguuacacucugucccaccagcgaaacuccacgcuggcagccuacugaaugcccccugccccaucacaagauacccacuuuggaccuacccacacugacaacccuggggaccacuaaugcuccaggugucacaugaaguacacaggggcagagaagaaagacagugaggacacaaacacauagaaacggaaauggagacucagagcugaacccagacugaaaacugaagagaggagauggaagggggaggccgggggugugguggugggagaauagacaagcuguggccugugugagcugaucagagcagucaagggagccacugagcacgugcaguagcuccaugugucccacagucucaucggucccuaagccuagaggcagugacauuugucccccagcacaccccagaaaggcccuggcaucaggcucccauucccuuccuuccccgagagcggucagcaggcugccagccuggcccuccucuuauacucagccaagugccagguagaaagcguccugaggcucuggaacccggcuuugagcccuacucccugcuccaugucuucagagccccaggcgcaaaucagagcucaauaucucucccagaaagaagaagacacuaagaaaacaacgaggaccacauaccagcuaucgcucugagucaaguguaauccaagaagcaccauccgacauuagcugugagcugcugugacggcccacaggcaugcugucugccacugcuggggacagguggccagccagagcucacacacagcaccccagccucugagcugacaccggguacaggagacagcucuccuggugcuucuaaccaaacuccuucaaccaguucugacaagaagaguaaggagcccuaaggugccaacucccauggcccaggccaggucuuggcugugaccugacagccuuucuggcaaacacuuaccucagcagugggugccagcagaggugccgggcaaggugucggaggagugggagagugggcaguggugcggcgggcaauggcccaccgccuggcagucaccacugagacacaggcaaagaacacugagcccuuccucccccugggcacagcaggccuagcauggacccggucugcuucccgggccauagcagggcgagaacccaguggggagugggcucuuuggcaggcugucggauacugugucuguagcccgccugccccaguggaguugagcuccaagagugccuaggccuacugucaccugcauggcugucauaccugcugcugugacgggcagggccaggaauucccgcuuguaccaggccacaaggcaagcaaggaugaguggccaggacucuguucugggguggccuagucaucuauugcuaaccuacaccccuuagguagaccuagcucucuccuccuauccucugccaccaagaccucaucccacggaucucccuuggggggcuggaacucucuacacugggaucaaagcagccuucaucaggagcagagucgccaaaugagcauaagccaggucucgaagccccaugucaccauucuagaagccuuuccugaccaccuaauucauagcuccugucccggguauuuggcauggauuuuuuuuaaaaaaacaauuauuuauuuuauguauaugaguacacuauagcugucuucagacacaucagaacagggcaucggauccuauuacagaugguugugagccaccaugugucugcugggaauugaacuaggaccuuuggaagagcaguuagugcucuaaccauugagccaccucuccagccccuggcauggauuuguuuguuuguuuguuuguuuguuuuugagacagugucuuguagcccaggcugaccuccaccuuacuaugaagcccaggaugaccuugaacuccuaaugcugggauuacagacgcugccagcccaccgggcacaguacuucauuuucagcagagaccgaguagggugguaaacacugaguacuacgcccaccaagauuucagaaaagagaccacagaagaaguaggugggaugucuguccgucaggagcaaggcagcagcugagcuggcgucaggcuuuagagcagcucaccauccuuccccugacuuuacugcaaaacaaacacuggaagccacuaaccgagcucaacaccccucugacccagaagaaccagggucaggggaagaagccuggcuccuacagccaagcccacaggcugcuucugucugcaaccacagaccugacccaaggcccaccaagcccaggaggaaguaggcagaagccaggcuguaucuuuacccuccuggaacucucgcugggcuuccagcacugaagaggcaggaagccagugguggccagggacucuccagcucccccagaggcacugcaauccccaguggggguggcagagacccagcauccagacugagcccgccagcacccuaacucuguucucugagcaaugcacacccucuuccaauggucuuccugugacucuuccagagugacugacugaucaguggcuccaagccuugaggagggagggggccucaagccuuggcuccugggccugcuuggugcugccgccugcaggacuugcaaacacaccacacuccuccauauuggccucucucuccugugcuacccaccuaaccacugguguuggccgguacagguuuaccggugagaaagggguuuccccacagaggccuguggaggaaguaugaagggaccagaagggcagcggcauuauguuugugucuuugacggagcagcguuuacauggacuuccugaccaccuggccugugcaagauacaaugccugccccggaugcaggcuccuuauugcccgacagacacucccuccagcccucccagcaucuuccaggccuagcauucugauuuccccaacccgccccaaccucagcuuaggcugcagggcuugauccugcagcuacucugauucucacagggcagggcugccuggggcagcaacacugagcaggcugagagggcuggagggucugagucacagcuaggucaaagaacaggaccagaaggaccagcugccacuccugaagcugggguuccaggaggagggaccaaagaaagggaggagccaguagcucccagccccacccugccacaggcuggcccugagagagcaggcccuuuguuccaggcccucgggagccacgugacaccugucacugucacugccuggaacggaggauggccacaggagcucccagagccacagagugggcucaaagggcccccugccacagggacagcgcaccaccccugccugcacaccaguguauaugauccugcccauucucucaggacgccccugucaucugcucuguucuacacaccaguggcccugggagaagguaccuggccacucacacaagccugcauggugucccuaggcccagaugcuagcgucuguggggguacuaccgcugugggagugucuucccgcccuucacagguuggggggggggcucugaagggugagagcccauuguuuauaaacaacugguagcugugacucagcugugacucagcugagugcugacucgcagagcuguuuacaacgcacagcauccugucccugaggcugacuggggacauggcucugcucuucuuuccugcugccugcugaccugacacucgggguccuaugggggagugagaggacaguuccucuccaggaacugggcccaucaucaagucaccccacacauguuccugugguccgugcuucacuggcuucuucucuggggccagggagagugcaggccucagcucuggccaaaaggccccgagcaguggugcuaucauugucuguacuccucagccccaaagcaaaauuuacccauagagggaguagauaccacaaagcccugguccccagucaggccaggcuuuuagcucuucucagugaacacaaaacauuuuccaccuagccugagacaaugcugaagccaccauaguuaucuucaugggaaagcuggggacagaagcccagagaaggcaaacaaucuccccaaggucacgaggccauggagaugcucagacccacucaggguccagggcugccugcuuucuuuuacucucaaucaaguuaaagaucagaaaauauuuaugccugguagcacugacaggugcagcaaggcugcaggguucaugucaccgagggcggcggucugccguggacaagccugggcugggauacugacuucucuuucuccuggccacugucuguaaccugcuuggugccuggagucccaacuacuaggucugaagggcaaaucuuucccacucguuccguaguuuaggucagugaccucggagagccuucacuuacaaaaaccacccaguguggacgucacugagucaccacaaugagccagggaaaaggcuucucacagccacgcagcagggccagucauccagugcugcuggcuguggcugguguccuagcugcucuucccaaaaucucuugccugccuuaaaaagaccaggaugccucuguccuugcggugucacccauggucaggaggagcaucucaggaacuccugggguuuugaagggccagagcuuccaaaugacuuaugggaagcuucauagagccauggguguuuuuuguuuuguuuuguucuguuuuuucgagacaggguuucucuguauagcucuggcuguccuggaacucacuuuguagaccaggcuagccucaaacucagaaauccaccugccucugccucccgagugcugggauuaaaggcgugugccaccacugcccggugagccaugggguuuuguugccuucuccuggcaguccagaacuggggaggccaagagcacagaagcacaugccacaccugccccagcauguggaagcugggcaaagccuaagaggaccaggagcaggcuggcagcugaggcccgccccaagcacagcaguaccucacaagagacuggcucaccacagggcuucccugugcuggcagccugcugccaggccucccaccaaccacugagucaugagauugccaagaaggggaggaccugagaauaagugcccgcccaagccacucccacuggcuuugggcccagcaggauccagcacugccaagaguuuaaggcuccucuggggguggggguggggagcagcugggauuagcucugccuccugcagccucggccugccccugggauguccggcaaguagccucccuccaacuggaaagauccaaguggcagcugugagcuaggaucuggacaaaauucuaagccaccugaugguuuugucggucuuuuucccuugcugguccuagcccacaaaaagcuaaucucugccucaggcaggcuguauguuuaaaagaaauguucaguggaaacacuugugauagggcaagaugauuuugugggccacuuguucagaagaauggcaccccaaagcugcuugggguugaucuucuuuuuuuuuguuuuguuuuuugagacaggguuucucuguguagcccuggcuguccuggaacucacucuguagaccaggcuggccucgaacucagaaauucaccugccucugccuccucagugcugggauuaaaggcgugcgccaccacgcccagcugggguugaucuucuaaccagaccuuuuugcuaauuaagagccaugacaccuggcuggagagauggcucacugcucuucugaagguccugaguucaaaucccagaaaccacaugguggcucacaaccaucuguaaugcgaucugaugcccucuuuugguguaucugaagacagcuacaguguacuuagauauuagauauaauaauaaauaaaucuuuaaaaaaauuuaaagccaugacaccuuugcaaaauguaaccaacauggugacaaaugcuacaguuucuaaaccuggucaguuuugauacuuaaaaggucaagggaucugaccaucuaggaccacagggguuccccaggcgccugaguuggugauaagcuggcaaacagagcagaugcaaacccaucucuagagcugggggacccugcucaguugacagagcgcugccuagugugcacgaggcucuggaucccaucuccagaaaugcauaaacuggacacaguggccaugccuaucaucuuggcaccugggaguuggggacaggggaagugggaauuuaagggcaucuguggcuacauauggaguuggaggccagucaggguuauaugagacccuaucucaaaaccaaaauuucacaauugccauaaaaauaucuaccucugcuccuaugacccuagggcaucauguaaacuucauguuugaaagggagaaugccuuggagggagaagagcaggguggacacagaggaggccacagcaacugucacaagccaggaagcccuaagcuucaugggcacagcagcccaguguccugcuucucaucuauguccacagcuaaagugugcuugaaggcagagaugccucacaaguauugagagcuaaggggauacacacacguauaacaguacacacaccaacacugcugugucagcuugaggccugccaggugggaugggaugggagccaggugccccuggaggacucugcucccggcauggguagguaccugacuuggcagacucaugaguaccugcauagacagguggaucugauuguccugguggcuccucuggcuuccaaauuccuggacucuagucguaauuccucaggguuacgagagcuucauggaggaggaagggugcacugucugcccaccugcuccagugaagguguugucuugccccagaggagagugaaacaaaacaccaaagcacaggaaggcaggggagguggcagccaggcuuucugggaagcaggcgcccuuuuccuuagaacaagagccaggugcuugccagaaaucaucuugcccugagaugccaagucagcucuggcucagcacaaggaccucccucuuuccuggcuggccagaagcaauuuuaggcagugggucucuggccacuggcuaacuauagguuguucuggugcagcuuggccugagcagagacacccgcaccaagggacagcggagagcugggagaggcugugggugaggggagcccacagccaggcucuugugcucagcaggccauggccauccaggguucaggaaccacaggaaucaggacaaaugggcccuuguggugcaggagacuguuugcugugccagggacacugcgugcccagagcugccaccagccugcagcucagggcugggaaguaggacugcccuuucagaaggaccucccgaguugcccugaccuaaagagggcuucagacuccaucuagaugccaggagauggcagcgcuggugccugcugcccuauuucccacagaacuuuuccaacaaggaaguuacccagccugggggcugguacugcuuugucccacccccgagcuaccugcuggcucucuacccauccugauuuuguuccuucuuuggugucuuuccagaagucaagacucucagaugcucauaucugggaaccuaacagaagagcaaacugccagucccccuuuccuguuggggccugccaggggcuaccuggucuccaugcccacaauaugauaacagaaugaccaugcacgccaggcacuguguagagcacuuccuagccacugaaaugcuggguaagcugagaaugaugaacauaugaacagaucggagaauggacacugaagcagcugagugugaaagcucaccuuccuaucccacagcuaggaugugacagcccucccugccucagcuacuugucccuucacauauacacuggcccagccaccuguaggucuguuaggucuggggacacacauuauuggaccacagaaacaagggccuggauuugcucaaaagugggcaaggguguccugaggcagggagaugucccgagccaccccagcagcaugcacacagagcacacacugaucugcaccccacacaaggcagcaaacgaugccgucuugaaggcccagagaccugggaagaggccugaaaggcacagcauuuuccccacacaacuaccccacaaggacagacugugacccgguggcucccucccucagugccuacaucuauagcuucugugcccagcaccuguuccuggcagggcugccgggagcagugcaggaagccagggcucugugaagggauuucccagcccugguugcuaggaaggaaauacucuuagaaucccaaagauguugagaauacgaaucucagccccuucccaggggacaccaccugcccacaugcucccuccagccucugguugucacucuggccacucagggcugcuccaagccaggugaaccaccuugcuuuuaaaauuaaaguccaaucuugagcauggauguucaguucagaggccugaaacuggccccggggaagcaguggaugacggcaaggccacgucagauggcucagacaauagaccccaccucccggggucugcgugggaauauuuguggauucaauucagagccugcaaguguccuugccuguugccuguucuaagagcugucccuucuggagaauccuguggcuaucugccuucagauacucccuguaccuuuggaaggccugcuuguguggugucaggugucugagcacccucauauacacuuuaagucuuuaagccugcaggggaggucaugaaggcuugggguuaaagggcuaagucaggauucucaucugccuggcuucauccuccucccuucugacuuccagacaagccagaccugcuagcaccucccccuccuugugacaaucagggcugggccacagucaggcaaggguggauuccuuugcaauggauuucuuucagguggggagaaccccaaggacucaaaaucauuucuucucugcccucccaguuugaacuuuuguuuuguuuuauuuuguuuuuugagacaggguuucucuguguaacccuggcuguccuggaauucacucuguagaccaggcuggccuugaacucagaaaucuaucugccucugccucccaagugcugggauuaaaggcaugcgccaccacugccgggcccaguuugaacuuuacugggcuaucucaccuacccccagucucuugggacaugucaccucuagggucaggauggaauccgggaagagacagaagaggagguagguuacacaggcccaccucuccucaucuccuuuggcaauaaagggccuugggcagugcucaagggcaacggcucagcccucuucaggggaacagacucuggguuucaacucagaggaggcgagcagggagaggacucaguccucucacccagccccgcaagagcaagaagccucagcuccuuaauuaugcacccagucuaagggcagggcuacaaggccaguccaggagguagccagaggccaccucuugcuagacugugucccugaacagccuucuuccagcacaggguugggcuccacaaaugaacauagcagcaccuaaggggaucuauaguuaccuauucccuugcagggaggccaggagugggaauuuccuuggagaaagggaaaggggaaggagagagaacacagacagguucugaaggaugguagcaugcaccuuuaucccagaacguaggagguaggggcaggcagaucucuaugaguucaaggccagccugaucuacauggugauauuguucuaaaaaauauacaaacaaacgaaaaaacacugacuggcuuagcaaucauuucaggauauuuaauacuaaaaccucaagcccaguguccagcugcccagacugugugcuggaauccaguuaccucaaccucaaacccuggaaucuaccagcggaggcaggcagacucagccacgugcaggcccugggcccgauuucccacaucccaugcaaguccccaaacgugacauaacuuacggggcaguauugauguuuaaaguggugagcacacagggaaagggacagaugagccagagauggagaaacaggucaagaggaauuaugcuguggucagccggcuaguuagucucaaaguugguuugagaccacagccuuguauuccaggagcuccaggggacucuuggucuuugccacaccugggaugcugccgugccccaggacuagggaguccggggcuacaggguauuuguguuguuaaaacaucgugccugucccucuggaauggccggcaccaggcuacaauugacuguacagcugauucugaaucuuucugacauucuaccacuguccaauugucacucggauaucuagaaaauggcauugguugcuaagggacuggccugaugguaggcagcugcagcuugggguaauaggaagagggaguagacugggguuucucucaguaaggauccuggggcugugggcugcuaggcccuauauggagguguggguggaucaaccacaggagguaaccacucagagcuaagagccacacacaggcggugggaaagccccuagccgggagucuuccugcagguauuuugggggacuaugguugcuaagcaacuguacuagguugccaugggaacucucccuucuucugggacuugucauuuuuauggagaugccacauuccuucccaucucuaccuccucaggcugucucagcuaccuguaaggggcccuggaggcuccccaaaccuaccuuugccuacaaggaagccaccuauccaagaaaguacuaugccucuaagacucaguuuggggguguguguguaggggauucaggucucacaguguaccucaggaugaccuugaacucauaauucuccugccucagcugggauugcagucgugcaccaccccgugacccucuaagagaggauucucuugagguucaagacccaacacagaaagcagaguugaggcccucauuagagucagggggaugaaaaaaaucugucuagcuugguuugcaucuccauuccugcuaaccaccaacucaggcucuuccugccuugacagggcucugaccacuagaagcccaguauaacuggaaggcauucuccgcccuagcccuggugccuggccccucccuggcuugucuguaaaggagugucaccuggggcuugccauuacccaaccagggguuguccccaugcccagccaaccaguguuggcagcaggccaugcuggguagacaugccuccucugggacaggcuaaggcuaaggucccugccagccauguguuguauaagcagcucaccuuucccuaaaacuacuucuuguggccugugguaauagguaggggagcugucuggaaacugcaguaggccaaggcaacuuacuggugacgagccagagggaggcaaaguccaggccccaagguguguguguuggggagagggggugggggagaagcugaggucuccucagugguuaccagcaacacccugcugcucgccugcucucauucugauuuccuucagugugugucaccaaggaugacuccugaccuguuuacaguuugcuuugucuccuggcaaccagaugagcuuuuguggaaacucgggacagggcagugcaguacugaacuuccacaccagagguuacagcgccaccugcuggugcuaccauugguggccuucaagccuuccuacacaggugaaauucugccagauccuaaggaaccuggccuucccuauaacccuccucacaggcucagcuguguccuuccaaaagcccuuggguccugcagauccaggcaacacaaggcuagacugggauggggucaggucagggcucacucucucacucucacacacucucucucucucucucucucucucucucucucacacacacacacacacacacacacacacacacacacacacacacacacacgauguccuuacaguaauggagacaaccagacacagacacacagagacacagacacacagaggcagcuguguggaggcagaggacuacagacacguuuagggggauuuaaagcuaaggacuacagccaugccagaagcugugguucagugguguugaugccuugcuuuuaggcuucuguccucuagaaccacgagagauuucuguugcacagggucauccaguauauggcauucugcuagagcagccacaggacacuaacacaacguaccaggccugucaccuuuuugucaccgucaugccuaccucgcugacucuugucucgcucccugucagcuuucugcacugcucuuccugcuuucucucguguggcugaccuaugagaugcacaagcacauggaugaauggcucuccagcucugcuacuucaccaaguucagacaaccguaaaagucagaagcuggggaaauggcucagagguuacagggccaggaccuccacgacucaggcaaaugccugauggcuguggcuauccagacagauauaaaucuagccucaaaggauagagacggaaucuccagagcaagcuggccagcaagcccagcccuauuaguugagacccugccucccucaaugaucacagcaccuaccauaugcaugugccaacacaugcaucuacgcccaguguguuggaguucccagcacucggaagaggaugucugugaguucuggggucuacacagugaguuccaggauagcuagugcuauguagagacccagucucaaaacaaaugaaccaaaacucaugcacaacauauauacacauauauguauaacacacauaccugaaaauggaagaggaaaaagucaagagacagcagcaggugugcagaugggggguggggugggguggggugacagcaaugaaggcaauagcaggugaggaagaagaugcuuccugcugcucauggccacccuggugccaggacaaccaaccucuguguuuccauaucccuggcccuucgaucucaggaggcuaaaggccaugugagucacccaucucuguccuuuguuuuccucucaaggccuaccuggucucccauaagcacaguggagacucauuccagcaccuacuugaccguguguguguguguguguguguguguguguguauguguguguaagaugacaccguaacacuuggggacugcugucagcugugacuaaaacacaaccuuaagaguuggaagaauuguggguggggauggagaguggcagggauauaaacuacagcaagccuggcucugggcagugguacagggacagucauguccucucuuggucuccucucccagccuacacacuggagggucgacagguaagcaaagucagaugugccccucuggcacacaccucccauuggccugcaugcuaacucuucugcucagcccauacaucaacccuaagccgccggccgauccccaccagcccuaaccccauccccugaagugggcuggaacugacuagcuuccaacuaacaaauaccaugaccacaaggucacggccaauguucuguuuagaaagcaucuugugucuuacuggauuucuuguuuccuccuggcccuccgucuucccuguccgacucugaggaggcggcagguucugauguuaugagccguuuuacagaaaggcagguccacauggccaagaagccagagaggucucauggucaccguggauccugccaaccacagcaggaugagcuccaaagugguucuucccagcugagccagcgugggucuuguaacaugaaauggauuauuaucaaggucugggggccguuggcugugagucaggggcagauucucacaccucggaggauaaacagaacaucugcuucuccucuuguauucuuagguguuuccuuuuuuugggggggagcaggggguucgagacaggguuucucuguguagcccuggcuauccuggaacucacucuguagaccaggcuggccucgaacucagaaauccgccugccucagcuuccgagugcugggauuaaaggcgcucgccaccacgcccggcucuuagguguuuccuaagggcaggaccuaccuacagccgucauuuuaagagccacacccaggagcaagguagccacugguuagaguucaggcacgcaaggcacuacgggaaaagacaagaggaagccagggcccuuacacccaacucacucugaggacagggaugcuaguugggggaggccugaaagaguggaacacacaacaccgaaagaaugacucuuggaacucugucccccucccccgcaguugcuccauugacuaaaaggauacugcugccccccaguggucaguaccagcacuacagcccccaggcaagaaacccugaaaacaaaacacuaccuuuuguuugcggguugucaagguagcaggucucccaggccccagcugggcaaaggaacaagaccuguauguuucagggguuaccacaaagaccucaggagccucauuucaccccucuuuccuucugauggcucugggacucuggcucacucagggggccuccucuuucagucuaggcaaugacccugaccccauuucaaauaagaaucacacauucuaacuaggguggucuuguccuuggauccuggaggaauggucuagaguuugccucccucuaguuacucuggccuuuaagucacucaaacccuaaggcugcuuagcaaguccaccagggggaaggcauuuuccuagaauuuuuaugggucauuguaggagaaccaaagccaaaagacauuccacaagccccugaaacccccgggggcggggacgagucacaagggccaagcauccuaaagugcaaaggaggaaacuaaugucuccucagcagccuccuccacacuaaggaccuccgcccugcccuccaggccagucugaggauggccccagacaagcaaaccccaggaaucuuaacaucucucgguccaucagcgccucucguacuaugggcacccccaaauguugcuaggagacuggacgccucagccccaagacagggcugccuucugccucuuccuucuuccaccucaccacaccaccuccacugucccacccuuccucggaaaccuaggaagucuguagaucuaucgagagugaguagggggugugcgcucguguuuggguagguuccacaaggaggggguuagccaguguuccccaggaccucaggagauucauuccccaagcaaacccuacgcgaagguugagcccugaccccacgggccggaagccuucccuucuccgcugguccccgcccaccuggcaugccucuuuccagaccucaguugcucgauuguacccgguuggacagguuggacgcggaacagcguuaagugcacgcucugcguggacgcucgcucuccgggugggugcgggcuucauucacacccacugguacagggccccaugucgacucaccuggcaaucuaccaucauccucagccucggcagcucaucgccagccccagggcgcggcccagggcucgcagaggccgcucgccucggcccgcgcgcggcgcagcggggcguccggcugcggggcucauggcgcggccuccgguccucgccaggcccggagcuccgcggccuucgccaaugccgcuuccauugucugcgccgcgccgcgccgcgccucgccucgccucgccu

SEQ ID NO: 12287 - RNA, 12255 nt, Mus musculus
gggcuuaggagauggaacaccgaaagguaaggauaaaauaguguggcuuccaggauccuggggauaggaagggggucagcaggaguugcucuggaauaaggucagccuccgagaaguuuucucucccugccuuugauggugccucuaaucuggugaacagcuguagcuccugcuugccacuucugccacagcaccugucugccacacuauguaaggcaaaagaaauaaguugugguguuuugggccacuggcugucuccugcaggggaccuagagugaauucuuugccuacauuaccucccagguuccgguugcuucucagaccuagggagagcaguguggcaggcugggagaaaaugggaucacacugucccucgauccacaguggccacuccucuguguugccugugugagcaagccaccuaacucuucuuucuuuguugcuccuguauaaaauaggaaugagagcuaagcaugugggucugugucagagcucuuguuuagcacgcuccaggcuguggcuucuuuccccaggaccacaaaagagcgacuacuaccaaggagaagggaauuuaguguguuguuagaguguaaaccucaguacccagaaggcacugggcgaaccuggucuguuuucucucucccuucuuugaaagggagacaggagcuagacacugcaggguucugagacacucuggggcucugccuuuuguaucuguucccucuuugcuguggagcaggguaggcuaagacuucucugcccuuugcagccugggacuggccagagagcccccaaggaugagaaagagaugguccgccgagccauccagaaggagcugaagaucaaggagggcauggagaacaugcggcgcguggccacagaccgacgccaccugggucaugugcagcaacugcuuagggccuccaaccgccgccuggagcagcugcauggcgagcuucgggagcugcaugcccaaguucugcugccagccucagccggugagcgaggagucugaauaaaccugggaacgggagacucacgaacacaauccuggccuuggcuuugaccacccuauaucauccacauguugucuauacggaagggaagggaaaaaggcaagcgcugcuuccccggggucugaacucuagccuuguguugcagagccagugaccucggaaccccagccgcgggcggagcaguccagggcucggcucucggaggcuuuacauaggcagcugcagguagagcuaaagguaaagcagggggcugagaauaugauucacacgugugccagcggcacccccaagguaagggcuggcgucugaugaagagggguaggccuggcuucucaucuaccugaugggagagacguagcucucagguauaaggaucacaaagccagccagacccugugccaacagggaaaugcuacccuggcccagcuccucaccuaaugcuagaaguacagguaggugggugaggcaagucucugacccacacugucagcaaagcccaacaacagaaggcuagcggaagauccagccggcugcccguccagcucuuggcaaccuacccucucuucuccaucugacagaauccuuacuacuuagcuugucaaacugaugagugucagguuccgcucaccccgccagccuccaccccccauuaccuaguucaacaagggaggcuugccuguaguaucuuccuuguaggagcuugaaccuugguauaacaggggaggcucagccccacccaggcccugguggucugccguaagccccuucugauggggcgagugucaccuccccaggagaggaagcuccuggcggcugcccagcagauguuaaaggacagucaacugaagguggcccugcuccggaugaagauaagcagccuggaguccaguggcucuccagagccaggugaggccucucaggucagggaggguggcccucgauggccgaggcuaaggguucaccuccgcccugcaggccccgacuugcuggcagaggagcugcagcaccgacuucgaguagaggcugcuguggcugcaggugccaagaauguggugaagcugcuugguggccagaggaugcaggaccgaaaggcacuggccgaggucaggcuguguccccggcucacugcugucucuacagcucuguuugggucuauccacaugcaguggggccugcacccaggguugcugccuguggaggguaguagugaauacccaugagguguggccugaccccuuuaacccauaccugguguuugugucuccuugguaggcccaggcccagcuccaggaauccucccagaagcuggaccuccuacggcuggcccuggaauugcugcuggagagguugccucccacccacucucuacguagcagggugacccaagaacuuuggauggcaaugcuugggaacccccaaccuuuggggacacuugugaaaccuauugccuugacagguagguagcaaggauucccuuucacgucagagggucccuuaccuuuuagagaggacgcugaagcauuugggagagaguucaguccugcugugugaccuuggaucccucauguucccacucugauucuugguuuauccaucuguaacauagauucaauaguagugacccagcaugauggcgcacgccuuuaaucccagcacucgggaggcagaggcagggggaugucugugaguuccaaccuggucuuuagagugaguucgaggccagccagagagacaugggagagacccuaaguaaacaaaggguggaagugcucuccugauccacaagauaguuuuguaaacccaaaaguuucugauguucagaacacacuuggagccuggccagcguggaugggauuuaaaugcccggccuucgguagggaguagauugacaaucaguccacucccuggcagccuuggggccugggcagcuuggacuaccuguaaguucuuucaugaggucuguucuuguagcagcagcugacuggcagucaacagaucaugggagcugcaagcuagagcccggcuggugccugcuucagaacacaauagauagggcuagacagagcucuguuacuauuaucuuggauaaucaaggagggcuccuuagaacaggggggagucugagcuuggccuuggagggcucucgggagugcugauggccaagccagcaaguccggcaagacaaaaggagccucuuguuuaaaggcaaagaauuggggacacguugauaaaguucuuucuuacugcguaugagguccuggguucagucccagcaccaaauuaacuggguaugguagcacacaccuacaacccaacccccugggaagugaggcaggaggaucaggaguucaagggcaucuuuagcuacauagugaguuugaggccaacuugggcuaacaagauccugcuuuuaaacaaaaacauuugcuaguuuguagccgaacuuccauuuccuaagacaaguguauugccugggccgcccuugguauuucuguaaggucuccaaguauuaccuccagacccagccuaguaaaaugguguccucagagccgguuuaugcccucaggagcuccuggguaucugcugcuuccuccucuuguccucuacccuuggagacaaaacucucagugaucuuagacaaaacauguuuuguccccauugggggcucucccucgcugaucaggugggaaggaauagggcaggcagcuagagugaugcucgggugccugccccugugcacuugagaccauggugcccaccagacccugagcucaagguagcaguuucccucauccuguggcuuuacaaagcuugggagaaguccuguucuuacauuccugcuguguucugccacugcauaggcacucaggaaggagagcuagccgggcugcuaaggaugcugggugguaacuaagugugguagguaggguuuagaucggcugcuccuagcucugacccuccuagagcagguggugucccucugggguuccauuggugguggcugcugacagagggcucucuugacucccaaccagggacacugcagguucgccuccugggcugcaaagaucugcugguagcugugccuggacggucucccauggcuguccuggcagguagcccuucugaaagcuggcuccgaacaaggucccggcagcagcgugguggaggcgaacuggccagugaguagggagaaaccaugggagguggugaggcccccugcucuggccaugcccuaaauccaagcccuggcacuacaggugagguacuggcuguguugaagguugacaaucguguugugggccagacaggauggggacugguggcugagaaauccugggaccagaguuuuaucaucuccuuggaccgaguaggcuggccuuugugugguuaggguuagcugugggguacgggggggggcacucaggugagggcugagccugaucuuuuccacauaggcucgcgagcuggagauugggguucacuggcgggacuggcgacaguugugugguguggcguuucugaagcuugaggacuuccuggacaaugccugucaccagcuuucucucagucuggugccucaggggcggcucuuugcccagguuccuacugaccccugaccucuaacaggggaucuuuaggacugacauuuuggguuggggugauggcucaguggguaaaguguuuacuguggaagcaugaggaccugaguucaaauccccaggaucuguguaaaaaccauguguggcuuggugugucucuaaguucauggcuggccguacagagacauggguucuccagacucgcuggccagccaagucuagcugaaacagugaauuccagguucagugagaaacccugucucaaaaauaagguggaagggcagauacccaguguggugucaaccucugccuacaucagugaguacaacucugugugugugugugugugugugugugugugugugugugugugugugcaucugugugauaaaaacugguaauccauguacuaugggacuugagagauggagacagguucacagacaggccuacagggaggcucacaucucuacacugagcuuguccugccucauaugucaucuugaauacguaaaugugucuccucugggccucaguuucuccccuggcccccgugaggauacgguaucgugucuagguccucugaguuuugcuucauaucagcuuugccucauuguuccgauaaaacaccggccaaagcaacugaaggcagggaaggggugauuucaauuuacagauuuacagccaacccccucccuacucuucucccacccccccccaccccccaccgccuucuuuauuuuuucugagauaggguuucucuugcagcccuggcuguccuggaacucacucuguagaccaggcuggccuccaauucacggagauccaccugcuucugccuccucagagcugggauuaauggugugcuccaccaccgcccaguuuacagccuaucuuuacgggagccaaggcagaaacuuaauaagcaggaacugaaagcagaaacuggggaggaaccguuugcuggcuugcucucugccucucucccaagcucaugcuuggcuagcuuucuuauauagcccaguaccacuugucuagggaauggugccucuaacagugugcuagauccuccuacaucaauuaacaaucaagacccccccccagacaugcccacgagccauguaaucuaggcagucccucucggaugggucauauggaaaguuagcacuaacuagaauacccccauggcugagauugggagcuggcgcugggggugggggaguggggauggggguggggacggggacgauccagcagggugaaaggcggccagucuccaggucuucagcuuucuucaugucccuuuaggucaccuucugcgagccugucauugaaaggaggccucggcugcagaggcagagaugcauuuucucuaagcggagagguguggagcauacggacugugugaggagagggcugggcugaccaauggggaugcugggacugagccccgccugccuccucuaggccgggauuucaugagagcuucccagaugaaccucagcauggcagccugggggcgucuggucaugagcuugcugccccccugcagcucaccaaacacagccagucccccuaaagggcgcccuucaacagcggucugugggacccccagugcugcuuccccgaggugagccgccuggugcagacucugagacacuuuucaggcucugucucuucagguucugagugcugucuuuugccuccucaaccucugagcccucuguccuuucacauggccgcgccccucaccccccccccccccuaaugugucugggcugagacaucuccuucuuacaguaacuuccugcccaugaagacgcucucaaaagaagacacgaagccuccucccaagcccccgcgccucuaucuccaagaaccagccccagggacuccuguaagggauucuggaggucagggcugccaggagggaaagagggucaguaacugcuguccugaagccaucuguccccacaguguaccaagcgcccccacauggacccuagaccugcaguagugcccgcccuggcagccuuauccacaagguacucacuggcuuccauucauuuagagacuuuugucuuguuuuguuuuguuuuuuaaaaaucuaaauauauauuuaugugugugugccuucgugugcacacagacccaugcugaagcacaauuuuauagugacuccauuuuauuucacguuccuugguguuuugccugcaugugugucuguaugagugagucaggugcucuggaaguugugagccacugugugaaugcugggaguugaaccugggguccucuggaagagcagccagugcucuuuuuuuuuuuuaaagauuuauuuauuuauuauauguaaguacacuguagcugucuucagacaucccagaagagagcuucagaucucauuacagaugguugugagccaccaugugguugcuaggauuugaacucacgacuuucagaagagcaguuggcacuguuaaccgcugagccaucucuccagcccccagccagugcucuuaacccugagccaucucuucuuuguuuuuuuauuuccuccuuccuccuccugcuccuccuccuccuccucuuccuccuccucauucucuuucuccuccuccuuucucuguguagcucucucgcugcccaggaacucccuauguagaccagguuggccucgaacucagaaauccgccuaccucugccucccaagugcugggaucaaagacgugugccaccacggcccugcuugcauccaacuuuucuaaaguuggucugggcauggaacgcaagccauuucccugccugagacucuuuuuaaaaauuaaggucuuacaguguaacccaggcugguugaacuuaugauuuuccugcuucugcagccugggugcugggauuacaagugugcaccaucgcuccuuguauauauugauugacaccucacuccauugcuccuccauuauacaaacugccuugcucaaugucuuuuugugcugaaugcagcuuuaaaauucuagauguggggagacagccuaggcccuuccucucuugcaggaaaccccccagacuucaagacuuccgauguuuggcugugcugggucggggacacuuugggaagguagguaguugagugggugggcaagcauugucucagcacauuagcuggagaugcugggauggagggaauguguggggagaugaaggcucucuguccuucguaccuggaguccaacuuuuucuggucccuagguccuccugguccaguacaaaggaacagggaaauacuacgcuaucaaggcguugaagaagcaggaagugcuaggccgggaugagauugacagguguauauauuugagaaguaucugaucuuggaucugggguggccaaccugggcucccaagguagcucgagaucccaaggguccguuucagguugucuuuuuggcccugggcaagcccucuugucuuuuaguaccccggggaacucgucuauaaauaggacugugguacuuuggcagguuugaagccuuccccaugugugaaccaucaacuugccuccuuagcucuccucagccagccagagguguuguaugggugucagggcacagcucauggggguuccauuccauguccucccuugcagccuauacugugagaagcggauccuggagacuguggggcguacagggcaccccuuccugcucucucuccuugccugucugcagaccuccagccaugccugcuuuguuacugaguuucugcccggaggagaccucauggcgcagauucaugaggaugucuuuccugagccccaggccugguggguucucuggcuacuuggugcuugcuccuuggggguaggggaguacccagcagacaaauagcaugggauugugaggagucuuggugggacauuacaacacaugaggacuucauuugcauagccguggaugaaaucugucaucaugacuuugcaaguuuguugcagggaugagagucauguuugcuacuugccuaccgcaggauagaagcagggucugccuacccagcuccaguugcugcucugcuuacaacagucugacuccgcacaucagcccucacccuagugugugacccugagucaaaucucagauccucauuucacugcguguauguguggcuguucauggccaccugcaauugaguacagagcccucagccaccagaagagggcacacaucaccugaagcaggaguggcuggauaucuaccugauagaggaacucuugucuaggaguggguaguggggcagagaauaguacuuccuauuaaaugccaggccaucucuccagccucucagauccagacuugagucaaagucaugaugacuaucccccgaggcugcugggaagauguccauacugagcuuugauccuagggcuuagugugagccagacucuaucacugagcuacaucuccagcccuuuaugguuccuuuucuguuuauuuguguuauguuuuuuaguuguuguuguuguuuuuuuuuuuagauuuauuuauuuauuacauguaaguacacuguagcugucuucagacccuccagaagagggagucagaucucauuacggaugguugugagccaccaugugguugcugggauuugaacuucggaccuucggaagaacagucgggugcucuuacccacugagccaucucaccagcccguguuaugguuuuuugagaggguuucucuguauaguccuggcuuuucuggaacuugcucuauaaaccaggcuggccuugaacucagagaucugccugcuuuugccucccgagugcugggauuaaaggcgugugccgccgccaccgccaccaggcuuuuguuugcuuuuugaaaacuauauagaccagucuggccucaaauuugcuauccuccugccucagccucccaaguagcugggauuauaggccuauacuacuagacccaguagcucugccauagcugagcacaggaaggauaggucauuaauacauagcaagacuggaauauuuugggcuucuccaguauuaguuuguuuagucccauccaugccugagucuggccaggaccuuuugguaccuuucagugccaggccugaacucucccuguaccucccucagcuucuaccuggccugugugguucuggggcugcaguuccuacacgagaagaggaucauuuacagguagucuuugcccaagagaugcugggugggccugggagcuuuccuucugcugaugcugggccccaggccucagccccucucaaccccuuugaucuucaucacuccaccaucagggaucugaaauuggauaaucugcuacuggaugcccaggguuuccucaagauugcagacuuuggacuaugcaaggaagguggggcccccugucuuguaaucacauccucuugucuugccuagaccagccagaaaucucuccacucaugguguccagcccuggccuucauuccugacccuuguuuaggggaacagcugagaauacccuaauuuguaguuggccagagaagcuaugaugaccuuggcacacaaguucaucagaaacaacucucaaacagucacuggcugcacaaucaccuuggccuagagagucuaggggauacaguaaaccuuguuauuuggugucauaaagacgggcaccaagcuggguggugguggugcacgccuuuaaucccagcacucaggaggcagaggcaggcggauuucugaguucaaggccagccuggucuacagagugaguuccaggacagccagggcuauacagagaaacccugucaugaaaaaaaaaaguguguguauguaugguauauaucacauacacacauauauguauauauauauauauauauauauauauaugcauauguauauguauguauauauguauuuuauugcuggguuuugacccauggucucacauguacuaggcaaguguucuaccuccaccuuuggccuugguuuuuuaaacuguauuguauauguauaggugguuugcagcauguaugccuaguauguguagugccuauggaggccagaaggggacuucagguaccuugaaauuggaguuagacauucacaagcuaccauguggguccugggaaucaaaccuggguccauccuuaaccagugagccaucucuucagguccauuccugauucuucuuuguggauuuuuuuuguuguugguuuuuuuuuuuuuucuuuuuuuuuuugagacaagaguuucucuguguaguccuggcuguccuggaacucacucuguagaccaggcugacuucgaacucagaaaucugccugucucugccuccugagugcugggauuaaaggugugcaccaccaugucuggcucccccauugauucuuauaaccagaacuacggugugugugccacacccagcaggcacugguguggauguugguuugcaggaauuggcuuuggugaccggaccagcacguucuguggcaccccggaguuccuggcccccgagguuuugacucaggaggcuuacacgcgugcuguggacuggugggggcugggugugcugcucuaugagauguuagugggugagguaagugcuagagcggggcuuccagggucucugggguggggacagugggauagccugcaucgccugcugaaccccaauuuccacaguguccauucccgggggacacagaagaggagguauuugaaugcaucgucagugcugaugucccauguccccacuuucugucagugcaagggcucgaacucauucagaaggugagacccaagguccagggcagcugcuugugacuuggguguacccugccucuacccuguggcucucuagcauagcuuaagucggguaccuguagggcagccagcaccuggaguggcaugcccucagguucacauccugcccugcuuccugccagcuccuccagaaguccccagagaagcgucuaggggcaggagaacgggacgccgaggagaucaagguucaaccauucuucaggguaauuacgaagccagaacccagcaguccccauuuccuggggagguggggaggcuggggggccucuggggucugcgguucccacauucuuauauuccuguaccuuguucagaccaccaacuggcaggccuugcuggcccgcaccguccagccucccuucgugccuacucucuguggcccugcagaccuucguuacuucgagggagaguucaccagccugccuccaacccugaccccaccagucucccagagcucccucacugcucgccaacaggcugccuuccgggacuuugacuucgugucugagcaguuccuggaguccugagggucuccuggcacuucagccagacugcaggaagccuccacguaaccaugugccugggccgaaguauuuaaugagugugugggaguccaggcaguggccguccguggggcugccguugcaggcuuuuccuucgugucccugcugugucuauaacucuguccuucuauuucucgguagaccccagaccaggaaagaguccacggcagcauggguggcuuuucuuuuuaauacuugacuuuauauagagcauuaaauuaauaaaacuguacacucgagguagccag

SEQ ID NO: 12288 - RNA, 12255 nt, Mus musculus
cuggcuaccucgaguguacaguuuuauuaauuuaaugcucuauauaaagucaaguauuaaaaagaaaagccacccaugcugccguggacucuuuccuggucuggggucuaccgagaaauagaaggacagaguuauagacacagcagggacacgaaggaaaagccugcaacggcagccccacggacggccacugccuggacucccacacacucauuaaauacuucggcccaggcacaugguuacguggaggcuuccugcagucuggcugaagugccaggagacccucaggacuccaggaacugcucagacacgaagucaaagucccggaaggcagccuguuggcgagcagugagggagcucugggagacugguggggucaggguuggaggcaggcuggugaacucucccucgaaguaacgaaggucugcagggccacagagaguaggcacgaagggaggcuggacggugcgggccagcaaggccugccaguugguggucugaacaagguacaggaauauaagaaugugggaaccgcagaccccagaggccccccagccuccccaccuccccaggaaauggggacugcuggguucuggcuucguaauuacccugaagaaugguugaaccuugaucuccucggcgucccguucuccugccccuagacgcuucucuggggacuucuggaggagcuggcaggaagcagggcaggaugugaaccugagggcaugccacuccaggugcuggcugcccuacagguacccgacuuaagcuaugcuagagagccacaggguagaggcaggguacacccaagucacaagcagcugcccuggaccuugggucucaccuucugaaugaguucgagcccuugcacugacagaaaguggggacaugggacaucagcacugacgaugcauucaaauaccuccucuucugugucccccgggaauggacacuguggaaauugggguucagcaggcgaugcaggcuaucccacuguccccaccccagagacccuggaagccccgcucuagcacuuaccucacccacuaacaucucauagagcagcacacccagcccccaccaguccacagcacgcguguaagccuccugagucaaaaccucgggggccaggaacuccggggugccacagaacgugcugguccggucaccaaagccaauuccugcaaaccaacauccacaccagugccugcuggguguggcacacacaccguaguucugguuauaagaaucaaugggggagccagacaugguggugcacaccuuuaaucccagcacucaggaggcagagacaggcagauuucugaguucgaagucagccuggucuacagagugaguuccaggacagccaggacuacacagagaaacucuugucucaaaaaaaaaaagaaaaaaaaaaaaaaccaacaacaaaaaaaauccacaaagaagaaucaggaauggaccugaagagauggcucacugguuaaggauggacccagguuugauucccaggacccacaugguagcuugugaaugucuaacuccaauuucaagguaccugaaguccccuucuggccuccauaggcacuacacauacuaggcauacaugcugcaaaccaccuauacauauacaauacaguuuaaaaaaccaaggccaaagguggagguagaacacuugccuaguacaugugagaccaugggucaaaacccagcaauaaaauacauauauacauacauauacauaugcauauauauauauauauauauauauauauacauauauguguguaugugauauauaccauacauacacacacuuuuuuuuuucaugacaggguuucucuguauagcccuggcuguccuggaacucacucuguagaccaggcuggccuugaacucagaaauccgccugccucugccuccugagugcugggauuaaaggcgugcaccaccaccacccagcuuggugcccgucuuuaugacaccaaauaacaagguuuacuguauccccuagacucucuaggccaaggugauugugcagccagugacuguuugagaguuguuucugaugaacuugugugccaaggucaucauagcuucucuggccaacuacaaauuaggguauucucagcuguuccccuaaacaagggucaggaaugaaggccagggcuggacaccaugaguggagagauuucuggcuggucuaggcaagacaagaggaugugauuacaagacagggggccccaccuuccuugcauaguccaaagucugcaaucuugaggaaacccugggcauccaguagcagauuauccaauuucagaucccugaugguggagugaugaagaucaaagggguugagaggggcugaggccuggggcccagcaucagcagaaggaaagcucccaggcccacccagcaucucuugggcaaagacuaccuguaaaugauccucuucucguguaggaacugcagccccagaaccacacaggccagguagaagcugagggagguacagggagaguucaggccuggcacugaaagguaccaaaagguccuggccagacucaggcauggaugggacuaaacaaacuaauacuggagaagcccaaaauauuccagucuugcuauguauuaaugaccuauccuuccugugcucagcuauggcagagcuacugggucuaguaguauaggccuauaaucccagcuacuugggaggcugaggcaggaggauagcaaauuugaggccagacuggucuauauaguuuucaaaaagcaaacaaaagccugguggcgguggcggcggcacacgccuuuaaucccagcacucgggaggcaaaagcaggcagaucucugaguucaaggccagccugguuuauagagcaaguuccagaaaagccaggacuauacagagaaacccucucaaaaaaccauaacacgggcuggugagauggcucaguggguaagagcacccgacuguucuuccgaagguccgaaguucaaaucccagcaaccacaugguggcucacaaccauccguaaugagaucugacucccucuucuggagggucugaagacagcuacaguguacuuacauguaauaaauaaauaaaucuaaaaaaaaaaacaacaacaacaacuaaaaaacauaacacaaauaaacagaaaaggaaccauaaagggcuggagauguagcucagugauagagucuggcucacacuaagcccuaggaucaaagcucaguauggacaucuucccagcagccucgggggauagucaucaugacuuugacucaagucuggaucugagaggcuggagagauggccuggcauuuaauaggaaguacuauucucugccccacuacccacuccuagacaagaguuccucuaucagguagauauccagccacuccugcuucaggugaugugugcccucuucugguggcugagggcucuguacucaauugcagguggccaugaacagccacacauacacgcagugaaaugaggaucugagauuugacucagggucacacacuagggugagggcugaugugcggagucagacuguuguaagcagagcagcaacuggagcuggguaggcagacccugcuucuauccugcgguaggcaaguagcaaacaugacucucaucccugcaacaaacuugcaaagucaugaugacagauuucauccacggcuaugcaaaugaaguccucauguguuguaaugucccaccaagacuccucacaaucccaugcuauuugucugcuggguacuccccuacccccaaggagcaagcaccaaguagccagagaacccaccaggccuggggcucaggaaagacauccucaugaaucugcgccaugaggucuccuccgggcagaaacucaguaacaaagcaggcauggcuggaggucugcagacaggcaaggagagagagcaggaaggggugcccuguacgccccacagucuccaggauccgcuucucacaguauaggcugcaagggaggacauggaauggaacccccaugagcugugcccugacacccauacaacaccucuggcuggcugaggagagcuaaggaggcaaguugaugguucacacauggggaaggcuucaaaccugccaaaguaccacaguccuauuuauagacgaguuccccgggguacuaaaagacaagagggcuugcccagggccaaaaagacaaccugaaacggacccuugggaucucgagcuaccuugggagcccagguuggccaccccagauccaagaucagauacuucucaaauauauacaccugucaaucucaucccggccuagcacuuccugcuucuucaacgccuugauagcguaguauuucccuguuccuuuguacuggaccaggaggaccuagggaccagaaaaaguuggacuccagguacgaaggacagagagccuucaucuccccacacauucccuccaucccagcaucuccagcuaaugugcugagacaaugcuugcccacccacucaacuaccuaccuucccaaaguguccccgacccagcacagccaaacaucggaagucuugaagucugggggguuuccugcaagagaggaagggccuaggcugucuccccacaucuagaauuuuaaagcugcauucagcacaaaaagacauugagcaaggcaguuuguauaauggaggagcaauggagugaggugucaaucaauauauacaaggagcgauggugcacacuuguaaucccagcacccaggcugcagaagcaggaaaaucauaaguucaaccagccuggguuacacuguaagaccuuaauuuuuaaaaagagucucaggcagggaaauggcuugcguuccaugcccagaccaacuuuagaaaaguuggaugcaagcagggccgugguggcacacgucuuugaucccagcacuugggaggcagagguaggcggauuucugaguucgaggccaaccuggucuacauagggaguuccugggcagcgagagagcuacacagagaaaggaggaggagaaagagaaugaggaggaggaagaggaggaggaggaggagcaggaggaggaaggaggaaauaaaaaaacaaagaagagauggcucaggguuaagagcacuggcugggggcuggagagauggcucagcgguuaacagugccaacugcucuucugaaagucgugaguucaaauccuagcaaccacaugguggcucacaaccaucuguaaugagaucugaagcucucuucugggaugucugaagacagcuacaguguacuuacauauaauaaauaaauaaaucuuuaaaaaaaaaaaagagcacuggcugcucuuccagaggaccccagguucaacucccagcauucacacaguggcucacaacuuccagagcaccugacucacucauacagacacacaugcaggcaaaacaccaaggaacgugaaauaaaauggagucacuauaaaauugugcuucagcaugggucugugugcacacgaaggcacacacacauaaauauauauuuagauuuuuaaaaaacaaaacaaaacaagacaaaagucucuaaaugaauggaagccagugaguaccuuguggauaaggcugccagggcgggcacuacugcaggucuaggguccaugugggggcgcuugguacacuguggggacagauggcuucaggacagcaguuacugacccucuuucccuccuggcagcccugaccuccagaaucccuuacaggagucccuggggcugguucuuggagauagaggcgcgggggcuugggaggaggcuucgugucuucuuuugagagcgucuucaugggcaggaaguuacuguaagaaggagaugucucagcccagacacauuaggggggggggggggugaggggcgcggccaugugaaaggacagagggcucagagguugaggaggcaaaagacagcacucagaaccugaagagacagagccugaaaagugucucagagucugcaccaggcggcucaccucggggaagcagcacugggggucccacagaccgcuguugaagggcgcccuuuagggggacuggcuguguuuggugagcugcaggggggcagcaagcucaugaccagacgcccccaggcugccaugcugagguucaucugggaagcucucaugaaaucccggccuagaggaggcaggcggggcucagucccagcauccccauuggucagcccagcccucuccucacacaguccguaugcuccacaccucuccgcuuagagaaaaugcaucucugccucugcagccgaggccuccuuucaaugacaggcucgcagaaggugaccuaaagggacaugaagaaagcugaagaccuggagacuggccgccuuucacccugcuggaucguccccguccccacccccauccccacucccccacccccagcgccagcucccaaucucagccauggggguauucuaguuagugcuaacuuuccauaugacccauccgagagggacugccuagauuacauggcucgugggcaugucugggggggggucuugauuguuaauugauguaggaggaucuagcacacuguuagaggcaccauucccuagacaagugguacugggcuauauaagaaagcuagccaagcaugagcuugggagagaggcagagagcaagccagcaaacgguuccuccccaguuucugcuuucaguuccugcuuauuaaguuucugccuuggcucccguaaagauaggcuguaaacugggcggugguggagcacaccauuaaucccagcucugaggaggcagaagcagguggaucuccgugaauuggaggccagccuggucuacagagugaguuccaggacagccagggcugcaagagaaacccuaucucagaaaaaauaaagaaggcgguggggggugggggggggugggagaagaguagggaggggguuggcuguaaaucuguaaauugaaaucaccccuucccugccuucaguugcuuuggccgguguuuuaucggaacaaugaggcaaagcugauaugaagcaaaacucagaggaccuagacacgauaccguauccucacgggggccaggggagaaacugaggcccagaggagacacauuuacguauucaagaugacauaugaggcaggacaagcucaguguagagaugugagccucccuguaggccugucugugaaccugucuccaucucucaagucccauaguacauggauuaccaguuuuuaucacacagaugcacacacacacacacacacacacacacacacacacacacacacacagaguuguacucacugauguaggcagagguugacaccacacuggguaucugcccuuccaccuuauuuuugagacaggguuucucacugaaccuggaauucacuguuucagcuagacuuggcuggccagcgagucuggagaacccaugucucuguacggccagccaugaacuuagagacacaccaagccacacaugguuuuuacacagauccuggggauuugaacucagguccucaugcuuccacaguaaacacuuuacccacugagccaucaccccaacccaaaaugucaguccuaaagauccccuguuagaggucaggggucaguaggaaccugggcaaagagccgccccugaggcaccagacugagagaaagcuggugacaggcauuguccaggaaguccucaagcuucagaaacgccacaccacacaacugucgccagucccgccagugaaccccaaucuccagcucgcgagccuauguggaaaagaucaggcucagcccucaccugagugcccccccccguaccccacagcuaacccuaaccacacaaaggccagccuacucgguccaaggagaugauaaaacucuggucccaggauuucucagccaccaguccccauccugucuggcccacaacacgauugucaaccuucaacacagccaguaccucaccuguagugccagggcuuggauuuagggcauggccagagcagggggccucaccaccucccaugguuucucccuacucacuggccaguucgccuccaccacgcugcugccgggaccuuguucggagccagcuuucagaagggcuaccugccaggacagccaugggagaccguccaggcacagcuaccagcagaucuuugcagcccaggaggcgaaccugcagugucccugguugggagucaagagagcccucugucagcagccaccaccaauggaaccccagagggacaccaccugcucuaggagggucagagcuaggagcagccgaucuaaacccuaccuaccacacuuaguuaccacccagcauccuuagcagcccggcuagcucuccuuccugagugccuaugcaguggcagaacacagcaggaauguaagaacaggacuucucccaagcuuuguaaagccacaggaugagggaaacugcuaccuugagcucagggucuggugggcaccauggucucaagugcacaggggcaggcacccgagcaucacucuagcugccugcccuauuccuucccaccugaucagcgagggagagcccccaauggggacaaaacauguuuugucuaagaucacugagaguuuugucuccaaggguagaggacaagaggaggaagcagcagauacccaggagcuccugagggcauaaaccggcucugaggacaccauuuuacuaggcugggucuggagguaauacuuggagaccuuacagaaauaccaagggcggcccaggcaauacacuugucuuaggaaauggaaguucggcuacaaacuagcaaauguuuuuguuuaaaagcaggaucuuguuagcccaaguuggccucaaacucacuauguagcuaaagaugcccuugaacuccugauccuccugccucacuucccaggggguuggguuguaggugugugcuaccauacccaguuaauuuggugcugggacugaacccaggaccucauacgcaguaagaaagaacuuuaucaacguguccccaauucuuugccuuuaaacaagaggcuccuuuugucuugccggacuugcuggcuuggccaucagcacucccgagagcccuccaaggccaagcucagacuccccccuguucuaaggagcccuccuugauuauccaagauaauaguaacagagcucugucuagcccuaucuauuguguucugaagcaggcaccagccgggcucuagcuugcagcucccaugaucuguugacugccagucagcugcugcuacaagaacagaccucaugaaagaacuuacagguaguccaagcugcccaggccccaaggcugccagggaguggacugauugucaaucuacucccuaccgaaggccgggcauuuaaaucccauccacgcuggccaggcuccaaguguguucugaacaucagaaacuuuuggguuuacaaaacuaucuuguggaucaggagagcacuuccacccuuuguuuacuuagggucucucccaugucucucuggcuggccucgaacucacucuaaagaccagguuggaacucacagacaucccccugccucugccucccgagugcugggauuaaaggcgugcgccaucaugcugggucacuacuauugaaucuauguuacagauggauaaaccaagaaucagagugggaacaugagggauccaaggucacacagcaggacugaacucucucccaaaugcuucagcguccucucuaaaagguaagggacccucugacgugaaagggaauccuugcuaccuaccugucaaggcaauagguuucacaaguguccccaaagguuggggguucccaagcauugccauccaaaguucuugggucacccugcuacguagagagugggugggaggcaaccucuccagcagcaauuccagggccagccguaggagguccagcuucugggaggauuccuggagcugggccugggccuaccaaggagacacaaacaccagguauggguuaaaggggucaggccacaccucauggguauucacuacuacccuccacaggcagcaacccugggugcaggccccacugcauguggauagacccaaacagagcuguagagacagcagugagccggggacacagccugaccucggccagugccuuucgguccugcauccucuggccaccaagcagcuucaccacauucuuggcaccugcagccacagcagccucuacucgaagucggugcugcagcuccucugccagcaagucggggccugcagggcggaggugaacccuuagccucggccaucgagggccacccucccugaccugagaggccucaccuggcucuggagagccacuggacuccaggcugcuuaucuucauccggagcagggccaccuucaguugacuguccuuuaacaucugcugggcagccgccaggagcuuccucuccuggggaggugacacucgccccaucagaaggggcuuacggcagaccaccagggccuggguggggcugagccuccccuguuauaccaagguucaagcuccuacaaggaagauacuacaggcaagccucccuuguugaacuagguaaugggggguggaggcuggcggggugagcggaaccugacacucaucaguuugacaagcuaaguaguaaggauucugucagauggagaagagaggguagguugccaagagcuggacgggcagccggcuggaucuuccgcuagccuucuguuguugggcuuugcugacagugugggucagagacuugccucacccaccuaccuguacuucuagcauuaggugaggagcugggccaggguagcauuucccuguuggcacagggucuggcuggcuuugugauccuuauaccugagagcuacgucucucccaucagguagaugagaagccaggccuaccccucuucaucagacgccagcccuuaccuugggggugccgcuggcacacgugugaaucauauucucagcccccugcuuuaccuuuagcucuaccugcagcugccuauguaaagccuccgagagccgagcccuggacugcuccgcccgcggcugggguuccgaggucacuggcucugcaacacaaggcuagaguucagaccccggggaagcagcgcuugccuuuuucccuucccuuccguauagacaacauguggaugauauaggguggucaaagccaaggccaggauuguguucgugagucucccguucccagguuuauucagacuccucgcucaccggcugaggcuggcagcagaacuugggcaugcagcucccgaagcucgccaugcagcugcuccaggcggcgguuggaggcccuaagcaguugcugcacaugacccagguggcgucggucuguggccacgcgccgcauguucuccaugcccuccuugaucuucagcuccuucuggauggcucggcggaccaucucuuucucauccuugggggcucucuggccagucccaggcugcaaagggcagagaagucuuagccuacccugcuccacagcaaagagggaacagauacaaaaggcagagccccagagugucucagaacccugcagugucuagcuccugucucccuuucaaagaagggagagagaaaacagaccagguucgcccagugccuucuggguacugagguuuacacucuaacaacacacuaaauucccuucuccuugguaguagucgcucuuuugugguccuggggaaagaagccacagccuggagcgugcuaaacaagagcucugacacagacccacaugcuuagcucucauuccuauuuuauacaggagcaacaaagaaagaagaguuagguggcuugcucacacaggcaacacagaggaguggccacuguggaucgagggacagugugaucccauuuucucccagccugccacacugcucucccuaggucugagaagcaaccggaaccugggagguaauguaggcaaagaauucacucuagguccccugcaggagacagccaguggcccaaaacaccacaacuuauuucuuuugccuuacauaguguggcagacaggugcuguggcagaaguggcaagcaggagcuacagcuguucaccagauuagaggcaccaucaaaggcagggagagaaaacuucucggaggcugaccuuauuccagagcaacuccugcugacccccuuccuauccccaggauccuggaagccacacuauuuuauccuuaccuuucgguguuccaucuccuaagccc

SEQ ID NO: 12289 - RNA, 134224 nt, Mus musculus
uggucagaauggacaguuuauuuuaaaacaccuucuccaggguuguuuuauucaguauuuuuucaacaucuuguuuaguuugguucuaaugggagcacaauucagaucuucacuuuuuuuucucuuuaaguuugaguuacaucuauucuguaagcccugguuagauuacauauugccagguagugguggcacacaccuuuaaucccagcacuugggaggcagaggguuugaggcuagucuggcauacaaagugaauucuaggaccgccaggacuguuuauacaaagaagcugugucuugaaaacaaaacagaacagaacaauaacaaaagauuguuauauaguauuuuauaauuuuagauuuuaguuuuuaauaaguaaggcccaugaacuuugacaauauuaaacucucaaugcauuucuuuaaacuuaccuaaaagauaucuuuaaaucaagguaaucaauuaacaggugaggguuuauggcacaguuuaaacuguaugguuguucuugagagugccugccuacugaguucuucauauguaggagaaggugguauuucucccacuuaacuugagaaucagaucuaauauaacuuugucauucaaaguauuaguugagagcucagaaccugaagucuaaaauuuaggauuuucccaaaccacaccauuuaaaaaugguugauuuagaaucaaacaagcacugacuggcagaaguaccauccugucauauggagugagaggacacgcccccuuucucuuaauguaucgaguguaccuacacacugaaugcuuaccagacuggccugagaauucuauuuaauaguucuugucuuuuaaaauaaugggccuuuucagaaugggccacaguuaaaggaaaugaauacguuaaaucccaucugauuugguuaagauucaaaaccagugcuugaagauuaauuaaaacagaggcgcaauucacacuauaacggcaucucguuaaggggaaaugcagauaggacgcccuuuguggccucuuuugcucucuguagcuggagcaucucuaacuucuucaucauugguguucuucucaagaucagaaaugagaauguucucuucuaaaugugcugugcugaaguugagugugggguaguaagaaccccgagaccccgugagucucuggaagaugucacuuuucugcuuauauauccagaagcaaagcaugaaaaugcccagggcuauuaucaacgucagcguuacugugacaggaacgaugcuguggcuuaguccuggagaaagacaaagaaacacagaggacagauacugucacaugccuaccuucuaucguauugauucuaagaaauaucuaaauauucuuucccuuccaaaccuaccuuucucuggcugcgccguuacagcugggaugccuaaaaucaaauaauaaacaaauauuucuuuaaauucaucuaaguuauguuauguauucaagcaaagcaagaaucagacuauugcucauauaccaugccuaguauaugaaugauguuuuauuagagcucugauagucauucauucauguauucuccucugugugugugugugugugugagagagagagagagacagagagagacagagagacagagagaggugucagucuuauaccaugguacaugcaccaugguauguguguauaggucacaugacaacuuguggguucucuccuucuacaauguggguuccaguguuuggauccaggcuuggcagcaagugcuuucaccagcugagacauauugcuagcccaugagccauuuauauugauaaguauugguguucauaacacaagugguuuuuucucuuucuucccucauuccuuuuaauuuacuaaagccaaaagauuuccauauagucucagaacuaucauagcagaaauauaugcaagacaugguccuuacuagcaggaagucaucuuuuuguugggauuagauggagaguuugcccagcaguaaaagcccugcuugucuguauguaacaucuuuacagucagcacauuucucaucugugauucccaagagucuggaaaggaauccauggacucuccauucugaagugacacaguuucuguuuuagggcauuuuacuguaagaacauuuuucauuuaagaagacuaucucaaggguuaacauuuaaccucugcaauuucaggucuaggaacagaaaagagggagggagggagggagggagggggagagagagagagagacagagacagagagacagagagagagacagagagagagacagagagagagagagagcgagugcuggagaaggaggguuucugggagucugaggucagucuggacuuuguagcaaguuccuugauaggcugaacaaaggaguaagagcuacuccaggaagcuacauuaaaaacaagcaaacccaaaagaaaucuaucuggucuuccaugcagccuauuuggacaggcacuuuucucaccgauaggaugaguauguuugaacugauccagggccuugaaaaguugccauacuuuaaaacuggacauuauggggugguguuuuugauuugcucuugaugcuuagaugccagggaaaacgugggcaugcuguuagccuuuugucugcuacaauguugccgcacuuugggguuucaagcauccugugcuccugcuggcagcccuuucucuuucuuugccagugucuugucagucuuccuacuucucccuguguuuucagucacaucauuuaaaucaccggcacuguccuuugcaucuggugaguguauuucacugugggugucuacccuacacacagggcauccuuugcuccacccggaaucucagcuccauagcuaagcacuggauccagccucauuggucagcaccauguguaugguacuccagucuagugcauucuccguggcugcuuuuuaguaaugcugggccuuugguuuaacauaucuguccuucuuuguuccagcucucuacacuccuccuccuccuucagagcccagcgucucauuucucugaagccuuacccaggagcccagaggcacucuaaccuuccuucuuccaaaacgagacucuaggaauagucugauuaucauaaacgccaaugguccucaugguacgcuagcugaggagccuccgcugcuguuuucaaauggcuagaauuuucugguuucacguucuaaaaccaauuucuauugccguaaaccguauugcucaccauggacucaaauaugaccuucuuggcaaagucuacucacaaggcagaauuauaccuacuucuccguaacaaauacaccaaauaaacagaggauauuuccuacgaccaaagaugacccuacacuuucuccuagcauggcacagcucuuuuugguguaaacugcaugucuuauuucaucuauaugauuaaugauuucccccccuucaucuuagaggagcugagauguucugacgugugugauguggagcaagaugacggugccagaaucuaucugaaaaacucucugauauggcgggucggcauuaaccagggucaauaugaagaaauucuuucuccuuucacacaccugcuuccauuuuacauaugaaccccuuuuuguccucgcaugggguaaagugccauauuccuuccgggauccucaggacaacacacggauguggcuugaggugguccaugucuggcuuccgaaggccccaguuggacugcucuguggguguuccgucaaaccaccuuaagguuuugucugugggaaaaaaaaugcuggcuuguuaugaaugaagugcaugauuaacagucuaagacugggaucaguccuuaaagcagccuccaaauuuaaggaggcacauuuaauuccaugaguauauucaugaacaaaacaucaaaaaagauacguauccagccaggcggucacauagaaaguaaaauuaauguauagaaaaucccuugaaauucuaacaucaacaccauagcaagaagguucauuuccuaaagccauucuuauacgggaagugauucagugggaaaauucagcccauacauaguuaauacggugugugcgugugugcgugugugaaaguauguguguaugugugauauguguguguguguaaguaugugugcguguguaaguguguguguguguguauguguguguguguguguguguguauguguguguguguguaaguaugugugugugugugugugugugugugguguguguguguggugugugugguguguugcacugucugaaaagaauuuauaacuaacaacaaagugaacugcaaguuggcuugccuuugguuaucgccaucggcuagaaauucaaacaauguccaggauuaaaauaccccuugcgaggagggucuccauacccaccauccugcaccacugugacacacucucuaugccaauuaaaauacuuuucuuuacaaguacuuuucaauaacaucaguguacuggcuaguuuugugucaacuugacccagcuggaguuaucacagagaaaggagcuuuaguuggggaaaugccuccaugagauccaacuguaaggcauucucucaauuagugaucaagggggaaaggcccauugugggugggaccaucucugggcugguagucuuggguucuauaagagagcaggcagagcaagucaggggaagcaagccaguaaggaacaucccuccauggccucugcaucagcuccugcuuccugaccugcuugaguuccaguccugacuuccuuggugaugaacagcaguguggaaguguaagcugaauaaacccuuuccucuccaacuugcuucuuggucaugauguuugugcaggaauagaaacccugaccaagacaaucaguuacauaaagaauagugugccuccgauuauacacacuggugucuauaaggauucaaaaagcacagcuguucacugaaacagcucccccauccuguugugguuuauaccgaacgcuugagaaagugggguguuuucaggucaacgugucuugccuuuguaugacuaagcccggggacagagcuggaacuagcagcuucagugucccagugaagguuaacuuguccguuuguuuuguuuggagguguggcuuuaggguucacacuauauuuucacagcaauuguguucaagaggcauccuggggcucccagaggccuucaggacugcguguuuacuugcgccuccucugcacccauggcacuuacuguuauuaucaaacugagcauucaaccaaaccaucugcacagaagacccaaacgcaagaagcucuuccaggagaaaugaauuuucagccgcaucccugauugccaacagauuagauccuguaaaagggacaagcagccaauaagcaagguaaaggggacucagaaauguuucugggcccugauuccugaagcccuggcuuugaaaaacaaucguucgguuacucaacacacgguuucccuuccuacuacuggggcuggaacuccagggccuugccaugcuaggcaggagcucuaaggaugaucuggagccccaacuccugguuuuuauuguuaaaaagugauugaguagaugaugagccacuaaagugccugcugcagaaacccaaggacccaaggacccaaggcugccgccucaggacugagguaaagaucagagguggagaggcagagacagagggguccaguagggcucacuggccagguucagugagagacuuggucucaaauauacagaauggagugugguugagaaagacaccugauaucaucacacacacacacacacacaaauucaaggugauuaaaaacaaaacaaauaaaaucaaagucccacuaugugccccuggcuagcuugaaacucacuauguagaccuugcccuuaagcgcauaccgaucuuucccugccuccugaggacuaggauuaaaggccccacgucaccacacccaccuacaaugugauguuugauuuaaguauaaaaguguacaaagcuuucauuuaaaaguuaaaauacugauuagccaguuuagagaacauuaaaauuucacaacgcgcauggcuucagaagaauuuuguaggaaagcucuacaccgaggcacacucuuggguuuucaaagucugcacugggacuugaacugccuauaauaguugucccccuaauaagcaaauucaauaguuuuuuuauuuuuuauuuuuuauuuuuucaguaguccucguggccccuaaagucccuggauaaucagccugcgagaaagcacacuguuuacugagcugcugagaggacaugcaaguauguuagccccacagaagaauuaccuucacuuuugcaaaauucaugagcaucuucaaaacuccugcuguccaggacuguggaaaaacuguagcaguuaccuuuaaauuuuauccagggaacugauguuucugagcacagcccugggugcucaaaugccuuuguuucuaugaagaaaaaacggguaugguuucaggcuggugucugggcucguagaccgagauaacccuuauuuuccauuccaugaaaggccaugcauaaccaaugugcacaugagguuuucaucagaagaccccaaaggcuggauuugaugcugaugguuacagacuaggguuaacccuaguucuugcauuucuguuagcaaacucuuucccuaaacaugaaggguggauaaaaguguuuugucgguuugagugcugccuggugaggguggcugucuacugccauucuaaaguugggacaucaguaagaugcacugcagagaggaagcaguagcugaacgaugcugagaaaaggaugucuaacgguauaauauguguccugugcagggcuaagugucacagaugucuaaagccccuacuuguguguaccugccuauagguauugcucauaucuaauccugaguuguuuucaucuacaauuaugcaaaguaugugugcuguagguaauaguacccacaauauaaguaaauaaugcaaccuuaugaaaugggcgauuuaaaaggagaccagagggggaaacucucagagcauaggagugcaacaaagaagagaguuagggaaacagaguaaacacgucagagggugaggacagagccccuggucagggcacugucgcuagugggauccuugggaacguguugagugaucucaauuaaguuucauugucaguaaagggauugggccagcugaacuucauguaaauaggauauugugcaaagugugguguagggcuuauagucaauguccgaacggugucagcuuaccaccacccuacucaucacucaagaaucuaccagccuugucuuaaacguaaacccucacaguucagauucucuauaaagcuguggcccgccuuucuuucuuuccuuccuucuuucuuucuuucuuucuuucuuucuuucuuucuuucuuucuuucuuucuuucuuucuuucuuuccuuucuuuccuuccuuccuuccuuccuuccuuccuucuuucuuucuuucuuucuuucuuucuuucuuucuuucuuucuuuuccuucuuucuuucuuuuuucuuucucucucucuuucucucucuuucuuuucuuuucuuucuuucucucucucucuuucuuuuuuuuuccuguucaaagcagcuuuauucauaauaggaagaaacuggaagcaacccagaugcccuucaaccaaagaauggacacagaaaaugugguucauuuacacaauagaaugcuauucaguuacuaaaaacaaggauaccaugaauuuuacagacaaauggauggaaauggaaaauauccugagugagguaauccagacucaaaaggguaagcaugguauguacucaccaguaagcagacauuagccuuaaaauacagaauacccaugauauacccuucagacacaaagaaguuaaacaagaaagaagggccaagcauggaugcuugaagcacacuuaaaagggggaacaaaaaggcauagaagguaaagggagagagauaaguggauggaagaggagaugggaaggugaauguguggcagguguggagagagacaggagaguggcccgccuuucuuauguaaggucucaucguccuuuuacccuaaccugccaugcuggcaaacucaacaccagcuuugcguguggcuccccuuccugugcuccucucugccuuccuuuaucuaagcuucucuccuccaaauucgucucuguguuguuguugcccaucucuccuauccacucugcaaguuccgucugcguacacugacauguccuucaggaagccuucugucuuccuccaaauaaauaggaugcuucuuaaaacacaacaacaagaaauuauugacuacaccgcagaccgugguggggagggcaguauccggagaacacacaaugcauucuuuucuugauaaccccucaucuucuagacacaccuggcaugacagguauuugucuuuauaugauagaccagagagacuacaggcuuccugagagcugagacuuuuuauuacauguguucguaaucauugcugagcacgaucaugcauucaguaguaacauaggacccauuccuggaguugaagagaaucguaccuaccagugacuacgugacaaauggcgccuugcagaaaugacucgcaggcugugcuaugccagcguccguuggugucagcaaaagcgcagucaccaagaaaggccgacuccucauccuuccaauaggugaaaggggauuuggugccguccgaccagucaaaagucugaccauucugcagaggggauuugaagcaccacuucauugccaaggcugcagcugggaucacccagcacuaacugaguacccacuccucccaaguuccacacuucuuuccaaaagacccagaggccguggagggaacagaguuuauuuuucagcaauuuaaguauguaauagucuuguuuuuaagaagcaaaaacaaaacaaaacaaaaaaucaaacucacacaaacagaauucugcguguuguauuucaaagguagugaauuaauuaauaauaaaguuucugaguacaaagcagcaaucauuucuuucuuuuuuuuuuuuuaauggagauucuggaaaucuaacaaauuacccacauacgguacuugaguuugagauguauuucguugcauaaaugagucaguacucagggaugcuagagaauuuucaaaggacccuugggguccuuagaaaccaggcaagggcauguuuaucuggaaaagauuuauacuuuuguuuuauagccuugggauucucaaaccaccaccaccaucaccaaaauaucaaaaccaagcaaccaaccaagcaaccaaccaaccaaaacccaguguuuuuuuugcauaaaccauuauugaaauguuacaauguuacuauugugucugggaguuguuuuugcaugcugauuucagcguuguuuuacuaaggaaguagacagaagggagggacugagaacaccuacgucugugguggagaguccaauccagugggugugucccagccugcugaggagaaccgugaggaaggccuggugaaacgcaucuggaaugcuggccaguucugcucugugcauccggcaggacuuuccggcugcauaccaagucauauuaccacggauuaucuuauaaguucuguuuccauauucuaacguacuggggauugcagacguaucagacacguuuacaugguguucaagggugucuggaacgagaacaucaacaaagucacuuguagcgucuggacuagagaggaggauuucaaacuuagcaugcaucuuugucaugggaucaacacugaccagccuuuugcuuccagaagcgaugaauucaaguucuacacuuggaagugugugugaugcuagggcacugggacagugugguugaaugacaguggccuccggaggcuuauacacuugaaugcuuggucucugguugguggaacuauuugaggacuaggagguguggcucguuggaggagguauauuauuaggagcuuugggguuuacaaagccauacucuuuccaguuaguacucucucucucccucccaccucccgccucugucucccuuauguaugugugugugugugucuaugauuacguucucuuuaauauauaugcaucugucuuuuauguccugcauuauguuauagcuauagaacaggcagaauucagaaaaacuaaaccaggaaaacaagguaaaccuuuucugcccuaaccgaucuacagugaauugcgucccucuaggcugaaaacuaaaaccaguaagugguuuggguuuacuaaggggcaugcugagaugaaaauggcugaaggccuggacuuagcccauuccugacucuaccuggcuaagagacccggagaaaacccauccaucugcagcucacauuucaggucuguauggaauuccucacagcacaauuaauccuuucaaguuucaaaacaaaacacaccucauuuucagcaauguggguuuguaacuucuuaugcuggagaagaaacaucuauggaaacugaguuguuuccagcugucuagucuuggcuccccacccaccaaccaugccccugugugugugcucaugcauauguguaugcaugugugugcguguuuguguguauguguguguacauagacuugugugugaauguaagccugugugugucauggcaugcacguggaggucuaaggacagucaugaaugcagguucuuuccuuuauuugaguugaggucuguuguguggcuuuucugcuguguuaggcaggucagcugcucugugagcuucagggaucuuccugucucuguccucacucugggaucacagacgcuuucaccaugaaccuggcuuuuacauggguccugucgauucaaacucggggccucacgcuuguacgguaaguucuuucacccaccaagcagccuccccuggccuuugcaucuuuuuauacccauauuucuuuauucuuucaggaauguagcaauuuuuggcuuaagcccaauauaagcauauaucuauaugggaaauguagggcauucauuguaacaagauuucaaguuuaauaauauuuugcaggaauaauuuuuaaaaacugucacuugcuaaacacaugcugggaacugugcuaaacuuuauguauauuugaguauaugaaauaguccucacaucguuacuuuguagaaauugagacucauagaggguaagucauuugaccauuuacagagguggaguggagcuugugugaccagacaccaggccugcucccugucugcccugcaaugucaccaaaggagugucuacguugcuuguccccaaaugaugaagaaaauaaucagagaagauauuuuagcauuacaggaauagaauugcuacaguuaacugaagcucuguuuuuaugauuaaaguuccuuaucuacacaacagggagacuuugacccaguuccuggaaugguacuaaagguuuuauggcauaaugugcauaaacccaaagcauggugccaggcacagggagacacagcagguagugaaagcaagaagucucuuugcuauuucuauuauuuaaggucacucuaggacagucacgcugcucauucaucccucuggauauuugugacagucugacacuuuaguuagcaucuuaaagguccuccuaagauccagugugcuccccagaguguugccacugagccgacgggacauuuaaggggugaggcccaguagaaggucucacgucacugcggguugcacuaaagagaauaacgggagcuuagacuccucccuucccauacuugugccuuccaguccugagaugaguggcuuugcucugccccuaucccuccacaagguucugcuuuugcuacagccccagagcagugggucuacuuaaucaccggccagaacccuuaaaauugcuuggucaauauacaccuucucucuuuauaaguugauuauuucagauauucuguuacagggagguaaagcuaucacauauggcuuugucauuacacuccagaaaccacaagggaguuuuaucugcuagaucuagaaacacacuauacauccuauuuagccacaaacacuauuuuaggagcuuuaaaaaaaagaaaggagugagugugaaauguuuauuuuuaugacuuuuguuguucuuguuuuuagucaggguuuuacuauauagcccaggucuaagcuaaguauaguuccuuaucuaucuaucuaucuaucuaucuaucuaucuaucuaucuaucuaucuaucuaucuauuaucuguuuucaguauucugggugaguuguaaaaguagccacaguagucuauguuuagaucuggugucaguguacucuguaaaguguuauaugguagaauuuaauccucacuaugaaguauuaaguggguagaaacaacaucuggcugugaaguucagaaguagggucuuuggagggugcuaaggccacgggguuccaugaugaauuuugguggcuuugacuggagagagggaauagaacggcucacgccaguaucuuucugugccuccuuggaagucuggcguaagaugguccucaauagacaucaucacguugccuuuggagcagaaucauaagucaaaugaaagugcuuuucuuuguguuaaugcuaacaucaucagaguguggggaaaugguacagaguccuaaaacacagaggaaagcuguuuagugguccuaggguuaaugcauaaacuuggugaucugccagauggucucugcaguccugagaacagaguugaagggcacagcccuaagaagcgguggauuugugguugaacagacuuaaaugcaggggacaagaaaacucuuguuauuagcagcaaagcugguagacaacagguguggaagaaagguuggaaauaacaggaauaaaacccugaugaucucuuaccuugcauuuuuucacagacaaauccauagccuucuuucccacagucaucgaaauaccauuuuccaguaaaauggaaauuaggauuacuugacaugagggcacagagaggaauaugcuuuugaaauucagugguguuauaacuugguaucuuuaaagaaaaacacguuacaaaaacaugguaacauauaacauuauugacacauugaaaauuuauuuagggcagaauuuuaaaaaguaaaacaccauuauucucuuauuuacaucuaauaaaccaacccagagucuccucauagccuucaagauaaauauucaucaugauguguaguauaauugugcugugauacucaugaaauuguuauaauaguauauuauuaaauauuaacauaugaccagucaagucauacaaauguauagcuucaaaauguggggagaaagaaauuuuagucaauaagucucagguaugaucucuuguuaaaaugucaaaaauauuuaaaacuuaagagucuuaggucacagcacaaugguuaaaguguagaagucccuggguucaaucccagaaaacccugcccccaauaacauuugaaacuuacauuuauuauauccgauggagaccaguuagaguacaccagaggcuucccauuuacccauuucucaugauuaguacuuuguaacccuauccacacauucguggucuggccaaaaagauucauaguaauaaaagcuggaaaagagaaaugcauuaucuaauaauuaucuaauaauaccacacaagucaucagguggucagcaaaugcuguucacagaaaugauuauauucaaaugacagcaagcgucauuaugcaucaguuauaggaguuccguacuuuguuccuguaacgaguugucuuucauuuugguuucaguuuaaauugaccuaaacgagcuggauaaccugauauuucaucagauuauuuagcaaaacaacuuccaguguuuacuuacuauuguuuuaaacaaaggaggauuaauguaccauauuuaaacagauauguauaauugccugaguuucaaauugaaauguauagguugaacucaaaaugaucuuuaaaaagcuuaucaugcaacuacccuaguguuccugaggaacuauuuuagccauuuuagaggacauguuaaguccuuauucucuucaguucaaaccuccaagggcagcaguuucuaggcagccuacugacucacagaugucauagcagaaacccugaugcucaaacugagauuuccugugucuuagcaacaugaugcuuuaaguguugauuuguaaaugcaaguuugaggugcuguuuugauuaagacuugaaugccgguugccauuuuggcuuggcugaacccucagacucuaccuuguuccaauucacuuuugauggagaccagcgucccacccuuggcgacacagaauuccugagcaccuguccaggucuucagcucccgaggguccuugggaauugucaccaggaagcacuacaaauaacaacaacacuaacuguuuaucccugcacuguucuaugagaacucaaacaauuucccaaagacaccgaaggucagucuuggaaaugauaauuuucuuaggcagagaacucauuugucuucugccugcucugcaggcauuaaugaagcaaggacagacacugcuuuggggcgagcgauuugucucauucucaugaagcagggcugaagaagaagcagagauguguuugucauguggaaugucacagcacugucuucuacucaguggagaaaggcacucuuccuaagaaggagucagugccugcaagcuuuauaguagggaacuuggaagaaaggaguagcuuagcuagacuaucuauaagcagagaugaaaggaccuggaggauuuaaguucacuagaagcucguuuaauagaaagcacacaggaaguuacagaaaaacaagaggagaggugagaagaagacagagaaauaaagaugaccgaggaaccaacuucaccacugaugcuaaauggaacacagaaauacaggcugaauucucacagugagauuggucacuuuaacagaaacugcaucaugucacacacaugaaggucagaggaccacucuaaggggucaguuccuuccuucuaaugugggguccagggaucaaauucagacuaucagguuugugcagaaaguguuuuuauccacugagccaugcugccagccugugacuguaucaucacagggauguccucacagugagauaggacgggaaucagaaugauacaguuggcccgaugugcccaccuugcucaauaaaugcagacaugcuagggaaagcuggaguaagucauggggagaaagacaaccaaggcucuaacacuucaggacaggauccauagaagucaggggagauucuaugcaggcuacaucccauucagaaagugcuagcuauuucucuuuacaauuuccuccucaaagaacauagccagcccuagucauuggccggucugaucccaggauugagcuauggagaaaacuucaaaguaaccccaguugauccagaaacucaaauacaagagugcuagcucuccugucuuacucuagaauaguguccuccucccuuuauucuuucauuuuuaaucugucaccucugcccaaccaccaugacuccauaaaagcagagaugguuagcugccaaaaggcaucacuagagacaaucccuaaaaaccauccaugggaugaaagaacagacugugaaaugaucgucaacuuugaucuacuaagagagacaggaacauuugagcagaacuguucuauuaaagugucauuuaaauaucuuucccuuaaaauuuuuuuucuacuguaaacauuuuuggggaaacaagaaaaaaacaacccacccaguuacagggcuguugagauggcucaguggaagagcacuugccacaaaaucauugguauuuggguccccagaacucaaguuaaaagccaggugacaccagggcucuccacuuguaaucccuggagguggggcucgcuccaggagagcuagucagauccugccucaguguauaaaguggagaauauuugaguaagaaaaccaaugucaaccuugguccuccacacaacuguggacacaauuacauccaacuauauacucgugugcacuuacacccacgcaagcacuuguacauacacucccaugacacaugcauuuaaaaacaggaaaauucagucaagauuacuaagccuacagggguacuauaacccauucuuuugggcacacagauuaaucuugucucucucacuacaacacugaaccaguacuuguguuuuccaucucugugacacugaacugagcaugcccagaaauguccacauccuguaucuuaaccuugcaaacuacucuaugaccuugagccaagaauggccagagaugggcccauuaucuuuucuacuuaagccaagcccuuaaacugagcacacccaugaaugugcccaccgaacagugcgucuccagaugaguagguauagauucucuacagagaucccacacuuucuuuccuugaggagagcagcacucuggggacaaccccagugcucuccuuaacugauacaggcagcagguccuccccucucuuaucuccugcuggauuucugccucagcucucuucaugcagcuaacucccuacaaucaaugauacaaugauagucucaggcauuuuagauuuaccacagcagcucucuuaggguacgguuuuuacccuuggggauauuucaacaaagucuggggacauucuuagucuuccuucggaaagaguugucaggggacauauaaaguuggaggcaaggaugcugcuaguuucugccgugaacaaccguauuccuacuguuuuuuuccacaacaaagaacuauccagcccaaaguguagauagcaccaaaacucaguccuaaugaugacgaugaugaugaugaugauguguguguguguauguguguguguguguguuuauguuuuuaaggacuucaggccuucuauucucccacccccuuuaggauuaaagcccagaaacugauguagccuguguuacugaucaagagagggguggguuuccagcuccugcugcacaccccuuucuuguuugcuucacaaagaaacggaauuggcuuuaaaggcguuuccuuuuauaacaaccacccuuuuaucuguuccuuuuuuauucugcuucuuucuucuaauuacaaaucccaaagaauggcacacacuaauuauugggaagucuuaucauuuaaugugaguucaccuuguguucagauagucacuaaugaaccauucauaaauaccagugacucuuacaggcucagguucuccacccuuugcgggaagacucucucuccucacugccuuccauguuccccgaagccagcauuuauuaguuugacaguggaaguauggccuccuguuaccacaggcguguuuuucuaaaauagaccauauuuacuaacacacuuugaaacagucuuguuaauaacugaggcugaacagcuggaggaaggacggcagccucgguuuuaacuuguuuaucuucugacaaauuugcaaaaugugaucaaguuuuaugcaucucugaucauaacugugaguuaaggaggccuuauaauauuccaaaugugcuaggaauaauaaaauuuuguuucaaaauaauuuuuagucaacauuugacaauagaaucuauaauauuuccuucuaauuuggucuuuucucaauuuuccuucuguuguugaauggaauaauuaccuauagcugaagcagccuuacucucucacccaucucugccuuagaugcugcugaaggauagauacacuggcacugaaccaaggucugaaauaaaaugugcugcaaagcacauacacacacacacacacacacacacacacacacacacacacacacacacacacacacacacccuauacagagguaggagaggagaugagaaaaagagaaggaaaaaugauaaagaggagcucccucuuggcucuguugacuaacccuuccuagggugacacagugucaggcuucgcauaccucauuaagcuguaucaucaaacauggagaagauuuaugagacacgggaaagggacgccuagcuugcagauaccucguuuuuauaaaauucuuagaaggugauugacuugucagccgaguuuuuuuaaaguaauaaaaauuagcccuugaaagaguucaccaaccagcaagaagauuuaauggcccauaaugcauugagauuuguucagaauguaucccccacuuucuuuucuauagcuuuaagaguuaaugggggaaauggcccaauggugcuugcugcuucucucagcaacaguccuuucuucgccagcuucuagaguaucugguuaacccaugaauacuguucccuuuagccguaguuuccacuuuaucaguuucaaauacccacagaggagaaagugcagagcaaugacaacaacgcuauggucugugcgugggagagagagagagagagagagagagagagagagagagagagagagagagagagagagagagagagagagagggaggaacagggagcaggcguucccuuaauuuuguuuuaggacagcauuuuauuuuauuauugguuauugugauucuuccuuuuuaaagauuuauuuuuuuaaaaauaugucuagguuaguucaagugccugaggaggucaaaagagggugucagaucccucgagcuagaguuuaauguagcugugaacugccccauguuggugcugggaaccgaacuugggucgucugcaggguagcacaaacuccuuacagccgagccaucucugcagccccuaugguuucuuaaccugccucacuuaugaauggaacuuuacuaaaguuacucaguccuuagcaagacccucaucuaaagacauucucuacaggugcccacacugggagggaagauggacauuuuagaggugaaaucuaaggaaaagccuuagaaauugagguguguccucauaaaggauuagggcaccuuagucucuguuucucugucuacuccuuccaacucccugauguaaguucaagauacaaccacuugccuuuugauucuguuuuaaaguaaaaauuugagacgagagaggcaguuguuuguaucugucuauaacaaccaauucuagaauguccuuguucuaacagccuuaggaaacuaacagccaugugauugaaauaaaagucaauuugaauccaaaucugagccaaaaucauguagaagaugacgugggggaaaguauuugugacaugugacuugaggcugcguucuuaggugucagaccaaaagcacaagcaagagaggaaaaagucgauacauugggcuuuaucaaaauuauagagaugcaugcagcagaggacauuauaauuauaaaggagaacauaauuauaaucauuagagguaaagaucauuuaccugauaggaauucauuacacauaacacuagaaagaauuucuauaauucaacauuaaaaaaaccaaaugacuuaauuaaaacauggacaaagauuuaauuaaacaucucccucuccaaaaguauaugaacgaaacuuccucuuauauaugcaauuauaaguuguuuauguguugggaaaacccauuugucaguuucucaaauagcuaaacaagagcauccuauaacuuagcaguugugcuucuagguuuaucuccaaagggaacgaaaacugggauguggaaaugugugcacugaugcauauuguagcauucuucuucuucuuuuuuuuuuuuuuuauuucuguggaaaauaccagcagaaucuugaugaagauuggauuggcucuguagauugcuuuggguuguguugauauuuuaauaauaacaauucuuugaaaaauaaauccaauacaacuuuuaaaacagggaaaugguauguguguguguguguuccuguguguuauuguagaagagccaugcacaugucuuaucagaggaccaccuuggguuucacuccuugcuuuccauccuguuugagacagggucucuccuguucucugccauguaaacaaacuggcccaugaguuucuggugaucccugccuuaaccucccagguagaagcaucugcugggauuagauacaugugugcuacuguaucugcuguuuuacauggcuucugccuccaacuucuauguaaaaauaggaauaauaauuuuguauaucuuaaaauuugaguuaaaugagaaauguuuacgaaacugccuaguaaaaucauccaagugagaacaacacuaggucuucgugauagacagauagaugggugggcaaggggucacguaucguauaggacuaucuucugagugagacagcugccaucuucagugcaacugugccccuugcaaaagaugauccuagcugggucuguugacuguuuauucucauugggaggagaggggucagaagacucucauccagcuaugaguucauccagccgcuucagacaccuauuguauacaacucugcccuaacugcauguggccugggggaggggcuagggaaagacuagguaggggaagauggucccaaccauguggcuaugucauugucucugcuagguaaagacuuucccauaagcaacccuucaccuacacucuguaaggaaaccaagugguucuucagugacuuuuguagaauaauacaacuuuuaaacagggaaaugaagcuggugugugugugugugugugugugugugugugucuuugggaaccuuaggaauagggguagauauaguuuauauuacacccugggaaagaauuuuagcaacacauaugcuauagaauauuacccagccuuaaaaaggggaaaauccuguuacauguuauaacauugucaagacuuaaugacaccauacugaaugaagugagccagucaucaaagaauaaauauacuucaugauuucauguacaggaggcauauacagccugucucagagaggcaugaaauaaaacaguggagccauuucuucaggagucagugugaugggaaagaagaauaggguguuguuauuauuuaaugaaugcagaguuuugguucugcaagaagaaaaaggacccagagaugcacuguacaacacaaugauacugagcaccugcaaaccacacacugaaaaugauuaaggcagaaaauccuauggugcauguauuucaccaaaauucaguuagccauacaucacuaccuauauauguacagaauucaggugacuucauugccucaguuaacagugacauuaagaugcugaagaaaacgccagccagugugaccacuuagacucaaaacuggccauccacaaucaaagagcaauuucauguuaguguacgcaauuaugacaccaucucauuucuuaauccucuaagaguuaaacuaucccaguuugggauuuacuuaaaucacucccagccaaggccuauaaaguuauuuuauuacaaaacagaaggaguggaggaaaaaaccuccgccuuaauugaaggcagcaucggaaaucauaaaccuggauggcagugucccugcuggcaagccuuuucucuuaaauggaauucugcaccaagugucaguuuuaugaggcucaagaugacccugaccaaauuacaucauuaguucaucaguuuacagguagguggaggccugcugguucugggcagugaagaugaggggauagagccugggccuguacauguauaguuuauuuguaggcaggaucuagauaagcuggcaugcagacacacauguguacacacccaugcacugcagacacgcacacacaucauauccugugacucgaaagauggucacuaaaacugccucuacagaugagguauggaggcauggcugccuuacacaaaaccuuuuuuuuuuuuuugccuaaaggaaaagcuucuaaaaccauuaggaugugauagugacaucucaggucccucagaaaacuggugcuuaaaaaaacaaaacaaaacaaaacccaaaaccaaaaaccaaaaaacccuacccucacuuuuaauaacuuuucaauugaaguucaacaaagagagacaaagaugacuucacaagaagaaauuuaccuuauaguuaaaauacagccaccccuuggggcaugucccaggcugugucggcggcuucuccuucucgaugacccauaucuucacucgcuuacagaugcugggcaaaggaacagagcaguucucagucccccagagcccugcaggaggagacaggucagaaagucucaggaacaaggaagacuccacccaaguucuuauggguugcuuuucauggcugcucugauuuuucauuuuuucuuuuuugaagucuggaaacugaaccaaacuacuaauuacagagauuucuagugacacugaccugggcaaggugagaccugaguaauuacaauguaagaauauaagaacuuuugacuaaaguaaacaaacgcuaaaacugaaacagcauuaauuuaaaguccuacggauaauugacuuggggcacgaaauaagauuucauaguuuuuaaguauccagcuucaguauacaggggaaaugauucuaagauuguccuuuguaaagauuguaaaacaucucuaaacuuuauaaaauaucuucagaaaaugcagguuggauauacccaaucuaauuucuaaaacuggcaaaguccaucuuagcauccccaaccugaaaacuccaaaacaugucuuaucuuacucggauaaaagaucuuccgaguacauacuaauacagaaaggucaagucaggaacuccucacaaaggaagauuucucagucuugacccuuaacugagaccggcucccauaggagccugucuucuguaagauagagccccagcuucccagcccccugcaaacuaucuuuuaacuuaggagggcuacaguuccagaggagaggugucagggcacguaagcaauugccugaguagaagccgaggugcaaggcaggcuaagcuucuuguaucagaacaggaguaaaaacuggggcuucuaagguggggcugggcugugauugucacuggaaugcucagcucuucuugcaaauagcccuuuccacaggcuguugugacaccugcugguaaagccagcagauuaacuacagcuuucuccuaacucugcucgcccacagaggauuuccucuucauuucuuuucugaccaaguuaguuaugaauauguuuuucuccuuauuacuuuucuuucucucucccucccucuaccuuuuccccuuaaaauauggcuugauucagccuagauagcauuguucuuagaacauacagaagccagucucuagcuucacuguaccaugggauccaauuugcagacagguuuucuucuaagaugugcauucaucagagccagagauggugaggauggugggacagugacccgggcauagguguuuuauuuaaagacuguuuauuuuuaugugcacugguguuugccugcauguaugucugcaugaggaggguaccagauccccuggaacuggaguuacagacaguugugagcuuccaugagggugcugggacuugaaccuggguaccuuaacugcugagucaucucucuagcccuaaauguaggguauucuucuucuucuucuuuuuaaugugagggaagauggaaguaaaugucccagagguuaaagugucagucaguguacaaacaggaaaauagagauguaugaagaaauagcuccccacugaagucucacagagaauagcaucuacaaggcacguuuuuuccccacuguaucuguccaaauuaguuaacucuuaauuguuuuggguggguacaagaaacauuuuuuuuuauauauuugauagggaaaugcauacuugucuuuaccaaaaauacuuauuuuuauugcuuugaauggauguauguggaccacgugugugccugaucccagaggaggucagaagaagacauuugaucucuggaacuggaguuacagauaguugggagccaccacaugggugccaggaaaccaggucuuagccucuggaccagaggugcgugucuguaacaguguccguaggcucccuucggguucuguuggcucuugaggacuuaccuaucuguaaguuuacaggcaugugaguacaugaauuucauaguaugagcagucauccagacaccugacaacuugugagacuguacaagaucaacagaaaacaaaaauaaccgcauggaggagacugguaaccucuagaggugguugcaguauaaacccaaacaucaaaaggaacagugaccuguuauggaagauaugaagacacaucgcuuucucuggcuauccacucuuucuucucuuccuuugucccaguucuggaauaucacgggcgacccguuacuccaccuguaggaaaguuuacagagauuuauuuuuccauguaaguguuguuaucacugcguuugugaguauuugugcugcauguguguagaugccuguggaguccagaagggggcaucagaucuccuugagcuggaguuacaggugauugggagcugugcagugugggugcugagaacgaaauucugaaagagaagcgagugcucuuaagcacugagccaucccuccagccucaggaaaaaaccaaaccaaaccaaaccaaaccaaaccaaaccaaaccaaaccaaaccaaaccaaaccaaaccaaaccaaaccaaaccaaaccaaaccaaaucauuaaggucucauuuugcauguucaguaucugcaucuauccuuguaguucugggguauagacuugaaggauaacaguuuauucaauuugguuaaguguacugcacuguacucacaaaguuuucuaaauuuaacuuuauacuguguuuuuaucucucucucucuuucucucucacauacacacaaaauaggacaggcagaagccugcacaggaaauugauauguuugucggauaguuugaugaugguuucauugguacugaacugaaaagcacucaugccuauuguuagacgaaugaaaauuuguaaguuaaggauaacaggugaaggccauucagcgaaucgauuaucaaaacccagccugaucauuuggcacacacaacuugucaaauaacguuaaacauggauuagugucgguccguacugaauuugaucucuggcuccuccuucuucaaguccgauccaccacuucacaccauacuuugucagcuauugaagggaagggagagagaacaugucaguguuugauguucuuguuuacauuguucuacuauuuggaucaaugggguugcuauugguuuuuuaauuacuacaauguuaccagguuauguaaagaagaguaacgagcuaagggcuagugucuagagaagucgugaaauugaauuauucuaaagcauucccuguucauuaugaaagagaaugauagugaaccacugaaaauauuucuguuucauucaacuugaaaggcaaggcuucuaacucugugagaagucacgugacauaaaagagagacggguaccucuucugacuauaauuaguggcuucuucucucagugauuuauggaagcucccugcagaugucacauuuauuugacaaacaagguacaaagacauuaacagaauaaagauuuagagucuaagcauauuagucugugaaccuuuagacaguguccacacugagagagagagagagagaggagagagagagagagagagagagagagagagagagagagagagagaauaggacaaaacaacccuacagaauuccaaugucugaaagcuagcaaauuauccauuuuauuagucuacagucaauuauuaaucacccagucuaagcacagugaaguaucaaguggagaagcauggacaugcaggcgcacacucacguacacacugcacugcagauaucaugcuggacuuaugguccaggaaauugaagccuucuccuuaaucacaaaagaggaagggacagaugagcuuucacugagcccucucgagcagugugcuuuacggcguaucugcucccucuguauguguaucaaaauucaaauuaacuuuuauaugcccaaacccuauuaagguuaaggccuuauguauuuaaauuuguacucuuauuuccuuuugggagggcuuggggauacauuuuuaagauacauuauuuauuuccauaugaauugcaagucacuaccacagaaccugauagcuugcuaacauucuuauuuugaaacaagugugcuuuuacuucuuagccagcauggcugucugccagagcagcaauuugagaauauugcaaagggggagccacuauaauuugagaucccugaggcacuguuccgugggcguguucccacaugcugaauucagagccccauuuucauacuuuggagugcuuccguugagauuggcauggauacggcaggaagacuacaacuuaauugcaucuaaggaaggcacaugggcaacagcagucaaaaucauagccugaccacucacucucccaguuuaggaccuuuaaggggaaguuauaacauuuauaucuucuuuuucuuuuuuuuuuuuaauuagauauuuucuuuauuuacauuucaaauguuauccccuuucuugguuuccccucugaaaaucuccucccccuucccccucccccugcucaccagcccacccacaccugcuuccuggccccagcaucccccuauacugggacauagagccuucacaggaccaagguccucuccucccauugaugaccgacuaggccauccucugcuacauaugcagcuggagccaugagucccaccauguguuuucuuugguuggugguuuagucccagggagcucugggggguacugguuaguucauauuguuguuucuaugacauuuauaucuuaagugguauauuuauugccaccugauuuaagauaugaucaucugccacauagugcaucccagcugugacauaugugguagagaacuuuacaggacaagcugaaagaugacaaaacagccugguauggaaaagugaauauuuuaaauguuagcuagguauauacagccauaacaacugaaaccuaauaauagguguuugaaagaagaaauguaauaugagcaugcauuucacaaaucaguuauauuuuguuaugcucaaguagccuuaugguuaacugacaggaaaggucauuucccagugagcuagacacacaagccaacauaaucaucuacucaacuuucuucagcaaaggcaaucugucaucucuuagguuucuaccaaagugaucaagggcguuaguuuaaggguuuaaacagccagauuuuaagaaguaauagauuugauauacaguuuuagaaaugcuuacaaacacaaaacuuaaaagagugaauugcaguuuuaaagugcaaauacuguauaugacagauacaagugauugauugguaagccaaucaaguccucugacucucaagugcuguagcuuuuaauguuuucaucguugaucagaaagagaagauuagagaaaagaaaaauauucaaagcucacucuaacaccccauggucuauuaucagagauucagagaaaacauaagcauccuucaaaagaaaaauuguuuuuguuagaaaaacucuacccagcuuucuaucucauauuaaauucuucuacacuccaaauaaauguuauuuuugccuuucacagucuuagugacuauucuucauagaaaagugauaugaaaccgugcuauuucaaaauaauuauuuauucuaacuuuuuugauguuuuuuuuuggccagguaugggucaaaagugagccauaucaccuuugcugaguuugauuccucauccuagagucaguaauuuccccugcauccaccaacuuggcaagcauauugguagacaugagacaucuuacgugugaaacacuaaugcucaccauaaauaccaccguacuacugacaaccaaaaguaccaaucguggguagaaauaaauacugcuuggaaaucuacagccacaccgaauguagaugucuccucccuucccaguccuuaauauugaaauccuaacucacaagaugacaugcugggaagugugagccucuggaaagugauuagaucaggaagcccucacgaguggcgagaguggcccagagagugaagaaugacucucacuuaauacccuugcuauuacagaagaaacagaagucaaaggggcauaaccaacccacguccccauaauuuucuaugaaucuguauagucagagggaaaagagucugaaaaaaaagaaagccaggacuuuuacggaaacuuaaaugaauguguagagucaaauuuuaaaaauaucgccucccccaaggacggaagguguaaacuaugaauucugugaagugauuuguguucguguaccccuuugauuuugcuguggaugaauucuugcuccugagcagaauaaauugugaggaagucacuucgcagccagccgcagacaaacucaaagguggcccacuccgcuggguggguguggaagagguacucggcguucugauagaagagccacggcgcaucugcaaggaaaccgugugaucaugaggaugcucucaggaccagcgagagauguaaggcgggcuugaaggagugugggcugugauugacucccagacuguaaucuggucguuuaacauuuuaaaaaggggguguaaggauguauggauacacgcacagaugugcaugugugcauaccuauaauucacuuauuuucuuagucuaccucacuugagaacccuucacuaguuuucuucuuuuuuuaaaaauaauucuuuuuuaaaaagauuuauuuguuuacuuccucuuauuucaguauguaaguacacuguaguugucuucaggcacacaccagaagaggacaucagaucccauuacagaugguugugagcuaccaugugguugcugggaauugaacucaggaccucuggaagagcaauuggugcucuuaaccauugagccaucucucuagcccccuucacuagcuuucauaggccagggauagauccauauuuuaaaauacuaugccgugaaaauggaggcaugauguuaauuucaaccccacuuaaugaguauaucuauuacuuugauuaugcccuucuugaucugcugauuugaacuaaucagucccagguugauauauaagagaauggguguguggaaagauaguauaaugcacuaauaccagccucuccuuggugugauuuagaaguuagagaacugucaaguuggcccuuaccguacugguaccagucuggaaacuugggucucacaucugcagagcaaaagcaaaacacauugccugagacuucugcagaguuucugcacucccucagcucuaaccaugcuauucuuaugucaccuucaaaaacauaaguuuaaggccagauaugcccuguacugucuagacugugaagaguuagaauaugcaggggaaucucccgaguccuaaaacaaggaccuagucacaugccagcgacuacugcgugugagacacugugcugggugcguccgcacccucagagcgcaacacuccugugugcucgugaugucagagggauauuucuuucaucugugcuuacucuuggugaccuucauuccuaaugcacagccuggcacaggguaccgaacugucuucccuccuuugacugugcucccggcuuuaacuaagcuagcguagcuagguucaucaggcagguuguuggcaguguggcucagggcucuagugcugagauuaugaaucucugggacccuucauuugagaaagugcugcguaucauucaaaugcaaacauacauacaguaaagagcugguaccucuuggaauucugcauauccacucguguuuggaggcacaguucgagggcaacaauguuuuguuugccuuauacacagcacaauuuuuugcaucuucuucaaaauaagcauugucuaaaaaugaagagacaaccugcggcagacgaaguucauuauuccucaaugaugauuccccccaaaaggaguuucagaagacucaaggcacccaggaauguaagcacuguuggcaguggcucucaacccgugggucgcaacccccugggggguugaacaauccuuuuacaaaccauccgaauacucaggcauuuacacgacgauucauaacaguagcagauuuacaguuaggaaaagcaauggaaaucauuuuacaguugggggucaccacaccaugaggaacugaguuaaagggucagagcuuuaggaaggcugagagccacuguuuaagggacuucagaggaaucuucagaaaagucuacaugucauuccaggguaagauugauccacauuucugaagacuaaggguacuucacauuuuuuuccuguucuuuuuucuuacaaaaagguaugcagagcuguggagauaggacagcuagucaggugcuugcugugccaagcauaaggacagggguucaaucugaagcacccacauugaugauuaaggggaaaaaaaucccguagaguagugcaugccugcuauccuaguacugcggaacugaagguaagaaccccgggcuugcuggguagccagcacagccuaauugauaagucccaggguuaguugggaaguccugucucaaaaaagguagagugugguugagaaagacaccugacauagacugcuggcuuccccacacauacagaugugcucaaacgugcaugcacacaagaaucuuucuacuguuuucuccagaggaaaucagaugcacacuuuauucugagcuuguaaugucauagugguuugaauagcagccccccuuggcucauagggagugguacuguuugcaaugauuagguccuguggccucggaggaggaaauguaucacugggggcgggcuuugagguucaguugcagagccuggcucagacuucucucuccuuccugguaucugccaaucuggcuguaaaacgcuuggcucucuugccagcagcaugucugccugcgugccaccacgcuuccugccaugugauaauggacuaaaccccugaacugcaagccagcuccaaugaaauguuuuccuuuguaagaauugcuguggucguggugucucuucauggcaagagaccauugacuuagacaacucuuuccugggguuugggguaagcuuagaguuuuagggaugucccagauuuugguaucaucuuugaugccaguuauuugcuaagcacuuaaauaaaaugcuaagcauuauguuuuaaggacuaaaaucuaagucuuuuugcuuguuuuaguuuuaguuuuuugagaaaggaucucaguacuuagccuuggcuggcccagaacucauuguauagaccagacuggccucaaacuuauagaaauccaccugccuuugucucucacaugcuggauuaaaggcaugugacuguaugccuggcuccagagauagcuuccauaaaccagaaaacuagcauuguucugagugaccacauauuauauauaauuccuacaacagauguuuuuaaaugagguguaaaccuuuucaacuauuuaaugauuaccugacagaaauguagaugaaccacaaaugaaauuaagguuaaaauguagaaaaauaaaaggauguauugaaaccacuuugaacuauuuaaauaugcacagaggcacguaucagcuuauccggugcuucuauccucauguuaggagaaugacgugaguuacguccagugggcugugcugagcaucaucagaacaucagugcguguagucucaucagugcgcuugcuucuuaagcaaauuguuguccuucuguuaugagcgaguuugagugacuaaaagaaaguauuucaacuucuaaugugcuucguuuuauuccccaagagcaaaauggcuuuagcaucccuuccauuucugggucucagcugcuucuuuagcaaaagaaaugggcagagcugagggauccaaauccucuccacgucuuuuuacacucuauucuugacacucuuuuucaaagcagcaauguuggaguggaaaauggggcuaggaucauguuuaaacuagcauuucucugcuauuauuguucccuguagaagcacacagguuuucuuguuugguuguuuuuuuuuuuuuuucuucuucucuucuuuuaacucuccucucagcugcaaauuugaacccuguccuuugaauaggcuuuccccaccccccucccaagcuggucuuuaucuacacuuggcugcugguauuguacaaagugggacagcccuggacaaccugugugcagauccuggcugcccugcguaguacuuuauguggauuaauuguucuauuguccacuggcacaggcuguuaagaaggucugggaaacagaagcugucucaaauggucccugaaggcuggcucuaaccgcccccuuucagaguugaaauggugucauguaauuuuccuugucaccuugauagaaaucugagaguuccucagugcaccuggaaaaacaaugcaccuuccagguccuuucucccuuucccagaguuugugaguauggaguggacugaaaagcaaaccuuugcccuucugaaacuaccuggucugaguuauuucuaagucugaugcccuuuguccuuuuucaaagauagaguaaaaauauucucagucucggucucucucuuggucucucucuuggucucucucucucucucucucucucucucucucucucucucucucucucuuuguguguguguguguguguguguguguguguguguguuggggaguggggacaggcagagaccagagaaggguguccugugucuuucucucuguugaccucucugcauuauggcuuugacagaggaucuucucacugaaccagaaacuccccgccguucuggccaggcugguuggccaguaaguucuagagacccaccagucuccuuuccuugcuuagcucuuuauguggguacuggagauuugaacucagguccucaugaguacagagcaagcaugcuuuccauuaagcucucucauaagcuucuggguaguuuuuuucucacugugacauggagaaaggcuacauacucagacagucaggcagucugcagaaaaggaggguggcuuagaagccuggaauuacuguaaagaccagccguuucccuaaacugggaagcagauuaggggaguauuuuuggagauuuggauuuccuuucaggaugaaauauaggcaucucagaacaguauagucaccugagauuucccaggaccuugguacaaccacugucuuagccaaggccuaggcaaguuucccaaagugcuacagccacuuccggguccucuugguuguuuuaccgagugagucccagaccgccuggcucggcuacaucuccuuuauauagugugaaacaacuuacaggugacccgucagaccacgcccaagaaccagcauucaguggguuccuucuauuaaauccaauccagaacugccuuuccuguguccugggaagagaagaaacaaaaguguuauuuucaaucucauucccaacaucagauggaagguucugcgagccggugaaccgugaacagaaggaaccgacgcuaauuagcagggucagacaauaaauggaucaagcauccuuuugcaugcaaaguccuggguuugugaaaugaggggaggugucuagacucacaugcuccuguguggcuugcucagagcucauggggagaaaaauaaacauauacugagaacaggaacuugucaucaagaauggaaacauccuucaaucaggccaugagcacacgaaaguguaagcugccuggaaauccuagagcuuagcaucgcuggaugacuuuaagugugcuacuacuuauggcuggacuuugcguucugcgauguuuuccuaugguuugguuuauugcucuuuugccaacuguucguguauuuuauacagguuuauuccuaucauccccaucuacuaacagggacacacaaaguuuguggaguuuuuuuccuuccaguuuccaacauaaauaacucugaggcaaaucagccugggccaugguagauuaacuugagaagucaccacugguuuagacugggcaagaacacuucacagagaaucaucgucccuccuauuaggcagagaacaaaucugucagaucgcgggguacucaauaaaucaagcaauaaagccuaguuguacaacgaaccaucucacugagauaauuuucugagaauaauuuugaagaauuaaagauuuaagagacucagaagucgugacagaugcuuucucaugcuuaacgcagaggagcgcgcucacucugcggggucaguucucccauguguuagacagaggucaaaguuaaauggaaagucucugcggucacuggugccugggugccuacuggugaugucacacuucugagaagaugagggugaccuguggaagccaggccagggcuguuaaccuccaggacgcgggcuaggaaccagcuucacacuccccacacugggaacauuuggucuauuccucacugauuuucccguucuuuguuuucccuguucuacuggcucacagaagacaaauugauauuuauuucucuccacuaauuuccuaaauuguguaauuuuaaaauaacacacauuugacacagcugaauucccuucguagcaugagcaaaaauaaagcauaaaucauacaacuuucauguucagaugcaaaagaucaauaauuugaaagaugcacagaauucugguaggaauuuuaaguauggacagaaagaaugucauuaccuucaaucuuuaaagggagaguguuuacagaucuggucuaugggcagaauguguaagcauggcuugcaagggguuaaaguuccaaagcacaacagaacaugggacaguggaggcugucccucagagcccgaaagcaccccagucaguguggaagcuucuucaacaccagucucacaaagucugaggugccauagagggcucugucucccaaggugcccaguauguaggcuccgacugaaaccaagagcuuaggucagugguuccgguacgaacaagugguuccaugggcuguuaagauuauuucagagggaaaaccauuuguagagaaagcacuucuugcuagaagucuucguaauacugauuauucauagcauauuucuaauaguguacauuuuuuuuuaguuuuauuugaucccucugauguuacaccccucucaaagaacaauaacaauagcuucuccaccaaauccucuccauauggaaccacucuaagaucacaugcaaggucauuuuuuguaaacauuaaagguaaauaauuaugggaguacuuuaugaagccuuuaguuacuuccaauuuaaacuuaguuaacaggguugggaauuuagcucagugguaucauauacccugggucuggccacaaacaaaaugaauaaaccaaccagccagccaucuauccauccauccaaccaaccaaccaaccaaccaacaaaaaccagacuacaguuauaacugcaugagcaugggcagucuaacaguugauacacacuaauaggugaccauugauuuuuuuucaaauguacaauuagagcgcugguuuggauuguuuuuaaacugauggaauucccuuccccaaccaaaugaacucuaaucuauggaaaacccuuaucaguggaaugggauuauguuuucugggggcucgaaagcaaggaaccaaagcucugcccaaauagucccaucuaaucuaagacccccugaauccucagagaacauguugaaaauccaccaaacuagauacaguuagaagcaaagcucugaaaauaucugauagaagacacaaaaaaauauuugacuaucuaaacaaugaucauuuuugcucuuuguuuuaaugcauugugaacuuggugcaguauaaacacaaaacuauaugaggaucauauuuuucugucacaagcagugacuagcuauuuuuaaaagcaaaacaaaugcugacauuguaaacaaccacuugggauauucaucccuaagaaggcacugcuaagagacaauuuuugacuauaaucuucucaaaauuaguaaguauuuaccaauuaaauuuugaauguagaagcucauucacgaaauuuucuuccucuauaugggcaaagcuugcgaggugagccccaaacuccucacagaaugcuucugcuucucuccacgaucuuuucaucaggaccuuuucgcuaugaaacaccuguagagcaacacaaagcugccaagugcuccuugucuuuacucuauugcgggggcauucaggggagaaguggagacuuccucuaugcugagcauggacucuuuccacugagccagacaucugccccuuucuuauucaucauugaaauuuugauuugaaggaguaacauauaucacaccagaauaugucuaguucuuaaaagauuuucugcucccucuaccuuccuuggcuucuuuuucacuaaaccucuuaugacagacauagagcuuucucuuuuuguuugucaguauauaaggaaaaucaggucaagagacauuaagaauacaguaaggucacacaccuauaaacuuauaaacuuauaaacaccuauaaacuuggcuuaggcccagaauaccuuguuucuagaauccauccauuucuauucuggcagccugccuauggcaaguuagaauucaagaaacgacaaugacguuguuggauccaucacaggcaaaaauaaacaaugcccaaggccuugagcaggucuguuucuagggucuuugggccuuugaugagcugacagcuccaugaugucuaacuucucugccauguaccagcuguugugguaccaggaagcaguugcuuuuggagcaucugcuuuugucucacgaucccgcaggaggccgaagacccagagcucccaaucuggggccucugcacccucacuguuuguaaauaagguugcuaagcuugacccccugaugcugcacauacaaucucuggccagcuuucccugggcucugauuugccgagaccagaaugaaugccuuuccaaauccuguggaccacagcacagccuuuccaucuuuuaaaugauacgucaaaacuugccuccuuugggaaccucugccugaaucacucuaaauucauaaauccaccaucacgcgcaucgggcacaacuugcauuuuugacaugucagggugauagauaguaaaauaccacuguaccgcuagucccaagacccagggauuuauuccaacucugucaauaaauaauugugaucuugggccaaucacuucaucaaacuggcuuugauucacucauuucugaaguuuaacuuauugcuccaugagguuguaucuggguucuuuauuuacgaguuuuauguagggauuucuuguguguacauuuuaaaugaagagcguccaaucguguuucugguuacauuccuacggcaguguuuguggaguucugucugucuccgucuuggaugugcccaguggaugaggaaggacuuucccacagguuuggagaauuucucccuaucagaugaaccaagagaagacuaccaaacaugagacuaacuuuuaaaacguggguauuucuaauaagacaguugugagaauugguuuaaaucucggaucuaaagcggauuugcaagcagacauuucuuccaggauuuugcauguauaucauguguacgucucaugauauauauagauaaauagaacauucuuaaucuggaaauugaaguuauuagcuguucuuaacaucuaaaacuuguguggaagugacauucuugccuucuuacuguuguaaguggguagaccauuucauguucuaaacacugcauaaagugaccuucaggccauauguacauaggguauauaaaacaaauuuauuuuguauuuagacuuaagucccaaucuuaagauaucuccuuauguauauguaaauauuguaacaccuuaaccuccaaaccuucuugcuuuaagcauuuacgugcacccccccauauauguguguguguguguguauaauguaaauauauaaaauggagagcuggaucagugguuaaaaguacugacugcucuuccagagguucugaguucaauucucagcacuuacauagugacucaugaucaucuauacugggaucugaugcccucuucuggcauacauggagacagagcacucauauacauaaauaaauaaauaaauaaauaugcaaauaaaccuuuagggaaauuacguguauauaaauauauaucuuuauguaaauauauacauagacauauagguacauauguauauauacauacacaaauacacauacauaccaaccauccauauuaccugguuuguucuucaggugucuagcagguuuuaaagucuuucuuuaguuuaagaauuauuuuauaauaguacuuuauguguggcuuacaaacaauacagaacaucacaauguuaauacccacugcgugcuggcuuccuuuauuugcuucacgcuuggcaauacaaacagcacugacuggccuuuguacucauuauaggaagacaauuucauaagugaccauggcuggccuuacuuugcuccuucuugauugcaaaucugguuuagaguguacugagaaugccacacucugaggaaaggagggacuguccuugucccucccagaacagggacuccugcaguguuucauuccaguggacccaagucguuugugaggcauaaagcccauagaagagcgcuuuccuaaccccugagcugggguagaaauauagucaaucugccauccuggguagcuguccugagccucaagggauaggcuugccaggauccuagguuucuaagguuucuuguagccuaucugugaacaguaaaguagauaugccugacuuauaggaguggucugccauacuggacuugaacucuggcaggugaaauuguacaaaacuucccaccaguucuaggaccuggucaagcauuuagaauccuuuccuagggugcugaccucgugcauagggcucuauuucuugggauugauacugacacaugguauuucuguuuuuagugacauuggggauagcugcuauuuaaaaagauucagaauuauuuggaauauaaacacaggagagaggcaauggauagaggcuaugcauaugcuguguaccaggcccugugacagaaagcuuaggaaaaaaaaaaagggagaggaccauggaccaaaugaauaugcagauaguuuugacaucaccuugaagcaacuggccagaccaguggcugauucccaauccauauagcaggggugaaacggccaucucucuucaagcucuguuuucucccagauuuugacuggugucuugcacagagacauugccuuaaagucgcuacaauccuucacuucccagcgaccaagugaacuuccuccucguacaacaacgcagccaccacgauugccuaaaagcagaaaacacaccaucuuaauauaauaugauuggaacaauuuguguuccaaaagacagcucucuggaguuuugaauaauugacacaucacaaugaagcaccagagaagaacaauggagaugaagaaagaugcuucauuggcacaauuaucucauuucucuucaucucuggagagaagaacagaaaacaggaucaugagcgaaaagaggcugugaagccugaaauuuggacauugucugcuuugagcucacguggugagugaugggaagugaggugcaauuccgacgugaagcugaagaaugccccaccgcaccucauuucgaggaucacaaugagaagugcacaaugcucauccccugagaucgaggugcaucaggguaaacuagucagaugaauaauggauucaaggcagacaagaaacacaacaaagacccaaacucuaagccacaagccauggagaauggagaaaaugagauaaagucuugaaaugggaucucaggggguuggaggcagaaacggcagcuaucagggaaaugaagggagagauggcuucuaaaggagacacaaagcacacugagcucagugaguacuguguaaaauauuagagguaaaaugucuucaguuauggaugaaacuucacuugcucuuuuguguguguugagcacgaaauaacucuuucauagaaacaaguguucagaauucuaaugaagacuuugaagacauggauuuauuaauuaguccaggcuggguaucauauuugugaucuuccuuucucugucuccugaaaaaaaguguggaccaccaugcuuggcccaucaaaacaacaucuagacuaaaugaaguuucuuaaguuuguacaaaauguauacaauuuauaggaccaccaaaaaccuacauuucacauuccaauggauauuaguugaaaacaauccuguuauaaaaauuggaugagaccgacaggaacugaggagcagccugggacaggauccuuccaguuucugucuuuggccuggagcugacccugugccacagcucuccauacccaaaucccacugggagagagcuggucucccagaaguggugacacaccugagagcacaguugagaccaccacuucugcucaaauuccuggcccaagcgggaccuucccagagccaucaggacacaggaaccaaggaacagcagggaacaggauccuuccacuuucugucugugccccagagcagacccugugcuacagcucuccauauagaaauuccaccuagagagaacugguguguuccaggagugcugacacauagguuuacaggaggaaaaagccacagccagagacagccaagaccagcuaacaccacaaauaaccagaugguaagggcaagaacaagcaacagaaauaaaggcugcuuggcauuaucagaacccaguucucccccuacagcaagcccuggauagcccaagacacuggaaaaacaagacucugauuuaaaaucacaccucaugaugaugauagaggacuuuaaggacauaaauaagucccuuaaagaaauacaggaugccuuagucaggguuucuauuccugcacaaacaucaugaccaagaagcaaguuggagaggaaaggguuuauucggcuuacacuuccaaacugcuguucaucaccaagggaguaaggacuggaacucaagcaggucaggaagcaggagcugaugcagaggccauggagggauguuacuuacuggcuugcuuccccuggcuugcucagccugcucucuuauagaaccaagacuaccagcccagagauggucccacccacaaggggcuuuucccucuugaucacuaauugagaaaaugccuuacaguuggaucucauggaggcauuuccucaacugaagcuccuuucucugugauaacuccagcugugucaaguugacacaaaacuagccaguacacaagagaacacaguuaaacagguagaagcccuuaaagaggaaacacaaaaaaaucccuuaaggaauuacaggaaagcacaaccaaacaggugaaggaauugaacaaaaccauucaggaucuaaaaauggaaauagaaacaauaaagaaaucacaaagggagacaacacuggagauagaaaaccuaggaaagagaucaggagucagaugcaaacaucaccaacagaauacaagagauagaagagagaaucucaggggcagaagauaccauagaaaacauugacacaacagucaaagaaaaugcaaaaugcaaaaagcuucuaacccaaaacauccaggaaguccaggacacaaugagaagaccaaacccaaggauaauagguauagaagagagugaagauucccaacuuaaagggccaguaaauauuuucaacaaaauuauagaagaaaacuucccuaaccuaaagaaagagaugcccaugaacagacaagaagccuacggaacuccaaauagauuggaccagaaaagaaacuccucuugucacauaauaaucaaaacaccaaaaaaugcacaaaacaaagaaagaauauuaaaagcaguaagggggaaaggucaaguaacauauaaaggcagaccuaugagaauuacaccaaacuucucaccagagacuaugaaagccagaagauccuggacagauguuauacagacccuaagagaacacaaaugccagcccaggcuacuauacccagcaaaacucucaauuacaauagauggagaaauuaagauauuccaugacaaaaccaaaauuacucaauaucucuccacaaauccagucuuacaaaggauaauagaugguagacaccaacacaaggauugcugauaggaaccugauacagcugucuccugagagguuuugccacaucuugaucaauauagaugcugaugcuuguggccaaccaucggacugagcauggggacuccaaugaaggaguuagggaaaggacugaaggagcggaaggggcuuuaucuggcaucaaugggaggggaagcccuugguccuguaaagccuugaugccccaguguagaagaaugcuaggguggugaggugggagugggugggugggggagcacccucauggaagcaggguaaggggggaugugauggggguuugcagaagggaaacuggggaaggggauaacauuugaaauguaagcaaauaaaauauccaacuuaaaaaauaaaagaggaaggagccacaguuaagggaacaucuucaugagauccagcugcaaggccuuuucucaguuagugaggggauagccuagucucuguugggauggaugugguccuggaaagugguuuauaggggaguauguggagcaagccaugugaguaagccaguaagcagcaucccuccaugguuucauccucagugccugccucuagguuucugcucaguuugaguuccugucuuggcuuccuucaguuauagacuacaauguggaaauguaagccaaauaaacccuuuuacuucuuaaaaacaaauuggaugagacuaaggacugguuuagcuagcugcuucaaggaacagugccauugucccuguuuccccuugagugcaggcugaucauucaaugaacgaaacugacauucaacaacuaccagaaaggaugcaucuacaacaugcugggauacaggguagggucuucucaaagcagccaggggguugggggagcucagaaggagaaacagaguguucccaaagagcucugucagcaaagaguuugggaggugccauuugagcugauuuuugaaggaugaaaaaggaaaaggguuuucaagguggccuuauaaaaaucaagugacacuggaggagaggguacaccuggagacuccucaugacaguuuuggacauaaaagcauuuuaaaacuaugaaguuguuuggcaugagguauguaucugcuuuaacuuccccuuagaagaaauggccacuuuuuauuuuuagauagcagguagcuagaauuguccuuauguauacagacaagcuuaugcaucagacagacccacaaaggugaaacaagcaguuguacagcaggaaauacacuaagcauggcuuacauugaacaaagaaaaguguuggguuauacaaaggccaacagacaucuacaguggcccagacaacuacucagaacucaugauggaguugggauaggguagggaggagguaggcagcccaguucaugacaauguuuucugguccagugaguauaacuuugggaugaggcccgucacccagcuggaucguaggcacuagagggaagguaucugcuuucugaaguuaaguugaacuguggaacccagauguaaggcccauaugcacuacuacaccacugggcuguugugguccgugggaaacaaacagcucaucuaauccccccacccuuccuuugaggccuccuguuggggcuuucccacagagguaggaggccuucuagaaagaauuucuaagccuuaagucugugauucuagucucugcacaaauauuuaauaacuugacauuugaauggauuaauuaaccacaacaagucuuguugaaacuagauaaucccuuuucuacucaugggucuucaugaagaucaaaugaaaucauuauuaaaaaaggacuuugugaaacagaaagcuagcaccaucuuuauacuucuuaugggcguuuuuauuacaaaacugggauuuuuuuuuuuuaaugauauaaguucugcugugugcucaagaauguuuaaaagguuugacucagcaaguuuacaguaauacuuuuuuuguuggcuuugcauuuugucucacuuccccgcauuagacaaugauuaacuagcuauguuuuuagaugcuguggauauucaagucaucuucauuagugaggaaggagauguuuguggcccaccaugaagauggaaagugcugcaggaguguuauugguauucuaaagugguuaacuuaauguaucauuugacccaaauuuuagugucucagccccagagcagcaguaaacugguguaauaaagggauguugggcuaagggagacacacaaggaauuuguaagucaguuuguggggaagcuugccgagccaaauaauaagggagggauagaaaaaaggggcagaggcaggcuucucccaaaacacugccuuuccauuggauaacccacuucucauuggagaaggacugauaccaucccucuccucauuggugaaccuuaaaucucacauuuuaaugcauucucuugacccaccauuccacccugcuccccuucaccaucucccuaaaccaccaacagagagacuuccuguaacuacgaaacucaaauucaugaaucuagauuuucccaugugcggcagcuaaucacagaaagugaauugagcuguggaagcuaucaacuuugaucucucuggucaaauccuuagguauaauccaaccaaaucaaaucaauuguggucucagggcaggaaggaauuguucuggggcauggcgucucuagagaguaauuugacuuggucugguaaguugcuuccaauucccuuccacaggacucacacauucuuacuucuaagucucuaccugccucaccuucccucuccccucccucuucuacaguaagacagagcuucugggacagggaagguaaacuuugcugaauaccugcaaucugcuuagcacugugucagccacucuaugcugucuuucuucuguuuaacuucuaaaacucucagaggcagagacucugguagcauuuucugauaguaaaauugaggcucaaagauguaauaacuugccacaggcugcagacuuagagcacuugauccuagccuagaaacuggacuuaucagagucuaacugugagaugguacugaaacccagagauguauauacagcuccuaaaggaacaaguucccuugaggcuauggucccucugguacugcuuaggucucaucagcuugacaugaacugacacauauaugugaggagggagccucaguugagggcuuuccuacaucagauuggccugugggacauuuucuugauugcuaauuaaugcaggaggcccagcccacuguggauggugccaucccuaggcaaguagaccuaggcaguaaagaaagccagagugaacaagccacuaagcagcguuccaucaaggucucugcuucaguuccugucuccagguuccugucuugaguucuuugaugauggacuguuaugaucagaacauguaagccccauaaacauuuuccuucugucuuacauaagcaguucuuguaagggcaaacauuuaauuggggaugguuuacaaugucagagguuccguccauuaucaucaucgcaggaaguaugguggcguacgggcagacgugaugcuggagaaguucuacaucuuaaucugaagucagccaggaggagacugucucucacaggcagccaggaggaggcuucugauuccacacugggcaguuuuugagcauaggagaccucaaagcccaucuacacagugacacauuuccuccaaaaagaccacgccuacuucaauaaggccacaccuccaaauagugccacucuuuauggccaagcauucaaacacaugagucuaugggggacguaacuauucaaacuaccauacuuccuaagcugcuuuuggucagucuuuuaggaaagcuagugagaauaggccuccucuugcacuaaguucacguccuguguaccacccacuucuaguacccuccacccagcaugguucucuccuuguauugccacaagauucccuugaagaacgccuaucacugguuaccuugcuuggcuaugaagcaaccugcaaaugugcucagaaacaaggcugagcacauacccaguauguggcauuucauuucaaaacccagaggagccuuaaaccugaccaugcugaccaugguuuaucaaugugauggguuuccuagcccuugcacugugaagggcaccuugaaggauacaagucugucuggcuuugcugggguccaguugcccuuaacuggcagguuucaacugauuuggaagaacuagugcccagguacccuggaugguccuacaugacugaucaaggaaugguccugaugcagagcugaaguuacagaaugccaugaaauagugauuucaggccuucuuuuaaucuguugggacacaucugaggcacacacuuacccuagagaagcuuugugccaccuuacgaggagacgaccuccuguuugccccugcagggcucucuuuacuaacuggaucuguucucucagaucaaagaacauuucuguuucuaugcauuauucucucucucucuuuaaucaguagcaauggcuagugugguucaaaacuagcuuucaugguuuaaggaauguucuacuucucucaaaaugcuaaggcuggagaguccuuuugcuguuuuuuaaaaaaggagaaugucagaguuuccugguguugagagacuuaaggauuguggcauaaaagaaaauacagauaaaaggcaaauuaagcaauaaaucugugguccugaauugaaaccgaaauuauggguuugaaaaaaaaaucucauccucacaugugcagugcaagcaaacacacaggcaacacauuucccagaccuguccaaggaaauagcugauaaacaagaacaaacucacagugagcccccuuauggccagauuaguguagagauuacauuucuucccaucaaaggaaaaccuggggcuuccugaugaccuggugcaggaauucacuucuggucauagcaacagcaagggcauguggaagacugcaagggucgcauccuugaagacauugccauccaacagacagggcaugagugcuaggaacagcugcaguggauggagauagaccaaugcuuaaaguacuuacuucauugugaggcuggaggcaccccuuagccuccaaauacucacuguuggaagacacuaucgaggaaauaauccuucuggaaacuagaaaacuaggaagagaaauaugcgaagcaucuaugcuggcuuuccuauaccaucuguaccacaaagcaaagaaaacuguaaagaguugcuuucuuauggaaauaucccagcuauaaauugagacacuuagaacaggccaggagaugcaguuugguaggggagcccuuccuuaucaggaaaagaccuugaguuuaguccccagaccaaaacaagcaacaacaaaaccguacucugucaaaucaacaaaucuacauguugaucaucaaaaacuuccugucacaaagagaaaauuggacauucugauucuuuacacaaaacaaguaacuaccuaaaaauaguuuuucucaaguaaaauaaaccucaauauugaucaggucuuugauuaaacaaugagguguggacuuuagaaaauguauaggaugaauaacccucuuacaucaguaaagacacuacaaaaggaaaaagggauggauaagaaaccuagauguuaaaacaaacuuuaggaaacuuuacuaauauauuauaguauguaaauguuauuuagauccuuauccaaacaaaccuuaaauauacuacauaguaguuagaauauaugugauuaucuaucuaucuaucuaucuaucuaucuaucuaucuaucuaauuuagauauuugagcauuaacugaacgauucaugacauuaaagaauuauaguuuccuggaaaucaguuuggcaguuccucagaaaauuggacauaguacucccugaggacccagcuauaccauuccugggcauacacccagacgaugcuccaacauguaauaaggacacaugcuccacuauguucauagcagucuuauuuauaauagacagaagcuggaaagaacccagauguccuucaacagaggaauggauacagaaaaugugguacauuuacacaauggaguacuacucagcuauuaaaaacaauggauucaugaaauucuuaggcaaauggauugagcuagaaaguaucauccugagggagguaauccaaucgcaaaagaacauacaugguauguauucacugauaaguggauauuagcccaaaagcuccaaauaaccaagauacaauucacagaccacaugaagcucaagaaggaagacaaagugugggcgcuuuggucauucuuagaaggagaacaaaauacucauaagagcaaauauggagauaaaguguagagcagagacugaaggaaagaccauccagagacuguccugaaagauccugacagaauguaaaaggucacagaagcccugaaauuggcaaaaauagauuucauuguuaguagaacuagcuucacugauuagaaaaauagaggugcacaaugcucuggccgauccucgaaccugugugucugccaauguucugaccaggugugugcccauugcugcaccuucauuagacucuuuccuugucucccucccauacccauuucuugaagaaucaaucauuuuagaauagauauuguuuagaucuggaaauccccuacucccccccuucuccuuuccccucugagggccuauaaaaacugggaccucuuuccccuugagcucgacuccucuaccccugugugggauaugagucguccccagagcucuggcuuucccugaauaaagccucaugugguuugcaacaagcucggucuaucaugaguucuuggguguccgcuauuguccugaggccugagcgaggggcuccuuucggagucuuucagucccaccugcggauucaucccauauacagucaccaaaugcagacacuauuguggaugccaaaaagugcaugcugaaaggagccugauauggcugucuccugagaggcccugccagagccugacaaauacagaaacgaaugcuugcagccaaccauuggacuaaguugggguccccaaauggaggaguuagagaaaugacugaaggagcugaagggguuugcaacccuauagaaagaauaacaauaucaaccaaccagacccuccagagcucccagggacuaagccaucaacaaaggaguacacauggcuccaacugcauauguagcagaggauggccuuaucaugcaucaaggggagcagauguccuugaccuuaugaaggcuugauagaugcuccaauguaggggaauugaagguggggaggugggagagcauggguggguggguggguggaggaacaccuucauagaagcagaggaugggauaggggauuuccugggggggggaccaggaaagggaauaacuuuugaaauguaaauaaagaaaauauccaguaaaaaagaaaacaauagaauuauaguuucaaaugugaucauuguaguauguuucugacagggaaguccuuguauuuuagugauaauauugcgauauuuguggaugaaauauucugacaucugagaucuguuucaagaaaagacucagacaggacugggguuagaacugaaacaacaaugauccaauuauugcuuaaugguuuauuacaauauuuaaugaacauaagacaaaguugaaaaacauggcugaauugugcucucaucuuguguugcucaucuuguggguauaccuuaaggacagccuuggcugaguuuauaaaaagcuuuuggcuuccuguucaguggucaauuuagguagucaguuuaugcuggauuaagagucugccauggggccugagcuaauggauucuuuugugacaggcaggagaggagaugugauuuaaggugguguuucuacaagcugcaauuuaaaaggaaaagggaaacacagggcuuuuuauauugcuauuuuccccagaaacaauuuacauuuucaucuuauucagagacaauuuacucagugucagucagcacgugcagcccugccgagcaucacagcauuauuuuugcuucagggaaaagagagaagaauaaugccacucaaauaaauuacagcagaaacuuaugaaugacaggacgcugcgcuucauuuccagauuuuagacaucuaaauaugcccugaggaaguuaacaugggaaaccaaaaauuucgucggcucaaaauguauuaauuuauuuugacagguauagacacuccuaacaaaauuccaggauacagacgugauccuugaauggcuucuucuuggcugcacagugauacaaagugacacaguggcguucagaaugcagaaggaggggacuaucccauaacaccggccauggugcuuccuauaucugagcuguuugaagucaagagaguccuuaaaccaaugugugcacauaugcacgugcacacaaauacacacacacacacacgcucucacacacacacauacaauuugcuguaaugucacacaaaaaaugaguaaauauuuaaaauuguaauuuuaggucugcagaaagcaagaugggauggugaauguuccuguacaaccccuuccugccaccuguacagucucccucacuauagaugucacaccacagugacacauuugucacaacugauggacccacagugacacauugcaaucacccagagccccuucucaucccuguuaggcacuucauuuauacaggagaaaauguaggccugcauuucuauaucauuuuccuugugaggcaaggccagcuggcaaaauguccuucaauuuuuaucuuguaaaaauaguucuccuucagugucagaggauaauuucacagagcaagaacucuuagggguuucccucccaccuucaucaccagauauuucacacacuccuucuugccugccugaauucugaagaagucaggaguaauccuuaucuuuucucuagggcauggauggugcuuucucacuauggcuccuuugucuuuuauuuauccaaaguuugaaaaugguauguguaaauucuuagucaucuggggaaugaaaucaaaacuacuuugagauuucaucuuauaccugucaggauggcuaagaucaauaaaacaaaugacagaccaugcugacaaggauguggggguaaggagaacacuccuccauugucgguagagugcaaauguacagccauuauggauaucagugugucaguuccucagaaagaugggaaucgaucuaucucaacaucuaccuauacuauacacuuaggcauauacucaaaggaggcuccaucuuaccacagagacacuuguucaaccauggucauugcacaauaccgagaaucuggaaacaacuagauguccuucaacaaggaauggauaaaguaaaugugauauauuuacacaagggaguauugcucaguucuuaaaaacugaaaucauaaaauuuucagguaaauggaugaaacuauauuuuaaaaaaaaucauccaaguaagccagacucagaaagacaaauaccguaugcauuugcuuguauguggauauuagcuguuaaagcaauuaaaucagugauaacugucuuuguuaggauuucuauugcuaggaagagauaccacgagcacugcgacucuuguaaaggacaacauuuaauuggggguggcuuuauaguccugaaguucaguccauugucaucauggugggaagcaaggcagcagucaggcagauaugguacuggagagggagcugagaguucuacuucuuccugcuggccugacacugggccugacuuaagcaucugagaccucgaaacccaaccucagugacacacuuccuucaacaaagccucaucuacuccagugaacugcuacuuucuaugggucuaugggggccauuuucauucaaaccaccacgauaauccaugugaaauccauagagccacaaagguuagguauauagagaggaacugggggacagggaacaaauauauuucccuaggaaaaggaaguagaauagauagcuauagauggaagguagcagaggcaggaaugggaggaucaagcaggaaaugggagaggagagaaagaugggggaggauauagagggagagacagcuaaaauuaagggccauugaggagcaggguguaaucuaauacaguugaagauuugcaaaauauauacacauuuaugaaggugacagaaauaaaaucuccaaauaauggggggggggaggggaaacagagccccauuugaacauccgugucaccaaaugaaccuuucaguauugggaaugggcuguaucuaauugaguuguugaccaaaaggggucccaugggaauccccaaacaagccacgcugaugucaagauuguuccccacaaacugacaacauggcccuguugcugagggccacaccuguacaacucacugaacauggagaaggugagcugguaccuaccuagaguuuucacuccugugaguuaguguaguguucuugguacuagaagacacucugcacacugucaaaguaccuuuuauucaucugauguaacuguuaucuuagaggcauauugccugucugcuaaccuaggccuaguccugauagcuucuagccuccguacaaucuaaucuagcucuaggauguuuucagccuuugagacuuacuuacugcugaguaagcucacccuuccuaggucuaucugagcucugacuggcugaucaacucaacuguucuggcucaaaugacucuccaagaugacagacucaauacaguguaucucccucugccucuccugcuuggccucaaauuaacucuaguaauucauucuaaucuucuggcuccuucucauucucuggcucguucuaucuucaccuguaucuagcuuguucucacuuuaaccuguuucuguaaaacucuccaggcaaaacugucuccuuguauuucucugcauugcucucuguuaaguagcuuccauuuccucucuuccccugagaauuggacauaugcuauucugucaaaucuuucccugauucauuuugucugccacucaauuagacaucacuuuuaaacaugggugcuuccuucaacagacuaacuuuaccuucauuguuuaagauuaaagguguauacuaaguauuucagccagaggaauuaaagguguaugcugacggcugagccucaccacaacuagaaacaaguuuuuuuaacacaaucucaggucaggguucacagugugaucaaauauccugcaacagccaaaggagaaaaauaaauaccaauugaguuacaaugguguccugccugcaagauauguuagggcaaugguggccauaacacuugugggaguaaucaaccaauauuugauuugacuuagggcucacucuaugagauagaacccauaccuaacacagcuuacaugcuuaacaaccugagacuagaugauccagggaccuaggauaaaaccaaauuccacuguucuacuauaggaacauaacaaugagauuacuccuaauggcagucagugccuuguucagccaucgucacagaagcucccuccuacagcagaugggaacgaacgaaugaacaaacaaacaaacaaccccccccccccacagauccacagacacuauugagacauuauuguaacccauuguaacuggguugguguuuaugcacaaggugaaagauauaguccuuggaacacucaucucugagugggauacuuucaucaaauuccucaaggaucagggaacccccacagaagaggaagcagaaagaguguuagagccagagggaauggagggcaccaaggaaacaaggccucauaaauacaacaggacugagccacauaugaacucagagauugaggcaggauggugcuugcacagguuuguacuagaagggguccuagagcugaaaggagaagugggcacaugcccccauccucacccuaucuccaauugauaaccucguguaaaggaaagauuaguuuucucccaggaagucucacuggggaaaugaacuacucuuaagggcaggcugcaugucuagcaguagaugccaacagaaaacuagcucaaugucuucuuugagcacuccuugucucaugaugucauguuggaucuuuuuucuuuuaaaaauauuuucauuuuuguuucuuucuuaauauagguccuuuguguaucuauauggcuucugguuuuguguuuuuaugagauucuugaguaugcaaaugagucuuugguucucuacacauuucuugugccuuuucuugggcucuuucccuuugauuuguauuguccuauucugauguguuuggcuuugucuuaucuuguuuuacuuuacuuuauuauugucucuuagaugacugugugucuucuaaugggcagaaaagggauggaugugauugggaggugagguggcugaggaacugagaggaguagagagaggggaaaccguaaucaagaucuauuguaaaaaaagacucuaaucuaggagggggauaacaacuggacuguaaaaaaaagauuaauaauaauaauaauaguaaucauaaaaauaaaaaggaaagaaaaaggaaucuaauuucaauaaaagaaacacaaaaaagaaaaugaggggaagggcauuacucuuguuugguguucucugagcuucaagaaucuuugguuuggggacauucguugucugaggaucacucccacucccaucucucuucccauccuucugcuguucaucacauguauuuaaaaaugcuuuaaugauaccacaguucuuguguagguugcuuuugcuuucauuucccccccucuguuucuuagguuuuccuacauuucuccaucacaaccuguaguucaggguucccucgcuuagcaagugcaggguaucaauaggccacagguacccuucacuucggucggaguacuuugugucucucauuugcucucuugucuucuuccucagaaugcccauuacucugcucuccauuaaagccuucagaauauugaauauaauuccaagguugcuugaauuacuuacugucacaugacugguucugaugcuuguucaguuuuuuuccaucaguccauucugccucugagauugggacaguugugcugccacaggaugugauuugcuugguaaaaggaacuuggugaacaucugaggucgcaugucacagaggggcaugcucuaugcccucugagccugaucaucuugguuuggguucucgguauucaacugugagggcuuucucuucuuauggggacaaaauggcuggggaaggcuggaacugaguaccacacuuccuccaaaaacagucucuucggccucucucucagcuagaagcgugaggagacaguuuuccaaggcucacugugagaaccugacauuguuccugaaggcggagcuuacagaauggggguagagaagcccccugugauggcaccuccagaagguagucucucaguuguccucacccagccuccagcauccucauagguguguguugaguuauguugucucagcccuaggccccugcuuguaaguuucugcccuaggagguugagguucuguagucuugucugucucuucaauuuaagcagugguucucaaccuuccuaaugcugugacucccuuaaucagguuccucauguuguggugaucuccagcucuaaaguuauuuucuuuuuucuuuuucuuuuucuuuuucuuuuucuuuuucuuuuucucuuccuuuuccuuuucauccuuccuuccuuccuucccuuccuuccuuccuuccuuccuuccuuccuuccuuccuuccuuccuuccuuccuuccuuccuucuccuuccuuccuuccuuccuuccuuccuuccuuccuuccuuccuuccuuccuuccuuccuuccuuccuuccucccucccucccucccucccucccucccuuccuuccuucuuuuuucuucucuucucuucucuucucuucucuucucuucucuucucuucucuucucuucucuucucuucucuucucuucucuucucuucucuucucuuuucuuuuuuuugagacaggguuucucuguauaguccuggcgguccuagaacucauucuguagaccaggcuggccucaaacucagaaaucugccugccucugccucccaagugcugggauuaaaggcgugcgccaccacugcccacuccuaaaauuauuuucauugcuauuucauaauugcaauuuugcuacucuugugaauuguaauguaaauaucuguguuuuuugauggucuuuggcaacuccugugaaaggguuguuugauccccaaagaaguugugaccuauaagguugagaacuccugguuuagaugguaggguuuugcccucugaguuuuuuugaugcaucuaagaauuauuaggcgugcucagauuuuuuuuuuuuuuuuuugauggcauagcuacuucuacgcuucuuguaugcuggguugaaagucuuuggaaagcacagcuauuuaaaccauguagcuaacaaagagaauauaaauguccuucuuugaccuuuccauguuuuuuuuuuucuuaauucagguguucuaaagaacuguuuuuaaaagauuuaaagcuggguuauagguguuaaagaacagagacugagccagccuuuccuuugggaucuuauacuucuccagagugcucauguagugguuggcucaucccagaaugagaguauauagauauagagcauauagcugaggaauccuaacaggcuagcccagauauucuagacuuaagugagauauuacauauacauugugauaagaaaggcuaagauuacaaugcagcagacacuguaauauuuuauuugauucucacaaaaauguauuaagguagacacuauuaucuuuaacacuugaucuuaaucaucaagaaacagagauggagaaaguaacuuuccuaaaaucaucacaccuugaauaugacucaguaguggguacucuguacauauuaagcuaucccccacaugauuucucauggcuauuggucucaucuuaauaucuucagugaagacaagcauuuuugguguuaaggauggagccuagagucucaugcaggcuagacaagcacuagcuauauccacagccaagcaguucugaucuucguauuuacuugagacaaacuguuaggccucccauaccuacagaauaaggggaaaaucuugagcuuaaaaauuuaagcuguggggcuggagagauggcucagagguuaaaagcacugacuauucuuccagagguccugaguucaauucccagcaaccacacgauggcucacaaccaucuauaaugggaucugacacccucuucuggugugucugacgacagcaaugguguccucauauaaaacaaacaaacaaacaaacaaacaaaucuuuaaaaaacuguuaagcugugguuucacugccuuuggacuuacguuucauaauucaucuccauauaacuuacccucuagucauguggguucagaaaucucucagcaccgcuuuaugauuccuuggcucuguauuuuuuuucaaacuuaguaaauucuauuuccauagacaucaaauuugaccauuuuuuuaaauuagaguuguaacaguccuuccucuguggaagucuaugauagcucauuaccaauguuccuggcuuuaaccauuagagugcuguauuuuauauuauauacaacauucaucccgcauguuucuauugcuguggccuaaaugggaauguccuuuuaaaauugacacgcuggaaacuaauaucuaucgagauacuaaaaguacugauuuauaaauacugguguagaaaguucuucaggacagaccauaaguuaaaagauaaaagacugggauuagacaaaugaugcaguguuuaagagguuuggcuguucuauaggaccugggcucaaugcccagcacccacgugcuggcucacaaccacaguuaacuccaguuacaggggaucugaaacccuccucugccuucugugggugccagucaagcaaacgauggauggacauguguaggaggauguaaguccuuuuacuaacagauaagcacuaggggaaccaggaauguuaaacccauagguuuaccucugaaagggagagauguguaaccugauuucugccaagaagccuggaaguggaugcagguagucaccuggugaccuuugcacuaugugugugugugugugugggggcacacugaguccuuccccagucuguuaucucgagccuguucucuaguuaaucuacagaacucaucuuuauggaagaggugacuuguacuuuacaaagaauuuugacauagucaugucuuaaguuuuguuacaaaugugggacugaguuaauuaucaccaggagaccuuuuccaaauugugcuacacuuaaauaugccuaaaacaaacuacuuugagucagacucuugaaguuugaaccaaaaugggucauguugaaccaaacugucuuucugucucuuguggaucaacacucugauaacuaugaugucugcagagacccccauagacacauacguaggcaacacagcuguacacaaaauauaaaauaaaaaacuguaaacacauacacccaaaccagugggauggcacuaguuaaaaguggaaaguguugguguuaggaggugcggagaggacagucuuguuuuucuuacuguacuucucucuucuuuuaaaaaagaccuacauaacucauauagagucaucucaacagcuaaggcuagagcaaacauaggugugcuuaauugaugcaagauaauagauacagaucggaacugaucagggaaacucgugacguauagucauguuauccauaguaagaauuacugacaacuucauuguucaguuuuauaaaccaaugucacuuugccuaucauuguuuuggagguaaaauuaggaauuaaucucuggcuagacuuucauaguaaggaaaauaaagagggggagagacuggcuggaaagauggcuaguuagauaagacaccugcugccaacccugacgaguugaguucaaccugggaccugccugaucuuucaaguucuccucugacacuugcucuguggcacacacauacuauaaaaacaaaaccaaacccaaucguguggcuuuuuaaacaugaucucuauauaguccaagcuguucuccagcuuccuauguaguccaugcuaaccuccaacucaugaauuuucugcuucagccucacuccagugcugggaccacagggauguugugugcgccuuuccuugaguugucucguaccguuucacagcucacuaguacucuuuccucucuuuagcuugguuucuggauggacagauagauuuguacaaagaucccaugaccuucugcgaggacacagcuugaguccucacacacauuuccuucagauacagaggaaauccacugccuccuuuguacugaugaaacaucauagacaagaaguggaccaagccuuccaaauguauuuaugcugaaauaaagaaggaauguauagucuaggcugucaaccuaagcuuccccaggaccugaagguuauucuuacacagguucuacuguaggauguggccaaagccaaaagcauugcugaaauuggucaaccaggcacagauuugugcacugggacucagaugaacuaauagggcuaauaauagcuuugauaucaguacuucaggaauccaugaagacccacaagaacagcauuccagggaugccaugugguaacaacugugaccugguuagauggcucauuucuuauagcuggauuauucuagacugguuaaccccuugugauugauggaccaugaggagggucuguaggggaagacguaaggaagacaaaacucuccaagaacuaaggcaagucuguucuccagcgauagcugaaucccuggaaauaucacgauacauauaaaccuuaaaacggccacccuguguugccuuacauagaccucuuaugaucauuuuagugacaagagauauuaagaaaacauuaauggagaauuuaaggaaaugaccgaagguagagaggauucagggucaaggauauagguuugcaggggugagggugggaguggggugagcugggguuaugagggacuacucacuggguugacgcguguuccaguauguguacugcaccggcucccucugccccacggucuuccaaguguacucuccuguauuguuuuggucuugaagagcaauccaaaaauaacuguccuuuucugccacacuacugaucaaacugguaauaaaagcuuguucaaaucuugauagaaaaaaaaaaggaaauuguuauacuaaguuucuggacgauuaaaagugucauuaaagcauaauaaagugcacaggauggaauccaauaagcaauucuuguuaauucucuagaacgcaggaccaggaaaaccgcaagacuuuuguauuguuaauagacaggaaacaucagugcaacucagagauacaggaguggagacuccuaagauuaugugacucccuaagacuuaacucuuguuacugucccgagggccggaguccaggucugauucuguggugaaauggcagucuucacacacacagcaaugcaucucuuggagaaagaugucuauuuuacauguaggcugcacagcacacacuguaugcaugggcuaggagggaggagggaggacuuuaugcuuuucugaaugugcguuuucuaccacguagcacaccggugccuucuccccacacucgcuuaguaagaaggaaaguggaggaggaacaaugcuaugccucccgaaucagucugugcacgggcauauggagucuuauucaaauguguucaaaaguguauuuucacugaagauaaauuucaacaaauccaaggcauuccacccacucgcauuucccccaagcagcugaaugaauuugcucccaaugauugcuggcaaugcucccuuucaaauacagauacauccaaagcagaugcagacagcuuguguauacaugcuuauacacacacacacacacacacacacacacacacacacacacacagaaccaaagcaugcacaccaaacucaacuagcauugaauucaaagcuuaguuuaaaacuucauucaaagcacauauuagaaggauguuuaaauggugguaacuucuggccagaucugaguggagagaaaauugaaggccugguacaauuacccaagaaaccucaggagaaagggcacuggacuuuuagcauucacuuuuggauucucuuuauucgcgcauuauucacuugcuacggagagcaaaagcagggaggccauggguaaucagaggagacucaaagggaaggggaaggaagggcagaaggacaaaaaguggaacagugagugccuaaggccaccccaggggauuucagugaaggaccugaggaguucccuuugucagagcaugugggcuucaucuugcuuuaguaaauauuuccuacaaaugcucuaucaacagucuaaaucuuacacuuuuaaaaucagaaacgcuacacgucagaggcagaacguugcacacgcacguuucugaggaagauauguaaagcuaaauauuggcuagaugcuguggugauauuccuuauucuuuauuggcuugugcggucacaauagaagaucugcuguauggugccuucucuuaccuagaauugcugugcuacaagccagagacuaguugcuguguuguugcuaaguccaaggcuaggauugguucuuccauuaguuuaucaaauuguaaaaguaccuuuuauuggccagauguaauugucaucuaguaggcuuacugccucagucugcuaagccaggacuaguccuggaagcuucuagccuccgugcacucuaaucuaggcucacccuuucuagcuucugugcucugacugguucaacucagcuguuuuggcugaaacucuucuccaagcugacugauucagucuuacuucucuguuuugcacuguauugcucugcuuggccucaagcuagcuaacuuuggcaaucuguuuuaucuucuggcuccuucuugaucuuggcuucgucugccucugcucacccgcacugaauucaaaggacaaaauagaacugacuccugagugcugggauuaaagguguguaugacuccugaaccugagcuuuucuggaaaaaaaaagcaccuggaacuugcucuguaccaggcuggccuugagcucagagaucugcuugcuucugucuccugggauaaaagacuuaucuguacuuuggccaauguagucagguugcuggauuaaaguuuuucuacauuaaauaauagcaagaaauaacacugucuguaaacuuggccuugagugucauuauuuguacaaacagugcguuuguaccguguugauuauagauuuguucacuccacucugauuugcuauuuuaucuucaucauuguuugagacaauaaaaacauguuuuuugauuugucaaugcuauucuuauggaguacauauacuuuuuuuuuuuuuccagaaaagcucagguccaggagucguacacaccuuuaaucucagcacucaggagucaguucuguuuagucaguugaauuaaguguggguuagcagaggcagcugaagaugaagaaggagccagaagaacagauugccaaacauuuaaauaaaaaaaacccacacaaaacccacuaaacuuuccucaguccaguuuacaagaugguaccauuaguaaaauaauucagcaagcucaucuaagccaaacauguucuuuugaagcuguguggggagugcuuuggguaaccaugcaugguccagggcaagcucuugaguaucugcuuccaguuaacaaagaagcaauuuuacauucuuuaccacuuuuugucugguuucaaacacuggaugaaaaaacucugguuauaauuuguagaucauaucugagaagauacaccaugaugaaaggauuuaauuuggguucauggucuauaggguuagcaucuaugaccaucuugguggguaacauggcagcagucagugaggcauggugcuggagcaguagcugagagcuuacaucugacccacgagcaugagacacagaaaaagaaagagaagagagagagggauagaggaggagagagaaagauagauggagagggaggggagacaaaggggggagaaagagagagagagagagagagagcgagcgagcacacuaacugggaaugaagguaggcuuuggaaacuucaaaagccaccuucaccguuagugaaacaccuccuccaacaguuuuacacuuuccaaacaguuuuucaaccaaaccuucaaauauaugagccuauguagaccauucucauucaaauggccacagacaauaacauuuacaauauuuuuacucugguguuuuagaaguauuuacugaaguucagaguuagcuauauaucaucuggucauuuuguuugaauuuacugauguuaauuuaaauguugcuaugguguaagaaaccaagauuguuguauauacacaguuuuauguuauccuuugaaacaagagaaguugucuuucuaucucuaacaauaaaugauccaaaaaugaagcuaaggaaagaaugucauuuacaucuccaaaaugacauccuuaggaauaaagacaaacagggaauagaaaguaccaaauaacaaaaauugcaugaugcuaauuuaaaaaaaauaucaaauauacaaaaugaauuggaugauaucccacauuuacagccgagaaagcuuacuauuagcuuguccacacuaccacaguggacaauauauucaaugcaaucacugaaaauuccagugauuugcuuuuucagaauacaaaauuuaauucugaaaucuauguacaguuucaagggaucuugaauuccccaaacaaccacaaaaaagaacgaaguugggagucucagauuucuuauuucaaaaccuacuuuaaagcuacaguaaccaaaacagugcugugcuucugugagacugacuuaugcgagauccguggaauaagauggaagaagccacaaaauaaaaccuugcauauguggacaaauaauuuccaggaaaagcaccgagaacauuccauguagaagauccauucuucuaacaaguggugcuuggaaacccagauaggcauuugcaaaacaggaccuucccuuaaacuguguuaaaaaaugaacucaaagcagaucaaagaccuacagauaaagcuaaaguuguagaauucuuggaauaagaaaaaccuuauggcacuggauuugguaaugguuuuguggauaugacaccagagagacagacaacaaaacagcagguaaucugggcuucaucacaaugaaaagcuuuuggacaucaaagaucaaaaacagaaaaggcaaacacaaauugaagaaaauauucccaaucauguauuagauaaggguuuaauauacaaacuacauaaagagcucuuauaauucaaccauacagauccuaaguuuuaaaagggacauggauuuaaauagaaauuucucugaagaugguauacaaguggccaauaugcacauuaaaagguguuaaacacugauagucaagagaaauaaaaaucacaguaaccaugagauacuuaguacgauggcuauuaucaaaacaggagaaaggaagacaacuggaagauaagaaguaaaguccagaauauggagacacggguguccugugugcugcucaagguacaaaaugguaugaucaucauggaaagcaguuuuguaauuuuucaaaauuuuaaaaauaaaaucacaugauucacuaaucucucuucugacuauauccucaaggaauuuaaaguaauaacucauauuuauuuauuuauuuauuuauuaauuuaaagcaucauuauucauaguagucugaugcuggaagcaauguuuggugguuugaauagguuuggcccucauagacuuguggguuugaacguuuggcccauggggaguggcacuauuaggagguguggccuugugggaggaaguguuucacugugguugugggcuuugaggucucuuccuaugcucaggcuccgcccaguguacaagagacccuuuugcuaucugcugugggagacagucuccaucuggcugccuuugcaucaagauguagaacucgcccucagagacuagucugcacaggugagaguguggacuacagaagcuaacagcuucugggagaggcagaagucacacagcaucuggggcagaccccguuucgggcuccagacaucuggguaccuucccugccagaggagaaguauuugccccgcccgggaggguuuugccggaguaccugggggagccauuuuggucugugaucucucagagacuagacuguguaggugagagugccgacuacagaagcuacacagcuucugggacaggcccuguuucaggccuucaucuucugccaggaggcagguccgaacgccagauaucugugcaccuuccccgcaagaggagagcuugccugcagagaguacucugaccacugaaacucaggagagagcuagucucccaggucugcugauagaggcuaacagaaucaggggaggaacaauaucuagccagagacaacuauaacaacuaacuccagagauuaccagauggcuaaaggugaaacauaagaaucuuauuaacagaaaccaagaccacucaucaucaucagaacccagcacuuccaccucagccaguccuggauaccccaacacacccaaagagcuagacccggauuuaaaagcauagcucaugaugaugguaguagaggacauuaagaaggacuuuaauaacucacuuaaagaaacgcaggagaacacugcuaaagagguacaaguccuuaaagaaaaacaggaaaacacaaccaaaagguagaaguccuuaaagaaaaacaggaaaacacacaaggugauggaauugaucaaaaccauacaagaccuagaaagggaagcagacacaauaaagaaaacccaaagugaggcaacgcuggagauagaaaccuuaggaaagaaaucuggaaccauagaugcaagcaucagcaacagaauacaagagauggaagagagaaucucaggugcagaagauuccauagagaacaugggcacaacaaucaaagaaaaugcaaaaugcaaaaagauccuaagucaaaacauccaggaaauccaggacacaaugagaagaccaaaccuacggauaauaggaguagaugagaaugaagauuuucaacucaaaggaccagcaaauaucuucaacaaaauuauagaagaaaacuucccaaaucuaaagaaagagaugcccaugaacauacaagaagcauacagaacuccaaauagacuggaccaaaaaagaaauuccucccgacacauaauaaucagaacaacaaaugcacuaaauaaagauagaauauuaaaagcaguaggggagaaaggucaaguaacauauaaagguaggccuauuagaauuacagacuucuauaauuacagucuucucaccagagacgaugaaagccagaagauccuggacagauguuauacagacacuaagagaacacaaaugccagcccaggcgacuauaccuagccaaacucucaauuaccauagauggagaaaccaaaguauuccaugacaaaaccaaauucacacaauaucuuuccacaaauccagcccuucaaaggauaacaccagaaaaaaaccaauacaaggacagaaacuacgcccuagaaaaagcaagaaaguaauccuucagcaaaccuaaaagaagacagccacaaggacagaaugccaacucuaacaacaaaaauaauaggaagcaacaauuacuuuuccuuaauaucucuuaauaucaaccgacucaauuccccaauaaaaagacagacuaacagacuggcuacacaaacaggacccaacauuuugcugcuuacaggaaacccaucucagggaaaaagacagacacuaccucagaauuaaaggcuggaaaacaauuuuccaagcaaauggucugaagaaacaagcuggaguagccauucuaauaucgaaugaauucaacuuacaaaccaaaguuaucaaaaaagacaaugagggacacuucauacacaucaaagcuaaaaucucccaagaggaacucucgauucugaauaucuaugcuccaaaugcaagggcagccacauucauuaaagaaacuuuaguaaagcucaaagcacacaucacaccucacacaauagugggagaauuuaacacaccacuuucaucaauggacagaucauggaaacagaaacuaaacagggacacagugaaacuaacagaaguuaugaaacaaauggauuuaacagauaucuacagaacauuuuauccuaaaacaaaaggauauaccuucuucucagcaccucaagggaccuucuccaaaauugaccauauaauuggucacaaaacaggccucaagagauacaaaaauauugaaauugucccaugcuuccuaucagaucaccauggacuaaggcugaucuucaauaacaacauaaauaauagaaagccaacauucauguggaaaaugaacaacacucuacucaaugauaccuugaucaaggaaggaauaaagaaagaaauuaaagacuuuuuagaguuuaaugaaaaugaagccacaaaauacccaaacuuacgggagacauugaaagcauuucuaagaggaaaacucauagcucugaguaccuccaaaaagaaacuagagagagcacacaguaagcaaauucacccaagaggaguagacaacaggaaauaaucaaacucaggggugaaaucaaccaaguggaaacaagaagaacuauucacagaaucaaccaaacgaggagcugguucuuugagaaaaucaacaagauaaauaaacccucagccagacucacuagagggcacagggacagcauccuaauuaacaaaaucagaaaugaaaauggagacauaacaacaaacccugaagaaauccaaaacaccaucagaucuuucuacaaaaggcuauacucaacaaaacuggaaaaccuggaugaaauggacacauuucuagacagauaccagguaccaaaguuaaaccaggaucaaguuaacaaucuaaacagucccauauccccuaaagaaauagaagcagucauuaauggucucccaaccaaaaaaaaguccaggaccagauggguuuaguguagaguucuaucagaccuucaaagaagaccuaauuccaguucugcacaaacuacuccacuaaauagaaguagaaggaacucuacccaacucauucuaugaagccacaauuacucugauaccuaaaccacagaaagauccaacaaagauagagaacuucagaccaauuucccuuaugaauaucaaugcaaaaauauucaauaaaauucucgcuauucgaauccaagaccacauuaaaacaaucauccauccugaccaaguagguuuuauuccagggaugcggggaugguuuaauauauggaaauccaucaacguaauccacuauauaaacaaacucaaagacaaaaaccacaugaucaucuccuuagaugcggagaaagcauuugacaaaauccaacacccauucaugauaaaaguuuuggaaagaucaggaauucgaggcucauaccuaaacaugauaaaagcaaucuacagcaaaacaguagccaacaucaaauaaacggagagaaacuugaaaugauuccacuaaaaucugggacuagacaaggcugcccacuuucucccuaccuagucaacauaguacuugaaguccuagccagagaaauucaacaacaaaaggagauccaggggauacaaauuggaaaagaagaagucaaaauaucacuuuuuugcagaugauaugauaaguauauaugugacccuaaaaauuccaccagagaacaccuaaaccugauaaacagcuucagugaaguagcuggauauaaaauuaacucaaacaaaucaauggcuuuucucuacacaaaggauaaacaggcugagaaagaaauuagggaaacaacaugcuucacaauagucacaaauaauauaaaauaccuuggcgugacucuaacuaaggcagugaaagaucuguaugauaagaacuucaagucucugaagaaagaaauuaaagaagaucucagaagauggaaagaucucccaugcucauggauuggcaggaucaauauaguaaaaauggcuaucuugccaaaagcaaucuacagauucaaugcaauccccacaaaauuccaacucaauucuucaacgaauuagaaaggacaaucugaaaauucaucuggaauaacaaaaaaccuaggauagcaaaaacucuucucaaugauacaagaaccuccgguggaaucaccaugccugaccuaaagcuguacuacagagcaauugugauaaaaacugcaugguacugguauauugacagacaaguagaccaauggaauagaauugaagacccagaaaugaacccacacaccuauggucacuuguucuuugacaagggagcuaaaaccauccaguggaaaaaagacagcauuuucaacaaauggugcuggcacaacuggugguuaucauguagaagaauucgaauugauccauuccuaucuccuugcacuaaggucaaaucuaaguggaucaaggagcuccacauaaaaccagagacagugaaacguauagaggagaaaguggggaaaagccucaaaaauaugggcacagaggaaaaauuccugaauagaacagcaauggcuugugcuguaagauugagaaucgacaaaugggaccucauaaaauuacaaagcuucuguaaggcaaaagacacugucaauaagacaaaaagcccaccaauagauugggaaaggaucuuuaccaauucuaaaucagauaggggacuaauaucuaauauauauaaagaaaucaagaagguggacuccagaaaaucaaauaaccccauuuaaaaaauggggcucagagcuaaacaaagaauucucaccugaggaauuccaaauggcugagaagcaccugaaaaaauguucagcauccuuaaucaucagggaaaugcaaaucaaagaaacccugugauugcaccucacaccagucagaauggcuaagaucaaaaauucaagugacagcagaugcuggugaggauguggagaaagaggaacacuucuccaucguuggugggauugcaagcuuguacaaccacccuggaaaucagucuggcggugucucagaaaauuggacauaguacuaccagaggaucccgcaauaccucuccugggcauauauacaaaagauguuucaacugguaagaaggacacauacuccacuauguucauagcagccuuauuuauaauagccagaagcuggaaagaacccagaugucccucaacagaggaauggauacagaaaaugugguacauuuacacaauggaguacuacucagcuauuaaaaagaaugauuuuaugaaauuccuaggcaaauggauggaccugugagugagguaacccaaucgcaaaagaacucacaugauauguacucacugauaaguggauauuagccccgaaacuuagaauacccaauauguaagauacaauuuccaaaacacaugaaacucaagaauaaugaagaccaaaguguggacacuuugccccuucuuagaauugggaaugaaacccccauggaaggaguuacagagacaaaguuuggagcugagaugaaaggauggaccauguagagacugccauacccggggauucaucccauaaucagccuccaaaugcugauugcauacgcuagcaagauuuugcugaaaggacccuauuauagcugucuccugugaggcuaugcagugcccuagcaaacacaaaaguggauacucacagucagcuauuggauggaacacagagccccaauggaggagcuagagaaaguacccaaggagcugaaaggaucugcaacccuauagguggaacaacaauaugaacuaaccaguauccccuggagcucuagcugaauauguaucagaagauggccuagucagccaucauugggaaaagaggccccuuggucuugcaaacuuuauaugccucaguacaggggaaugccagggccaagacgugggaguggguggguaggggaguguggggagggucugggggacuuuuaggauagcaaaauguaaaugaagaaaauaccuaauuaaaaaaauuuaaaaaaauguagaacucucagcuccuccagcaccaugucuuucuggacgcugccaugcuuuccuccaugaugauaauggacugaaccucugaaauugaaagccagccccaauuaaauguugucuuuuauaagaguugccuugguguuggugccucuucauagcaauggagacccuaacuaagacacaauucaaaugucuauugaugaguaaguuggaaaacauacugugcauacaaacaauggaauauuagccuuauaaaggaaggaaauucugacauauguugcaauguguauaaaacuugaagacacugugcuaagugaaaugagccagguacaggucuuacuuaagguuucauugcugugaagagacaccauaaccaaggcaacuguuauaaaggagaacauuucauuggagcuggcuuacaguuucagagguucaguccauuaacaucaugguaggaugcacggcaguggucaggcagacaugaugguggagaagccaaaaguuuuacaucuugauccaaaggcagcagaaggagacuagauguguuucagacuggauguaacuugagcauuuaagaccucaaacucucaccuccacaaugacacacuuccucuaagaaggccacaccucuuccaacaaggucaaacauccuaauaguaccacccccuauagccaaauauucaaacacaugaaucucuaagggccacaccuauucaaaccaccacauguagcaacacagauauaagauggcccuauuuauaucugauaccuuggauggucccucuucuagagacugaaaacagaaaacuguucacugggagcugagggugggugagggauggagaaucaggaaggauuccugaaagaguaugggguuuugccugucagaagaagaaccaugguccggagacagaugguacugguggaugcucagcaacgugaaugcauuuaaggccacugaugcucucuuaaugucaggacagggguacauuuuacuucacgaauauuuuaccaggcuaauucuaauuuuguuuaggggaauauggcuuucaaaacaggagaaugugaacuauggcaguauaucucuuuuugggguggcaaaaaaaaucaagcaucauuugcacaaaacuuuucaaggcugacugguucaugcuuuaucgacuuagcuauuaagcaugugguaucaugguaauucaguuuuguauccuguucugucuggaagcaaagugaccggaccuaaaaagaguuuuuuuuguuuguuuuuuguuuuuguguuuguuuuuuaacaguagucgaguaaaucaaaaucuguuauucagauggaagggucuuuuuuucccccuuuguauuccacaaugaauuuuuaaaaaguccuaacccugagcaaaaacacagaacaaaagucauuugcagcaggugcucuaauuacacccaucaaaccugucacuccacugugcagacaguggaaaaccaauuaacaacuacaagcuuaggugcucagagugguggagagucaaacaggauguuggcgauggagguacgugauucccaagcccgucugugggagcuccuggguuugaggagccuucccucacacugcccauguuucucagacaagucccgcugcagaauguuccagcacugauaaccacuugccuucuucccucauggggucugaaugaaaugagggcccacuuuucucgacccaagaguaucauggcggagccucugcuuuggauguguccuuguuuguggaggugaguccugaugcugacugacugagugcgagagaggucacaucguuggccucauacaguccugcaggcucuguggagacuggaggcaugccaacacaugccaguacaagguaaccuggaugggccuacacgccuugcgcuggcuaaguuuuauggcaacuugauguaggcuagagucaucucagaagagagaaccucaauugagaaaugccuucagaagaugggcuauggguggaaaagucuauagaacaucuucuuaacuuaugaucaaugggggagggcccaacccucgugggugugcuaucccuggucuggugguccugggugcugguagaaagcaggcugagcaagccaugaggaauaagcuggcacacaacccuccucaggccucugcaucaccuccugccuccagguucccacucaguuggaguuccuaccuuggcaucccucagugagcugugauucaggaucuguaagccaaauaaaugcuuuccucccagguugcuuuugguacugguguuuuaucauagcaauauuagcccaaaauaagacacggcugaaauuaacauaaaaauuaaauugugugauacccugcuuuagagucagaguguuccuaaggguuggcugcuaaauauaguaugcaaagcaagcaacaucaacaacaacaacagacaaacaaaacaccccacaaauguuuacagaauccgcugguauccagcuuggaggaaucgaaacucucuaacaguagaaugagguagacuaugaggaaugugaacucuaacagauuucuguguuggauugggcucuauggcacucuuagcaaucugcaaggcugcuacuccaccuccuugaccuguuucaugucugcaauguuuggucucuucaguuccaugcuguagaaggcucagucauaccaccugcauuucuucaaauagcauguaguguuuaguauggaaucuuuuacaaaauuguuagucaaugaguaauuuucaaauaaacucuugaauauauaugaggacacacacauauaugcacacacacacacauaugcacacacacacacauaugcacacacacacacacacacacacacucacucgugcacacacacaggccagauagauaaccuguguaaaguaauuaacauugcaugagaaagugacugcuuugcacggcugucucaccagccagcaugugccgagggguuuuccuagcuggguuucuuuaccuccacagauagaugggugaggcgggucacaagaccuucaucugaguauuagcuguucuguacugccugauaauuuaggucuggaaagacuaaggggggaggauucuccaacgaaguagcuaccugggagcccucuucccugcuggacaaaggauuuccagguguggccggucggggaaggaauauuccauguuccaguaaauaauuuaugcuugaaagaaagccaaauaaacucaauggcuucccagagugaacuuuagcagaauagugccucaauuugugauugggaccuuaggaggagggguagcccuuguuucuaucuccccagggaaagaaauuugaguuacagugauagacacucaacgaauauugaagaaaacugagauauuaaaaagaagaaacaauuagacuucaaugaaaucauaauuaauaaaagaagcuagucucauugggcaggcuccuauaauguccaauuuugggucucuaacugggagacuugugaccccaagugcucuuggagcuuugaggagcugaggacacaggggcuccuucugccuggaagcugugucugggagggaggaagggagaccuagacauagcaccgagaucuagcaagcuuuugcugugccccaugagagccacucagcccacuaacaccgccugccuuuccauucuucuggguguuaggcucauucccaagcacuguguggacgacagaagagggugggaggggaaaggccaugauaacggcugucaauguggacuuccaaaguagggagagcagggugcccaugugugugugagacagucucucuaauggagcccuggcuagcuuggaauucacugaguagaccagguuggccuugaauucacagaaguggccugcuuggcugauacaguuucccauagaacuccugaagaauucuacccguguuaggaauagaagaguuagucccucagcccucaguguccugggcauugccaugacacaucuuucuuaugacauuuuuuuauucccuuuacacauuuguaacaugcuucaaauuguaaauacgaaaaacaggcagagucucuccguugguaucaggaagacagccauauacagagcaaucuaaguuuaaauaaaaccccuaagacacauuugccugccccuucgauuuccuucuauuuccucuucuaugaaacaaaccacaacuucuaaccaucacacuuaaaaguacuguucagugacauuuucuucucauuacaaacagaagacaaacccaaauauaccugucuaugucaaccaagcuagaaaccaacgaacguucuuagaaaguaaaggcuaccuuaagcuuuaguguuuaucauuuaaaaaaaaaaaaaucaaguuagaaauaacaccagggggcuggugagauggcucaguggguaagagcacccgacugcucuucugaaggcccagaguucaaaucccagcaaccacaugguggcucacaaccaucccuaacaagaucugacucccucuucuggugugucugaagacagcuauaguguacuuacauauaauaauaaauaaaucuuuaaaaaaaaaaaaaaaaaaagaaauaacaccagauuucgacucuucuccauaaauacucaaaaucaguuaauauucuacugcacacacguuuuagacgugggcgagcccaguggaccgauguucugccaucgcacagcccaggccagagcagaggccgcuuagagaguucgcacuuaccggcuggugauggucaggagcgcaggagagcaguaauagccacucgaagccuccucaaagcuucgcaggacugugucgauuuuguaacaaaaucugccgugucucucccagcccuuagggggugaaaaacaagacccagaaagaaaggacacaaugugauuuaguuaaaugcccggagagccccuccuucccacuugcuccaccuucuuuucugacuuggaguuuuauuuccauagagcucuauguuuguucccucuggaaaugccaccagucacagcccgguccacauuuaauuaaauacucaguuuacauuucaaaaaaauauaaccaucuuaaaaacaaacacaacugaaaacaauggggaaacccugcaaaaacaaacaaacaaagcaauaaggagauacucacgcaagagccaccauucuuuuucuuaggcucacagaauuucuuucaaauggaugugauguuuggguuaaaauauaguauugaccauggagggaggaugguuugaauugguuugaauucuggguuccccacuaagccacuuuauuuauaaauaauggaugugcuuuaagagacauaaucucuccgcaucuaguuuccucaucugugggcugaggguaagaauaacguccauggcugucccaaggagcaaaggagaaaaggcaggggaauccuugagugggggaaaacgcggaggagcagugaggcccggccuguagguagugcggagugugauggauggaguuuucaguuugauuucacaauagcuguuuuggguuccuaggggcuuaaguagaguugcuaacagguuggucaucugggucuauacugaaguuuaccuaguucuucuguaaucugaggcacuuuuucguugcugcugccacugcugccguuuugagucaugguagcccacaccugucuaaacugucaccuccuaaguugccuaggcuauacucaaacuucugccacaacauccugcgaguugggacuacaagagccauugaguccagguaaagcaacuguuuuuugucuuuuuuuuuuccaugcugugcauggaacccaggggucuuugcacacuuggcaaguccuuugcaacugagcuacauccccagcccccaggacagucuuguuuggcucauaauguuuccaaguagaaacuaacucccuaauacagacacacacacgcacacacacacacacacacacacacacacacacacacauacacacacacacacacacacacacacacacauacacacacacacacacacacacacacacacacacacauauauauggcuaagguuuuuccccccaaauuaagugauuguccuuuggaguaguaagaauguaaguuuggggacuuagaugaagaugaaaauguguagcucugucaguuagcaguaggagcaagguagggcaggucucuuccuuaaaaucauaucgugaaguggcuauucauuuauucuagcacaccugacuucacuucugcuuccuacaccaccaggucacaugacucugucuguccguguuugcuuccucaccaguuuaaaaugcucaucauuuugugcccugucagugaacaccaccagcuuuugaucagacacaagaugauuucuaggauauuucuuggaaaaggucuuaguucugugguuaauugcagaacacuuuagaaauuggcuaauucagcuaaaacaacaccgcaguaaccaagccaacucacugguccguuuuccuccugucuguucuggggccagacucagccccucaggugccccugggcuguccuuggaaggacaggaggaagagugacuuauauuugacuuuucugacaaaauauuucuuauuuaauaguaauuuuuuggcuaauaagauggaagcauugcucacacagcccaacaccccaaaauuacucagcgggaaauaaaaauuacuguuuugcuuuugagguaaucaauguuuuuguuuuuaaauuguugcuguuuuguuuuuuagauagggucuuauuauguagcaaggcuggccuggaacuugcuauagaguucaggcuggucucaaauuuaugaucuucaacagcuucuugaguauuaggguuguaguacaugccuggcuucuggacucauuccauaaauuaauuauacaugugccaauuacuuagcaaguuuuacugaaacaaugagcuaaaacaaaacaaaacaaaacaaaacaaaacaaaacaaaacaaaacaaaacaaaacauuaggaagccauagcccuaaacugauacaaaauaaaacauggcagugcucgcaguacucaccgcuggacauccggacugcucaucagcagggacuugcccugcuuucuuacaaauauaaaagagucuuucuuuacaaucuuucacuuuccagcguccguccuaaagggaaaagugucacaggaugaaugagugaacuccggacaggacguugcucagucaugagcagagcucugaauagcaaguguucccagugggugguguuccagaacccugcauggucacacaacagccugguagcugcuucuugccugaggcagucugcucgggguccagaccuggguggaccccagugagguccagagcuggguggucccgagugaggaagggauuugguuggugcugggaauacgcagaaacugccaugacucguccccaggguuaaaauucauguucaacuccaacguccuuccucacuaagcuuccucuuuaauuaaucaaauauuguuauuuuuuugagaguagaucuuaacuuugcaguuucaggcucaggcuagaacucagaacacagccuagauuugcuccagcucagcagucuuccugccuuggcuuccuaagugcuagggcuaggauuacagauauuccccgggcccagcguucuucucuccuuuccugucccucccucccucccucccuucuucccucccuccuucccucccuccuucccuuccuuccuuccuuccuuccuuccuuccuuccuuccuuccuuccuuccuuccucccucccucccucccucccucccucccuuccuuccuucuccuccuccuccuccuuccucucucucucucucucucauugguguauauauggugaauguacauguucauguguaugcagauauguauauguuggggguuggguguguaugcacgcauguaaaccagaaguugacauugcauggcauucucaauugcuuuucucauuuuuugagcaauggccucucauugaaccugagcugaucauuuggcuaggcuggcuugccagugaacucuagggaacugccugucuccuuccuccccacugcugggguuacagacccgacaccaugccuaugccuuuacaaguaugcuaggaauucgaacucaggugcucacgcuugcugagaaaguacuguauacucagggaggccucuccccagccccagcuuccucuucauauacagacccuuuaggucuuuucuuaugucugccuaaaucagugcuucucaaccuauaucaugagcccuuuguggggucauguauaagauguccuauacaucauauauuuacauuauauuuuauaucaguagccaaaugacaguuaugaaguagcaacaaaaauaauuuuaugguugggagucaccucggcaugaggaacuguauuaaagggucacagcacugggaagguugagaaccacuagucuaaagcuuuucucagauccuuuacugauaauaauauaguagugaacagaucaaaauagugucuucccagacgaccuggaaauccuaacacaaaacagauuauuaggugaaaacuacucaguucaaauuucaggcggugcuuugguguucaggauuuuagggggauauaugggguccuuugacugccuucagggaaauacuaugucaggaccaacaucaucaccaguaagagaagugccaggccucuccauggaaccugccagaaaaugauuuucugcuauaggacagugucagacacccuacaggugcuugguaucuguugggaggaagugugaaugagcucucaccuucaaauuuaggugugagauagauuuauguaaaguuagugauuguaauuauucauauaauaauaauuauuauauucauacugagaacuguuugauggaaguaaauguuaauuucaaugcuccaucugcuuacuguuuaaggaguuuauaugcugcaaaaaagaggaggugcugcaaaaucucucagagcacgauuguucugaccaugcagcaauacugccuaguuaggguuacuagugcugugaugaaacacuaugagcaaaagcaguuugaggagggaacggcuuauucagcuuacacuucuguaucacuguucauccucaaggaagucaggacaggaacucaacaggcaggaaccuggaggcaggagcugacgcagaggccaugggguugcugcuuacuggcuuguuccccauacuugcgcagccugcuuucuuauagaacccagggucaccagcccagggauggcacaucccauaaugguccuucuccaucaaucacuaauuaagaaaaugcccaacagccugaucuuacggaggcauuuucucaauugaaguucccucaucucagacaacuccagcuugugucaaguugaccaaaaaaccccgaaacaaaacaaaaaauaggcagcacaaauaucaacauuuguccucauuuucuuaaaauuaaucccuauuuaggaauuagagagcacaauuaaaauaagccagacauaaagaccauaaagacaacuaucccauguuucucucuuauguggaaucuaggcuuuacacacacacacacacacacacacacacacauacacacacacucacucacucacauauacacucacacacacauucacauacacucaaacacauucacacauucacauacacucacacacauucacacacuuacauucccauacgcauucacacacucacacacccucaauucucacacacucauacacucauacucucacacacacauguacucacacucguacauacauauaucacacucacacucucacauucacacacaugcucacaugcacucacacucucacacacucacaagaugaggacuccuggaggaaagagagaggacuagugucaggaagaaggagaugacaggguaaugaggucugacaugguuaaagcacgugacaugcuugaacaaaaagucaugaugaacccauuaauguguacagcgaauauacacuaauuaaaacaaucccuauccaaauguuagcuuucccucuauaaauaugguaagugaaauagucacaccagacaauaggaaaugaggucaccuuaauuaucuaagaaccccugacucaaacaccaucaacuccugaaaaugugcuaggguucaggagagcugcauccaugacagacaucuaaagaaguugcugcugcuuccuucccaaaugccacucagacccacacugguggcauguauaauuaugagugcacauguuucugcaagucucaaaagauacagaagugaaacuugucagaaaaguaagcgcuuugaaauuuucauguuugguugcuacaauuauuuugucaagcuaccuaaguagcauuuaaugagcuguuucuugggggggaacuugacaccacauccuguggcuagaaagaaugaggacacccaucaaguccuggagucuccuuaaacucagccagugcuccccacagcuguuugagcaaagagaggcuauuuuuucaaaauguuuaauaaacuauucagaugguucagacuaaagcuauuucugcaaaucugacaucuuggauaaagggcagacaagagugugcauaaugccaaggucgcuagcuccauucuggucaugugagagugagauuuggcauugauccauggucuucaaagagguguuuauaagcuacgggagcuuuaaaaccaucacuuuccaguguaaccuuccagccuuccuccucccuaucucuccagcaggauggucuaccucaccacugucuaccaaagugguguucauucaaguaaaaaccaaccaaacaaaauuuguuucuggcccuccacagccaauuuaguuagcaaugaaucuuguuauuugagacaccuugaaucuuuuuucuucucagcauaguaacuacacuaggucaaccauggaauagccuucaaauaguuucucagcuucuguuuuguccaauacauucuguacauuaugaccaaaguuauuuucaagucagguuuuuccacuggauccuugaaacacucugauggccuugguauauaagucuauauuuuauuauuccucuugucccauguccuaucaccgccuuacuaauggccccguguuuggcuauugaagacgacagaucuucacuaaccuucagaacaauguguaccugccugguuuuaggggaggaagcagcaacgaucucucuagggcuuugccuaccuuuguguuuuucuuagaaugauuuuccucuguuguguaaggguuuuugcuucuuugaaguccuaacuuaaacaccagauguucagagagguuucccaccccuuuccugucugcagcucccgcucugaugccagcuuugucuuucuuuccucagaguuaccaugugcauaguaacaagcaugggagcccugugaaguguaggaacugccucucuuggucucgaccacgacccaagucccuaguauaggugagucucgguaucagugccacaaaacugaccacugaucaaaugaaucaacuuacagauuccucggcugagacacacaguugucuucuguuuggaagaauucgaggcuccagaggguaccaguuaguaaagaugacagaggagccacuggaccacucaaaggagacugggauuuuauugcuacucaaaccaauccacguuucugaugcauuuucuguaagaaauacauagagauuauaagauauuguuugcuuauuuuuauggcacaugcagguuauuaguaagcuauacucacucacaugugauucuuuuuguuuaugugauaaaucuuauuugggacucacuacggaguacuuguccaguccucuccccuccccuaauauccagguuugcucaauauaggucuucuaaggaagguggaaugugagcuaaaccaaaagcaagcacuggccggagcaagucagaguucagggacuccagaaugugggcuccuccugugcgaaaagugaccugaaauaucuaguuuugcuuuugcguagagaaaaggaaaguuaagaggcuaauuggauuuuggaaaggggaacauuaaaaucacuaccaccaucaccacuaucaccacuaucaccacuaucaccaccaccaccaccaccaccaccaccaccaccaccaccaccaccaccacccaaacucuuuuaacaugguguaacuuguguguuuuuucuucucucccucccccucagccccucucaauaaaacaagcagaagcuccccacagcuuacacagaacagugggguugccagagacacaaacaaaaccucagagccccauggaugcagugagaagcaguaggcagcagagaggcuucaaguguccuuguugauacaggggacacugcaggauucuuuuaaucccaaaugcaaaggauuagggaaaaugaccuagaaguauuugugugugcgaacuaaagucuaacauugaaaaggucaccagccagagcguagggauuuuuuuguuaaacauuggaaaaugaagguauaauuucaaggaauuuuuuuuuuugggaacgacaccaugcuuaauguauaacauggguagggguggggguggggcagcuugcucugaagaaaggaagagggaaggcucaggagccuggaaccucggguaugacacacagcccgaaaaccacugaggcaaaugaagucaaauuauuuaccuaagacauuaccuuuaggagaguauagcacauggcugcccagcagccauaggcugacuuauggguuuaggguucagauagaaguucuaaggaauggcuuuaugacuucuaccccuugagauucuuuuucauguauuuuuuuuuaauuuugagaauuuaaugugaguauuauguuuacauuguuucuacccacuucucucuccaucgauucaguguuccacuguacccacucucaaauucauuauauauauguauaugauguauauguauauguguauaaucuacugaguacauuuaguguugcuuguauguacauguguuuagggcugaccauuugggacugaaucaccucucaucccugaagaaaacugauccuucaucucucuguagccauugauuggcuauagcucuucaucuaggacucugugagacuuccccuaucuauguugucaucaacugguguugucauuacacagaucuuguuuagucagcuauauuguuaagauuucaugugugccacuucccuaucauaucuauaagcagcaucucacagcagacauccugguuuucuggcucucagaaucuuucuguuccuucuuccauaauuuuuccgaagccuuagguguauggguuggguuguauagguugggccaaaaaaaaaaaaaaaccacauaucuauuugacaaauguaaauauguuacauagcuucugaauauaugacuuaaaaaauccagugaauuguguuucuguguauuuuucagaaauuuugacuuuauguuuaaauauauauuccauauauauuaguguauauaucauauauauacaccauaaauuaucacuuuaaaauaauuuaacuuguuuucaacucuaauuaaaagguaguuacuuauacuauuucauagaccuugaggcaaagucuuuaguacucaccaucccuaaggaggcuuacaagaaacuccaccucugccaacgaagcuacauccaucaacacgcugucauucgauuggcaagagugcagagccccaagccagcucuuucugucuuucuuaaguuuguagcauuuacgauugaagggaguccagucaggaucacagugaguggcaugguauuuccaggaguccuuuucuuuauaaaucaacacaaagaacagcauuugcacaauuacugccagugcuacccaauauccuuuauagagucaugagugugaucacuuuuagcaaguaaaacacagaauugguuccuagcacccacacaguggcuuacaaccaccugucacucuagcucagaggaucuggagccccuuuuuuuuaacauaagcacugggcacacacaguacacauacauauauaaauauauacauagaaacauacacauauauacaaacagagagagagagggagggaggggagagaagagggagggagagaaagggggagagaagagggggagggggagagagagacuguaacuggucugccuauuuaaaaaugauuucauauuauaaaaaggcuguuaugaaacauaauuuaaaugguauuccaaggauuuuauacagggcagguauccuuauccuggagcuaaaagagccuaaaauucuguucacuuccuuuagagcacagaggaugaaguuucauuuucucauucuccugggucgcugugguaucuaugaugucaugcaggaugaguguacaaaacuccucccuugaguuucaccagacuuucuucagaagagcuaagaauagcagguaggaugcuauagcggccccuuuuaguaugagcaaaugggaaggcagugaggacagcaggaaggaaagccuuugauccuuuccccaccuccaagccccacagcacagagacuccucuuaccaggggaagaccaaauuaaguguaguuugagacccagcaccagggcuccccuggugaaacccagugcuaagcagagcccugcaacucccaccauaaagcuauuaacuguaggcugagucuugcauuuguccaggaagcuggcuguagcaaaacuggccuucaggaggcaaggcagaggucaggaugccaucugcuagagagcagagggaaggcuagcauagagcuuccuauugcagcacagccugguggccauggcuaugacuuaggucgauucuuggugacuguguagaacugggcagaacccuucagugucugacagugagugaugcauuuggguguagcuggcucaugggggcagacuccucucucuagauacucucuuaguuccuuuugaacaacguacuaacuacacuggguaaaagcugacuuggauuacugccuaauaagagugacaagguaccaaugccaagcucuuagccaauuggacgugagcauuaucuggugacaaauggcccagagaaaacaggcauccagaauaguauuucuagaaggauuggcaugaacaaaacuagauuaggaaaggcaagauaaacaguccuuuaguggcuagacacugcugcauuacaauaaguauuggaaguuuucaggaagccaugccugugucuguuagacaaaagaaaguuuuagaaauggacuagcuaguaaucagucugggagaccuuccauaaaaauuaaaacagcugcuugauagaagcauauuagauuuuuaaaaaauacauaagguauaaauuagcagacuuaagggaagagagagacucuaauacacuaguaguuggcaauuugcaccucauauuuagugauauacagacuguccacacuauaagccaaccacacaacugcaaaaucaaauugcaacccuggccaaaugccccuagagacaucuacagaacauuccagcagcugccuaauucacaauuucccucaucagcauaaauuauucuccaugacagauaauguuccuggucacaagacaagcauugacaaaucgacaaaaacugaaaucacaucaacuacuuuuuuuuccccaacacaaugcaauaaaacuagaauucaaaaaugagaaagaggaagcuaauacuuacucauggaaauuaaaugacuuguuuuugaacaggcaauaaaucaaagaagaagaagaagaaauuuaaaaauuucuuuugaaacaggugcauguagagagucaacaugccaagcuauaugggcucaagcaaacucagcauuaguggggaggcguauaggaauccucugcuuaccuauggaagguagacauucagcgucauacccauucccuugcugcaccucaagggguuggugagcaaaacaagaacaaaucaaggaaagaauaauaaagaccagaguaggaaugaaugauauggaggugacaaauuacaaaaggucacugaaauuagcuacuggaauucuccaaauacaauagacaaauccuuagcccgacugaaaaagaaaaaguucagauaaaaccagagauggaaaggaagauguuggcacuuugggguaacacgguaaacuaaaggcuaucucuguaaaagcugcaguuugacagcucagagcucugaagccaccaucuguaagucacugggguagagagugagaauucugaaguccagaagguguguaugugauacccaccacacugucccuccagcaggcucacuaacacuguggugguuugaaugagaauuuaugcuugguccccaguugguggaacuguuugggaagaaugaggaggcguggcuuuguuggaggacguguuucauuggggguaggcucugaaguuucaaaaccuccuauuauucuuagggugcccucucugcuuccuauuuaucuaggucaagaacucucagcugucccugccaccauaucuuugcauuguuaucauaggcucuaacccagugacugcaagccuaauuaaaugcucuauuauauaaauugccuuggucauggcauuuugucacaggguggaaaaggaacuaagacauuacucaaaaaguaauaugcaaggauggguuuccugccugcacucauccuaaugcuaugauaucuucccacacacuccacugcauuugggggacaaccaucagggaaaagauuagucaccccaggggauaccacuaggaaucuggggaaggugaggacauugauccaagucauagaaugcaaagguaagcauggccagcagaggccacugguauugcagagaaggaaaacccccacuaugaagacaacugggcagacauuaacacuuguccauuccagcuuuagcaacaacaaaaccaacaggacaggaaagagucuucagguucagccaugaacuccuccauguuuguagcuggcaguggccaguuucuggggagccagaaagaaguggcccuguugcuccucuuuuucccucuaggauuuuaguacugucccuuccgaacuuccccuauacuuuuaugcuuucauuuuuaauuucccuucauagauucaucaaaucuuguucuugaaaguuuuucuauuuugggcaauauuuuuuuauacccccucuauguuuccucccucuacccuauucggaaguauuaugaaauguuauuauugguggagguguuaaauauagggccucauguagucuaggcuggcuuggagcuucugccaaggaugaccugaagcucugauccuccugcuucuaccuucugguauuugugguacuuaggaaugaacccagaaauacuuuauugcuuuaaaaaaaugcuucauaguauaaacugaaccgagaaaagcugaaagcuuucuccuugaguucuguuacaagggugcccacuuucacuacuucugucuaguaguuccugaagugcucacuaaagcaaucaagcaaaagaaggaaaagcauucaaaucagaaaagagggcucaaaauugucauuguauguagaacccaucaucuuauuauauaugcagagacaccaccaaccccacagaaaacagauagaaauauaacugaauucuauauaacacaucaaaaguaaggauuauuuggucuggcgugguagcucaaaccuuuaaucccagcacucuagucucuguaaguucaaacccagacugguuuacaaagugaggauaaaguaagguccaggacagccagggcuguuacacagacaaacccugucaugaaaaacacaacaacaacaacagucaagacuauugcuauaugcuaacggugaauuaucuaauaaagaaauaaaaccuguuuacaauaauuggaaaaauaggauaagugcaauucuuaacaaaauacuaaggauguuuuucacagaacuaaaaaaggcaagccuuaauuuugucuggaaucauaaaucacuuaaacaguaaaaacugcuguggugguuuaaaugcuuggcccauggaaaguggcauuauuaggagguauggccuuauuggaacagauguggccuuguuggaggaggugugucaugguguaggcaggcuguggguucucccagugcucacacucugcccaguacagaagagagacccuucugcuggccgccuuuggaagacaacuccuccuggcagccuucagaucaagauauagaacucuuugcuccuccagcacaugucugcuugaaugcuucccaccaugaugauaauggacuauacugaagcucuaaacuauaagcuagccccaaugaaauguuuucccuuauaaguguugccuuggucauguuguccuuuugcaucaaugaaaaccuaacuaagacagaaguugguaccuaggacugguauugcugugauaggccugaccaugcuuuuguuggaagaauguggauuuggggacuuuggaaagcagcagaauguuuuaagcagggcuuaacaggucauccuaauaggaaaauggaauucaguggugcugagggugauuugaacuuuggggacuuagcucaagagguuucacaagagaagaauuuuaguauguuaccuagagaucauucuugugauaugugaugaagaaugagucugcugaagcgaaaauaaagagauuuagauuaacugcauugacaaaggaaaucucagaaaagccuagcauagauucuguacuaugguucacucuugugaagaguguuuuugauuaaagauaacaagcugaucaggaguaacaagcuuagaaaggaaaaauacagaauguaugguucaaagaguaaagggacaugaggaaguggaauggagcuaaauucuguguucaaggauauugaauggaauuaaaagaguggagaccucgguacaagauccuacccaccuaagcuuauuguuugcaauugaauaagggauacuuauauuaugcuagguguuauuauuaccugguuauuguuuucauuuggacauaaggagauaugauuaugugucaaauugacaagggauggauugugaugguuacuaucaguugucaacuuaauuguaucuggaaugaacuacaauacagaacuuguaaagaucuugugagggguaaagaaaggcuuagguccaggcauggugguacacgccuuuaaucccagcacucaggagacagagauaugaagaucuuugaguucaaggucagucuauagagcaaguuccaggacauccaagcuuaagcagugaaggaaaccacugaaaacaaaaaguugguaaagauguaauagaacaagggagccauguuucagucuggugagcagcagaacuuggcaacguuggccguguggcacugacuuuagagucaagaguagaagggguuacugcaaacaauugaugcuggugagcuggagcuaggaaauuagagguaguuaagaaaagaucagcugcgggauaccugccaaagaaagcuucuaacugaguggaagcagcccaagaggaagaaguuuguagccaucaacaaagaugaaaagagugggagaucugaagagcacuuugucaucagagauggagauacaguuuuaagcaucacuggggugaaaucuucugguguuuucugagggcacaaaggagcuguguuccggauacagacauugcucuggcaucuggacuuagcaauguguaagaaucacccagaugguacaguuuugaaggcaugacggaguuauggagaguaacugaggcucggcacugugagagaccgagaaggcuauuggugaaggugcagccucaguuguagcugacagccuaguauucaaggggucauccaaagauauugaggcuuagcaccaugaaaagagccuauaagagacuguuggaugaagccaaguugcaauggaagaccccaguguguuggagaugacaguaccaugggauaaccaccaagaauagcagcagcaguggaguagaauuaaucagagccuagggugcuacagaggucagaacuggagaaguaaguucugagcagcaggauaccugccaaggaaagcugauaacagggaguggaaccagcccaagaggaaagagcuuguugccaucaacaaagaugaaaagaguuggagcucugaagagcauguugauaucaacauggagaugcaguuucaaguuugcccagcugguuuucugucuuguucuggcccaguauuuccucacugugacauuuggaaugguaauguauauccugugauguuggaaguuugugaacugguuuuugauuuugauuuuauaagggauuagaguuaagagauugcaugaaucuuggaagggacuuugaacuuuggacuuuuaaacauuguugagacuguaauagacuauggggacuuuugaaguuggacuaacuguguuugaacaagccaaugggggccagggaguggaaugugguguuugaauauccuuggcuuguaggaaguggcacuauuaggagguguggccuuguuagaggaagugugucacuguguaggcgggcuuugaggucuccuagugcucaagcuccaccuaguuuggaagagagaaccugcugccugccuucagaagauagucucuuggcagccuucggaucaagauauagaacucuuugcuccucuagcaccauaucugccuggaugcugccaugguucccaccauggcgacaauggaccaaucugaaacuguaagacagccccaaugaaauguuuuccuuuauaagaguuaccuuggucaugguaucccuuuucagcaaugaaaccccaacuaagauaaccaugcaaggugaagagaacaaaauuuaacucuggaacauacuacaaaacucuaguauucaaaggaauaugggaucagcauaaacacagacucugaccaguagaacaggauaaagaacugagaagugagcccguggauuguagcaaaugaucuucaaccaaaguuauaagaccacagaacaaagaaagagaaguaucuucaauaaaaagugcuggagaaacgggcgugcauacauggaaaagugaaaauauaccauguucagcauuugcaaaauaacaaauaaaaaugaguucauaauuuacaaaaagaccuuaaguuauggaacuguuugaagaaaaaagggcaaguacaucaggauauugaaaugggugagcaucuuuugaacaagaagagucugaagcacaguaauuaaaaguaauaucagacaaaugaguauugucaacuaaaaagcuucuacauauauauauauauauauauauauauauauauauauauauaugaauugaaauuaguauuucaaaagaacagcuguacuucuaugcccauuguagcauugucagaacuuggucugagaauugugaggagaauuuugagugcuugugagaaagcuccaagaaaauaaaacaacgucuugugacaucaguuucuucaaaacauggaauuguucuuggaaugguuugcguaccccucccagguguaacagagaggaguggcuuuacugcagaugacucauuauugcuugcugaugcuauucaauuaaaugguuaaacuauccuuucuaugccuccauggaaaaacaugguuuguuuguuuguuuuugccauguguggcuuguuacugagauuguauacagcuuaacuaaugagaacuuuacuggggcggccuuucuucacccucagaguauaaacugucugaugcuuugaguaaaguggcuuuugcuugagacguuaguccacccauuucucagcuccauucucccagguccuaucuccucuagaucagugacauugcauuauuuacuucacuagucaagaacagaaacaagggaagugucacucagcaaacaagugaauaaaaagacgugacauauuuacaccaugcacaauauauuuaacgaaguauuauucagucauaggagugaaauucugucauuuggauggcauggguagaccuaggucauuauauuagguauaggaagccaggcacagagagacauaggccacaugcucucguucacaugugaaauguaacaacauuuucacggauuuugaugucaucauuuuguggugaaguagagugacagaagugagaggcugggcgggguggggaggcgcuauccacagcugggugacggugagcuggaggggacagugaagggcugagcauucggaaacugggaacaagcaugcagguuuucacuaaugauuaacauuugaggucauagguauacucaacccgauugaaaugaacaacguauacuuuauauauucaucaauucucuacugcaugagcacauuaaaauuuuauuauuauuuuuuaaaugugucauuuagcaaaaaaaaaaaaaaauauccuggcagcucagaaacauagugugaucccacuagaguaauuaucagaccaauucauuaacuagaucuauugaugagaucaucaagucaaacaaaagaaaauaaggugacgagagagagagagagagagagaaagagagagagagagagaacaaaaauuaagugaaggaugaaagaagaaauggagaaauaaggaaugaagaaaccggggcuggugagggaucagaggguaagagcacugacugcucuucugaagguccugaguucaaaucccagaaaccacauggugacucacaaccacccauaaugagaucugaugcccucuuccggugcaucugaagucaucuacaguguacuuauguauaauaauaaauaaaucuuugggccggaucgaccagagagagcaggaacaaccaaagcaagcagggcugaccagagcgagcagagauccuaaauucaauucccaacaacuacaugaaggcucacaaccaucucuacagcuacaguguacucacauacauaaaauaaauaaucuuugaaaaaaaaaaaggaugaagaaacaaaucagaaaguaaauguccauaacagccagaagcaguucuagcaaaugcuugaaauaauggaaaaaucguuacacaaaguuaugaguggaagcuuuccccccucccacgcuaugcccaguucuccaacacugccggugucaacugccauuggaggggaaaaaaacaguuagaacccaaguggcagaggcaauguuuacaaauuaugaauuaguguauuuuaaaaucuagagcuguuucuaauuaucccuguaauaauucuuuaaaauuuggccuuguuguuauuuugacuuuuaaguucagauuaaaaguucccacagaaacuaaaugaggcaagacacauuagaaauggauauaauuagggcuaggaagauggucaguggguaagaaugaugcugugcaagccagaguaugugaguucaaaucccccagagcccguguaaaaagucaggcaugagucuuaaaauccuagugugggaggagacugcagagagaggauuauuauugaggcuugcuggcuacuagucuaucuccagguucaguaagagacacagucucaggggaaagaggcggaaagugagagagcaggauagcugauguccucuggccucagcauguucacaugggcauacacgcccauacacacgcgcacauacgccaaguguauacgucuuguacaaaaacauaaacugaucacugucaacacaucugucaguacucacucauacucacagaugaauaacgagugacgaugauaggcuuggaguagauuauaacuaggaauuauuuguuuuaauuauaacccaaauuuuguucauuauuuuaguggggauagcacauuacuaauaggaaauuugaaauguggcagaaacaugaaaauacuucaguagaggucuggaguucuguugcauaccaggugaccagagucuaaacggugcacuguaauauguugaaauagccuuaagagaggcauuggaaugguuucuucacaaagaaaugauaauguuugaagcaauggcuaugcugaucauugcacaacacacauggagcaaagcacaucgcacuccauaauuuuguacagguauuauguuaaaaagcgaacaaaaagaaaaacaaagaaaaucagcauaauaaauguacugcuaagauauucucuuuuaccuuuaaguuugaggaaucccucaaauaaaacucaaaacuauacaagaaagcacacguugguuuucugauauggauugauggaagagcaaggacaggaauguugacucggcuaauguccuuuugcucugguuuugagcauuugugguaggcaugguacuucaggauggccggggucacuuacacauuuuuauucacauagccaccaaccugaauuuuccaagcccuaauuaugaauuauuuacaaaaacagagaaauuugaaggcguggaggggacaugucaacaaccaaaggaugacuggaggagcacuuacccaggauucccugcgcagugugguuuagaucccguuugcauauauaaggcaagguggacucgcagucccugcuccuccaggcagcugaaacaaccuccaggguuccacagugaugcucaacaaauggcccaggaguuaucucugaaaaucaauacacacagaaaugcuugcagcacagaagguagcccuucucuuugccucuguagcgcccccuacaggacacucacuauaauugucugugauuuugaaguucaagucuagaucugacuagagaacuacuuugguuguaucaaagcagaggaaauauuuugcaauuuguugcuauuuugaaaauggcagucuaucuuugacauccccccccucccauagccccaggauguuagcuaaauagauuaucuuucuggcuucugccuucuacaaaacucgccuuguaggaagccaggaagaauaaaacaguauuuauaaaccccuaggugugguggcauacaccugcaaucccagcacuugagaggucaaggcagaagaacugagaggucuaggcuugcuuggguaacacaggagaaccugacccaaggagguaaacauuaaccucucucagaauaaaauauuuuugugggacugcaaugucuaagucugcagcauaucccagcauguugaagguagauaaggugcugcggguaccuuggcuccaguucagguagcugagugguguuccaucagaccacugccagccagccuucucauccagcugguucaaaccaauccacacuuccuugacuaccuugcucaagugcucugaaaagaaaaucacggcauuucaacaggaaagcgaauagacaacacuaaaagaaagucaaacucgaugcuucacugcuuucuugaacuauuucgucgugucauaaagccauagguaaugccagacuaugauagaaacagaugccaugaccccuuugcuggggcuuuggugagacaaagcagggcucugaagaauuacugacagcaaugagcaaugucacgcucuggucuauccgaaggcgcucuguuuggaaugugaggcucucccacuuccuccagcucacacacuuccaguuuuagacuuuggaggcagagaugaccauggccacgcccacagagugaauggaagcaagcgcucacacuggggugaacugaagacgaagcagagcugcugaaggaaagcaucagagagcaggagcccaguguucugaggcucagcacgggggacccagccugggggcccacacacuugagaagaggauuuuugugguucuguggucccugcuucuaaacacggcacagcacggcagcaucuccccaguuaauccaauccugugccuuuaacagauacuguagaaaacaggacuaacaugcuaacacagagcaaugugcccaacgaaauuguauaauuaugguuuuucuauuaaugugccuaaguugaaaauaagugguuuuuuucuaguaugaauguguacuacuuguacaauaaaauuuucagugaaaauggcuaauucugugguccucucagauauugcuguuuugacauaucuucuguaaaggagagcaccgcuuucuucugauucaugugcuucagauaaucucacccacucccuuccucaccuucucuucccuuucucucuccuugccucucuuuuuaucacugucucuccauguaucucucugccuaucucuuuguuucuaucucuuuuuguguuucucugugugugucuauccuuguucucuuugucuuuguuucuauuguguuucucucucucucucucucucucucucucucucucucucucucugucugucuucuuucuaaaugcagggaccuagccuaaaguugcaggcagauuauauccagagagugcgugucugggcuuguuuccuuccuaucauuucagccuguuuacucucccaggcuccucaguuuggcugugugguuaucaggacaaggacucuguguauucacauguuaagucugcugcucaacaauuaaguuaaagucagcaauuaaguccucaaccauuggacauuucaauacacaguggaaguuugaugaggcuggacacuuaaaaaaaaagguaaaaggugcucuaacacuaaauagaacauauuauauaugaacuccauauccaaguuuuugugacauuauauccagucucuuuuuaaguuaaccuucccaugaggccaggguagauuggaagauucacugauaggacauggagaagugauauuguaaauaacauaauucacauauuaauuauucuuagaauuacucuauguacucaaaaucaugcaauugugcuuacuaaaacauauagaaggaucauacaauguguaauuaguguuuaaaaguacacacacagaaacaaaaacaaaaacaaaauaucacccaacaaaacagucagacaaaauauaaacccaacccuucuccccuagucuacuuaccuuuuuaacuaaguuuacccuuagcacaugaauacaaacucaggacuaaauucuuuuggauguuucuugucauuugugacagccuagauaauucuucaucucacaauuuggugacuagcuagagauauuagacuccuuucaccacuaaaaauacuuugguuaggacaguuucugucuuucugaauagacuucuauuuucccaaacaagcccgaaagccuaauuauagaauugaaauguuuaaauaaaagccauugacauaucuuauuuuuuuuaaauugcuauucaagcuugaugaauagguacaaauucucccaugagaaaccauggcaguuaagauagauaacaacuguaauucauaaauggugugcaagcuuuugcacaagacucauuacacauuaguaaugauuugggaaauugucauuuuauuccaagaagauucauucaaauuaguuuugacgauaauuccccacuugugcagagcuguggaggaagguugaacaggcacugugcauccauuuaucucaguccuucuggacgaugucucugccuuuguaaagcuguaaguccgccucuuucaccauccagugaaccucauuauaagaauacagacaaaguaacugggacacagcacauguaugugugggaaugguuggcaacagcgauaaacaaauaucaaaguaauuuuaucugccuacuccaaaggcagauugagagagugacauguuacuacaaguuacacugcucaguaauaauuaaaaugagaugcaggccggagaagaugucucggugaguaagagugcucauucugcaagcaugagggccugagguugccuucccagaacccacaucagaagcuggacaugucuaguaagcucgugaccucaacauuuuggggcaaauauaggaagacuccaggaucucacuggccagcuaaccuagcugagccugugaaacgcugguucagugaaagacucugucucaggagaguaaggcagggaggaaugcagaaaggcaccugccaucugggucugcucuccaacagugugugcagggaugcaucagcauacucacauauauacaucacacacacacacacacacacacacacacacacacacacacacacacguaucccacaacacagaacuauauauccaucuuuacaaacaggaauacauacagguaaauuaaauaagcagauuauaaaauuaugcacacagcuguuaaguggucagcccacaccauuuguuaugcacaccagacaguuuccuaaggcuuccucuguauuauaagauacauuguauaccaccaacuaguuacuaucaugauuuccacuuccuaagggggaaguugaacugucaagaggcuaacucacuucuugaguaacccugcaagcagugguggugguggcaggacucggacacagagaggagucucucucuucugucuguccguguacuggaaaguaccuuggacuacacaggcuccuuguuuuuuuauacuguacugaucucuauagauacuacugguuaggucuuauuuguuguaguuaccaaucugacacaagccagagucaucugaaaagggggagaucucaacugagaacauuccuccauuagauuguuguagggcauucucuggauucaucauugaugugggaggguccagcccaaugugagugguggcaccccugggcagaugguguucagugguauaugaaagcaggcuaaacaaagccaggaagcagcacuccuccaugacuugggcuucaguucccucucuaaguuccugcccugacuucccucagugaugacuaccuguaaguguacaaggaaauaaacccauaaacccucuccucuccuuacucuuagucacgggguuuaccucagcagccacugcaguaugucugcacgcauauuuacuuacuuuggcagagcauggcuagcccuaaauuguagaacuauggcagauauuuuucuccauuugcuuuccuuuuuguauggcugaacuucaaaggcuaaaauuacuacagaugaauuugagaaaaaaaaaauugugcccgaaacucaaucaaaucaguugaauuugauaguucuuaauguuucuauuauuaauuauuauuaaagaauuauuaauuuguguguggaggugccugugcgcaguggugcgugugugggggcacggacagcucuuaggacuugcuucuuucuugcugcauccugggauugaggauugaacugaggucaucugaccugcgcacaagcaccucucucucucuacccacugaucuaccuggucagguggaagaaacacacuuuccagcucauuuucacaguucuguuugaggcagaaaacaaagauaggaaaaaugguggacgcguggaaggaaagcauggaaaaaaagucuuucauccugggccugguuuauccaucuuguggacagagacagggaaccucaggcaccauugaccacugagagggccaaaguuguuuacggagacaauauaauuuuucccucaagcuaccuugucaaagauaaacaaguuguguaugauuuagccuaaaguuauauagagcuuugagcuccccacacuuccguccccuccuaaacccaaacaguaccuuuuacaaaucaccuuauaacuuugugcagaagaaaauuauuuaaaccaaaacaaauaccaauuucauuuuguaaaaaaauuaauuauuuguuuuucguacuacuguguugucugcagguauaucugugugagggcguugaugcccuggagcagcaguuacaggcagcugugaacagccacacagauguugggaacugaacccagguccucuggaagaacagccagugcucuaaaccacugagccaucucuccagccccagaagaaaauucuugaacuuuuaacauugguguagaaauguuuugaaaugggggaagaaugauuucugagcaaucuuuagagacguaacuugaguccagaaaaauucuacaaauaucuauugcaaagauaacuagauagagacucucuugagaagcugguaucaaugucugggucugccuuauuuuuuuccugggugcuucuucuguuagccccugcguucaagaucauguuaagaaugucauuaaauaaaucucuaauucugcuucauauugggccaccuauauacucuuuucuuguuuuuuucauugagcaacaaacucggcuuugucugaauggagguuccuaacgggaaggaaccccgucaggcuggcguggaggauggaggguacccgagcuucucugcuuuuccccauugacaacgugggggcuugucugggacccaacuaaaucacugguggauuucauuagcuguuacuugucugaucagccuugauaaacgcagcuuguauuucaucuugguuuguuucuguuuucuggccaaagaccuauuugauguuuauuaaaauaaguguuauuagaaaugaagguaaaauucucccagcauugucuccaucccauccuuggaucagaugaaacaaugcugagcuuaucuagaaggacauuuccaugagaucugauuuaccagugucaagucaugcuguugcuuuaaggagagcaggcugagacaccauaguaaagcuguuuccccaaacagcacauuccagaaacaugccagaaauggccacuucgaaauuuuguuuugacccuguaucucaagaucuaugugucuuuuaauacaucuccaacacuaucauauuggguauccguaaaguuauuuucuuagcgcaguuuugccugaauggaggucccuaagggaaagggaccacguuagcaggacgugggaacaaaguaaagcuguuucccauucccauugcugcuggcccuuugaaacacuauugucuuguugugcuaguguuuuuuuuuuuuauuucuccacuaauguuaagguuuugguauuuaccaaagggccugugaugggccuggacaccaggauggauaagcuagcaacaaguagacuauguaauuauuuaccaauggaauugaauguugaaauucugcaggggacaagaaucaguacuuaugcugaaaaacuccucugcaccaccugccagaguugucgcucacaugggucacgugcuauuguuucaaauucucuuccccaagauggggggaggggaacugaggcauaaguagugugaaagagaauggugcaguguucauagaaaacacauucaguuucagugucucugguuuuauuugaaguuccuugauccacuuagaucacaaaggaacucacacaauauguacucacugauaaguggauauuaacccaaaaccuaggauacccaagauauaagauacaauuuccuaaacacaugaaacucaagaaaaaugaagacugaaguguggacacuaugccccuccuuagaagugggaacaaaacacccuuggaaggaguuacagagacaaaguuuggagcugagacgaaaggauggaccauguauagacugccauauccagggauccaccccauaaucagcauccaaacgcuuacaccauugcauacacuagcaagauuuuaucgaaaggacccagauguagcugucucuugugagacuaugccggggccuagcaaacacagaaguggaugcucacagucagcuaauggauggaucacagggccccaaauggaggagcuagagaaaguacccaaggagcuaaagggaucugcaacccuauagguggaacaacauuaugaacuaagcaguaccccggagcucuugacucuagcugcauauguaucaaaagauggccuaguuggccaucacuggaaagagaggcccauuggacaugcaaacuuuauaugccccaguacaggggaacgccagggccaaaaagggggaguggguggguaggggaguggggguggguggguaugggggacuuuugguauagcauuggaaauguaaaugagcuaaauaccuaauaaaaaaauacaaaaaaaaaaaaaaaagaaaaaaaauuucgggauuagagagguagcaagauggcucagugggcaaggacacuugcuaccaaacaugacaaaaguuugauccccagaauccauaugcuugaaggagagaacugacuccuaaaaaacuguccuccgacaucugcaggucgacauguacacauauguugacauaugauguccuccgacaucauacaugcacacaugcacacauauacacacgcacacucaaaaugaagguuuuagaauucagaauuaaaauuugggcuauauuaagaaaagaaaaacaauuuuaaggauacauauauauauauauauuugcauccaaggguagaacugcccgcaguagccauuuuauugcauuauuauccacgugcaccauuucuguacuuacuccuuaugaaaucuucuucaucuucaucugcaauacuuagcaaagcaccuccuugcaucaggcaugaagaaugggccugguuccaagacagagacgaaagcagguugaacugguagcaaaugcgugaacugccauuccuuugccacguagcaucacagaacaccuucauagaggcugaaaaaaaguccauuaaaaacacucaugacaguguuccccuccacagugauaucuaagaugcauucaaauaagauggcuccagcgugcaugcucucaaacuucagugccuugacuaggucuuuaugugaaauccgcauugcuguucuauuaaugucuuacgguuaaacacauccuaaauuuaccugaggaagcucaagagaugaucgguaaagaaucucugauacucucaagggaauaagagaaguuaguuuuaagagaaagaaaugaaaugagguuuuuuuuugaaaauaauauuuugauucuuuaauaagcaagcauuuagaacuucauguuagacaugggaguuaaauauuuucuugggauagacuuuaaugcuguuucccaaacuaaaagcaaacugccaagauggagugauuguggcguaggagcuauguguuaaacacaaacacgguuucacccggcauaaggauaaugauaccagcuuuaaguaguucuuucagacaaacaggaacaaaauccacuuuuaagauacuggccaagauuucauaguaugcuuaaaagcaaauuuaauagaguaugaaguguagaucugaaaucuggaguuucuugaaaugacaggcaacaaaggccuagccgugugcuuuugcuaacguucuaacccaacccccaaggugaaccaguucucgaacucgaacucagucguacaacguguaggaaaugugagccguauuuuagcauguguguaacugguggacaggcagcaugcugcagucuagacuguucuuuuccuccaaguauaguccugaaagucagcugacagcaggacacuucccaugacaauuugguacaucacgacuguagggugugcuuuucaaauccaucauguagauuccugggcuguagaagccugcuuaguacuaauucaauauaugucacacugacuugacaaugaaaucuuuuuuuuuuuuuuugugcuccuuuuuuuuuuuuuaaccuagaauacuucgauaacucccuugaaaaauguggaaguuugauuucaugucuaguuacugcauaccuuuucaagaaccaaagcagcuaguuggaaguuaguuaauaauuuacagcuagggacaucuacagcauuuccuggcugauacauguauuuaugaaugaguucaauauuaaagacaacagaaaaaaaagauugucaccaaaaaaaaguuuaagagagggaagggaagaggagguggaagaaaaggggaaauuuuagaaacuacuuugcugggguggcuagaaugcucucauugagauggaguccuucauuguugacuuagguagaaugguaggauuucccugguauggccaauacacuagguuuagauuuuagauuggccauguuccccuggugugacugcugagacccugaaaguugauuggcaacuucaggugggaugcggagaguaacacaguucauggagagaagcagcccauggagagaagcagcccuuuggagauuagcugccugcacagaacuauaaauucuaucacccgagugaaacaaacgugaaugcuaaacgaacugacuucuaaggagaaugugagugucuacugcaaacauuugacagaaguuucucuauuauauaaccuucgacaucaucacagauaguauaaacccaagucaaaucuaacauuaccccagcuauaagucuggaaagaagaacauauugaaagggcaggaccagcucuugacaaaaacagaacccagguggcagccuuucuuaucaugcauguggcuguggucuguguuauaaucaaggcuuacugucaggucuuucuccaugucaggagugagcaacaggugcccuguucccaggauuaacuucugccuguuaccacccucgagucaccacuggccacccagacaugccugccuuagaaaaggcuuugaaguuuuuuccuuaaagacaguguuacuuaggguuuguuucacggagcaucagguuugcagccuggaacaaauuguaaacguguauccuugagccccauaccagaucuaggaccuccgaaacugagagcagggaaucagcuuaauuuuuuuuuaaauucugcuacaaaauucauugcagggucucaguggucauuccagaugaaccugaccggucuaaggucuacacacagcguauuggccaucucaggccaucuuaccuaaaggcaacaaugaaggauuccgucuuaaugauggcuuccaucuuaaugugaaagguuccaucucaaugaugaaggauuucaucucaaugaggauauucuagguaccccagcaaagugguuccuaaaaaauuuuuccuuucucuuccuccucuccucuccccucccuuaaauauuguuuggggacaaccuuguuuucuguugucuuuaauauugaacucauuuauaaauacauauaucagcuaggaaauacugcagacgucuuuagacauacaaggucucagccauugaaucuuccuuggaccuaugcuuuccuauugagaauuucccuucuauagaaacagguuaauccucauauugagaauuucccuuaugucuaaaacagguuaauuggugaguguuuggucagagccccacuuuuguuuucugagaaaccacaucugagucaucaagugauuucgcuucccugcaccuuuagugccucaguuaccccauuuccaggugcauuccaaaauggcugaguaucuucugucuuuaaaaaggaguaaaaaaaaaaacucccuaauuuguucucccuaucccagcuauugccuucucucuguuuccaaucguuacauacuuuuaugcacauacuaucuauaauuccucaucuccuaaaguuuuuauugcaacguaagucauacgccauguaauucacccacugaaauuccauaauucaaucuucaguauaaucagaagaguguggaagcaucauaauugcuuuagaaugauuaaaucauuuaaagaaaaaacacagcacucuugaggacugacuuccccauuucccuugcgguccucauugcuaccugacuccagcccauuucgcuuuauuguauuauaaugccagccauuaauguaguuucuguaucuauauguuugcuuuuauccauuccauauagcugaaauuauauagaauguguuauuuugugccugacuucguucucucagaauuauguuuuucaaagucauuauguuguggcauggaucaguauuucauuuuuuaaaaaaacuuccuaaucguauguguuauuugauaugcuacuuagcaguuugucuguuugacauaacuagagccaugcuggaggaggggcccuuaacugaggaauugucuccaugaagcuggccugugaacaugucuguggggcauuuucuucauuaaugguugaccugggagggcugugguagacugaauaaggagggcucucauauuugaauguuugguucccggaguguugagcaguaaagaaacugcugacaugacugcuccaucucaugauuaaggggaaaguuuuuauuaugagagagagagagagagagagagagagagagagaaaacauggccagagcucucugugagaggagguaaaauaaccagagauagagaauggagggcaugaggugagaacagacagguucuaagacgaugaguagcuaggggagggaagucuauuaucuggagggacugagggcagaggaggaggugagaggagcuaggaugcuaguguggacuuugaaaucuguaacaaguacuuaugauucugaggguucuggaagcugauaugggcuuugauauacaaugucaauggagccauccaucuccucugcccagagguaagggaaaugucaugucuccuuuugauggaugggaacugguuuuacaaguucugaggaacgcugguuuaucuccagaaauccuccuauaguauuuauuuguagaaccuuuuguaguuagaaaacugaaaguuucuuuggcuccaaugcccagguggugaacuauuugggaaggauuaggagguguggccuguuugggaaagaugugucccugacgauggaauuugagguuucaagagcccacuugugcuuuucaagauguaagcucugagggacugcuccagugucauagcugccugacagcacacauacuuucugccaugauggucacagacacacccucugaaaccauaagcaaucccccagcuaaaugcuuucauuuauaaguuuccacgcucauagugucucuucacagcaauagaagaguaacuaagacaagccgcuagcccacuggaggugauaccacuccugggaacauuuggauuacauaaaaucaggauucuuuuuauauucuaccuacaauaucucuaugagcaagugacuugugaauauauucucccauuugaaggaggucuucggaggcgaguguucugagaauagaccauggggcauuaagcauucaaggcaagaauucaacaaccuaacugcuugccucagugucuugauagguucuuugaagcacacauuuucuuauuguuugggauuguuuuuguaaauuauuacugauguaacauacugcugauccauuuuagggacucugaugaggguggcaauuauuguugguacuaaucuauucuguuccaucauucaaauuccugaucaaaacuauagugaguaaaaaccaggggugaauuggaucauuccagaggauagaauuccaaaaguaucucuaaaugggauucucuggcacacaacccagacagggucgauguggcccagacuuugccucuaaacaagccagagucgaacccuguuuguuaugcucauuuccugacagggauuaacuacacucuuagggcuaguauguuuguccagguguuaaguuuaaaucuuacuccuuugcaaucaacuuuuacuaaaggcaaccaucauuuuauacauagagauuuaaaaaauauaguccuuguaaaauuacaugagauacaggagugugaaucuuuguuucguuucucucuguguccugucuacuucuugacuccuggaaacgggucucagugaacucagcuugcaauuccuugacccgucauuuugaguuauauuggccaccagaacccaaaagcuauaaggaagggagaaagauggcucuaaugcacaccauguccacacguucucugcugcuguggggaggucagggagcggugagcaggugggcagagaaagcacccccugcucucuaccccugccuccucagccaaacaaauagccugagggaauaaaaaaaagcccaaagcucaagaaaaccaagcuuccaagggggcgggggauggggggagggaacugaaauuggcuacaaaugacagggugggaugacaaaauucuucucaggaacuuaagaaaacuguuugugcuggucaguuugucaacuugacacaagcuuuggucaucugggaagagggaaccacaauugagaaaaaugccuccauuaguauggccuguagacaagucuguggagcauuuucuugauuaaugugugugggcgcccugagcaggggcuccuagguuguauaaaaaagcaaacugagcaagccaugaggugugaaccaguaagcaggguuccucccuagccucugcuucgguucugccuccagguuccugccuugacuucucuucacuguagacggguuugggacuaggagccaaauaaagucuuuuggcccauaguugcuuuguugauguuuuauggaaaugccauaagagguaaacuaauuuauggcuguuaaauuucuucacgacauucugguguguagcuagagugagccugagauuacuugcauaucggggaaaucccuggugaggaauuacauguacucaacucaccuuagcacuugucaaaaaugcagaugccugggucccacauccugaacuauccagucucccgggucccacauccuggaccacggggcuucuucucccaggugauuuuaguguaucagcuccaauauugucugcauuuucuggugcagagcaagacugucccuccugccuuaagucuagaugccaguuucuuugagggcgguauccaaagccuuaaauuucuuaccauuuaccacuaucucuuccccaucuagugguaggacaagccacguugaggcuagaucguacauucagaaguaaaggaacgcaugcugcaaggauggggacguagcucaguggcagagugcuugccuuagccugauaaagccuccagguuccguacccagagcugccaaaacgugugcugaauagugacagccuguccccaugaguacuuacugagcgccggcuacucuccguguuuucgaugcacugucggauugaacauacacaguaauccuaauaggcaacgcuauggucuucacuuugucagaggcacuuuccuugagauucacugcugggaggaaguuggacucaucuugguuugucuaaauuuaaaaacgccacucuuuccuauuuaccgaacccugcggcucuuacacugaaaaauaacucugcagauagcuuauaaaucacaccauugcgacuuagcucuuuaguuuacuuuuuuuuuaaauuaauuguuguauuuuauuguaugcauggaagggaggcaggcauggagggagaggaggugagauauucucugauucucaggagccagaauacagacagcagaaguuauacguacccuucaaaacuuaggaacaauaggaaaucuuuuaguuaaaugaaaaauaauaaccaugcacugccugaaaaauacaaguaauauauauauguguagauauauauauauauaucagcuauuauagcugucacuggacuuugaaaauuagguuaacaauucgagaaaccauuuuuaagccuacacggaaggguuggaaauucagaauucaagaugagaccucgugguugaugaguagggagcguaacugugaugcuccagaaaggucaucagggggcagcugaugucggacuugacagugguccagauaagccgucuggauggggagacacuauggcagcuccuaggaggugcugguuggaaaggauggcugguuuuugucugcacuccugugguuuggaagcacccugcuggggaacugccauuggcaaguccacagaauagcaucaucugauuccagcuaaacuaucuuuaugcaccucacugagcgagcaugaugaagagaagcuaguuagcaucuuuugaauguagauggggggaaaggauuacgaauuagaauugucucuucaagucaaaaacaaaccuccaaucaaaaucuagacugguggaaucaggaggcucauucagacaucaaccgucagcccugguguuuuuccuucacuacagauaaguuuccaaucauccuggauucauucaugacauauggagacguauuuauucuuacuaggaucugggcagaauccccacuucucgucuucuucguaucggcuugugguggcacaccacagcaggugcucuuucugcccuucucggauacagucauggugccagugaccuuugaacuggaaaggaaacacgcaaggcaucccaugggcauucccuuuuaacguauauaaaucuaggagagaaaaagaauuuacagucaaagccggugucaguuucuucuggggaaagugucaucuauuagugcauuuuuacugguuaaaaacuuccccccaggacagcacuugguaaaagcucugugagcccucggggccucaccagcuagcuuacacagacacaccaggccuucagaagcacuggcaaaugguuugucccuauguuuaucuagcucuuuguuuacuauggcuguugcucagcauacaaauuugugaaugaaauaaaaaggaagacacaauggaauuuuucccuuaaaguauuugccagccccuaucaccccucacugucugaacucuaguuuuauggccgucuaccaguucauuugguugacauuguagauuacagucuuacagcaaaacagaugucaccacaucagaaguguccucuuugggccugugaaccauugauggucccugauagaaggaagggcuggggaaggucauaggacucucaccggaguagcuaacugugcuaccccacccacauacacacuauuuaguauucugucuggacuccacccccacagauaccugacaacagccagguaugcuccuucccacaguuaccuggcaacagccagguaggcuuggcccacuauaaaaggggcuacuuggcuccuccucucucucuuacucucuugccuccucuuguccccuugcuccccauucccuuccccacucucuccacguauucauggcuggccucuacuucuccacuuucuccuucucucugccucucucugccucuacuacccucuuagcuccccuccccuugcccuaaacaaacucuauucuaagcuauaguguguggcuggccucucagggagaagggaugucucagcaugggccugcugaggcacucccuccccccacacccagauagaacauauucuuacagcccuuuuucuuuuuaugauuacaaugcuauuugcauacaaauuuguauaacuggucugagagacucacagaggcauuugagugcauaggcuggggaaggccaaaggacgagggguucacucaugcagccuggcagagcuaucauucacauuaaucacagaccuuccaguauggcugcuuuuggcucacccaugcuccaggcuaugcccccucacccaugcuauguaagaagccuaacaaagcauugcuugcucgggguuaacuuugguagucuccagagaccauugguuugucauugggaucuuauguaggggguagaugguuaugucuccccagggaaggaauuuucacaacagccaauagauauuuaggggggcuggcaacauggugaaauguuuuauagcaauucuuccucuugcagagcaccuggguuugauucccagcacccacauggugacucaaaaccaucauaacuccaguuccaggggauacaaugcccucuucuggccucugugggcaccagggaugcaugugguaaacauacauccaugcaggcaaagcauucaugcauaaaauaagaauaaauaaauccuuuaaaauuaaaaaaugaguacuuauugaucaugaacauauccugcacugggaauaugguagugcaccguagaaguuucuuuuugcuaacaaaguggcuugguggagagauaagaagugauagcaaauacgcaaacauagaguuucgaguaauaauaaaucucaugacggaauaaaacaggaugagaagaucguguguguaguggaguguccccagcaucugaugguuguuguaaaaccucugugaggacauugaguaagugaggaugcucgucuggggaaagaaauugucccugcagaaggagcaucaagucuaaagagcuggagaaaggagugcuuguggaauaaagacggccccagggaguggacucccggaagcaguuucuccgauugcuguuauguacuucugucuuuauucugaggguggugggaagucacuggcagguuucaaaugagaaagugacaaaucagacuucuauucuuaaaaagaaaaaacaaaacaaaacaaaaaaaaacccaaaaaacacaauaucacuggguacacugugacaguccgaauggagagagcaacucgggcuaaccagugagucagcuucuauccauagcaauauugagguuuccuugguaacaggaguguccuucuaggguugcuagggucucggacguggccagcacagcugcuuuucacccagugcucucagacagugcuugucucccgaauucaaagacugaaauucaaagauuucagccaaagagggagaguuuuagaaaccuauuuuuagauucacaggugagggcuuaagggguggcaguggugggcagggcuauaacgcaggaaggcuccuaggaaaccagguaccauccagcugccagucugggcccuuuaaaggacuuauggacaaaacugggcugagauacgaagagaaaggcgaacuggucagucuaguugcccaaccacaagguguuccgcaccuccucuuggucugucaggcaguuaccauagccucaccugcccuuuuuggagaugaaagagaagcaggaaucaacauuccucuggcauuccaggucuccagcaaagacauucucagaaccucaacccacccgaccaguuucuaguuccuauucucaucaagauggccaugcagagcugaucugcugacuacuugcuuagacuccaccauccuuggccacugugacaauuaaagccccccaggauucagcuggcaauuucuaggauguggguaucaaugaggucaucuggucuucaucuagacaagggggucagcuauggacauuucuguacagucucacaacuggcaagggccuaaccgaguucacagcacauugccaauuuucauaggaauuagagauauuucaggacccagccuuuuaucucuuucaguccccuguuuuucacuaaacagcauggguguugucaguaugggccgaggguuaaaaugcuaacauaaagcaagcaucaagcucuucccgagaaucgugcgggugucagcaugcugauaaagcucuugcuuuauugcgguaugcaagccuagaaaaacgucuuagccuuggcucugacucuucacucacaucagcaacagaagguccugccuuaggacuuaggacuuucuugcugcacuucuaacccugaggagaaggacgacgucugucuuggccuucguacaagugccuaacauugugccugauccauagucagcgcucaagaaaaaauaaugagugccagauggaaggaugaguguacaaaugacuagaucuguggagggacagaacacacgugucagcauuuuacuguguagcuuuauuucuguaucuuccauucuuuuuccguuuuaaaaaaaugucaaaaaguaagagaacuguagaaaaugaaagucucccuauaaaucaugccucccacaguccaugcuuggugcgcaacaaauaacccuugacaauagugucucauuuaucuuccagcaccuuguagcaugacugucauagggacgacagucaggcuuagaagcaucugaaugcccccagagacacacccccaggguggggcugaauuucuacugucagagaagcagugccaagugggugcauuauaccuggcagugugaaaaccuucccuucuaacguguuacguucuguuuucccuccucuuuuucucucuugcugguucuucuuuguauugauccccaaagcuaguuaaguacuuuccuucgguaucuuuaaauuccgagauagucauuucuuuauugcaucuuuuccaagauuccaauaauccuuuuacuauaaguaagaaaacuacuaaaauuuuccagaagucucaacaugacaacaagcucaguguguuccuuuuacauauaagauuauaccauauauauauauauauguauauauauauacacacacacacacauauauacauguauguauauacacacacauguauauauacauguauguauauacauacauacauaauauauauguguguguguguauauacauguauauguguguauacauacauauuuaccuauagauaaauauacaauuaugcuuuuacacagauauguauauguaaauauacauguguuuuauaugggaaacaggaucuauguauucuauauauugaugacuacauuuaccucugcuaggaugcucacaaauguccccaccacuggacguguaggcgauccaccuauggaucuguuuucuugccaccacuguguugucagacuucaccuggaccuuguacuggagugggcccucgaucaucuuccugucacagugccaucucagggaaaugaggguggaaucacauucauagagcuuuaaugguugcuccagagcagauauguucaggccuaggcagccacugccucccacauuaaagagguggucgucggaaacccauuuccacagcaugugcucguuuggcugcuugcaguucuccagggucaguacagauuuaccugccugaaugcaugucuucaggcucucgcucuggauaaugaaaauuccuuuaucuguaacagaauaaaugaaagacgugguaugcaauuuucauauauaauuagcuagggcugugaugaucccaguguguguaucuaagccgugauaagucacagcugccagucauuuuuguaguugagggauagaguccaccagaaagucuucauuugcauaaaauaguuucccagcaagcacaagaaagcguccuuauuggcaacaaugggagaucacugaccuaagaggcuccugggcauggaagaccaggguuuccugacagucaaaccucuuauaacacuuaaacagagagcaaugguaugcaagagggacauuggguguccaggggguggccaucauuuauuacuuuuauuuucaguauuuggaacaugacaguuuacucgagagccauugaggugaaaaaucucuagccucauguuccugcaaagagccacaagguaaugguguaaucagaagugccucucugcagcccuuugagagaggauucagugcuggcgagagcuuaaugcuucugcacgcugcuuucagucuugacccaucgggagugugaagguggaccagcugauacuccaucaggaguagccuagcaagcaugcagccaguggcaucaaucgaaugccugaucccuugcuacaaaagacgccuggagcacagaggcagcaguagaaaaugacacaggacaugacaggauguucccuugagucucccuaguuugggucagucuccugugaaaaagcugguaggauccagccagagaacgcuugcuugcuggccgagcagucaucuacuucauaacuaugcauacauuucgucacagguauucgaaagacaauagugcugucuuaauucuguggucuaaacucaaccaaugucugacacugauuggacacaucagcaucuuagagcucucggcagcugggcuuucagaugacccuaucucaggauuccuguucacauccacgaguucguuuguccuccucucagucaggcucccauauuacauuuuacuucccauuuauucuuuaaaacucugcagggaacuuaucaguuuccucuaaaugacuggguuuagggcagcaagaguuauagaaaaggaacggcagagacaggucgagccguagagagguuuggaacagaguagacgacccuccuaacacaugggggcugagggguuaaugccuccuuuggguggaaguucuuuugguuuccuccaaaacugauuuauagcaacacaaaucgcuuaagacucuguucaaaacauugucaacguauccauugaaagcugugccgcauuuaaaaacugauaaccuuucuuauaaccauaugcuugaggaguuguuaggggucagaaaaaugcuuugauuaucauacacuggagcagaagagaagggagaaccaauggcguggguagagaaugaaugguucuaggggagauuucauuuagaucaggaaauuuguuuuucuaauggaagccaucucaggguggcuauuaguaacagucguucaaaauaaaauccaucccucgucagugugauguggauuucaaucauuagccuuccuuccaaaccuuccuuucaccuuuucaugcccgggcagaaugcaaguccuaauuucugcuguaaucugcuaauugcuuucuagcuagcucagagucccauuaguuucucaauagaggauaauuauucuacugugaucauccuguagcucagcuccuaucugaugagcauauucgaguguauccagcucugcuuucuaugacugggucucaauucaugcaucucagaugaaaacauugagucauuggguaagaacucuggacacaggugggcccaccacugaccagcuguguaucuguggaucaaugacuugaucucugacagucucacuuucccuauuugaacuggaacuguguacacuaugaaucucagaaggaugugaaagacagucucuuaaauaaauaaaccaugcaagacuccaucggcaacugagaaggccccaggaaacaugacuuaguaguacuucucaacuucucagccaucuugcuucugagagccagagcccacuguagacccguagaucuacucugaacaucugcugaagacuuauuuucuuuuuaaacauugucaauaguuaaaaguuuacuuuugcuuuuguuuuaaucacacacagugagggcaaagugcucaugaaauauuauggaggaaacauaaucuucaaagcaccagauuuuaaaaauccuugucucacauuuucaaguucauauacaauuauuauuauuaagacuccuuauguuuuguuuuuccauacucccugacuauaaaguauguacugaaccuuaaaaagaaaaaaaaacuaaaaaauaagaaaaaugugucacaugaacaagcaguauauucgaggcaggaugaauaaguaaacaaagaaauugcacaucacugggauuugggaugaaagaauaauguuuuacacuuccaaauggugacaguugguauauguuuggcccagagaauggcacuauuuggaggugugcccuuguuggaguagguguguccuuguuagaggagguguggccuuguuggaguaccuuugucacucacuaugagcaugggcuuuaauacccucgcccuagcugccuggaagucagauagagauguagaacucucagcuccuccugcaccaugccugccuagaugcugccaugcucccaccuugaugaugauaauggacugaaccucugaaccuguaagccugcccaaauuaaauguuguccuuauaagaguugucuuggucauggugucuguucacagcaguaaaacccuaggauacaaaucaauacgcauuuaaggugaaagaguuguagaauuagggaugguagaaucauaccaguaaucaucaaaacccuuuccaaggcauaaaaauacuacuagauuagcacaugccuugcugcugaguucuggaagccaugacagcuccauggaacauagcuucaggaaagcgaaucuguaugcauuuuaaaguagguaugacuggccucccugaacagacgugcuacuucacaauaagccaagcuaacagacgacccaagccacuuucccaucaagucacaucagaaucugauccuaauauuucaugucucugugacuguccaacggccccucuacuuuauuagaggcacaggcuaguccugagcuccccccugcccuagccucaaaggcacugggaucacagcagggagcuaccacaccuggcuuccagcaccaucaaucuccucaaacucacuaacaacaaaacagucuuccagugaaccacgaauagacagacuguaagcaucacuguucagguugcuacugcgugcucauaauaguugccccuaacaacaccguaauguggaaagaggccacugcuccuuagcgcaugcaguuguuggauugaaaaaaaggauggaaaucuagggugggaggaaucaagauugauuacauaugucaagauaucaguucugcuugaacagugauuaagugauuaaugaaguacugccagcaucacuaaaucucuuuacaggcaaguguuauguucuucccuucuuaauuaugaauuuggguguggaagagguauggauuacuagaagaaauuuacaagcuaauuuacaccccuuuaaaacgcaggcagacuaguccccucuuucugcuucugaguuucuaagaagggagaagggagcucuacccugacugacuguucugcuuauucuaagguauuguucucaugauggcagcugggacauucacgcacucauucauucagcaaacacucauuggugccagccaugcgggagggacaggccuggaggccaaggacuuguuagucuaacuaucuguccguggaaacuuucaaucuguguguucuggaagcuugagagcugcccuaacuaaaguaaugaaggaaguccugucagcgaugaagagacauuauuccaguucuacucaaagugagucugugaaaaauaaguaauuaaagccaggaucaagaaaacugaucacagaaaaagacgcuuaacugagccuucaacugcugucaguaggaaguagacggaacucccacguaggaagcaugcguggacacgugcuugcccgucucccagggaggauaagcugagcaacacugaguucagcagggauacaagcucugcccagacaggccuggagaagcuguuuaauugaaucauucauucauuaccuuuuuaguuucaucccaaacccauuuucucuuaggauaugaauucgaaguuuacugaggacuguacucuacugugaauuuauuuucauauauccugucaaaacauugagaaagaagaaccaagcagcuaauagauugcucaagugggcaacuugaaauuuuccagcaacaaacacguugugagugacauguuaggaaccugcagauagaaggcuaaguuaggacuaagagacuuagaguucauggucacauuuauauuucaccucacagacguccaacauggcagaagccagagguaaagggcauuguucuggacuugaauaucagagaaucacaguccucauauuuucacccaagaaauacugaccaggcacuugauauuuguaacuauggguaggcacuggucccugagaggagacaugccucugcuugucagauaguguucagaauagcaggggcaugagucaauagauauauuggugacaacugaggaagcuugcagacaggauacccaggacacagagagugucacuaaagcucagagaugaugaagucagucagacuuugaguuaagacaagcagaguuauagagaaaauuuggacagcaggaacaugugaagucagaaugacucuauugugcuugggggucauccuauuaagaucuugaauuuuacuaaaaaaaaacccuuuuauauuauuaauuauauuauaugaauauaauauaauuuggaauaagacacagaugaggcuguggcuuaaaagaugaucgagggucaaauagauauaauagagucaacaauaccauaugccauguaacuucugugugccuagcauccuuuuaggugcccagacaaugaaagaccgaccaauaaccaaguuccugauucagaggcucugauucagguggagagagaugguacgugaauggauuugaggaacagucuugaaauuauaauugugguccagcauuggagacugaagucauaugugcaagccggggagcagcaccaagggggagggaauggcaggguugggcaaucaauggaagguaggugguguggcauggauaucuuccaagggcucaugugauuuccugucuugccagugaccguccuucugccauugcaaagccgucugcggugcccuagugaucuccucacuagaacugaccagaggcuggugcccagccggugagccucuagagcucgaacauaaugagacgcauugcucuauaacuccacgaacuuagugagauacauugcuuuaugacuccacggccuuggcugcuucauugcugaauguuaccugaggauucuagaaaugaacagaaauuccugagaagaagcugugucuggcugugaacaaaacagcuccugggguaagucucugugucugcauugacugauggaugggauggagucucaguauugugcagagauuugcacuuuuguaguucaggggcuauuuuaucuuaggcugguuuuaguguucuagaacagacacuccuugcuccacucuguaucuuaacuaacaccucggauauuaaggaaaaaacaaacaaacaaaaaaaaaccucuuagaagccagucacuuagcagaacacuggcuuccaccaacccaugagcuaaggaugugucuugggccuauagaauagcuccgcuuaucucucugguauacccacaaauauauuuuaaacuuacccugacuugugauuuucuuuguccuguaaaaguguguguguguguguguguguguguguguguauauacacacacacauacauauauauacacacacauauauauauugaaacuguuuccacauuggaaguuggaauuugcaguaaucuaaaucucugucccugaggcuguggucccucaaaagagcuccagaauaaacucucauacacccuuuaagaugagaauguuuacauccacagguacuuacacuggcuaggcuuuuggcuucauguauucaaauggcuaucagauuucucuuaacucccuugaggucaaugugagaggcuagaggcagacagauuccuagagaggcaaacagauagggagagggacuggcacuauguaauaaagauggucaacguccaacauagccagcuagcuucuuccccuucuugacugcagacaaaagcuuggcucugugaaacaaaagccuuugcuccccacuuuccucagccaggagggccucugcuguagacuagcccaucaaguucaaagggaacauguuuacauaacagugucauuuuucaaacugaccaacccuaaauuaggggaggaagauccuucaaaaacuuagauaagccccagccuucaaggaggaguacccugucugcuuugaggaaggucucagugugcuugcuacggaggggguggggaggaguggggguggggaggaguggggguggggaggagugggggcgggugucucucaccccuaauaaaagucuuucuucaccaacagacagcgguuugagaauuucucagcuguuaccuaucacgcaagagauuacuccugccuuuuaauucuuuaaccaccagagaaaaugaacccaauccagaucacuaugcaguaauaagaguuacagcacagcugcggcucaccuacugccaacuagagucaccuguaggaagugucccuugaggcccuugcauuggaacccuccugguuuucucuacaccugucuuuagugucuccugcuuuagacagagcuucucuuagaagcaaccucaugaagauagagagaggcuaggacgggguuugaacuguugauucugucucucaacuaccucuuagcacuucuaacaaacacgacuugcaacaaauaaccaaacagaagccuaaagcaauccgcugcucuggcaacucuguaggcaugugcagagcucucgaguagucaacagaucacacggugagcaaguugcccucugcggugcucugugucaagagcccgggcaaagaaaguuccaguguacaguucacaucuacugcaaugcuuaagacaaacuauuaagaagucauggcuugugaucuucgucugcugucagacucuuuccaguucccugaguuggaggcuucuguuaguccagccacccaaacaucacccacuggccucaaagggggcauugcagcuucucuuugagucaguuuggugauguguguguguguguguguguguguguguguguguuguguguaugauagauguguaugguguauacaugugcacuuaugugugcagguaaucauggaggccaaaggaauuggguguucugcucugucauucuuaaauguauuccuuugaauacagcaucucucacugaccuggagcuaggcuggaagccagcaaacccccgugauccuucuguuucuguccaccccacuccccccggugcugaagcuacaagagcacaugcacccacaccggacagacucuuucauauggggauuugaacccaggcccucauguuugcauaccaaguguuccuaccaguuaaccugucuccccagccccucugacacaauuccuguuugaguccagaagagugcagggguuaguggggacugcaucucucuggaacuaggcugaaagacgggaagguucucucuggagacauacucacuuuauccacuuccuggauuuggauuugucagcagcccuguguaaacacgggaauucagacgcagcugcauugauucugacgggguagcaggcagggguguuguaagguguggaagcaacacccccuccagacccccucagugauagagaagucugguucucuuccacaggacucuguaagccagaagcgagaaacuucccaugcucacagccaggggccucuaccugguccuccaaagaacagaugcacaaaaggagagggagaaagaccuuccuuucccauggcucucuguugaaaguguacauuugaucugaaaccauuuggguacuuuuaacaguccuugggcuccugucuauugcguuuuauuaaugaacuaaaaagugauccaucccauaaucagcuuccaaaugcugacaccacugcauacacuagcaagauuuugcugaaaggacccagauauagcugucucuugugagacuaugccggggccuagcaaacacagaaguggaugcucacagucagcuauuggauggaucacagggcccccaauggaggagcuagagaaaguacccaaggaacuaaagggaucugcaacccuauagguagaacaacauuaugaacuaaccaguaccccagagcucuugacuuuagcuaccuauguaucaaaagauggccuagucggccaucacuggaaagggaggcccauuggucuugcaaacuuuauaugccccaguacaggggaacgccagggccaaaaagugggaguggguggguaggggagugggggggggaguguauuggggacuuuuuggauagcauuggaaauguaaaugaggaaaauaccuaauaaaaaauuaauucuaaaaaaaaaguuacuaaaguacaaaaauacauacauacauacauacauacauacauacauacauacauacaauaaaaccaaaacucccaagccacaaaacuccuucgucucagugcuuccuucucuuuccauugccuuagcccuguccuugacucugagguagcuuuagucuccugcugcuugugaaccugaauagacacccccuccccaggcccacagguccccucuggcuaaaucuuuaacuuguuccuguucccuuucuuucuaaucuccccaaaucacugcuucagguucuaggaggcacacaauacccuuugucacaagugggggaaaaaugaaacccggcuuaaucagccccacugggcacacuugugugaggcuucaaauugccucuuaccaaccccugcaggugcguuaaccauuuagacugcguuugaggaucucagccauccaggcucacucucacagcccccacaaacccccagccaggcucuuugccauaauuuuguaucuuacuaggaagauuucacauggagcaaggaacagguuucguccuuuucguuuucaggccaucccugcaucguuuugcuuucauuuaaccagaaaguacccagcagacaucgcugggguaaaaacucacuauucacugugguucuguuauuuucuuacggccaguguugaaacuauacaucuuagucaugagggagcaugcuugcaaagagcaaguuaaggcaggacugacauguuaaacucccugcccaaaugcccacauguuaaagcccugggggaaaggacacagacugaacagagcacagacagaaaacagccucacugucaacuggaaaugcagugugaccucucuaaagacaaauguguuuacacagagcugucuaucccaaaguacauuaggaauguggcugcuuaaaaagucaguguacacuugagguagguguuuuagaaagcgaauacaacaugauguuuaaggugggcuauuuguuuauaucuuuauuagucugccacaaauaguguggccuaaacgauagaaauuuauuuauuuuuccugauucuggaggcugaaagguggggccaagcuggggaggguugggccuuucugaggccuggagggaaggaagagccucuaucauuggcuuuaggccaccuuccugauucucuucauaucucuauuuuuuaugcauauuucacccccaaauuccccuuacuaugagaacaccacuguagagccauacuaacucucuuuuacuuguuuccuuuugggggaaggucccccuuuuuuuccugaauaaauucucauucugaggugcugcgggauuagccuucuaccuaugauggggguugaggacaguccccaucugugaagguuugaauaaaaaugccccccacagacucagguauuaaaauaguuagugagacuauugggagaggagggucaguggccuuacuagaggaaacauguuacuggggaccaguuuugaauuuugagggguuguagcuuugucccauuuccaguuuccucucccuccuuuguuuaaaguugaagaugugauuuggauuccugcucugaccuccugcugccuugucucccuuaccacugaaaccauuagccccccaaaacucacuuuuccuuaaguugccuuugaccacgguauuauaucacagcaauaggaaaguaacuagcacacuguccuucauauuacacuauuugcagacuccagugcaaaaugaaaccgugugucucuagcuagccacagagaaacagcccuccuccccucaggcccacaaggaucacacuccuuaucccauaauacucuugacacacccuuaguaucuagauuggacauaggggaucaguucucaaucgucuuaguguaugagguaaguuugcuggccagugggcaguucacucucaggacccaggcaguuugcuugcuacccuaaguggauagcagcaguggcuaugagauguaccagggagguagcggucaugagccugucccagagagaaaaagccaggugaacugaaucacgggccucuggcuuguucuugccuaucagacguauaugagauaccuaaacacaaagauaaaaauuauuaagaccccggacuauggagcauuaaacuauguguuggggccccuucugaacauggaacuuugagaaacuacacuagguucaugucugugaauccuuuucugaucuucuuugacuuaaguuagugcuguaggaaaaaaggaccaucaaaaugcaaaacacaugcuucagacucagagagaaucugccuuggauuccucaacugcauaacaggguucauucuagugcuggcaccauaggcgcugaugcgggauacccugagucauguggaucacuuaggaaacugaaaauaaaucuuaacuuggaauuuccuguuuauuuucauccuugcaauuucccaacaaccagaauaacauacuccuuuggaacaacuguagacuggaaaguaucauaaauuaacaagucaugugaccacucacagacguaggaagcucuugcuuucuuuaguggccuaccacagagcucauuucucuugaguggcuuuacuucacagaaauacgguaguucaucuuguauuuauaaggugcuuuuugguuuguuuguuugcuuuuuuuuuuuuuuuuuuuguuuguuugguuuuucgagacaggguuucucuguguagcccuggcuguccuggcacucacuuuguagaccaggcuggccucgaacucagaaauccgccaaucugccugccucugccucccgagugcugggauuaaaggcgugcgccaccacggccggcuuucuuucuuucuuuuuuuuuuuaaaggauaguauuucuuuucauuuccaucuauucaagcgaugacuuauguucccagcuaugugccggaagaucucguaaaaagcuuucaaggacaguuucugaaagcauuuggaaggaacaguacagagauaucucaaaucugcuacucugauagauugaaugaggacucgcuagcuaggagugaguucagaagagugcacaaaagcacuguuguuucaggacacccaagauacauaaaugaacugucgggucaaagaagaggaacugagggaacaacuggguucccuaagugacuuaacuuuucuggucccuggcuuggaaccuguuuuggaugacacuuguuacuaugacaaugaccaaugggaaaugagauuaguaguuuagugaugaagaguuaaaaggaccagacaaaccagaaaucuaugcuacugugcaaaauaagugagugcaguaaagagccaaucagaggaggugagugagguuaagagccaaucagaggaggugagugagguaaagagccaaucaggggaggggagugugggaaagggccaaucagaggaggcaaacaagaaaaacacaaagggagagaugcugggaaacgaugggcagagaugagagagauggaguccaguggguuggaguggccagggaaacagcuaaaccagacuggucauguuuuugcuuaaauucccaaucuccagauuaguuaggagaauugcguguugccugaggacauaggaauugcccagaucaguguauaaaacaauacauuuagacuuuuuuuuuuuuucccaagacaggguuucucuguguagcccuggcuguccuggaacucacuuuguagaccaggcuggccucgaacucauuuuugcuuuaugaaaauauucacuugugcauaugggauuugagagcaaggcacugcagacaguaagaagaccuauugaucguccuagggcuaaauggaaccucauguugcauguaugguguaggagaaaagucuaucuugccaguuacuaccucaguguaaugauauccagugcaggugcauguaaacuggcacagaguccucuccgguguugggaacuacuaggaucaggaaagagggcguuuccaccucuguaucagaaauugugcuauuaugggagaacaucagagcuccgauccuuucccagcucggccuccaguuuguggcuuucaguuucccagaaagcucucccaggugguaaugucucuucucguccuccacugggaacuacuacucugaaccacuuuuccuuacaagaugauucuggcaguagcagcaagcuccucuuuguucucuucaucagaaaaagcuuuaacgucuaaaugcauacaucaagacucuagcccagugcuuugucuacugauggcugugccuauuaauauagcucauggaaugaauuuaguaucguaaccacuaugacagaauagacaaaagaguauagaguaggaaaaaaaaaaccacucugauauuuugugcaagggcaucuucuaaaugaaaccuuuaauuagacauauaccccacauuuaccgugcauugugggaugaaauauuucugugaacaucagauucuuggcucuggcucuaguauggcucuaaccaguugguuucuugacuucuucugcuucaaauaucuuuuuuucacuuccuguccaauuucaugacuacuccugggacuacaucuucccaggaagcucgagagcuauuacauuuggugccacuauccagaauggauaaauccccccaacugcaaauucccaugucuguuccccucacuuucuaggacugauuuagcgcaaccuuaacuuccuagaugaagucugauugggugaugggggaguggugucuugcuuccagugucgaguauuuuugagucuccacaagaugcuuguggagcuuagagugugccccacauuugccucagugaccuuagcaggcgcuuuuccuugcacauaagaagagacucauugggaacuuucagcucauugaacuuugacgguggcugaugcauggguuuauggcuuucacauaaaauaugacuuaguacccuaccucuuuuuuucccauaugccaacucuuuauuuauccuuuaggacauugagagcucuuuggcgggucuccagcuccucaggccagucccuccucugcagcccuucagccauugcuugcugucuuaacaccuacucuacugucuugcaguuguuugaguuucugugucugucucuggcuucuuggagacugugucauuugguccucuuguuuuuauauucgcagcauggggguauguaguggaugcuguuggcucuguacucacaccuacuaauccagugcuuguucaccuucacucaaguucuacucaccugacagagucuguuucuacccaguuuucaggcaggccagaagcacccaagagugaaugucucaggaaugacaauaaauaaggggagggagguuucuggaaacagcacggcuuucugucugucugugggcccacugagaauucacagguccccgagaaucugacccucaguugcccauagaggucuucuucccuucucugcucauugccuuucucccuuacccugcuuccuagaacugccucccaaauaaacaaugugcauuacaauagacaucucagggauugccuucuggugagcccaaaacugcacagggaaagagcacauaccauuuaucagagagaaaccagggaggccuucagccauugcucaucgcacuucccuucacuuaccuugcuucacugucuuucuuuuaggcaagagccacggucaagguauugaccucacagacacccucauuguuucuuugcacuaauuguccagaagagccacaucagccugauggagcucacuacacuuguguacuggggaaccgacaccacaggaggaaaaacucacucugcccugaucagagccacuuuacaguuauggcuuuuagccuucaauguaguuucacaugugauuauucucaaucaacuuccuuuagcaaaaaccuugccuuucucuccucaggguacuuugcucccucuucauuuucccuuugcccuuccaguaucuggagucugugaguggucagccugacaacuugacccagccuagaaucacuggaaaagggaauccuaguggaguaauuguguuuauugcuuuggccugugcgcaugcccgugcagcauuuucuugauggauaauuauauaacugugguccuagcccacaguggaagauaucauuuccuggacagguaguccuggaccauaucaggaaguaggcugagcagaaagccugagccagucagcaagcauuguuccuccaugauucaugcacugaggcccugccuugacuucucucagugauggauugugacucauguauaagccaaauaaaccuuuuccuucccaagucccuuuuggucagagucuuguaucauagcaauggagaacuaaccagaacagugguguuagcaaguuuuagcacaugcuagaagaaagacucuucuggugagggaaaguggaccacaagaaggccuugguuuaguugacauggaaguggaggaccggguccaccaagagcaaugcugaggaugagaaacgauggacacacgguugucaagauaguccuggucagaggaagaagaggccaugaagaucauaagcuauggacaacacaugccauuauaaggcuugagacaaaugaagcacagagacuaaguaacucauugaaggucuuguaaauaucauauccaggcugucccugaagcucagagaucucuacggccauaugauacaacauuuccugauuuucccauaaagauuacugacauaugauagaaacagcacaacauguuugccucccagggcugguaugcuugaacgcacagaacaauauuacauguggcacagaacaauauugcauguggaaccuguuaugcauugcuauaaaucuacucuuaauggauaugcaacuagaauaacuuggauuaucaucuuaacgguuaggcgggaugccaaucauggcuaaagguaaaccagugcagugcucaagcagugagaaauggagcuguugcaaaacacggccaagcacaucguagccguuuccugguuccugcgcuugacucuaugaacuuaaccucugcugccaguuuuaugucagcuugacccaaacuugagucauuugugaagaggucgccucaguugagaacaugcaccuauagaauggcccauggguaagcuugugguacauuuucuaaacugauaaugaugugggagagccccucuucuuacugaugaugacucucuugucugugcuguccaaacccuagugcuggugcuuuaagaaagcaggccgagcaaacaauggagagcaauccagaaaacacccuucuuccacagccucugcaucagcuccugucuucagguuccuccugucuuucccugacuucccuucacgauggauuguaaucugugagguaaacgaaauaagcccuuucuuccccaaguugcuuuugcucauaguguuuaccauaaccagagaagcccuaacacagagaaguagacacugucuacuucugugccacucaagggccaauuccugggugugggucaaaucuugggugaugcccugguguacccccagcagcagcugcugcaguaucacuaaccauugaaccaucaggcacgcuaggugaugcccucgggaaccacaaucaugcccucugcucuggacuggggugcaggagacaagggacaccuccacucuuuuccccaauaccaauauuuuguuuucccuucuuugcuaauaaaaacucgauuucaggcuugucuacaauucacuugcaauucuacuggugcaggugauggggucaggaagagagacugugugguagcuagugcagaaugccuauacuuuuagugcaucaaccacagcgccuguguuuggagaaucucugggucugcaauguugaacuccagauuugcaggcuguaccuggggaguauggcagggagcugguuguuuucauauucaaagugcccuugauuauggaaaagaaggccucuucagccacuaucucaggucaggauuugggucugccaaauauagaaaggauuagcucccagugggugcugacccugacugggaggaucucggaucaggcuuccuguggcugagucccagcuagucucacaagcugcugcccuuuccuaacacuuaagcccaggcaggaucuccacgcuaagauacaaaguggccaacugccuaucuaugcauaugcuugccccuguguacuuagaguuuuacuuaacugaaaaauaccuaagagcauuucuggcugcuccagaauaggaagagcuggugugguuuagccuuggugaggauaaagccccuagagugcucugaaguacaacugagggaaaaaaaaaaaaaaaaaaacaacuuaaaaaugugugcauauguugaaggaaaaauaaaagaacaaagaacuggauuacaucuuguuuuaugccucuucgccaaagguuuuccuaggacagaacgcacaggagcugccaggaggcuccuucugguuuaaggccaccugcuugccuuugaucacggcacagucacgcguucagggacacaccuuuuaugucucagagacucgggccugaguugcuccuugcggacacugauucuuuuccuugggcuuccuucuaugcucacguuggggccuuacuguaugugggcugaugcucaaaccgaugcugcauuuaucaguuuguacgcgugucgggggcuguguaacuuauuugucagugguucaugaauauuauagagccauuguucagccuagagaaacggaggaccagaagguacaaaucccaucgcuguccaccccacugagccccgccuccccaaggggcguagcagacaggccuguuuggggguuaucuguagaauguagauccaacuucucccuuuggaagguaaugaaagaagacaucuuuuugucagcauuaucugaaaggugacccucuuaaucaacccguguaaaguuugcauuuugaaacuauuucuacucuccuaggucccgcaagccuggaaggcaagacccugccccuuaccucgcccuaauuuggaggacaagaggaugugcggaagagacugucccaucugccccgggacaguacacaagcaaccacaauacaaacuaggccuugcucuuacuugucuugcucaacuccuacccguuuuccgccccgagucccgggugccaaucagcccccaguucggcgcugcggacacucaccacgccacucgagggacgguuccuggaugugagucaaaucuugggcgaugcccuggugaauccccagcagcagcagcuguugcagccagagcagcugcagcaucgcuaaccauugcaccaucaggcacgcuaggugacacccacgggaaucagaaccguguccccugcucuggacuaggcugcaggaggcaagagaagcuaccacucuucuugaggaccacgccaucccagagcccuggagaugaacucgcc

SEQ ID NO: 12290 - RNA, 82521 nt, Mus musculus
uuucggcggggcggcccggccuggccggcuccuccuccuccccggccuccucccccaguccgggcugcucacgguuccgagguacugugcucgccccgccacuucucagcgccaggcaccgcgcgagccagcgacagagccggagucccgggucggacaccgcuccuccugggugccgcccggcucagcuucgcgccgcccggccgccccgccgcccuugaccgcaagcgcacagcacagcucggcaguucgggggcgcgcaggcggcgggccgcggccaccgagcaccgggacagggacugaagucuuucggcucugcgccccgcgcgcgccccggcgauggcugcucccgggcgccugcugcuacgcccucgccccggcggccuccugcugcugcugccgggucuccugcugccccucgccgacgccuucaaccuggacgucgaaagucccgccgaguaugcgggucccgagggaaguuacuucggauucgccguggacuucuucgagcccagcacguccucguaaguggccgcgcucgaguccccaggcgcccccucccccaccgcgcacccucagcggauccgcacccagccgcuggcuccaggguccucccggccccaaacccgccuacucucuccaugccgcggcuggcccaggucuggcauggaugaaacuuuuguggggaugaccuaaccugacacucagcauccaguuucaccguguccccaacuucuucugauuggcuggggacagugcgagagagcuuugaaggagcucuguuaagcauccaggaaaagugagacaucuguacaggcuuguccugcgagacuuuuggccaucucuugucauuccguaacuugcuucacuuggccccagaauuuuuuucuuccguaucaaccaguuagccucuuccuagugcuuuuugcuuucugaaauuagcucuuccuucgucugauucucucucucucgcucucucucucucucucucucgguuuuuuucccacuccucuucuagacacuccgaugacuaaagugaccaaauuguuguauuaauuuguaaaggacuaugagaccuuugcgcguuuaagguccaccagaugaauggaaugcgucaucugcuccuuucuaguccacuauuuaggucauuguucagacagagcgaggguguuugcugaguuuucacucucugcaggucacuucaaugcugaagaauacagcaggucacguaggcuuucaaauuacucacgucccguguugcaaaguuccugaggauuugugacggcuaaugucguguuuuuggauuaaaguugucuuugacucaacgcuggcaucauucucaucccuacuaguguaggaaaccccgauuaaauugauguuuuucaugucuauuacauuguauuuccaaagaaacgguuucuuuaguuacuucuuaguguaccccuugggguaacaacauauuuuuuuuuuaccacaaacccccaacuccccccccaauuuaguuuuggggaggugcaaggcauaauuuugauggguaggugauacaagguucauuugaaggugaccuaaguauuugucugagguaguuggggcagccuccaggguuugucaccguuuuccugaacacugaugaguaucauaggaaccaguccuuaaagcaaccuguagcuugggugggguuggcaaaaaucgacauuguuuauguagagcacgguuugauucacauugucagugcuuucuguuagaccugagcucacacucuccaaaaaaacaaaaacaaaaccaaaaaaccacagaagcaccaauugcagacauuuaaccacucccgccaugcgaaugaucucuuuguauggauagaguagagcuugggguucuacucaggggcccaggcugcugagucuguaauauaccucugagcuacagccacauccacucuaucagaccgcuuuaguuagcucacuguuuaaaaguuucuccuuuccauguauuuuuuguuuguuuguuuguuuuugguuuuucgagacaggguuucucuguauagcucuggccauccuggaacucacuuuguagaccaggcuggccucgaacucagaaaugcgccugccucugcuucccgagugcugggauuaaagacgugcaccaccacacccggcuccauguauuuuuuuaauuguaugcuuuuuacaucauggccacugcacuugcccccuggguguaucuuuuagauuaaauuauacagaaauuuuucugacugaaaauauauucucugccuuacaggaauuagcaguuaaauacuucagaguugauggaguguuuugcagauguuauuacuuuuuacuguuauuaauuuaguugguuuuuguuuuuguuuguuuguuuguuuguuuuuuugcuucuguuugucuauggcaaagauuuaguauccaagauacauccagaaacauggcaggcuggcaagcuuuuaauugucuuuugccauggaaaacagcaguuuugagcuguuggugguauuuacuauuguugauugcaaggaauguaacuaaucuuuggaaaacauauggauaugcaaugagcucauacauuuacacagucucauguuuacaggaacuuaugcaugaguuuuaauaguaagauauuguggaacuuuggagauugcauguuguauuuugaaacagucacuaucaacuuugguaccaagagaccagccuaacauaaaaaagaaagcaacuuugaggggcccccucccucccaauacaccuaaacaacgguuuauacuuacugacucuuccagauuaaaugaagauuauuacaaaauuauacuuaaucuuaaaauagaaaaaaaccaaaaccaaacaaaauuucagauggugguagcacaugcuuaaauccuaggacucuggaagcagagucaggcagaucucugaguugaaggccagccugguuuacagaaagaauucggggauagccaggacuacacagagaaaagcuaccucaucccaccugccaaaaacccaaccaaacaaaauuaugcuuaguauuggcaaaggcaccuguauauucacuauauauucagcaagcauuagaauccacaguauuguaugucauuaucuguugcauauauugauaguuccuuuuuuccuuuccuuuccuuucucucccuccuucccuccuucucucucucucucucucucucucucucucuuucuuucucucucucucucugccugcccgugccucccaagugcugggauuaaaggcaugcauuaccaugccuggcuuaaaaacuuuuaaaggagaacuauguaguaaaauguuaauaaaagagcucccccuaugugaaaaaaauugauuaaggaggagaguagcugugauccccacauauuccaguuucagaaaucuaaauacuacggaacggguucacuucuucuuuuucuuuuucuuuuuguaaauuuuauuuauuugaauuuuauauauaugaugaguacacugucccugucuucagacaaagcagaagauggcaucagaucccauuacagaugguugugagcugccaugugguugcugggauuugaacucagaaccuuuggaagagcagucagugcucuuaaccgcugagccaucucuccagccccucuuuuuucuuauaauagaagauuaugagugagaauaucaucuucauauuguuauggaaaugaaugcaucaguacucacuaaaaagaaguguuaagcaaagcuuccagaauggagccgggcauugugguagaaaaugcuuagaaaaugcaucuguaaucuuagcacuugagagauggagguaggaggaucaggaguucaagccccacuuauguccuguguuccaggccugcugggguaacaugauaccuuuucucagaacagaaaaggcccuaguuucaaguucuuuaucuccauuaggaacaauauugcaauagcugugggccaguuagcccgaauuagccguguuaacucagcuaaaaaugaauucuauuugcaucaggagauguugguugcaccuccacuucuauuaauggaacccuccuuucucuguugcccuggagaucauuucauauuccucccucugauuuucuauuuuacuuugccucuccugcuacacuccucugagauuagucacugcuuagucaccaggcagaaggacuuacaaucucuuccuugauaaugcuuccuugcugcuagcucgcuuucugcuucugcuucucacuugagccuggcucugggcggcucagagcuucuugaaucauucugccuauuuggcugauagaccugcaaaacauguuauauguuucuacugcuuuuauauuuccaaaacuuuuuuuuuucaguaguuccauuggcagaggaaauccaaacccagauuaaggccuccugaaggaaaauuuucaaauuuccaugucacaauaccuuagaaaaugacucaaaguaguguacuuaccugaagucccagcacccagaaugcugaggcaggagaggauugucacaaguuugaggccagccugggcuagguagugaguuccaggauggcuagcuuuggcuacagagugagaccuggucucaaaaacgcacacccaccccccaaaaagaaaaaaaagugcauguuuuaauaaacuugaauguacuguguugguuaauuuucuccaucauaaauaauacaucugguuaaacuacagucuuuauuauuuggaaagcaaaccuuaggucuauuccuuucgguuaagaucauagauuuauuggguggaugugaugguugguggauaccuuaauucccaggccucgggaugcagaggcagggcaaugccugugaguuccagggccgugcaugaaaugugguaguuacugucuccguuuuacuuuacauaguuguugacccaaagcauuuguuuguuuguagagaaaaucugaaacuugaauuacaccucaacuauuuuauacacauuuccuuuuauguauauaaauaguguuuuuuuuuucaggaguucccauuggacaccucagagucagcuacguauaugaaacaagcuuuaucucggaaaggccagugcugagagcagccaaagagcuuaguucauuuggaaaguuuggaaguguacuugucauuguuuggccagcugcccugcuugguagccagacuuguauucugugaagcaacugcccuuccucuucugcacuggguaggaagugcagcucagggccauccucacagcgugucucuuuccccucuuucucuucccacccccacccaaacugcuuucuccuucccaucucuugccuuccgcuccucucgcuccucucucucucuuucucucuaucucuuccuuucuuuuccugcugcuucuuagcaucuccccccauuccuuggcaucgcaugaauagcacacucauuucuggaguccuaaagaggcauuaguacaaauaaaucgaguuaccaucgagugcugguguagguguggcucuuggucauguuuuugggcguacuuuuuuuuggagugagauagagacagcaaggagagcaccgaaggcauguuggaucuuacguugcuuagcuucaaaaauauacacauucuuccgugaggucuuuccagccccgugcgagcuuaagguagcuccccaccugucggcuuugccaggaaacgguaugagccagcuuuccugcccuucgcuuuucccucuucuccuuugaguuaguuacuugagcacuaauggcucuguggaaagaaaagcuccuuuaaaagcagacuuuaaauuacuuccuauuucauuaggaaauaguuuauuaaguauaucaacugcugguuugauugcuaacguauuguuuucauuuaucgacuggccaccugggaaagaauuuaaguaacgacagagcguuguaccucuguucuggagaccugagaacggagauuucaagugacuccucuugacugcuugccuuguuugugaguugaccccuucuguuugcacuggguggugcugcuuguuacacugcaaacaacuuuucuauucugucuccucuuuucuuauaccuggacuucugcaggcaaucagcagacaguuuuaguugacuuuuaaguaacacuacuugcuuuuuauaaaguguuucauugaugggcuuacagguugguuuguuuguuuuuuuuuuuuguagcauaaauaacuuuugucuuaauuauucuuccucuuccucuucuuccucuuucuucucuucuuccuccugcuucuccucuuucuuuuucuucuccuucuuguaacugugaccuuucuaugccugccccaguucccaaauaaugcuuccucugacucugaguagugcaucccugugccauccuccuucccagagccaaucagucacucucucucucucucucucucucucuucagaagucccaccuuacuauuaugcuuuuuguuauaggucauaggcuuuuuauuucaaccaaucagaggcaccuuaagcaggcaaggaaggacagagauacgucuucacaaaguguacaaaaagaucacuucuaacaccaccuccaucaccaccuccaucaccaccuccaucaccaccuccaucaccaccuccuuucuccucuucuuccucuucucuuccucuccuccuuuccuuggucucucuguguagcccuggauauccaggcauucacucuguagaccagguuggcucuaacucaaagaucugccuaucucagccugccaagugcuggaauuaaaagugugcaccacaucagcccagcuuccuuaauuuucuuagcaucuuuuucccacccuguacccuccagucuaugggaauacuuauuuauuuuuuuuaauauauaacuuccuucuaagauucuuuacuuuugaggcuggagagauggcucagagguuaagagcacugacugcucuuccagagguccugaguucaaaucccagcaaccacaugguggcucacaaccaucuguaaugggaucugaugcccucuucuggugugucugaagacagcuauaguguacucacauacauuaaauaaauaaauaaauauuuuaaaaauucuuuuuuuuuaaacuuuuuccaaaucuccauuuguuucuuuuaaaauacuuaaauaucuuaaaaguaaccaaaguauuacagugauauuuguauaaaaaacucuguuucucauauuuuuaaucuuauugauuuuuaaucacuaaccugggauuagacccugacaguuuucacaaguuccaucuucauuauucuccuauuucuauguauuuuaccagugggcaagacugcacaugaagggaugcauagggaaacuguugaacaucaauauuagcucuucuaauuaccauccuuucaugccuguaaugugcggacagccugaugaaagcagaagccugguuccuggacuccugcaagcacucaggcugugugcugccaacagagacauuuuuauuccgugcucucucccacugugccccuucagcuuuagccagaggccguccccuaauaaguccccuaauaauaaccgaugagugcucgcgguuuuacaguugccaagucaagaagauaacucaaguauaaaacuaaauugaauuguuacauaaggacauuguuuuaaguauaauuuaaauaaucgaauuauuugaaaaguacgguuuccgugacccaagaguugauggaguacuuugggaaugacuuauugcuauguaguuaguaaaagacagagaccuguagcuaaugaauguguuguuaucugcucaggcagaagggugaacuagagccccacauucaaauaagcacuuauaaguugugaaucguuuugaaaaaaaauuauagaagguucugaacagaaauguguaaaagacacucuggaagugaguugcuugugggugucaaggcaaaucuggggaccagcuguucucacuuggaaccccauugguccacacacuaagggcucgcauauuucugugcucugauggccagugcaagaacucggaaggaaggaaccaaguccucgucaaggugcagacuuugacaagcagugcauggauagucucaggucaccagaucacugacuacuuugugacucagccuucuccugaccccacagcuugcauuucagccuucccguggccaaagaaaagggcagagcauaggaaccacugaauaccggucaccaccuuucagccugaaggcuaggggaagggaugugugcuagacuugacagcaucacauagugggagaaggaacuuggcuccccacuccauccccaguggaaggauggcaucccacagaggcuuacucuguguuagguacauuucuguugcuguguuaaaauaccaaggccagaagcaacuuugaaaagggaaaguucaugugggcucacgguuccagagguauaguccauauagcaguggaguauagucuguauagcgguggaggcaugcagcaggugguuggaguaagaugcugagagaucacauuuucgauuacaaacccaaaguagagugaacugacgugaggugaagcauauacucccaguccuuuucccuugauacacauccuucagcaaggcuaugucuacuaaaguuuccauaacugccccaaguuucaccaccgacuggaguccauaucuuaaaauaccugugccuacgaggggcuuuucccacucaaaccacugcauucuccucucuucugagcuuuugucccaguuccccauugaugaaaccacugauuggaaaaucacaguccauggaccacaucuccccacugccugccuggguaaauaaaguuuuauuagaacccccaaagaaaagcagcauauuugcaugaguuauucucuuggaaauuucuuuagauaaaaaugaacauuuaugguaucuccucccaccacagcgucccaguuaaaaaauguuauuuuuuugagagaggguuucauguagcucaggcuggcucugaucuugucagguagcauuauguagccaugguuggcuuugaacuucugauccuccuaucuccuguaugaugcgauuaugggcauugcccucacaccugauuuuaggugguacuagggguugaauucugcuuuguuuucuuuguuuuugcaagcgaggcaaagcacucugucaaaugagcuacaucuccuacucacuuugccugauuuuguggugcuagagauccaaccucaggcuuuagucaagugcugugacagucagcugcguguccagacuuguggcuaaaguucugaucuaauugagaggaaaacacacacacacacacacacauacacacacacacacacacacacacacacacacacacacacacaauuuacagcuagauuugccuuuguaaauuuauauauuuauagcaaaaauuacauauucuaauuugccuauguuaaucaacaaguucugaaagaauacagguauuguaaugacaaggaauuucuuucucuuguagugauaccaaucucacacucaacucuuuuuguuuuuuguuguuuuuuuucugugaaaggaagauucuugcugagugaaaaccaaugauuucuuacucagaaucauuacugugaugggagaaggccagcaguaggguuuuacugcugccaaauaugacugcauaaagauuuauuaaacagggcguggcuugcucugcaguuuaguuuggauuuugaauguguggguuucgagauaagcgucugaguaaaggauacuuauuucuaagcaguccacgcagcagcuuucuguuugcucucgcugaggucugacugcuacuacccagaagugagguugaguggauuauaaaaaauuacgauaaguaucguauacauuuaagauguacguugguuauacuuugccagaacuuaagugacuuguuuaaccagauggaaugguggugacggcaguaucuaucuagugcugccucccucgcuccccggcucucugcacgccccuuuuuugauaucgcuaaacuaaaucugucaguuccuugaaaaagcaagguggaggguuucuuuuucuuccuucuuccucauagcuuacucuugucugucugucuucucuuccaacuccuucugggcacagaucuccauuuucugcugggacuuacuuaggugucucacagacagaggcaugggacggacugagaacugaguucauguuuuccagggaucugcacuccucuccccuacuugcucgacaagcaccuucgaaugugaagaguuggauguuguuuuucuguuucucccauuucuguguucaaauccuagguguugucucucucuguucauucuacuaacuguuucuuucuuucuuucuuucuuccuuccuuucuuucuuucuuucuuucuuucuuuuugauuuauuuauuuauuauauaugagugguugcugggauuugaacucaggaccucuggaagagcagucagugcucuuaaccauugagccaucucuccagccuucauucuacuaacuguuucuuaacucuuucuccaucuccuuuggcuaauggcgcucgcucaccauccccuccuugagcguuuuuuuuuuuuuuccguuuuuuucuuuaauucuccaaagucaagacaguccccuuuccuaagguuuuaaauggaacugagauaaaacugaugguuuuaccaugucugaaaggaacuucauggcuuagcuuuugccagacucccagguaguuauuuugggccacuccuagcuugcucucuaugcuuagugauaccucuugucucuucugucugggaggcuaaguucuuuccuacccaggaucauuaugcaguauuuaaggugucccacccuccuuuucaucgcccuuucucaccuccccuuucccuuccuccuacagcaacuuccuagaugcucucucuccuaagcagguuccuccucucaagucacugugcaguccguagagauuguuuccccggaguacuuuaucucuaaaagaucuuuuuccauuccccugacaccuuccuggagagaguucccuuucccuaaaggaagucuuuccccuccauuccuugaagguaacuuuccuuuaucuaaggaaggccugccaucuucacugccaagaaacccucucccuuggccaguuguuugucuccuucagagcaaugucgcaugcuuuguuggcuggauugguuucuguggagaggacagugucuagaccaggcgucuuuagugccagaacugagccggaugcagcaaauauguucaagccuccacauuaauuuuugaaugagaagaaaacaaaaaguuagcucaggaguaguggugcccaugguuuuaaucuugguaccuggaggcagagaugggggcgggggaggaucuccaugagcgcaggaaggacagccauauuuugaggucuuuuuucaaaaacaaaaacaaacaaagaaaacccccacaaaaauaaaaaacaaaaaaaggcgagguggguggcaggagaaaaauaaaacuuaagaaaaaaaaguacugugugugugugugugugugugugugugugugugcgugugagugcgcguguaugaggacuauggugaacauucagggagaacagaggacaacuuccaggaauuaguuuuuuuucuaccauauaguuucuggaaauugaacucgggucuucagacuuggcaacaaucaucuuuacuaucucacugguccaagaaacugcauguacuuaaaauguauaguuugggguuagggaaguagcucagaggauaagagcacuggcuguucuuuuagaggacccagauucaauucccagcaucuacaaguagcucacaaccaucuguaacuccaguuccagggcauucaguaaacacucucuucugaacuccauaugugcaggcaugaguguuguacacagauauacaugcaggcaaaacacucagacacagaaaauaaauaaauuaaaauguacagcuuggauaauguacauuuuuaagugaacgcaagagaaauuaugucauagugggggaaauuaugcuuccugaaaguaguuuuuaaaaguauuuguggauaauaucaaaagaauguuggucguaaaucauauuauaaagaugacaaauuugugucauuugaaguaucacccggcuuuuguguuuuagcaggauguuucuccuggugggagcccccaaagcgaacacgacccagccugggauuguagaaggagggcaaguucucaaaugugaaugcucauccagccgccggugccagcccauugaguuugauucaacagguaaaccuugaugcuguuguccggucucuugauuuaugccauuugguuaguugguugguugguugguugguugguuuuggagacagggucucacuauguauucuugauuagccuggagcuuguuauguagaccaggcuggcuuugaacucacagagcucugccugccacucaaccuucugacaacagugaugccaaaggcuuguggcaccauacccggcccauuugguccuuuuucuugucuuguuuuuauuuuuguuuuaauguaacaacagggcuggagagauggcucagugguuaagaacacuuguggcucuugcagaggacugggguucaguucccaaggacccacuuggcagcugacaaacauuuguaacacuauuucugggagauccaguacccccuucuggccuccaaaggcacgggucaugcacaugguauacauacaugugugcagacaaaacacuuaugcacauaaauaaagguaaguaccaccuaagccacaucaccaccccacguccacggagagacuuagcuauagaaauggucuguacguguuugcuacagcaguucugugagucuccauugcuuuggaugucuuccagcugaagcuuacacuguccauauguagacaucuugggaaaaucuacuaagacaagucucuaucuccucagggaauagggagcucucaagaacaggagagguuucugcaguuugacugugagccaaggugaggcaggauucacugauuacugcagauuaccccucaacucaucaaugauucccaggcuuggugugaugcaaaaaacaaaacaaaaaaaggaagaacaacaacaaaaaaauaaguugagggcuggugagauggcucaguggguaagagcacccgacugcucuuccaaaggucuggaguucaaaucccagcaacuacaggguggcuuacaaccaucuguaacaagaucugacucugucuucuggagugucugaagacagcuacaguguacuuacauauaauaaauaaauaaaucuuuaaaaaaaacccaaaaaacacuuguaccaaaguaaaaaaaaaaaaaaaaaguugaggaaugaucuugaguagguaaauagauuuaggugacaaaaaaaaaucauaaacacauuuuuauuuaaaagguacuggaaauuuauauuguauuacugauaacaggauaauuuuguuuuucgaacaaauuuuaaugucaaucaagguguuggcaauaaaagaaaaguggaucuaaggaagaugaguuauucagauuuuauauucacaucguuagaauaaagcauacagacuccuauauacauauauguuggcauauuuuuuuuggggggugggagaugcugaagagauggcucaucacuuaaaagcucuuguuaucuugggaggucuuggguuugguuuguuagcacccacaugguagucaacaaccaucuguaacugcaguuccaggggaucugaugccuucuucuucuuuuuuuuuucucccccgagccaggauuucuuuguguaacccuugcuguucuggaacucacucuguagaccaggcuggccucgaacccagaaauccaccugccucugccucccaagugcugggauuaaaggcgugcgccaccacgcccagcuucugaugccuucuuaugaucucuguggguaugaggcaugcaugugguauauacauaacugugcaguuaaacuguauagaugaauguggagacuauccacauagcaggcuaauauggucuguuacuucuggauuguauucaagccaaucuuagcucccuauugcuggugucaaagcuaucucaacccugguuucuuucuuuuuuauugcuggagauugaacucaggaccuguguguggaaaacaugaccacugagcuuuuccucuaucccuagaugucuuucaacaacacaggguuauuacagccaguccuagaaguuagauaucugcaauggaucucacugggcuacccugcauuucucucggagccaauagcggggaaccuggagcuucuggcuucuuccuucagcuaaggccagcgguguucacaggauccagugcugccucccucuacugaugcucguccuggcccuucuuggacacacccagacguuggcggaugaugugacugaucacaccugccaagucuuuuauuaccuaggaagguucugggaaguaggacguacaucucgguuggagugguguuauucuauuggccggaaucucuuuacauguuuuaaaagucgauauugguuaugcugaaggcugcuuccagcaagagcuguguuuauauaaguaggcucagcuccuucucucguucuuuuucuguuggcagcugugguuacuuggaaagcaaacuugacuuagaagacugggauucaggcucggauacuuacugggugaccuuggaaaagugauuaacauuugcucaucgcaucagucuccuggguugucagagaaagcagaguugucauguagaucaaaggaguccacggcuugaauucacuuucuagauagcaaagugcuaugcuacacaagggaagaauagauuguuuauuacagccuguuacuagaucugggugaagaguaaucaugaaaaaggaauuacaagaaaggaaagaaauagagauaauuguggcuguugaguuaugucuugguuuacaacauauucucuguuauugugacuuuuggcaaaacccucuuauugccacguguuuuccuuuuccaaggaagcagauguuacuaacagacugaucaguacccaguuuuauuuauuauaaaaagagucuuuuccaguugcaaguggccucaugugccucuuauuccagcccugugguuggcagagacaggagggucacuggggcacgcuggcugccagacuagcuucagguccagugagagacccugucucaagggaauaaggcagagagcgauaaaggaggaccaggccucuggccucugcauacaugagcauggaugugggcauccacaccucugaaagcauauauaacacaccgccacucccuccccuuccaugaucauggucuguugaucuccacuggggaaggaacauugaucuucacuggggaaggaacacccuccucuuuccuuggaaauacaggcuugacugcaagcuuacgaauagggucuuuuaaaaguagaaggaucuaacuucauccuagagaaggucagauguaagguuccccuuuucacccugaacauccuguuacugcaacgcucaagcguguuucuagguuucagcugcaggcagcggacaagccuggccaggcagacucucauccagaagaaugcgguaaaguuauucccccucccacuccucccccauuccuaggcuuugcuuuaaauaacaaauguaaaaauggccuccgugguguacacuccccagcuuauugaagcuaauacacuuagguagacuggaaaacagcuuucugcaagucuaacuuccuccuucuggugaguuuuucugucuuuuagagauaugucuagauuguacauuuauaguagccuuuauaaauuacaaaguuaaaacaaaugaaacauaguguucuuuugcuacagugugaauuuagaguaaagauuuuucuuuaaugagcauguaucuuccgacagaaucagucaucuccugguucagaacugugggauuggagcaccuuaggaauacauacuuuuaucuaguucuuuuuuaucgauuaacauauagcuaauaauaucuuauuuaauaucaguaacauuugaccaaccaguuucacaugaucccuuuaaauccuacuucucacaguuugauccgacucauguccauucauucgcucaagacugggguugauuuuauuuuauuuuucuuuucgaaucuccaguaaagggauuuuguuuguaacuguuugaaguucuccggaucacuuccuccccaacacuagcaggaaacaauccagcauugagagagcagucggcucacacaagccuguguucuuugugcuguguuccugcagaaccucggagaugguggcuggugggaugaggggggaagagucugaauaaggcuaaauaaacagugcugguacccagaaaaaugagcuccagccuguuucuuccggauacacuuugcugacucuucuuguuuaucuuuagaggauagcugucuuagguaaacaauguuuccagauaguucuguggaaauuaguaacagcagccagcuucgguagggacacauagaguaugagaggaggaggggacaugcaccagccagaucagcugaaucacccuggugaccagcagaaugacagcugacagccacauugcucccaaagguguccuucaccaagagcagcagaggccuugggccucauucccggcugcaucccuaccaucuagacagaggauuuuaaugaaugaucaaagggcuuucuuccucugaccuugaaaguuucacauaaauaauaacuucuauugagagguuuuuuuuuuuucuuucucacccaaauuuauuuuuuacuaauauccaaguugaaguuuuauuuggaguagaaaacugcucgaggaagguuuuuuuuugguuuuuuuuguuuuuuguuuuuuguuuuuugguuuuuuuuuuuugguuuuucaagacagaguuucucuguuuaauccuggcuguccuggaacucacccuguagaccuggcuggccucgaacucagaaauccaccugccgcugccucccgagugcugggauuaaaggugugcaccaccaccgcccggcgggaugacauuguuuugacagcuuguuuuagcaaacaaaaaccaacaaauucucuaaggacccaaaucaucuaguuauuuacagaacccauaguaaugaauaggaacccaauggccgaaaacacguuugacuucuaaguagaagcuucucucguauuucuuuuggauauuucagcauuucucauuuaaaaagagugguauaaucuaguccaaaagauguucuuuagucauaaagagaagagaaaaaacuaucuguuuuaggguaccaggguaucuucaucuuaaaauucagcauaauguuaaugauaguuuaguucuccagcaagcugaacccucaugucugggcaguggcuugugaaacacucuggagagcauucgauacucacacugacugggugcuccuguuacggcuucugcccugaaggaaacaugcccuccugggaguuugguggggcacaaagaacauauuuuggaagauuguaaaaaaaaaaaaaaaaaaaaaaaaaagaggguuuaauuuucaagucucuagugauuugcuucaugauuuuauauuuauuuuuauuaguuuuaaaauagaguuucucuguguaguccuggcugucuuagaacuugauuuguguauuagccuugaacucacggaagaucugcuugucucugcugggauucaaagcaggccacugugcacccccccccccaaguuuauuuggguaauaugagccaguuguccaacacauuugagguaaaaaaaaaacaaaaaacaaaaaacaaaccaaaacaaacaaacaaaaaaaaaccccccaaaaaacaauguuucuuccagcccuggaauccccgaucuguauuuuauuuccuuuuuaagaguggcaacacaguccagcagucugggugguucagcauagugacagcgggacagcagcgacuucggggcugugacucaaaauauuuacuucccucauguguuccagaguggcugccaguccccgccagguccugaaugagcugccuguggguuuguuuggagagcggccuuuccuugcuuucucccgcccacucuauucacacuuccuuucagcggggccacugucugauguggacucuaguauuuuaagacuugggcucuuagugaagacaaacuuccuuugcagcaagcuucuugaaaggauggagaucuggagucguggcuguugaagcuggaggcaguuagauguaguagauggcguguauaugugugcauuuuuaugauuauugacuuaacuuuggguguuacuauaggccagugcauauaucagcuguauuuaguaauguaauuggacauuuggugaagauuuguguguuuggguguuucgccugcauguaugucagugcaucacguguaggaacuucaaccauuggauccccuagaacugaaaccacagauggucaugacccgccaugugggugccaugugggugcuaggaaucaaacuggauccucuggaaaugcagccagugcuuuaaagugugucaccucuccagcuuuggaacugaaaacauugaugcauggugcuuuaaggcauggcuguugauucugaacacuccuccacuucagagaagcucuauguuguuuuggaaugagugcccuuccugcugcccuacuuccucuaagguaguaguuuucaguugagaccucuuuggcaacucuuaucuuuaaaaguacuuauacuacaauucagagcaguagcaaaauuaugauuacgaaguagcagugaaacagguuuaugguuggggggucacuacaacaugaagaacuguauuaaagagucacaguauuagcaagguuggggaccaacuauauuaagggucacaggucaggcaaguugagcaccacugcccuaaggaagccaggccuuuuaauauuuaauguaauguaauuuauuuauuuauguuuugaagacagggguucuacuugcuugaacaggcagcccucagacucuugauuuaccagccucgguguccugagugcugggguuacagacuugcaucacaaugucugccuuaaauuaguuuuuaaaauuucugcuuacauccaaaacauaugucugauaucugaugcuuuaaaaacaaaacaaaaugaaaaaccucugaccaguauucauuuguucuuaauaagugguaaauauguuuucauauggaaaagaacuauggauuuuaaacugguugauaagcauaagaccaaaaauauagaauuugcauguauuuucugugacuuuucuagcuuacauuaaucuugauauccacagagacaagucccugagaagcauuauggcaggaaguaucuuuuuuuccuuuccuucuuuuuuuuguuuuuuuuuuuguuuuuuuuuuuuuuuuuuuuuuguuuuuuccagacaggguuucucuguguagcccuggcuguccuggaacucacuuuguagaccaggcuggccucgaacucagaaaucugccugccucugccucccgagugcugggauuaaaggcgugugccaccaugcccggcuccuuuccuucuuucuuuuugaguggugguggcacacgcuuuuaaucccagcacuggggaggcacagacaggcagauccuugaguucgaggccagccuggucuagagagugaguuccaggacagccaggaguacacagagaaacccugucucaacaacaaaacaaagcaaaaccaaacaggauucccuccccucccucccucccucccucccucccucccucccucccucccucccucccucccucccucccucccucccuuccuucuuucuuuucuuccuuuguuucuuucuuuuuauaacauauaauauauuuuaaguggaacacagacacuuggggaugcacaugggcuucuccaugaggaucuuguccacagcagugggugccucccauguccauagugagcugcacagaggcaucugcaucuugggaacuaaacaggagaaacccuuuucaaacaagcggaagaaaucgcugcagugggaaaggcacaggggaagacugcccuggaucuaggacagccucccuuuucacuguaugauucauuguaaagaggaagugagcucugagaaaaauaucugaaguauucugguaggggggagaaggcaguucuccaggagcuccaggcucuggguaccagcguggcucuuguacugacuugggcuuucaggaacuguuccuucccuggugucagugucucgugcaugcuugcucccucucacccccaugucgcugcacacccauacagcauucuggaggaucugcagcagacauccugaaggucauagccuccaucucgaguuaggcugcugagguuuggucauucuuagucagcaguggguugcugacaaacauccagaagaagggcugcagucaaccugggugcggucauguguacuguaggacccgguggaauuggaacuggcaccagccagggcaguggucacagcaguagacuagggguuguguugagccauuuacacgaagucaaaggggccccauccuuccaugucucuccuugcgauguuugugacagcuucugaguucuuccaucuuucucccucaaaaccagauccacuuccccaaagcccaaacucuuuagcucauguucaauauccucccaugugucagcacaugcccugccucauccuuccacauaggcacugccuugcacaucuccccgagguuugccccauccaggugauggaaggccuuuagcugguggugccauguccuccgccucugcagcaggcugcuuugagagaaaggcagaggaagcaaaccuggcaggccaugacguugauucacucugaggucccaggauccaccaggauaucuacucacucgaaacaguaacacugguacagucagggcuauauaagaacugggagucccugagcaggagauggagcuagcucuaguucagguccucacaggaaaggaagaggguuuccaggaacuuguccuuaugugggaaacaugcuccucccucaaacaagggcugcuacacguacacccuacccuggagacuuccacgacaggcagauagaugucuuugauguucugucagcucacggugacuuaucacuugaugaucucucugccuaggaggugaggcugaggacagcaguuuccuggagucuaccaguaucacguccaugauaugaucagccuucaggcucaggaaggguuucagcuauugcucuuccagguggccgacagggucaggggcaaagcuaucuggaaucaccauguuccaagagagagggccuuggagcaagagaaaggugccuccuaggaaccacugauguugucugcuagaaggaccuguguaccggggaugguauaggaagagguauuuuguauaccauuuuguuuuauauuuuauuuuauuccuauacuguuaucaaagucauuuauuuuuaguuauauguauuuuugaaugucuguggguggguaugcaccauauguaugcaggugcccuuggauguuauuggaucccaugaggcugugagucagcccccauggguacugggagcugaacuuggguccucuggaagacuagggcaugcucaucacaucugagccauuucuccagcuguuucuaccuugucagucuguuuuguaaggagagugagaccaugguggcuguuccaagcuucugcuacuugacaguguacaacaacauccggugcuaccauauacaaacuuaaauaaagcaaaguauauuucuugagaaaaacauuuguugagacaguuuuggaaaguagcauaauuaaacaaaauuuuacaaagaggaauugucuucuaaacauccaggccuaaaauaauugaagaaaaauggcuuagcacagggucauuuucagcaugaauggagggcguucuuuagcacaguggaaaggcccuucacaauucuuuuccugacuuuuccuccccugauguagagaacaacccuuaauucccuuagaauccaggaaugccuacucuuuuauuucuuugcauaaaacuuggucuagagcagugguucucaacccgugagucaugacucuuaugggauguuguaugaccuguacacagggcucaccuaaaaacaucaggaaacacauuugcauuaugauucauaacaguagccaaauuacaguuaugaaggagcaaugaaacuaauuuuauguuugcggccacuauaacaugaggaacuguaugcagcauuaggaaaagccacugaucuagaagguauuucuuuguugguacuguacaacuguauucguagccucucaugauuguauuguaguagacaugcguuucuauaaguauaugcuggguuuucagguagcauuauuauuucaaguggaaggaaugacguuucccaugcaaaugagccuugaauacaaaggcuguguauagaaaugagacuaccuaguuccguggacugaagacaggcauaggguaauauguauuuuaguaguaacuuaaguguaucugagauauuuggcuugaaauaccuauuuaugggugaaaaugcaugcuuuaugcucacgaaagcauucuuuaggagagaagccaaaaaugucagcagaggucauuucuuugugguguuuaggccucucuuuacguacagcucuauuuugcuacccuuugccauuccucgggauucccuguguucugacgucaguauaugccuuuaugauauggcaggaaugccugggaguagaacagguggccacagaguuuguuauaguuacucaacaauuuagggaauuucacuggaaaccuaccuuaugaugacguuuccacaucugugauauaauugauagugcuugcaguaaaccugacacacuaacaugcccuuuucuuucuuuuuaauuuuaauauuauguguauugguguuuuuuccugcguguaugucugugcaccgugugugugugcagggaucucagaagaggacuuccuggacuagaguuacagaugguugugaguugccaaguggguccugggaacugaacucuaguccccugcaagagcagcaaggaccuuuaaccacugagccaucucugcagcccccacacuuccuaauuagcuaauaauaguccuaaguuauguaaaguacaggagauacugcaguguaggcaaagugacuaaucaaagggacacuuuguuuguuuguuuguuuguuuguuuuucuuuuugagaagugaucacaguauguagcucuagcugcccuagaauucacuuuguagaccagguuggcuuugaacucacagaaaucugccugccucugccuccugagugcuggaacuagggguuauggccccugcacaccacaaagguacacuauucugaaccuggccggauagaaauagauucucguguucuagaacagucugacuuguuucugaccacacacacuguucuuuuccaggcaaucgagauuaugccaaagaugacccacuggaguuuaagucccaccagugguuuggagccucugugaggucaaagcaggauaaaaucuugguaagucuuuaggaacuaccucagcugaggggggccgguuuauguggagcacaggaagucuuguauguucaaauugguagugaaauuuggucuggccauuggugcaggccucugaucaaaggugggccaugggagcaugcuguuacucuccccuccugcuguuucccagguuucugcuucugcagccugccugcccacacucuuucucucuuccugcucaguuugauagucuccguggugccauugaacaaagucaaauccuguuuucucacacaccuuuuauuuauuuauguauuuauuuauuuuuuuauuuauuuaagcauaauucuuuguugauucuuugugaacuucacaccuuacaccucaaucccacucaauuuccaguccuuccauauccgauacuuucuacccuuuuaaccaccccccccaaagaaaauuaaaaauuaaaacaaacaaacaaaaccaaacccugccgcgugcccuuuacccaaucaucuuugcuuguaaauauucauugcgaugagucaucggucucauuugaggucuuuggcuucugcuacccuaucaauacuggacccucucagauauccuguuguugccuuuugucuuggagauccugcgggaccgggucucuucaugugcuccagcagcucauagcugggguugauguugggcugggccaacucaagcccugaaucugggucugagugguagcugaguuggucagcugaccaacucgcccacgcccacgccaccaggccaacucucucgcacugcugagguaagggcggggucagcucuucuguauccucaccacuggugccaccacacaguggcuggugaggggugggaucugcucaccaugguccucagacaucagcaugacaucaggcagacugcugaugaccacugcauggccuuaggugguaacgugagccauggacaucgacacagaccucugcugcaguaggaccacagacccugacauggcccuugguggaagcacgaccuagaaauuaucauggccccgggugccacucgcuacucaccucaggcuguuccucaccacacuccagcucagccucuucauggcacagaaaccacuccacuucucuuucucccccaucucuccaccacauauuugcucaucacaguggugacugccugcccauccuuuaaaaaacgauuuuauguguacgaguguuuugccagcuuguauaucccugcacuucaugcaugcagagccaauagaggucagaaaaaggcgucagauccucuguuacuggaguuauagaugauugugagcggccauguagguguuggggacuuagccugggucccccggaagagcagccagugcuccuaacuggagagccaucucugagccauuuccacagcucccucuccuucccacaguuuuaagcucccucuauccccccuuugagacaagauaucacucuguaacagggcuguacacacagucuuccagguuccaagauuauaaguacaugucuucaugccaggcuuaguccuuuuugugucuuggguuuaugugacacuguauaucuauauauuuuuuaaauuuauuuuauuuuuuauuuuuuaacauauauaagaaauaaauggaagcaaaaaagaaaaaagaaaaagucuuugauaagauucaacauacauucuuuuuuuuuuuuaaagauuuauuuauuuauuauauguaaguacacuguagcuaucaucagauacuccagaagagagagucagaucucguuaaggaugguugugagccaccacgugguugcugggauuugaacucuggaccuucggaggagcagucgggugcucuuacccacugagccaucucaccagccccucuuuuuuuuuuuguucuuguuuuuuuuguuuuuguuuuuuugagacaggguuacucuguguagcccuggcuguccuggaacucauucuguagaccaggcuggccuugaacucagaaaucugccugccucugccuccgaagugcugggauuaaaggcgugugccaccacuggccggcucaacaugcauucuuaauaaaagcccuagaacaaguaggacuguaggaaaccuauuccaacauaauaaagguuauguaugacaaacccauggccaauaucauccuaaaugaaugaaaccauuaauaagccccauuaaaaucaggaaugggagaggacuguccacugucccuacugcucauccauaaugugauugaagcauuagcuggagcaguaagguaagagaagggauacaaaugggaaaauaucaagucaaauuauuuucaauugaagauuauauuaucuuauauccaauguucccaaaauuugacuagaaaaauuauagaaauuaucaauaauuucagcaaaguguuaugauacauaauugacuuacaaaauuuaccagucuuaauacauauggguaacaagcaugcugagaaagagaucauggauacgcucuucuucccaguuucucaaaucaaaucaaauauuuagaauauacauaacaaaauggguaaaaaaaccucuacagugaaaacuuuaaaugugugaagaaagaguugaagaaacaugauaauuugaagaccucccaaguguagcuugguagaauuaacauugugaaaaaagaccuucuaccaaaacagcuuacugauucaaugaaaucacaaucaacauccucaucucauucuucucauaaauagaaagaaaauccucaaauugauauggaacaacaaaagacccagaauagccuauuauuaguccuagauaaguguuuguuucuaugccuucugcucguuuuaagugcaucuguuuaugaccccaacauauauauauauauauuucuauugaguccauuuucuuccauauuagaauggcuaccccagcuuguuucuugggaccauuugcuuggaaaauuguuuuccaaccuuuuacucugaggcagugucugucuuugucacugagguggguuuucuguaugcagaaaaaugcuggguccugauuacauaagucuguuaguuuaugucuuuuuauuggugaguugaguccauugauguuaagagauauuaaggaaaagugauuguuacuuccuguuauuuuuguuguuagagauggaauuauguuuguguggcuaucuucuuuuggguuuguugaaagacuucuuucuugcuucuucuuucuuuuuuuuguauuuuuccuccuuguguugguguuuuccaucuauuauccuuuguagggcuggaauuguggaaagauauuguguaaauuugguuuuuucauggaauaucuuguuuucucugucuaugguaauucugauaggucugccuuuauauguuacuugaccuuuuuccuuuacugcuuuuaauauucuuuuuuuguuuaguaaauuugguguuuugauuauuauguaacgggaggaauuucuuuuugaguccagucuauuuggaguucuguaggcuucuuguauguucaugugcaucucucucuuuagauuagggaauuuuucuucuauaaucuuguugaagauauuuacuggcccuuucaguugggaaucuucgcucucuucuauaccuauuauccuuagguuugguuuucucauuguguacuggguuuccuggauguuuuggguuaggagcuuuuuugccuuuugaauuuucuuugacuuugugucaauauuuucuaugguaucuucagcugagaaucucucuucuaucucuuguauucuguuggugaugcuugcaucuaugacuccugaucucuuuccuggguuuucuagcuccaaggccuuuuuccuuugugauuuauuuauuguuucuauuucuauuuuuagaucuuggaugauuuuguucauuuccuucuccuguuugauuguguuuucuuguaauucuuuaagggauuuuuguguuuccucuuuaagggcuucuagcugcuuaccuguguucgccuguauuucuuucuuuuuuuaaaaaaaauuauuuauuuauuuuuuauuaguuauuuucuuuauauacauugcaaaugcuaucucgaaaguccccuauacccucccuccgcccugcuccccuacccacccacucccgcuucuuggcccuggcauuccccuguacuggggcauauaaaguuugcaauaccaaggggccucucuucccagagauggcugacuaggccaucuucugcuacauaugcagcuagagauaugagcucuggggguacugguuaguucauauuguuguuccacuuacaggguuacagacuccuucagcuccuugggugcuuucuuuagauccuccauugggggcccuguguuccauguuauaguugacugugagcauccacuucuguauuuggcaggcacuggcauagccucauaugagacagcuauaacagggucucuuuagcaaaaucuugcuggcauaugcaauagugucuggguuuaguggcugauuaugggauggaucucugggugggguagucucuggauaguccauccuuuugucuuagcuucaaacuuugucucuguaacuccuuucauggguauuuuguucccucuucuaaggaggaauaaaguauccacccauuggucuucccucuucuuaauuuucuuguguuuugcaaauuguaucuuggguguucuauguuucugggcuaauauccacuuaucagugagugcauaucuaaugacuucuuuugugauuggguuaacucacuaaggaugauaucuuccagaucgucuguauuucuguaagggaguuauuuauguccuucuuaaaguucucuauuaucaugguaagaagggauuuuuagauccgaaucuugcuuuucuggugugaugguguacccaggacgugcuauguugggagaauuggguucugaugaugccaaguaaccuugguuucuguugcuuauguucuuacgcuugccucccgccaucugguucuugcuacuucuaccugcccuugcuauaucuggcuggagccuguccuuccugugauccugguuguguuagaacuccucagagucaagcugucucugugauccugugauccugagaucccggguguagcagagcuccugggaguaaagcugccucuuggaccgugagguucuggugugaucaagccccugggauucugggauucugggauucugggcguguuagaggaccugggaguggagcuuccucuggguguugugggacuggcugcagagauugggcccaaguucugcucagggcaccaagccagacuggaaggaaccggugccacugaucaggcgggauaccugcauuccuggauccagcuugucccaguuacuccuggugguguugggacagauguuauguccuccucaccucugauccuacuauuccugggugcuuuagaguuccugggaguggagcuuugucuggguguugugggacuggcugcagagaucagcccaaggucugccagacuggaaguauuaaauuuuauuuccuucuauuuugcucacuuuuguuuuuuguuuugguuuguuuuuuguuuguuuuuauuuuuguuuuugguuuuuuuuuuuuuugagacaggguuucucuguguagcucuggguguccugaaacucacucuguagaccaggcuggccucgaacucagaaauccaccugccucugccucucaagugcugggauuaaaggcgugcgccaccacugcccggcuugcucgcuuuuuaaaugucucugguaauacuuuuuuugugagcauccuaaccauugggguguuuuugagcucuacuaagucucuauuguuuucucuaacuaacccauuuacccagagguuccuuucauuuuccaugucugugaauacaaucuauacauuacacucuccaauaucucuagcuauuaguuggccccaaaauuuuaaauggguacuccuaacuuaugucugcuauuuuuuauuugucucucuaauagaguacucugaaugaagauggucaaagugggauucuuguuagccucugucaaagagcacgaacaagcaacaggacugacuuaucccugggugguuuggcuucccacucuaucaguggucccuauaaaauauauccaccuccgaaaugcauuucuugauagaucuccauccuugcucuccucccugcagcuaaccuucaccuuugcucaugcaggccaguguaguuguuccuguuccucucugucaguuuccucucauguccaggcuacagccuguucugcagagcaagacuuaagggaaucugcaauccccccuugaugaaaacaguggaguggcuuucuaucucugaauuuuaccagccaggcacauaaacaucccuaagaucaggcucauuguagguaggguuucaguugcugagauaaaacaccgugaccaaaagccacuuaagaagguuuauuucaguucacacuuccacuuuauaguccauuacccgaggagucaggguaagagcuagaggcaggaacugaagcagaagccauggaggguugcugcuuacuguccgggucaucauggcuugcucagccugauuuuucuguggcacucaggaucaccagcccaaggguggcuccacccacagcgagcugugggcucccacaucagugacagagaagaaaaugccccacauucuaauuuggugagggcauuuuuuuuuuuucuuuuucaguugagguucccucuuccaaaaugacucuagcuugugucaggaugacauaaaaauuagccagccaaaggauaugggcugaguuucuguuaccucaguccaucauagcuauuuuagugacacuugucuuuggguuuauuucuuccauaucccaggccauuucaaccaguaccuaguguuaugucccuucuacccggaguguuuuuucuugauuuuuuauucagccauuucauuuuguucaguguucacuuuuaauuucauuuucucagagaguccaucguaguuauuucauuuuuacuuacauuuuuaaaaauaugauaaugaaguaugaaggaaaauucugcuaaaggguugagguuacagcaggacaucaccuuggaggaugacaugucaaguccguagagcggaaggcuaggugugagauggggcuugugagaugcagagauugauggcuggaaaccaagcaggccaugcugcuuauccucccugcaguccaggaccugcagaggggcaacgccuccuguucuaaguuucaccagaguggauaggaaauaguucaaggccaggguuucugucggaaaguuauuauagaaauaugcugagcuuucuucuagcuguuacauuuuugcaaguuuuaugugccauuaaagcguucauuauuagauugcuucugugagauauugaaaucaaacccuuggaaaguucccacaguuuacuuggaaaguacauaggagaagcgcugcaggguacuuuugcuugcugcuuacucgccgucuaacgcagggguaucuccuacacacacaagaauggguuuaguucaaaaggugacucaaucugugaccuucagcucagaaucuagaaauaaugguucaugaaacaagagcucugcugacugcuaaagacaggaaauaugagcuacgaguauagucuucagaaaaucuacuccuuauuguaccugaaaaacuucgaagugacagagaaucugaagaaaaccaacaaaacaaccaaaacaacagcagcagcccuucuuuuagaaucguuauuccugugauaaagcagaggcuggguuugaaguuuucaauguuuagugcucuuguauucugaguuaguauagauacuaggauuguuaguuuuucagaggauucuuguaccauggacuccaccuuuguuuuuuaggccugugcuccauuguaccacuggaggacugagaugaagcaggagagagagccaguuggaaccugcuuucuucaggacggcacaaagaccguugaguaugcuccaugcaggucaaguauguaugaaaagcugcaccuucucuuaacaagagacccuaggagccuaguuuuugugugagaugcaugugugugucuguaugacaaauuguguggacauugugagguuaauagagcaaaaugaccuaacucugcucauacaaagaaauuacaaaugugaauugaccauguuucuaagaacucaguuuggucauccuugauuugugauaauuaauaucuacucuuggaaauauguuguguccaguccuaguuagugaaaagacguuuauauaagcuucucucaaggaggagugggcaucacaguuaaagauuccgagucacuagaucaggccuggcaccuacauuuuaaucaagcucuguaaggucgugcuguugcaccuaaguaugagaaacacaguuguagaugaauaaugacguuaaaagaaaaggacagugaagauaguguuuagguuucuuaagucuaaaucugcuaggcuuugcuuucauuuuugcuucaacuaacauuagugaaaagccugcgugucuguugguugcuccaaugaaagucacacccaggugaugucuugcagguaucauuuggcuacacuuuucucugcauaucuuucuuccgcuggagaucccagaccuuuugcaagccugcuucuuguugaauuucccugacuuuacauucucuuuauaccaaagacauaaaaauagauuguccaagcugggcuguggugauguaugccuuuaaucccagcacuuggggggagucagaggcagacgaaucucugugaguuugaggccaguuggucuacagagugaguuccagaauagccaaugcugcauagagagaccaugucuuggaaaaaccaaaaaaccaaaaaacccaaagucaaccaaacaaaaaaaauaggucauucaaaugcagucuugccuugucuaugaggcauauucuacaagauguuccaucgacaccuaagaccauagguaguaugaaauucuacaugcuacuaaauuucuuugaugaaucauuuauuuuagacaaucucccaaguagugacuucagaacagaauuaauagugagugacugaaacaguuaacaguaaaauuaugccaaaaauggggaacuccagguagucuaccugguaucuuuuaugaugcucaaccaaauaguugagcagacagaauuaaccaguaaagucucaacaggugaaacacuugcuagaagauucaucuccacaugagcugacauauaacauuagaucaaaggaaugacagucuuccaacuacaaaguauuugaaucuccagggaauugcauuuuuuuuuauuaaacaguuauuucuuaguugaccacuugaucauccuaccuacuguaaaugggaaauacacaucaaggggaugcuaccuguguagaaagcaugcgcugccuggguggaggaagucagagcuccauccucugagcuuggugccaucugucucacuacauucgugugggugguuaggucaccguagcauccucagugguaguguguagggaauguaaggaccacuuuaguguuuuuaaugccgguauuucaaaaacacucauuuugaaaauauaacuucauagcucugaggagagagaaugccuuauccugugucaguaaagcugacauagaauacauaaguacaugcauucacaugcgugcacacagauuuccgugcaugugcacacacagacaggcacaccaaccaucacucuucucauuugagaaauguggaaacagagacucgggacagguggggcauauuccuccguauauuccaugguaccaaauggucaaauaagaguuugaacccagguuguaauauuuuuuuucuuuuggugcuagaugcugagcucaggucucauguauguuaagcacuuucaccccugaacugaacccccagucugucuuuacuaaccagagcauuugcuuuacauuuccggcgcacgccuuuaaucccagcacuuaggaggcagaggcaggcagauuucugaguucaaggccagccuggucuacaaagugaguuccaggacagccagggcuauacagagaaacccugccuggaaaaaaccuaacaaacaaacaaacaaacaaacaaacaaacaugucugaaaagagcacuuagcgaugcaucuaugugcagcuaguucuuuuacuuuuuuuuuuuuuuuuuuuuuuuuuuuuuugguuuuucgagacaggguuucucuuuuagcccuggcuguccuggaacucacucuguagaccaggcuggccucgaacucagagauccgccugccucugccuccagagugcugggauuaaaggcgugugccaccaccaccuggcuguguagcuaguucuuaaugcuuccauuauuuguuuuagacauaaaaauuaugaaguaaugaagucauuauuuccuaagauacauucuaacuacagugauuugugacuugugaaccugccuuugcaaacaccuuuaaaaaaagauuauuuauuuuauguauauuaguacacgguagcuguacagaugguugugagccauuaugugguuucugggguuugaacucaggaccucugcucacucuggcccugcuugccccggcccaaagauuuauuuauuauuauaugucaaugcacuguagcuaucuucagacacaccaaaagagggcaucagaucucaauauggaugguugugagccaccaugugguugcugggauuugaacucaggaccuuugaaagaacagucagugcuuuuaacugcugagccaucucuccagcccuacaaauaccuuuuuuaugggaauuuagccacacccauuugcuuauucacugucuggaaaguugagucauucuggaguugacauaguuaguauaugaccccuguuuccugaaguacuuaaaugucuggaucuuuucaggaaagguuuguggaacucugguccaagucaaacaucucaaagaaaagcaucauagaacacguagacagaggaaaugccucucuuagcaaaccaggcuauaguacaugcucuuuggucagaccuuugacauaggacauaccagcaggcuccaauuaagaaggcugaaacuuacccagaguggacacugaggaggaguagagcuggaaaaccugggugauagccucggauuccccuggcucugaaccggagcucugggcaaucaauccccuuaaccacgcugagcccucacucccuuauuggaaaaacaccgaaucugcccaagccuuuccgagguacugcuuggcguauguuuuucuuuucuucuguuucuuuuuaaaauucuucucucauauguaaguguccccucucuccccuccugccagcaccguuugauaguucguguucauucaugcuucaguaaccuguacagcgcagagcaggaugguuccaguuuugugaggcugccugcugaccucugagccuuugccugcuuggcuguggcgguuuauguccgugugugcuggggcuggcuuuguuguuguuguucggcuggcugcugaugcauugacuuuuguuucuagcgugaccugcguauacagccuggauaaagagccucacucuuagccucccaauuacuuccuuauuguucguguuugcuuguggcuuuaacagcaauauccauaaucacacuuggccuuaagcacuaaccagaugucugucuguugaaaaccugacacgguguggagacucuuugaacgcuaugcuccccugaauccguugcucccgaccucuaauuuugauagccauauuuggauaguuaagguuucuaguuuuuucuuccacuuuucagauaauggccaucagguugcugaucaaaauagcacagcucaguaguauucauagugccagcugguuggcuguugacaagucacuuaaugccucuagacugggcuucugaacccgugacuaguaaucacagcucuccaaggauuguucugagcuaagugaauagcuuccgguaagugcuuaaugcacgccuguggccucucuguccccaaucacuccuugucauaauauuuccaggcuugacaagcggaaguaguuuuggcuaucaguggagauaaacacugagcccuucacugaacuaagcuguuguauucagagaguuuuuaaauugucagaagcacccgcuuuaguacgugccugucaaggauauuuuaaagaaguuguauuuccaacuggauaucucaggaaaccaaauaaagcagaaaguugcauaguacaaauaaaaaaagcaugucuucauaaacggcuuaaggccauugcccagaugcagcuugaauggaggaaaugcaugguggaguuaagguugaaguacaauuccuuggugugacucacuagacacuggaaaccccaguccacauuuuuccuauucccucuugguuagaaaaauuuacauuacaguaguguuacacuuuuguggccauuuucuuaaaacaacaaaaaaaauuauuuuauuguguaaucuuggggcaguucccagauuuuaaaauuggguuccaagauuggaagggauuguuugcccccccccccccaauucuuagaaguuugacauuaugauuaaaaugaacuauuuuugguuucuauacuugaguggccugacugggaguaacuuaugauguaucugaaaugcaaggaaaacaaauuuuuuugguaacuaaaagauggcaucuaauaaaggaagaauuaaaaaaaaaaaaaaaaaaaaaaaccaaaccugagcugccucucuauucuggguguaguauugcucaugauuaaaguuagcuuaaauuaauuggccaguuacuuagaucagaaucagucacuuuuccugagacuuacaaagaacaaacaaacaaaacagaguaauuacaggaaagcaaauuauugacugcuauaguuggaggacacuugagagccauauuuaaacgaacuuaaucagcuccuaugacuguagcuacagaauaguggcauaguuuacucugcagauaacauuaaguuuggacuuugcaauuuucugaaauucugcaugguguuauuuguaguuuguuuuuguuuuugugauagggucucuugacauaagucugguugucuuggaacucacuauguaaccaggcuggccuuguuucauggaaauccuccugccucugccucccaagugcugggauuaaagaugugugccaucccuucagaccccuccaacuaguuuuuguguuuuaucaucauccgugaaauguauacauaggaaauauauuauuaagacuguauggaugucuuuguuguuuuuccuaagaacuuugcaaagacauagcaacuguaagguaauggggagaaaguauuucaaauagaagacuuaaauuugcagaugaaggcucagugguuguuaagguaaaaugggucauuauugguaucuuuuugaaaaacaagauauaauuguauagagaauguacauuauagagcacauugcaucucauaauauuuugugagauuuuaaguuauguauuuauuuugcauauucucaauguuugaugcauuguaauacaagguauaauauuucugugaguugugauuggaaaaaguaguuuaauccagcuguggcaacaugugccuuaauccuagcacuugaaaaauagagacaggaggauccugaauuugaguccauagauuguauggacaauacaguggaauucuuaggaucuuagcugaucuuucugguccuuggugacuggcccacaugcucuucacagcggugucucuguuuuguaucugggagcagcagaugguccugaugaacagaugaacaugugagcuaguguaacaguagccagaugccugagugagugcugcagagaaaccgugguucaacaacagcagguuuauuucaugcuuuguuuguguuauuugcuuguuuugggguuuguguauauuucccauuuuuuuuuuuaauuuuagaaaauauugaugcugauggccagggauuuugucaaggaggauucagcauugauuuuacuaaaguaaguucccauguaagauagauucagaucuuucuuuacugacucaacuggcuuuaaaaaugcgugcuccuuacuucagcuuuucaagaauuauuguguuuuaaugaaaaaguaugaagugguccguucauuuugauauucguuucuuucauuuugauauucuuugauuuauaauauuauccucuucuucauaaauauugcuuauuuaaaauggugagauagcacagugagacuggggaagguaacuaugacggcauuggaguucccaggggagaugagaggcucagccagugggggcgcuugucacccaagugugaugacuugaguucagucccugggacccacaugaacugacucuacagauguguccucuaaucuccacauguacaccuccccuacuuacgucaugcccaacagaccccacacagacacagagacacgcagauauauacucacaacuuccacauccacacauccucaaacacaaacauucucucucucucucucucucucacacacacacacacacacacacacacacacgaaauuuccacuuacggaaaauuauagacuauuacaguuuuguuuucaacugaaauuguuuuuuuacaaaagcuauuaauaggauuuuuuuuuuuuuuuuuuuuuuuuuuuuacaaaauuaguuuaauugcaugaaagcugagaaacgaaucuguuugccaucuguuuuuuugucuguaggugccaagugaagcugaggcagucuaaucaugguggaaaaucucaugagcaggauucuaauuuuaauuaaacugacaugcuccuuaaacucaauaguuuuuaaucuagcuaaauaaaaaguucaucagcauuuuuaaagacaaacuuuuuaaaguauucuucuuuaugauuuuuuuuguuuacuuuagcaucuuuuuuuuccucagcugucuaaacguguuggauaucaagaugauaauaucuaauauauugacuuaaaguagagcuuccuggcccugggggguggcacacaucauaaucccagcucugaggaagcuaaggcagaugauugcaaguuccuacuuaccuuggcuauacagugagacccuguuucaaagcaaggacacccaaaguaacaauaacagcaauaaauguggaguguaaaguuauaggugcauuuggggagggaaaugaccugccucuagcaagaaaaaaauuccaagacaccaucauguacaaacacaagauaccuugaauuagacccuuacaguuuguuacagauuuuaaaaaaaugcuggugucuuuacuaaaauuuucccucugaagccacguaucuuuagguuugugagauacuaaaauaguuuuucuuuagcagaacauuucuuagagaucauuagaaaauuuaucuuaaguaauuguagaucuacuauaggaaguuagcaaacuuuuucauauugcaaucaaauaauauucccaccaguacuucauucugaauguacagaauagcccagaucuucagaaaaaaauguuucuguguuagaugaaguuauuacauuccuucuuaauuccucuuggaaguuacuucauacugcugaagcugagaugcugaggcaacagcuugugacuuaauuaugauguuuuuagucugugcauaaguaccuguaaugcuuagugcacugagggcgggguccaugcucaugguuuuuaagcaucgcacuucuguucugugauuugaucuaggcugacagaguacuucucggugguccugguagcuuuuauuggcaagguaaguucagaguuuucaaaugaauacuagucuacucacaugcccaugguauauuucaaauuauacuaaaaaagaaauagaaaauguaauuuaaguauauaaauuaucugguauucaguauuuuuaggaaauaauuugauguguauucuauggugaauauuaaaugaacauauauuuuagauagaaaacaacaauuuuaaaggugaauuuaaaguaaacauauagaguaauuuuuaaaaguuuguuuguuuuguuuuuguuuuuuguucuuuugguaagugguuuguauuuuauuuuuauaauccagacaccauggcauauacauuaguaaguauagccugcugaaagcuagguguuuucaauugcuuauuagaauacccaaaugauugcuuuagccuuucuaaucacugcccuugagggcuuuaaagguuagaucuuagcuggacauagugauccgcaucauuaaucccagcauucaugaggcagaggcuggcagaucucugagaguucaaaacaaacacauaaaaccucaacuuaacuuuuaaaaaguaauuaaauugguggugauauaaagauaaaacacuguauccauucuagaaaagucuuacuacaauagccaucucauugcugacauuuugagggagggagggaaaaaaagagaaaucacgaaguagaaacaauguuauaagacauuguacacaguauauacaagacuaaaauccaaagaguaucuucauuuguuugauuuguuagagauacauauuuguguagcuaauacgcuccuuguuuaguuucuguuauagagagcuguucaccgggucauagcucuccuuuccuaacaguccaguguaaggggcuuuguuugcaagcacuagaaaggacgugaugguaucuauuugaaagucuuuuucacuuugacuuuugcuuuuucuuucacucugauuuuccguauaaggcucuuucugggaaacucugugcuuucauuccaugucuagacagagauagagagagaagggaaaagcgaucaguguuggugcacaccuuuaaucccagcacuugggaaacagaggcaggcggaucucugaguuugaggcuagccuggucuacagagugaguuccaggacagccaggacuauacagagaaacccugucuuaaaaaaaccaaacaacaauaacaacaaaauaaagaauaaaugaaaaguugagaaaacaucuagaaaaaccaggcaucaacagcaacagccugggccacucugagaaacacacuagcuaagacagaaaaguguguguucugugaguuaugcagcuauuggaaaguggugcucaugaaaguuuuaauuacauuuuauuucugugaaacaaaagcagcauuuuaagaaggugcaaaugaagaaauaagggcugcugcuuucuuguuaggcagagcugcucugacagcuuccauuuauagccuggagugugccacuuccugauggaguacuuauaggccuguggggcuucaaccccuagcucccaggucaggggagagaaaacguaauaccaagcuuggguuuguuuuucuucuuacuaagcaugccuuaaccuguuaguguagccaagcgaguagaauuuggguauuucuuccaaacaacuaugaacgaagcuagauuuugugauucucaguaucccacuaacuuaagacaccucuucuaagauguauugacguauugauaucauguuuauauaacaggccugcaauauacaauuaaaaggcucaauucacagaggauuauuuuacacaaggguuuuuuuuuuuuuuugguuguuaagaguuacuugagacugacuaguaauuagaaauaguaaugucuagccaggaucuguaggaaccccagcccucagagcugaggcagaagaauugaguucgagaccagccuggaguacauagugagacccccaugccacgaacagcaaaaugaaaugaaacaccagaaauaauaauaucuagccagcacuuuguucaugaaggcaccacucugaaguucccuugagagggcuauuucacucauucuugucuucccuccaccacaggucagcucauuucggaccaaguggcagaaaucauaucuaaauaugacccaaaugucuacagcaucaaauauaauaaccaauuagcaacacggacugcacaagcaauuuuugaugacaguuauuuggguaaguaaacacaaaauauacaguugcauggagauuugguaugguugcucuguaauuuugcauauacuacuuuaaguaaaaaaacaaucacugugaaauagauuguuuaaaaagcgucaaagaggcagauagcuuugaauagguguugaacacauagguuaugcucuaauucagcaauuaaaacugaagaaagugcugauuuguacauggcuaguaauaauaaccuugaaaugucacuccugugcucugggcguugucugugcuuccuuuguauugcuuauguaauccucgaaagucugcagcacacaccguuuucaugucuguaugaugaggaaugaugcugagggucagagggcaagcugcuugcccacuguaccaagucacggcugaggcguuuucacuacugcccuuuggacacagguuuuggucugagacuacaucaguguuuguucucacucucuaaauuucuuuguuauuuauggaagcaagucacaccacggagggaggacuuggugccugagaaucuguuauuccuugugccugcagacuucccugucuuuaacacuccuugucuuaguuuucugauacggaccggaugcccuuuuugaguacuuggccgacucgcuuuaaacuuuucuugucacaugcguguaaauucuuuaccccuggaggagaaagaagcuucaaagagucugaagagaaucaccgugucucaccuuucguuccugucuagguuacucuguggccgugggagacuucaauggugacggcauugaagguaggaagaacuuggguuacccaucguguucuccaaauaagcgcuggaaacacaaaggcuggaaagcuuagcaguuugcaacccuggcuguggaacauacagaaggaagaaagugucggaggggugggguugggggugggcaggggacaaguucugccuggcaggacugcugggggcugggagggggacaaguucugccuggcagaacugcugggggccuggagcucuuugcuugucccuuuugaggcccugguaaauucugucuggguggagaggcuuuuccucuuuuggguuaucuguggcuuguggucauagucgggagcaggcuguaccuccuuccuccuugcccugcuuccaguguagccaccuggaaaucacauagguccugcuucugaccccagccacagucucauuucagcuagguauuguuuuucccuacuguaauauaaccuccccaccccccuugaucuuucuguuccuguuuaauaagauggugagucauuugagggcuuacaugcauguuuuugaguuccuggcuguccuugaacucacucuguaaaccaggcuggcaucaaaguuaaucugccuaccuccacagagauccuccugccccugccuacugaguguugguauuaaaggugugugccaccacuccuggcauauuugaguucuuaauacuguuuuuauaauuuaaaaugcaagguagguuacuuuguauccaacaucgauccaaaaggucucuaguuuguuuucuacugaauuuauaaaauuuaaagcucucugguagaguaccuccaucuguaaauuccaguguuugucuuaaaaaaugaguaauuaagcugggcgugguggcgcacgccuuuaaucccagcacucaggaggcagaggcaggcgaauuucugaguucgaggccagccuggucuacagagugaguuccaggacagccagggcuacacagagaaacccuaucucgaaaaacaaaaaacaaaaacaaaaacaaaaaaaagaguaauuaaguuuuucuuucuuucuuuuuuuuuuuaaaaaaaaaaacuggauauuuucuuuauuuacauuucaaauguuauccccuuuccaguuucccucucuacuggaaacccccuaucacauccucccccccugcuucuaugaggguguuccuccacacacccacccacucccaucuccccacucuugauuccccuacacuggggcaucuauugggcauucauuggaccaagguccucuccuuccauugaugccugacaaggccauccucugcuacauaugcagcuggaacuauguguacuccuuuguugauggcuuagucucugggaguccuggggggucugguugguugauauuguuguucuuccuaugggguuacaaaccccuucagcuccuucaguccacucucuaacuccucuauuaaggacacucagucaagugguuggcugcuaacaucuaccucuguauuuguaaggcucuggcagggccucucaggagauagccauaucaggcuccuuucagcaugcacuucuuggcauccacaauagugucugaguuugguaacuguaaaugguaugagucaguaauuaagguuuuauucccccccccccccagauuuugucucaggaguuccaagagcagcaaggacuuugggaaugguaagaugaaaaaggguguuuuuaaaccuaugggggagaaugggcuggggagauggucagaagauaucucaaaagcaugaggucugcuauuuggauuccgggugggcaucugaaaggaggcccaucacgcuguaacccuggugcuguguagagacagguggaccccugcugcucaccagccagucaccauacaaaugaacgacugccucaaaaagggaugaagacacucaacuuugacacauguacaagcacccuuccccuccccccaugcccauaucuccacaaacauauucauaugccacccccaucuguagauaucauuaauuuuaaauauuucucuuuuuuuugcacagguuuauauuuaugaugggaaaaauauguccucuuuacacaauuuuacuggugaacagguaugguauuaaaauucacaccccguuaugaaaauucacugaggagaguguagaaagugaaaauacagaagucaucugcagaguagccugacacacacugcagaaggccccucuugcugcugcuguucaagucugcaugacagauuccauuuccaguguguuaucuugugucagucaguguuuuguggaaauaguuuaauagguccauacauacaaagcuauaaauagaauuaugacaggcuuugggguuuuuguuuguuuuuuguuuuucugagacaagguuucucuggauaguccuggcacucacuauguagacuaggcugaccucaaacucagaucuaccugcccucugcuuucacugcucaccugguuucagauauuuuaccuuuguuuuuauuuuuauuuuuuuuugaaggcaggugcugcauuuauuguagcucaaccuuuguuuuuaaacagaauaucaugguuuagcaaauccuuuugucuccguauaauauagcuuguuuuuguuugcugcuuuuuaaaaaauaaaacuuauacaaaagcauaaaauuuccuugauaucaucaauguuuccuuaaagaauuauccaauuggggccggggagaauuacccaugaagccuuuaauucuagcacuagggaggcagagccaggugguucugugaguuugaggccagccugaucugcagagugaguucuaggacagccagggcuacccagagaaacccugucuugaaaaccccauaaucaaaagaaaagaaaagacaagaaaaggauggcuuacguguuuuaguuuuaucaggugccaaaagcacacuacagguguguauauuacugaugacauaugcauagcugcauugcaaaauauaaguucuucauuuuaguacaauccuuuuggagugaguagagauguuuuauaacauucucguuugugugucucagggaacuaaguuacaaauugguaacgucaaaggagaaguuacacagugggcagagaaagguccucccaguguuguauggaggcuggagccucuuuccugcuguguuaggcucagagagaggagggaugaaaagccucauggcuuaggcccugcgaugauggacaugaaauguguucugcuuauaaaucuagaaaaauuaaaaaagccucauuaacggauggccauugucuuaggaagcagacaaaaagacccuaaaugcacagagaaagaaaucagccuuucucuaagauauaaauauuaguguaaauguucaucuggcugaaugaaauguaaauguuuuguucuaucuucuucuucagauggcugcguauuuuggauuuucuguagcugcuacugacauuaauggggaugaguaaguuuuaaaaaauuguuuccagaaaccauuuuuccucuguguuuauaagugcuugacuaaaacuaaacaguguuucuucuguuucuuugucuucuuccuguuacucuucugucauuuuaagaaaacaaguugaugcucccuaauaauaaauaugaggaaauccuugaguugguccuaaauuuuaacucuaacacagugguucucaaccuuccugauggugugacccuucuucauguuguggugacccccaacuauaaaauuauuucauuguuacuucauaacuguaaguuugcuacuguuaugaaucugauguuacaaauaugaauggaaguaucugauauuaagaauaucuaauauucugccucuaauauuugccucugacccaaccaaccacugggucaaggccaaucgguugagaaccauuaucuuaaaccaggacaauguaauuuuaugaauaaccuaccauugagccauguaguuauaagaagccugcaaacgggugggaaguggagacugagugaaaaagaggaguuuuaauaagaaugugcugaugaggagcuggaaagacugcucaguggguaagagcacuggcuugucuugcagagggcuuggguuugagccucagcacccacuugguggcucauaaccaccuaaauccaguucuaagggauccaaagcccuuuucuggcaucugagggugccagguacacaugugguacacagacacacaugaagaccugguacccccuuacuccuagaagaaucagguggaucucuguuaguuugaguucugccuggucuacagagcaaguucuaggacagcaagggcuacacagagagaccuugucucaaaaagccaaaccaaccaaguaaccaaccaaccaaccuaaccaacccaaccaaccaaccaaccaaccaaccaaccaaauaaaaaaacccacccauagaauaaaauagaaaauuaagaggaauaacaacugucagauagaguuugauuuugugugugaggauguucucuucuuucaguuacgcagauguguuuauuggagccccccuguucauggaccgagguuccgaugggaaacuccaggagguuggccaggucucagugucucugcagagagcagugggagacuuccagacuacaaagcugaacggcuuugagguuuuugccagguuuggaagugccauagcuccauugggagaccuggaccaggauggcuucaaugguaagauccaagcgccuuucugugucaccagaggaaguccuaaaacaccauguacaggagcuccuaugugcaaaccucccggaaagauggagagcacaucacagacaccaaauuuaaaaccagauugcuauuucuuuuuccuugaaaaugagcaaaaaaugucaaaacuuggcuuucaugagcuagagaugauugaauucugaaaggagccuccaaucucagggagcccucugcauccugcugccugucagugcccucuaguguccauuugcuuccaagugaaaaacuaccucccagccuuugucaaagcaguaaugacuuaaagccuaacucaggcacgaguuuccacuagagguuuuuuuuuuuuuuuuuuaaauagucgcagcuuuauagugaaaccucagagagagguuauauaucuuuucauggggacuuguaaauggcuuaugcucauuguguuaugguggccuuauauuucaauaguuucagauaccuuuuaaaauaaaaguuggcuuuuacuacacagcucuuuuccgaagccugaaauacagauuaaaaauuagauacauaaaauuuagguuacaaggauuuuuguaaaaggauagugaggagagaagaauuguugguuucuuugcauaaucagcaauauauuuggguuuaagcaacauauuagaaaguuauuaggaagaagacucgauaaauucagugguacagaugacucugacugcauaguggaaggaaacaccuccauuccugcccuguggacagcugugugucacaggccaguuugaauaaccuuagaagauuucagacuuagggaauaacuagaccaggguauauuuugcuuccuaaaauagucuuaaaauuuuuuuuuugucaucaaagaacauagcauucaaccuuagaauaaagcuuauaacaaguuauggaaagaccacuguaggucacugcucacugacaguaaaaccuggagguaagaaagaaaacuguauuugauuuucuaccuuguguaaaauuaucaggucccuuucauuucagcugggcucugucucccaggcuuucuggaacaacuaagacagaaagcuguugcuuuguuccaaagguauuccagucacuuuaaagucacauuuccuggauauugucaucuugcuuuucauauuuuuguuauguuauuugacagcauguguaaacaacagcaaaaaaucuuugaaaagauuuuuacaaagaaguuuuacuguuaggagauaaauaccuuaggagguguugauggucuguagggaaccgugaaugguaauucuuuaguggaagauuaccugagccauguuuauguaaacaugcauuuuugugcuguuaguuccaaucucauuuuguucagaucugguaacagugaaugccuguuucaguccuccaccucacuagguaccagcaaaaggcgaauuaguuacguguugcuguuaccagauaugaagcaacuuaagggagugucuuaguuaggguuuuacugcugugaacagauaccaugaccauggcaacucuuauaaggacagcauuuaacugagccucacuuacugguuuagcgguucaggccauuaucauuaucaucuucaucuucaaggugggaacauggcagcauccagguagacauggugcaggaggaccugagaguucuccaucuucaucugaagcuugcuagaagacugucucccacauggucuuuuagcccauacccacagggacacaccuacuccaucaaggccacaccuccuuauagugccauucccugggccaaguauauuuaaaccaccacagggagaaggguuuucuuuagcuuacagucugagagcaguggcagcagaagcauaaaguaccuggucuaucugucuaucugcagaaugcagagcacagaugggaagugaggccagaugauaaggccucauggccugcucccucucccugaaacacucauccacuuucccagucaggguccaccucugugaugucccacagcucuccaggucagcgccacuagcuggcgaccaaguacucaaacacaggagucuaugggcugagggacaggacauuucacagucaaaucacagcaaaauggauguggaaaaggaaacauuaaguuaggcuuuguauuguuauguagacucggguaauucugugcaguuuuugucauuauugccuaacaaaacaaaacagagggaaggguuaaaaccuaaagagaaugcuccacuauggucauagcagccuuauuuauaguagccagaagcuggaaagaacccagauguuccucaacagaggaauggauacagaaaaugugguacauuuacacaauggaguacuacucagcuauuaaaaagaaugaauuuaugaaauuccuaggcaaauggauguaucuggaggauaucauccugagugagguaacgcaaucacaaaagaacauacaugguaugcacuuacugaugaggggauauuagcccaaaaacuuagaauauccaagauacaauucacagaacacaugaaacucuagaagaaggaagaccaaaguguggauaauucguuccuucuuagaauggggaacaaaauacccauggaaggauuuacagagacaaaauucggagcuaagacagaaggaaagaccauccagagacugccccacccagggauccaucucacauacaaccaccaaacccagacacuauugcauaugccagcaagauuuugcugacaggacccugauauagcugucucuugugaggcuaugccaaugccuggcaaauacagauguggaugcucacagccaucuauuggauggaacacagggcccccaaugaaguagcuagagaaaguacccaaggagcuaaaggggucugcaacccuauaggaggaacagcgauaugaacuaaccaguuacccccuccccaacucccccagagcuugugucucuagcugcauauguagcagaggauggcguagucagcuaucaaugagaggaaaggcucuugguauuaugaagaucauaugccccaguacaggggaaugccagagccaggaagcaggaguagguggguuggggagcagggcagggggaggguauagggggcuuuggggauagcauuugaaauguaaaugaaaaaaauaucuaauaaaaaauuaauaaaaaaaaccuaaagagaacaguagugcaauccagggaggaagugagaucaugacagugcaaguggcuccagacagcagcagagagggagacaauaacugugcaugcaauauugacgggguuagaaagagacagcucauacuaaauaaccccauagacuagagccaucuuuuucugggaaacuaaucaauauuuucuuuuuuaauuaaugaauuuaauuaauuuuauguauauguauacaccagacacaccagaauauacuguaguugucuucagauacaccagaagaggguguuggaucccaauacagaugguugugagccaccaugugguugcugggaacugaacucaggaccucuagaagagcagucagugcucuuaacugcugaaccaccucuccaaucccagucaguauuuucuuaaugcauauguuaauuugaauuaucuuuuaaagacuuagaaaagguuaaaaggacuacuuuacaugaugcaaauacauauuuucaaagaaugacauauucuuagggcuuguggcuaccagauagucuucuaggugcugaaaaucagaggcuagucaaagcuggaaugauggugcacaccuuuaaguggagcguucuggagggagagguaagcagaucucuaugaauuugaggccagccuagucuucauaguguguuccaggccagccaaagcuacauagagagacccugucucaagcaaagcaaaacagcaagaaacaaagagguugaucaccuacacacauccuuagucagguggugguggcacacaccuuuaaucccagcacuuggaaggcagaggcagguggaucucuugauuuugaggccagccuggucuacaagagggagcuuguacauagagaaucccugucuccaacaaaacaaaacaaaacaaaacaaaacaaaacaaaaaagaggguaaucacccacacacauucuugaggaacucagcgugcaauagggugaguguauauguaggaaauauucuuuuuuaaagagcacuagaauggaguuaccaugguguuugagauauuuccagccuugauggucucacauaaagaaugcaaaauccaggcauguuuaguaugucaggagauguuaccaaggaggcauaagguuguuaaguaaggacacugaggcaauuugguauagcugguaucagggccauuauaagucaaagagauguccauguuuggacugguagcaccagaagaaggaggaauugguauguuuaucuucaagccaccauuuagugucacauaggauugcuuuaaaaaaucaaaaauuuuguguuuauuuuguuucaguauaaauugaacagaaugaagaaggcagaacuuugaaauuuaugaacuagauuuucauuuuguaagauaaaacucacaaaugaauuagaaggaggggucaaaagugucaaaauggacuuuugaugaguguuuucauguguccucauccacaucuguaauguaagaugaagcauuuuagauucauaaaucugaagucucuuguccaaggucagacccagggcaccugccucuagauuaaugucacuguugcauaguuuucccuuuuguuuucugucaucuucagagagucuugcucuggagccaggcugacguugaacucagaguccuccuggguuagucucuugaguucugggauuauaggcuuguuccccuguuacacccuagacugcuguucugcagaacuuuaccucaacggcugaccuaacagaucgguuguaugaagaguguuaauaccaagaaugucuucuggccauccugcccacuuuccuaauucccuauuccucuucucuuccucuucuccacccuguucccucuuguccacagauauugcaauugcugcucccuaugguggugaagauaagaagggacuuguuuauaucuucaauggaagguccacaggcuugaauucggugccaucucaaauccucgaggggcagugggcugcucagagcaugcccccaagcuuuggcuauucaaugaagggagcuacagauguagacaggaauggauauccagguacuuuucugcaaauaugugugacucuggguuuuucauucccaaaguauuaauuauucuuuucuuguccaucaucccauuuaauguuuaaacacugaugaagacuuuaaacagcucuuuuugaugggaguauacaauaugaaauagaaagccaaaugcacauuccaagguuuguuuguuuuuuuuuuccccccgagacaggguuucucacucuguagaccaggcuggccucgaacucagaaauccgccuuccucugccucccaagugcugggauuaaaggcgugugccaccacgcccggcuacauuccaacuuuuuaaauggcaucuauugccuuuugcuuuuaaggagcuaguauuuuaugaacuggugcaaucacucuguguguguguguguguguguguguguguguguguguguguauguauguguguguguaugcaugcauacauugaaugcauauguuuugagacaagguccaucacuggagcucauaaauuuggcuaugcugguugagcaagccuagagauccugcugucucuugcccuagucccaugcuaggauuacagguucauagcacugaaucuggcuugaguguuggggaaauacaaacugaaguccucauguuuugugcgguaggaacuuuacccacagagccaucugccuagccuggacuaaucacucugaucuauaacaaaacaaaacaaguaccauuucacugaauuuucccaacagcaauguuguggaauuuaguuaauggaggucacuauggucacuauauugaggccauuuuguagauguugaaguaacuguaaaaggguaacuuacccaagguuucccauggaguuagucuguuagagugagacagaccaucagcuuagauuucuacaucuuuugaguaucauaguggguuuaggaucaaaauugauccuuuccuuacgugaaguaaaauuuugaagacccagaugaucucuguuguugaaauagccacuccagauucugggucuuagcuuggugccaugcuuuagaaaugagacaugagguuugucugugagcuggcauuauuucagagcuuugucaugagugcagugugugcacuccagagcuuaauaucaccaaauguaucugcauauucccccaaugcacuuguauuuugugauuguuugaggcacuuuuuuuuuaagauuuauuuuauuuaugauauguaaguacgcuguagcuguccucagacacuccagaggagggcaucagauuucguuacgagugguugugagccaccaugugguugcugggauuugaacucgggaccuucggaaaagcaguuggugcucuuaaccacugagccaucucgccagcccccuuuuuuucuuuuuuuuaauguaccccagcuuguucuggaacccauaaucuuccugcuguugccuuuugaguggcugugauuacaggugugcaacaccaugcccagaucauucauucauucauucauaugaauauacaaauauaucaugcauguauaaaugucuagguuuuuauuauuuuauauaagugggugucuuacuugcauauauguuugugcaucauguguucagugccuacaaaggccagaagagggugucacaccccaugaacuguaguuacagacaguugugagucacuuugugaaugauggaauuaaacuuugaucugcaggaagaacagccaguuuaacugcagaacuaucucuucaauuauauauauguauauauaauuuaaaaaaguaacacccugcuuuaguuacuuuucauuguguauuuuauuucuuugauacauuuauuauucuaaaacaugaauuucauauuucccauucuaacaaauaaccacuguauccuauuuuaccuuuauuauauauauauauauuuguuguuguuguaugccucuacacauuuccucaggacaaaauucuauaucuguuacuucaaaggcacccacucguguguguguguguguguguguguguguguguguguguguguguuuauguguguggugugugccaagguguggugguguuugacuuaggugugucucugguacacgaggagguuggaggauguguguggagugucuccuuaauugagacaagaugugugugcugcugcaccuucacuggcuugggagcuucuagagagucucauuuccaaguaggggcacauuaggauuagagccacuugcacaacuguguccagugcuuguaagcaccaaagcaucucucuagcccucuaaacguucuugacuggcugaaggagagucuaacugaggaugacaguuuauucacuguuuggaaauaguuuugccuugugcauauuauccucaaacuucuuggcuuugagaauaaaacccaggagcagugaacaugccagaguaauguauauuuuaaaacuuauuuuauuauuaauauguuuuucucucucucaagacuuaguuguaggagcuuuugguguggaucgagcugucuuauacagguauguugcauauacuuuaauacaggaauauuuuaaauuauuugaaaaauguuuaaguauucauuugaauuucaguuugauuuucuuauagugacaaaauuauucuauucaagaaacucucaaagaauagaaagcuauaguuuuuuaaaaauauuuuuuaaagacuauucagaauuuuccuucauuagccuuuacauuuugugugaagacauuguccuacguuuuuagucacuucuaaaauguaugggugguaccugccuuguguacacaaaacacugggcuugguccuuucgauauagcugcauugagugaggcuaugccagugccuggcaaauacagaaguggaugcucauggccaucuauaggauggaacacagggaccccaauggagaagcuggagaaagugcccaaggagcuaaaggaacaacaauaucuaauauaaauaaauaaauaaauaaauaaauaaauggaaaaaaaaacccaaaccaaaccaaaaaaaaacaaaaacaaaaacaaaacagaaaaacaaaaacacacugggcuugggcccccugccuccccagaaugaauuuaagaugguaaaggcuuacauuuuuuuccaauuuuuuauuagguauuuucuucauuuacauuucaaaugcuaucccaaaaguccccuauacccuccccccacccugcuccccuaccacccacucccacuucuuggcccuuacguuccccuguacuggggcauauaaaguuugcaagaccaaggggccucucuucccaaugaugucugacuaggucaucuucugcuacauaugcagcuagagacaugagcucuggggguacugguuaguucauauuguuguucuaccaauaggguugcagaccccuucagcuccuuggguacuuucucuagcuccuccauugggggcccugugauccauccaauagcugacuguaagcaucuacugcuguguuugccaggcaccagcauagccucacagagacagcuauaucagggucagcaaaaucuugcuggcauaugcaauagugucuggguuugguggcuaauuaugggauggaucucugggugaggcagucucuggaugguccauccuuucgucucagcuccaaacuuuaucucuguaaaagguuuacauuuuuauagaagaggcagugaaacuaaguugguacuugugccucaguauuacaugaccauaaagguguuaugucauaaacaucaaaacucuuauuuaaucuagaacacaaauuuuuuagcuguauaugugcucucaguucuaugggucaucacuuccucugccucagaacaccacugaucuuuugaauagguugggguucuuguacuguuaugggcugaacuuggcaagagaguuuccacuggagccauguaagguucugugauucaucaacuucaucauagccacggagaacauaaacuuacagacccagccagauguaguggugcacaccuuuaaucccagcacuuaggaggcagaggcaggaagaucuccaggaguucaaggccagcuugguguauguagccaguccaggauagccagggauguuacacagagagaccuugucuugagaaccacaacaaacaaauacggcccaccccaaccacaacaaaaaacuaacaacaaaaucccuuacagacuuccaagauuuaucauucgaagcggccucgucgaccugaccccacuguucuugaauauaaaacuuagacuugugcaucugaacuuugcaaaaauguagucuuaaguugaauggucauuguuugaaacgcuugggaccacaagugcuucagguuuuggagguuuauagguuuuuaaguauuugcagagacucaguuaagcaugaaaccuuccuacucucaaaguccaacacuugaaauaggccacaacauuuuugaucaccuuuuugguacucaaaauguuguacauuugagacuguauaauauuuuauuguuuggauuuucaggacguggggaugggauacucagauauauuuuaguuuauuguuuucguuuuauaauuacuguuaguauaauucauaaguuguuauaaaauuaauaaacacuugcaugagguaaguauguaagaaauuuaaagggcuaaaauggguuggagagauggccuagcagcuaagaauggaguucggagcaugcacuguucuugcagaggacccaaguucaguuccuagcaucuaugucaggcuguaccuccaucucccggggaucugauauccuuugcuggcuuuugcaggcaucugugcucacucccacccauacuccacuccaaaugcacaaaauuuaaauaauaaaaacaaaucuuuaaagaguauaaaauaagcauguguaugcuguacuguaaauauucucgucauuaagaagucaugucugccuuaaguaugaucuguaggaauucugccugccuugcaggaucuguucuccuauacauaugccugucagcacagaugggcuuaugacacacacauuccuccccguguucacucuaauuagcuggaugaccuauaacuaguaacaguugugcuuuagugugcugaacucagguaggcugaucgauugucucacuugccuggaauugaacauuugccaaggugcaggacugaauuaggucaguuguggguaaaaugagacagucaggcaucuuauguuuacaucuagacuaguacaauuaucguugcuauuaccaauaguaaugggcauugaauugcaucuguauugaaugagaauuuaaucaauuuauuuuuaaauaaccuuucucuccuuuuccuccuccuccucuucccucccucccucccucccucccucccucccucccucccccucuuucucucucauuuaaaacuagagccagacccguugucacuguaaaugcuggccuugaaguguacccuagcauuuuaaaucaagacaauaagaucugcccguugccugggacagcucucaagguuuccugguaaggaucuuuguuuaguaguugugaugauuaauaguucagucauuguacaaacaacacaaacuuagcuggcauagcugaaagaagaaacccaggcaguuucuaugaaugcaaucuauauccauguuacagauaagguuauagaagguacacuuucaaggaagcugucuagaagguuccagaaauaguuuauaacuuaguaugagaaagauuuuuaauguauuguauuuggucaaaaguauauucaagaagaagaaaaagguaagcagacuucaaaacauuuuaauuuuaauuauaaauaggcccuucugaaaauuuaaguuuauaacaggauguguuuuuucucagaauaaacacaugcgaauaauauuacaaaaauuauuuuucccuauuuugucuuuugcuuguuaugcgcgcgcacacauacacacacgagucuauuuuucauaaaucuaguguguuaguucucuguaucauaauuuuuuuuaucuuaaauaugaaauuucccugaguuuugcuauauuuucauuuagcuguacuauaauuaucuuuuauuuaaauuaauucguguuauuuuaaaaacuuaaacauuuucauguauguccaaauaaauauaaaacucaacuaauaaggagucuugacucaaguauaaggagagcagcuuaucuugaggaacucuguucaugguccuuugcagaaggucagauagaacuuacaggugugauguguagauuggaaaacuuuauaugaaaugagucugagaagggcauuuuccuggcucucuugaaugauugcuacaaacauugaaaguuugcaguccucauucuccauuggauuacgcuaagcaguauguaacacuugcuaugugcuugguuggcaaccaggcuguuuaggguuuagcugacauuuugacuguucuugucugcucucaccuuuucugugagugcuggguaaguacugcuaauguagucaccauuagagagcuucuagugggauaccuagagcagugcaugcggacacaacccgguuugacagaggagcccgggcucuucuaauagugaucaugguacagagugacaaauauauuuugcauccuauuucagugaguaagaggccaugucucaauuagacagagaaugauaggggaggacacccaaaguggacagcugacuuccauguaugugcacauaagugaguacauauguacguauacugcauauguacauacauguacauacaaacacauacuuaauacauagauaaauacuagaagaguauuaaaacauaaagaaagaugaaauuuuuuuuauaaugcagacucuacuaucuguuuucugcauuugucaauccaauaaaucauggagagaaauauagaauaaaaauugugucucuucuggagaugggcagacuuuauucuugucauuccuuaaaaaugcaauacagcagauauucacauaguauuuguguuguauaaaauguuauaacuaugcuguggguguugcaacuauucugugggugggugacuuaaaguuggaggaugucggcugucugcagacacaacaccguguuaugucagagcucucgugauacgcugauuuguuguuggagaguaaacggcugguugcuagaaccaucucccaccaccccgauaggaaggggcauauacauuagaaaugugagauuugugugguauucaguuucaguacuauaccuaaaguagauuacagaauuuacauuugaaaacauuuuuucuuacaguuuuaaugucagauucugcuuaaaggcagauggcaagggaacccuuccucggaagcuccgugaguaucuucuugugcugggucagcagcuucagggcacacgaugcaguuauucaaggagcuguuaucccucuaaccugaauguuugugcuugaagacauuuaagauuaaguaauuauauacaaguauuuucuuuggcagcucauaggucagcucagaggcaguauuuuguuguugcuggacacugagcauaagaaugguaaauaggagccagcauugaggauguugagugguuaaugauaggagguaaauggggcccaggggaggugucauuguuuaugaaucugugcucuacugagagcuggggaaggccuuuccuugccuuggaaaggguguaaccuuuguguugcugcguuuagucuguggcaccgacaccauuccuucucugcugaaaugauugauguggucugagagcaaggcuugccaguugaauggcuggugacuucugcuagugaguaggagcaggcuggagaagaagcuaaaggagcugcucucagugggaaugugcacaggauggcaagcaggaccucacugcaagaucagauuuacguggagaccacaggagaugagagagcagagggaugccucggacuguuuaagucugugguggagugagcucacuuugucuggggagcugcauggauguacccauggagaccagagaggggauacacccgcauucgcauucgagauuaaacacuuaaagaaguagacaaagagacuugagguuuuaaaauuuugcacaaauuccuuuuaagcagcuucuuaaagagauaaauacuaggaggcaguaauuguaacaauugccugcauauucauuuauacgauuuguuacccauuagauucucuuuggccauaugcugaaggagggacguauucaguugucacauuaaagggcagcuucauuggaaacaccguugcaagugauauaaacuguuuguaauacucaauguaaugguuuggaugcacguuaaucaauacuuagcauaucguguguguguguguguguguguguguguguguguuguaugccuauauauacuguaagggggauggaacccagggucucaggcauucuaccagcagccugcuccccucacccagugggaaaaaccuuaauuuacuucuguuucaguccaggacauccuugcuuagcuuaaaugaaaagccuuuuuccccuuagcuuaaauuaaaagcagauccgcacccccaccccaauaacuugguuucacuacugucauuguaacugcauaugacauuuugggggggacgacaagugaauuauuuaguuauuaguuucuggaguuaauguguugcugucucaccacaaugcuuaggcauuuaaauaaauauagaagaaaguugcuuuucagaaaugaauaucucugccugcaggaaaagucuagauugcuaggacagccaugugccggccaggaauguguugguuauaaaugcugugguuuguauagacuuccagguggagcuucuacuggauaaacucaagcagaagggagccauccgacgagcacuguuucuccauaacagguccccgguccacuccaagaccaugacuguuuucagggggggacagaugcagugugaggaacuggucgccuaucuucggguaagacacuuucugcaccauuaacuuuuccuuguaguuacucucccucuccgcuucauguaugugauuuuuccuaccugugaauugguguuuaguuaaaaugaaaagcccccacucagagaaauacaccugagaaaacuggcuuuuccagucagugucaaagccaauaucgaagguagaguuuauuccugucagauggauguuuaaagaggcuagaguguuacugaaugaguccugaaaaagcuuauuucuggaaauauugcuggacucucaagucugcaaaacuuucuaguuuccaaaaaguaagcaauccacuacagauucccgguggcuaaguuuaaaaucugaguuguaaacuucugugugagucuaguuugaggcgagagacggagccugacgcagggauggguuugaguguagacaucagccagagauugagacuuaacggaagccuuuugcagucugaggcuuguuugauccuuguggagcaugaaggguuccuggcacagagaugcaucuggacucuggcgugguggaguacagggcccuugcauaguccaacuuggcaaucacgugauguucagucaaagcaggaauuauuuguuguauguguuuguuuuacuugcaugcauguuuguauguauguauguauguauguauguguaucauguaugugccuggucuaucuaucuaucuaucuaucuaucuuucuuucgucgucugucuaucucugucuauccauccaucucuuuaaaggcauauuccagauauuaaggcugucuauuaugcuuccuuuuagaacuauguguaucgcuguuuugccugcacgugagacuauguaccauauucaugccuggugcccugugguggucagaagauauuagguccccuggaaacagaguuagagaugacugugagcugucaugugggugcugggaauugaacucagguccccuggaggagcagccagugcucuuaaccgcugagcccucucuccagacccuaggcuuucuuaaagcuuuuguugccccaguuccaccaagccuuaaccauguagacuuguggaggauaccuaagcuccaaaccacuuuaggaaucaguaauagaaaaguaaguugaaaaauugauuggaaaaagacagggaaugugauuuuuagguaaaagcaauuauaagggaaaauuacuuaaauugucaauggacuaucauaggaguagaauauauagggaaaagguaugucuacuuuaaaugcuauuuaauuuacacggauugucugacaaauuuaaaaaaacgaaaaagcauuuacauaaaauuuguaauaaaaagggauauaagaauagauaaaauuucgacuuaaauuauaaaguuucuuaacuaaucaauauauaggaaaacuuggauuuaaaaaaaacauaauucuuagacauauguaacaaaccugccauaaggagauacaaaaacccaauagcuauaggaucacucauauaggauuauauauagacacuucuaaaauggaaagguauuuggaaucaguuuuguuuguuuuuggaggcaguguuaccuguugucuagguuggccuugaaccaugcuuuguagcugaaaaugaccuuggauucauaauccuccugccuccacauccuaaguccccuuuaaaacaaaacaaaacaaaaacaacaaaacuuuacagauaggaacauaaggccuagaugauuuuuaugcaauauuauaauuuaggaaugagccauuucugauacuuuauuaaucucuguucuucaaaugaaaaguaaaacugaaaauuuucuaauguucuaugaagcuugacauaugucaaguuaccaaaucaauaaguuugccaaggugaauucauucuaggcuggacuaacauugagaauuuagaaggaggacuuucugcaugaauaaagaagggggaaagaagcaagaccauuuuguguagcugcggaaaaggaaagccugugaucugaugaaccacugaggauuuauuuuagaggcagucaugacugugaacagauccgagguuaaauuuaauucaggucuguuuguuaacuaguccaggggugaugcguggcagcuccuuccuugcugaugauccuuuaguuguuaugcagguuuuggaaaauaaauaagaacuggugaauuuugugacuauuuaaguagaaucaucacugcaacaaaaucuuguaauaacaaaaacaaacugggaaaccacaaguaaucuuugacagaagaauggauaagcugcuauaacauauuaccuagcagugauguauguccuagcuguauauauggaacagcauagaugaggcuuaaacuguuaaaugggaagaaaaucagagguuauauaugagcucauucccaguuauccaaaggagaaacaaaaaacaagugagggacgcacuguucggugacacaaucucuauaaaaaguggcgccggcaagauguaaauaccggccaccaggaaagagugaccacaagagauuucuagacaaguuugaaaacaguggugucagcagagcaggcagggaugggcgaacugaaauucagcagcccuuacacugugaaggaaagcaaagguugaaagguugggcagcuuaaagccacauuaauauuggucugauuacuguguuggguaucugccugaguguuccuuuuaccguguuggcauaaaaucacagucucacuuuaaggaaggcaagagaagaauuuauucaaggaaugugagugacucuggcuggaggccucguccucugaagcacagacucugggcuguguuguguauguuuuuacggacacaggacaaagggaggcuggugcgcuauugaguaggugagcuacaaaagacagcggaaucucugcuguaagguucacaugucauccuuaacaucuucuucagaauucagaucuuuaucccauuccuugguugcuggaggggagagagccaccagguuuucugauggauuccaauaguuuuagcuagcaauggcaaaauaagucagaugcagagauuuauagcuaagaguuauuagaaaggacucauauuguucuauaacaacucuggcucauuaucugaaguauuacaccucugcauaauuggcagagcucagcucuuagcagacuguuaaguacgugugguuuuuucagagaacuuggguucacagcuaaugcacuucauagcuucuugguuguguuuugagucaagcguuacauuauaaaacuaacccugaugcacaguucuuacugaacagccaugugaguuuuacguuaugcuugccacaguuaacacaguuuuucagauguuguaaccgaacauucugugaugaauucagcugcuuuugugguuccccaccauuguggauuucuccaaacuguuuagguugaugucaccuuuaaccugaagcucuuuuguuucaggaugaaucugaauuuagagacaagcucacucccaucaccauuuucauggaguaucgguuggaccagagaacggcugcugaugccacaggcuugcagcccauccugaaccaguucacuccggccaacgucagucggcagguaaugcaugccaaaguuauuucuuauaucauccuuugaucuuuugauaaggcuuguguucuuaagggauuguuuuuacaguguugguagauaauuaagaaaucagagggggaauaaucagaauauuuaugucugagaucuuuaaaccuauucauuaguuacaugcauugaaagacugggcuacauuuuguauacagauaauaguaaaauuauuuaacggaaauaacaaaaggccuguuuauuuacaugcaguuuuuaguacuuacaucuuggguguacauuuugugguauguguguguauaaauauaaacauauuuauacauauauaugcauguauguauauauauauacauauauauguguguauguauauguaaugcauaugcaguuuuauguauaugucuuauauaaguaauugcuaaguccagccuggcuuggucuuggaaaccugacugggggcgauggaggacugaaggacaaacaaacacacauguacugaaaagcuggggucagauggguuaugugcacuccgauggaggaguaccaaccaucacacagcaucugggggccucaguguguuugcuauguacaacccagggggaaggguuagcuagucuuguaggcagucucugugggugaggacucucagcagguaaaccucugggaggagaaggugcgauugcuaggcuuugcacacacugccaacauuugcacugagacgagaggaaagcauugcuaguucuagccugcacuguauggggaaggcuuugccauucccgugggucuggugcauugcuccuucaugcugcuuugcccgaaucaaacaguaaguuuucacccaguacuacuucugcucgugacacauacacucagagcuccugcacaccacgaguaaugcuuuucauaaggcaacacaaaauuacaaacaguuugguaauuuuguaaaacccuuugcacaauaucucucuuuaaauauuuuuucuauaucuuccuugaauguuauuacguguccuuagggcucggucucucagaguucauuagcauaaucuagguugucccuucuucuuugacuuccuuucuaagaccuuuugagcaguguuuauuucugggggguacaauuugagaauuguaauaugacaacauagaaagcaaauugaaauauuuuaaaaguuuauauguaguuuauguauuuuaacaaacauuuuguuuuguaucugccauuuuuuacuauccacuagcaaaggacuugugaacauaguuaguucuguguuccgaguuguuacugggguggauggauguuguaccauugguuaauuuuauaucugagcuucuuaguaugugugcuuuaaugugguccuuucuuuacaaauaacuuuuuaccugugucuuauaguauguauuuugaugacuauuuuuucucuauaguuuuagaauuauuuuagaaaucuuuaucauuauuguuacuauuuuuuuuugagauaagcucucacuaaaauagcaacaaauaagccaagaaugaccuugccuuuauuuccccuuuucccuucaugcuuuguuccuucuauguguucuaccaacaucucucuuugugcauugcuucucuuuugaggguuuuucuacgugcucuucauggcacauccccuuggccagagucagaaaaagcaaguuuagauuuuuuugauguuuucuucugguuuaauuaauuaauuaaugauuuugguuguuugcuuuuuuguuuguuuguuuuuuguuuuuuuguuuuguuuugucuuuugucuuuuuuuaaaguuucuuucccaauauuuuguacaugcuaaacuuauuuugacccuuuccucccuaguuaauauuugcagccaguuucugugauaguagcagaggucaaugucuuaacgaggagcccugauuauuuugucacugcuuguguagguuagccaggagcacauuuaaaaggaucccucauuucuuguacuagauagacuuuauuccaaaaugcuaacagcugauuugagaaauacaaaauucuaaguaauuauauuuugcucaauuuuuucccuuuauucuugauuaccuauacugacaugcuuaaagaugaguuucuaguauccaugucgaaaauaauaaaauguuuuucuuuaaggcucauauucuacuugacuguggugaagacaaugucuguaaaccuaaauuggaaguuucuguaaauagguaaguuguacccuaaacugaaaauagaaaaauauaagaaauuuaaauggaaaaacacacuuuucuauucaagaugcuaauguuuauaaggagaauuauuuacaguaaaggagaauuaacaauuuuuuucacaauaaagcaauuaauaugaugguuaaaaaaauacccacuguguuuuugcuuagcggccuggcuuggcagguuuaugaccaucagccgugguuguaccacgaguccuacuaauugccuugauacacuucacuguggacaagcucugaacugaggaauguccucaccacuugauaagacuguugugagaauuaugacaaaagaauaauucgucuuuuuagcaaagccagcaaggaauuagaaguacaugcacagauguaaugugacauugguggcauguguacagagccaugcucugugagggcuaccagcguucagucgcacaauguggggcacuggacuugcauccagugugcuauuuucuguuuucuguugagcuguggagaagccgugcgugaccuaucccgagacagugaaggcugucggccaugugacuuaccucuggaucggcucccuccccauggcgucucuuuucacuguuggauuugaauuaacuugcagugaucaaaagaagaucuauauuggggacgacaacccucugacacugacugugaaggcgcagaaucaaggggaaggcgccuaugaagcugagcucaucguuucuaucccaccgcaggcugacuucaucgggguuguccggaacaacgaaguaagcuagcaagcugucucuuuugaaaaucacagcgcacucccggcucuuauuaacauuaaugaggcaggccguauuuagugaagcccaagcuuagccauucgaucuaagacuaaauugcuaaacaauaguuuaauaauuccuuucaggccucaugcuuugcauaauauguuauuguagaauuauuagcuuugccagccaugcaucugaaaagaacgaggucagcuagaucuagccugcccaucacauugcuagcuagaugcacugugaccagaaucuaguccucuaggggucugcccaacauuuuuacauuuacaugcagcagugguccacagccccgacuucuuucucuauuuacucaauagauuuuuuggcuucauaaaaagaggaauuugaauaccuacagaauauuggguaggaacuuuguaguuucugcuuuuuuggcuacuauuaauuucuuuuuucaucccaaccccacuucucucucgcuuucuuucuugucuaucaaaggccuuagcaagacuguccugugcauuuaagacagaaaaccaaacucggcagguggugugcgaccuuggaaacccgaugaaggcuggaacucaaguaaggcauuugaauuugauggauuuucccccuguaaauagaauacaauggguuuuuucccccaucgagguuuguuuauaguaacuucaaacuaaguuggguuuuucauuguuacuacugguugguuuugugugccaggaccuugcacaugcuuggaaaaugcccuaccgcugaggucuaugcuguccuguuuuguuugcuugugcuuuuaagauaggauccuccucuguaagcucagcauagccacaaacucaaguucuucccaccuuugcccacuaaaugcuacauugcaaggcugcuguguaccaccacggcagcucuagauuauaccuuuauuuuauuuuauauacuuuuuuauuuaaauuuuuuauuuauucacuuauuuuguguguguguguguguguguguguguguguguguguauguguguauuaugccuacauaugcaugcauguaguugaccacaugcuauggggaggucagaggacaacuuuuggaaguugauucucuccucccaccguauaagaccugggaacugagcucaggucauuggaucagguaauaagugccuuuacccacugagccacuccacuugcccucaaaguaguaccauuaaauuaguuuugauuuagaguuuaauuauuaguagagcucuguuuuuuuuuuuuuuuaaacuaggauacuaaaauuauagguggaucuguaugcacagcaaugccgguuaugugcacaucuguugccauggucuaagcaucgcaugcuuacgcguuccucggcaggcagccaucauccuggauagacguguccuagagaggagcucugugcuuucccauccucucugguuucuagcuuaugacucuugaaguuccugguuuuuuuguuuguuuguuuguuuguuuguuuuuuccuuucuucuucuuucuuucuuuguuuauuuugguuuuuuuucaaggcagcguuuuucuguccuggaacucgcuuguagaccaggcuggucuccaacucacagaucugcugggacuaaaggugugugccaccaugucuggugguuccuggcuuuucuaaauagccuacuccagacuuuguaaugugaguccagcccacucagaggugucuuuuuuacguacaauuacgugaaccccaagaagcuugcuaucuuauauguguaguucaguuguuuucuuuaaagccagucagguuccugccuuggaccuuagguugucccgagggaaggggacugagaguggugugagagggagauucugcuuccugucuugcuuccuaacucaagucaguugucagauuccuaugucaagucuuauacucaauugugcauugcuuucacuggaacaacaauaaguuuuagaaagacaguuaauaucauuguagggaggugugauuaaaauuaauaguuguuaaauagccuccauuaugacuucaguggaaaaucaguuguaauuauuuuuguucaguuuuacaauaaacucaugagaguguauuuuagaacccacuuuuuuauuuggaugucauauuugauguuucuaacuuaaagaauauacugaccgccauuguuaccgcuucccuucucagcugcucgcuggucuucguuucagcgugcaccagcagucagagauggauacuucugugaaguuugacuugaaaauccagagguaugaaaacacuccauuaggauaaaauaacuauuuuauuuuauaaauauauuacauacccccuuuaaagauggaauaauguagauuaagccuucaguacugcauuauaggauuuuucacaaauuuauuuguuuuaauuuuuaaauguacaaugguauuuugccugcauguauauuugcaugaaggugucggauccucuggaacaggagcuauagacaguugggaguuaccacguguaaaugccaugugggugcuggaaauggaacccgcuccucuagaagaccagccagugcuguuaacuccugagccaccucuccaugccugcauuauagaauuauuaaaucaauauuuuaguuauacaaaugauuuugaugucaauuugacauuauaaaacaaagcuaaacauuaggaaauacagcuuuucuccaucuuugaauuaaugguaauuaagauaauugguugaucgguagggcuucaguuucuauuuugcuuugaauuguuuaguuuuaguuccccugaguucucguuuucauagcuuugaugauaaaugugcccaauccagcccugaacauguuucuaucuuucuuguuuucuucacuuuucagcucuaauucuuuugacaauguaaguccaguugugucuuacaagguugaccucgccguuuuggcugcuguggagauaagaggguaagugugcauuucaagcugaguaucucguuguuguuguugugcuugcuucugaaauguggcugcgggacuuucugcaggcagccacccugccaccccagcuuagugcugcuuuaccaaggcaguggacgauguagagauaaggcccugacuguucuucgagucccaaguaucuuucugguggucuuucgaaaaggcaugguagcagcaaucuuaaagaaguugauugaaccuucacaacacuugcuuacuaguucaucuguugcaugcugauuuagcaacgguggcuuuuaugcauauggucaucuguaagcuuuuccuuuaugccuuuuuaaaauuagcucugauuuuauuuagcugaauauaggauauuuaggaaaaugaacugauuacacuguuugauauucaugguaguuuuuuuuuguuugucauuguuuagaguuucaaguccagaucauaucuuucuuccaauuccaaauugggaguacaaggaaaacccugagacugaagaagacguugggccuauuguucagcacauauaugagguuugcagucauuggaccuaauagaaagcuagugaaggggucaauggggaaagcaacuaaaccuuuuaaaaccaauucuauuucaucuuuauuugcaauuugcauaguguaaacauguaccagaaguacuauuuguaaguucauuuuuauagacaaauaccuauauuuguuuaaugaacauaaaaucaacucuugaguaaaagagauagcucugugugugccccaugaaauuuugaaguucugacuaaaaaacuggaaaugccuguaauuaugcaaaguuuuauugcuucuacgaagguuauuaagucagcauucaguaacucuuuaacagcuuucuauacacuuucauccucguagaucuuccuguugagagauaagcaucuguuuggccuguguguacaguggucaugcuugaagucuaucaguagcaacugcugcucuucagaucccguuuuggauaggauuucuagugcuaacauuguagaagaauuguagaacuaauuaugguccaaggugcuuacguuuuucuuuuccuuauuagcugagaaacaaugguccaaguucauucagcaaggcaauucuaaaucuccaguggccuuacaaauacaacaacaacacucuguuguacauucuucauuacgacauugacgggccaaugaacugcacggcagauacagagaucaacccuuugagaaucaagguacugugcuuuaaguagcucuuuauuaucauaacuuuuauuucuuccuaaacauauaaaugaaacuuaaaauaaaacaacuauuuugaugugugaacucugcaagaaguuuuugaguucacaaccaauacacuaauaauuagcccauuuaugcaauagguaagaaaucugugaaauucuugaggaccuuauguuuaugaguggucaauaaaccucaggagauauuccugaccauggcccauugcaauaucaguuugucaaauguauaacacucuauuuaaagcuauucuauuguugaaauuucuguuuuuagaguaagauguacuauuuuacuugugacuugauuuacagagucuagggaagugccauuuuauaggacuuuauauacuuuuggugauagugaucuuuguucuagaguauauauuuaucuaaaaauauuacaucagucugggcagugaugacagaugccuuuaaucccagcauucagaaggcagcugcagguggaucucugaauuugaagccagccuggucuacaaguuacaggacagccaaggcuacacaugaaacccugucucaaaaaaaacaacaaaacaaaacaaaacaaaacaaacaaaacaaauuacaucauauacagucuaaggaaauuucagaaaacaaauaaaguaagccagacuugacggcacaugccugaagucccauaacaaguuugauguuauccgggauuacauuuuguguuuaaggccagucugggcuguauaguaauacucuguuuccaaaaccccaaacaaaucagacucaagccuccuaacugacacucauuguagacgugcugaagaacuucaggcucuuucagcagauaucaguuucccuccagggaugccgggagaagcagugguuaggaaaaggcaacauuuguaagggcaauuaaugacguugaucuuuuucuuuccuguucacuaaguaguaaguuguaaauuuucugucauaccacauuuucauagauugcaugcuaaucauaucuaaguauuaguguccaaaugucaguguaagauuuuuuuuuucuguuaucguuuaaccaccaguguaauccaugucugucuuuacagacacccgaaaagaaugacacagcggcggcgggacagggagaaaggaaucaucucaucaccaagcgggaucucacccucagagagggagauguucacacuuugguaagcgccaucuccagugcacagagaaucagcaucuaaaaauacacggguacaggccacucgacaaccaacaccucagcaggaucacuuaaaaaaaucugugguccucuugaucuucuuccuaguuacguuaaagacaguucucaacugauccauuuuauacacuguuuaauaaaagcauuuuguauucugccugccucgacugcucuuccagcugggcacuuuugaucucaucuuccucuuuggcacuucaguggcauuuugcacgagaaaccuggagacacagugaugaaaacuguacaaagggaauaauuaguucaguguuuuaacuuuaauuaugucagguuauucagggacuguacuguuugauagaaaugcauuguuauuuuuuaaaaacccuuuuuuauuuaauuaugcuauaauuuuucuuuguggcacauacauccugucugguaugucuguaaaggccagaggacaacuuguagaagugauuucuuugcuucuaacacagcuugacagggagaaccuuuaccuucgaagucaucuucccugugaagccaucuucucugcccacacccacuguuuuuauauaacugaguccuguggucaaaggcucauuauucaaauacugaauuuucuucccaucacuacaucagggcauuauucucuccccguucuccaucugcugcccuacucuccucggucucaguuuuuagauuugugaccucuacacgaaccuucaggcuccuuaauugcugauuagaauuucuuucgaaccaugcaucagcuuuuucugauuugaccuggaggagagccaggguuuuuucguaguucuuuucaggucugucacagccggucugggcaauaguucaaagacugauguggucccagggugauggacccugguuucaauauccaaccccugaaaaggaguucauugaucaaaagcaaguccugacaacugaugauccauucaucugucuacgaacagcgugguccucuagugggaaaaaaugaauaaauccucuguauuuuuacucugaugaaaaaaaaaaaagaauuucucuuaaaugucuaucagaaaauaacaaaucuagaaauacauccuggaguuuucccagcauuugucuuuccacacugaucuacagggagugacuacaaaccccauucucuaaguccuugcucugugucucucagcuccuacauccugcauuucaguaaauuucagccccgucuacuuuguaaagcaccuccccauccuaacccaugugcaccaacuccguuccuucacagggugacccacaccacuuuccauuggccucugauuuuaugcucuuaucuccccuaaugucuauuuacuacagaaccuauagggguucuuugaugugugggucacugacaggucacuacuggaguuucugaguugacgcagaaaaaucauaggaaagauagcucagugguuaagagcaccagcugcucuuguagaggacccgaguuugguucccaggacccacacaggcaacucacaacuguaaccacagcuccagagggacuaacuuuuuccgguuucagaggacauuuauauccauguucacaccuuccuagacaguacacauaacuaaaaaguaaauauucaugaaaauuaggcacuguucuaugggaacauauaauagcaugucauuaggagucauuuuauugguauauucuuugaacagaauaauaguacuagguuuuccccuugucccugaccuagcuuaucuaaucccaggcucuuagccacauuuuuaucgucagauguggguuccaucuuauggaauccuaauuuaaaaacagcuguugguuacucacauaacauuugugccuccauugcaccagucugucuuguugacaggucacuguagucggucgcaggguuuguagcugggugauauggaugaugacauuucuccaccaguagcaugcaggguaccuuuuccagucccaugaagguuaagucagucaguagcgguggaacuucuaguuaggcaccaacucgacuuucccauguuagaugacguaaauaaguguuguccuaucaauagggcuuugccauuagguuguggagaacaaccaagagccuggcuaauacccuguuauaaagagagcagcaacaagcauggaugaggaaggaucucuguagugugauguagcgcccuuugggugugugcccaagagugguacagcuggaucuuguaguagaccaauuccuaguuuccuugugucuaguuaacuucuucagacugaagguuuucuccuaguccauucuguagagacagggucucucccugaaccuggacuucacugauuggcuagacuagcuggcuagccagccucagggaguguccuguuucuuccucccuagcaguaggauuucuggcggguguuucuaggcuuugcuuuuauucugugggugcugagaaucagaacucagcuccuuacacuugccuagcagguacguuacugacugauccauccucuacuucuugcagaauucuauucuauugauuuauaugugcagucuugaugauaacaaaucguuuuuauuacuauagcucugcagcaaguuuugaaauccuucucucucccucccucccucccucccucccucccuccuuccuuccuuccuucuuucuuccuuucuuccucccuucuuuccuucuucccaccuuuccuuuccucuuuguucuuucucguuucaaacauagaccauucucacuguagcucaaguagacacuucuacagauccucccaccucagcuuccggaguacugagauugcaagcuuguaucaaugcauuuggcuuauuuucuucgagucuaagcuuguuuuugauguuuggcauuuuuagcaauucuuuauguacuuuagguuaaguauauacacuucuuagggcuacuuacaucccacuaguaguuuguggguguaacccugauuggagaacucuugugucccagaacacgggcuacccaguuagguucucuucgacuccuuucaacaauauuucaguuccuuucaaguuuucauaaaaaagcuuuuaguuuucaagauauuagcuuugcacuugauuuucuucuuguuguucuuuuaaccauuguugcuauuguacagccaacaagucauauuucuauguugaauuuguaggaacugugcucuguuguuggucuguucuuguuuauuaggucuuuauuacuuuuaguguagcuugcuuggauuuuguuguuguuuuaguuugguuuuuaaaacauaaggucuuuucaucuacugagagauguuuuaucuguuuauuacguugcuacuggaccacacuggcuagaccgugcagcagacuagaagcagcguguccagaccccuugccuuguuuguggucuucucuuaaguguagauuuaguugugcuucugucaaggaugcccuuuaucaaguggagggagcucacuucucuuccuguuccucagcugcugaugccauuaacuggacagcgagcucuguggugcaugcgagugacguagugcaaugugacuggcacaugaaaggugguggauauuguuucucuuagcugccgacguucaaguuccugaugaaaacacuaauuauggcaggugucaucagcgugugauuuucuuucuacaggucucacacagaauaauaauuaaagauucacugcuuucuuugcuuuucuacagaauuacugugauccgaugucuuaaaacgacuauauucaggguuugccuagagaacguuuaguugcugucauaaaaccgaacucuucaauauuaggcuuuaaguugcuagaauaaauuacacuauggaacaaugcuuuugccagguguggugcauauaccuuuaaucccagugcugggcaggcacggguaggcagaugugagaucaaggccucuacuuaaucuguguaguaaguucuaggaaagccaaggcuguguuccaagacccugucucaaaacauacaaagaaagaaacaaaauaaaacaaaagaggccugcucuuuucugaagggaaccauaaaggaguggaucuuggggccagggaagaugguggggagggcuggggggagcagagggaggggaagcaguggucagguguaauauaugagaauuaaaaagaaaagcccagagcuagcuguuguccuguuuguuaagcuuuaugccuagaagacagagaaucuauagaguuucucuuuggccuucacguaaggaugcuuaauguucaacuguuacaaaugccagugugaucucacuguguaaggaaauggucuguucuggcagggcuguggaaucgccaagugcuugcagaucaccugccagguuggucgacuggauagaggcaagagcgcaauccuguacgugaaaucccugcuguggaccgagacguucaugaacguaagcagacagacguaccagcagguguauacauuuuuucaaagaguuauaaggcuugcuaucuaagagaccaucgcuuguuauuucugugcagaaggagaaccagaaccauuccuauucgcugaagucaucugcuuccuuuaauaucauagaauucccuuacaagaaccugccgaucgaggaucucuucaacucuacacuaguaagucaccggcuucagagcacggauaccugccgugcaaacaccuuagugauuuuaguggaaguuuaacuagaacaagugaaaagauaaguuauuggagaggauuauagaauggaaagcauucucuuucuuuuuuuaaauuacauuuguuguugcugaggagggucacguaucacagugugcaggucagaggacagcuuuucagaacugauucugggacgugaggauuggaccuuggauaugagguguggugaccagggccuuuagcugacgagucaucccaccgacccaggcucuggucccuugguguucuuguacuucauuguccuagaauuaguagagcuggcccuuuuucuuuagcacuuggugcuguguaacaggguuuuuuuuuuuaacuguauaccaaauuugucaggggauauuuugggguuacuuucuccccacaguuauaagguuggaaacuaacuacuaacuacuaacuaacuacugcuaaguaaacauauuuugaagauaucuaaguauugaaaauaggaucagcugccaugaucuguauugggaaauuuacuagucauuucaauuuaaaucugaugucaaccuauugucagagucuugugugugcgcuuuuguguguguguguacgcaugugcuauggaugccuaacgugcacucacuaaaugauuguaugagaaaaagaacguggugugacuaccacuaaauuuauuauuaaaagaaaguugaguacucacugacuaggccagugagcuauuuaagacucaguguguuuucugcaacaggucaccacuaacaucaccuggggcauucagccggcgcccaugccugugccugugugggugaucaucuuggcaguucucgcagggcugcugcuacuggcuguguugguauuuguaauguacaggguaaguaaugggcguugaaggggguagggggauggaauaagagaagaagggacaggaugaagggaguaaagaaaaggagaaaaggacccacaguguugcugccuggugagcagggcuuauuucaggaugggacacuaaacaaaaacgccauuugaauuuucgaggugauaauagagucggucauacuuucagcgaucuguuacugagcuagaacuaugcuuuuucuuuaacuggcagaugggcuuuuucaaacguguccgaccaccucaagaagagcaagaaagagaacagcuucagccucaugagaauggcgaaggaaacucugaaaccuaaggugcuucuuaaguggcgccacuucuguccgcuccaaguucaccaccguggugguggauuucaacaucucucgugaacagugaaaucccaggacuguauugcugagagcacccagcagucucaguuuauccacaaaauugaaauggauauuugucgacuucucuuuaugaauaaguucagauuacauuuacuucgccuacacuaacguguguucuuagggacuuaagugauggaauuucaagugauuaucuuuguucaguguacauaagacagacagcacugagucagcacguuacauagcauaguaccucuucaguuacuguuccuaauugacugugugggguuucucucuucgacguuacguuagggcaauuaggauuguaaagcaguucaaauuuagaccaucaguaaguuugcacaggcacuuagaacagguacacauuacacuacaguugacuucauaagcuacugaagacuuugcaauugcauggacuuagauuuuaauaucauuuacacaguagaacuuuuaaauaacacgauaccaucaaaauucuuuccugggacuauagcucacuucgaagcgugugcaacucccuggguucaauccugcacacugggaggaaaaccagcaguuuccuguauuaacaaugguacaguauuuuuauaugaaaguuagguuuuuauuuauguguagucugcauugugucuuauuguauuuuaacuuuuguaauuuaaauucuacaucaaauccuuuaagucguuuccugcagaaaauuuuauaauuaaaaauacccguuaaguaauaguguggucucagcugcugcugcugcugcugcugcugcugacugaagcccguggaguuggaagggguuuuugaaguacaucuauucccuuuguuuggcugccugcaauguggaaaagcccuggagacucuccaugggucucuacucuaacugcucaucaaaaagacauucuuuaauuggaccagagcguuuaauuauuaguaauuuauuuuccuccuguccucauauuuuccuuccacuuccaaaacugagaauggcucaagaccuucuucauaaccuauaggaaccuggaucucgcgcccuuaccccacgagagaugccugggacccacauuccaaagguggcucaugggaugguuucuagcaauagcaugguagaaccucagguuaagcaaggugaucuauaaaaccugccuccacugucagaaagaaugcuacaaagguguuuuuguaagcaguucuuguuccuuaaaccuucuaacucugucuuacauuuuuuaauuuaaauuaccuuucugggacuuuaauagaggcagcagaggaagcacgggaccgucuuaagugguggugauuuauucacaguuccucaaggccccgggauaacuaucaauuauagcucuauuuuugugcaauuacaucauguuaugcauuggaaguugagaauuuuaauagcuuuuuaaaaugcuguccucauuaagcaaugaaaaauauuucucuuaaauaauugaauauuuuucuacauuuuaaaaguaauugaaguuugucucaccguaucuuaggcuaauuccaugugcauauggaugagcuaauuuggagaauauauuuucauaacaugaagcacauuuaugugaguuguacgaauuagaauauagacaggacccuauauuuagcuuuaauaaaauuuuaaauuaaugaguucuggcuugaaagaucauaaucauauaugcaauaauuauuuuuuuaaaccaauacauuuaaauucuuuuaagaaacauuuuggucuuagggacaagugucucuaagcuacuuaggacuaccacacaggucacuaaguuggccuauacaaacuuuuaccuucuuugucugucaacauaauaguugucauuccugaaaaucaaugaaauucauucuuuguaaaaaucaauauugauuuuuacaguuauuccuauuauggcuucuaugccaaggaauaacuuucuguuagagauugaaagauauuuguaauuggaaauuaacaugauguaguuuucaacaauagcauggauuuucuuuuaaaaaauauaaauuuguaucucuguaaacuuaggaacuguaauuugagaguuaacacucugaaaaaaauguugagauacucuuuaucccauaacagcauaggcauguagucaacaaaauagcaagagauuauuuuagauucauauuuguaauuuaccaauaauuaacauuuauuucuaagcauaaaauuuucauaauauagguuaauuaaagaaauugauugauccagaggacauuugacacaugugaggaauauuaacguggauacugauuucuuauagagauauuuauuuuagaguugguacuuuaaaacaucugugugaggguuacuuuccucccuuauguuuaauuaucaucauaauucugauuguguucugaaugacuacggaaggugaaacagucaaaauauugucuuaaaucuaccuguauuacaauauuacuuauuaauaguaaauccucaugaauacauuauuuauauaaugaggaaaaucacuaagagcagacaagaguuuguugccgccuuacgagaacagugugaguuucuguagugagucuaaccccgaggagggaauuuaguggcaaaguauauauugguagagcaacugguucuuguagggcaacagaaggccaagguggcauccauccccauuugagagaauucuggggagagccucaaggagaaggaaaggaaguuguucuagagucucuguguguggccauugccuaucucugugucaccuuguucuuacucguggcuagcuuguacauuuaauuugaugaguaaggggagaugaccaaaauguauuaugggaucuaaaaagacaaauacaauugcuugaugucuaguaauuuguaaagguuucuuuggacuugguccuuuuauuugaaccaugaaccuguggcuaugccaucugcaguauacacuggcauucauuauaauuucugauaugucauggacuuccugugagguacugaaucuuugaauuuuguugucauuguucuuaagugcaauauaacaauguaacgaaacuuaaauauaagucacuauuuaguaaucuuaauccgaaauuuauuaguauuuuuuuguuagcagaaaagaacaacucugcuguaguuguagauauauaggugaaauuuuuuguuuuuugcuuuuucuuugcuuuuuuuuuuuuguuuguuuguuuuuuuuaccucuaaaccauccaaucugcauuuuauuuuagguggaagaugaacuauuccuuaccaguuuuaaaacacuuucaguauauuaagguaacuuggaagcuguguguaucaaauucuuuugcucgcuaaguaaccuggaagauaauuuuuuuuggcuucucucgugaucacccacauugggugagacauaagaugagucucuccugaaaucugucauuugcuaacuuguuuugaguuaguaaaagcagguaccauguucugcuuuguuuccaguguguaacuugugacuguacaauaaacuugaacguguggugccagc

SEQ ID NO: 12291 - RNA, 150893 nt, Mus musculus
gagggggaggggaagagagggggccgagcgcucggcgcggcucccugcagccggagccgcaugacgcgcggaggaggcagagggagcagccggggccgcgggagccgggagcugggagccacgcgcggagggugggcgccgcucgcuccgccccgcgaagccccugcgagucuaaggccgcggccgcuccgcgccaggcgcgcuaggcuccgccguguggccgccgccgccgccgcugccauguccccggggaagcccggggcgggcggagcggggacuaggcggaccggcuggcggagaaggaggcggaggcgucggcuggagacggagacgagggcgcccggcuucgggcacacggcggggcgcgucccgggcacguuccagggcgcgcagggcaugaagcccgcggcgcgggagacgcggacacccccgcgcucgcccgggcuccgcugggcgcugcugccgcugcugcuguugcuacgccagggccagguaagcucucgagugggccugggcgugugguaggaagacgcgggccgaauuggcaucgccugcaccugcccgggugucacccguuccaggaacacccggcgagggucugagagaucgugguccugggagccuuccuccuggaggaggcuggcagggaucuuggccagccuccugcucccgccacucagccccuucccuggcucccgggugccaggggaagggcaggauuccgggguccccagggugucccccgccgugcccguugacucuuccauagaagcucccgcaugggcugcaggcggcgguggcccggccuuucccggagcuggucacgucuggccagcgcgggcccugcuugcgcgcccgaagcggccggagggggcguguuugcggagggcuguggaugcggagcagggacggccuggcugagccgaggccgaccuacgacccggccuggaggggcacgagggcuuggacagaagggcaguggcgguggccgggugcuuggggacaggcccuggcgcugggcggugggcgaagcgccggacucagaaccgagggcgcuuuuugugggggaaaguucccagccuugccaagguggccgcucaaaggcgucccuugaggcugcuggcucuguucucaucaucgcuccugagauagugcuggcuuuucugggugugcauucgugcuuugugggcgcuagcuauaccccuccccuccagacuuuucuuuucuuucuuuuuuuuuuuuccuugcuucacuuuuuuuuuuccgauaauggugggacucgaauuuuggaucuuuucucucagugguauuuucauggcaggggaugugaugcaaggcagcuggggggacauucccauuuugcagauagggaacugagggagagaagugaaagaguggaaucacccagcuggugcugcgggagcugagcaagcgaguucugccucacagccuucugggaacuggcuguggucuugaacucugcagcugaaaguggccuggaggaugcucuugucuugcuuuuugcuaaugaaagucucacuugcuuuauagguaccagcucuaaacagacagugagacacaaaugaagcauaggcuggggauggaaacugacuuugagagaaagcuuugcacacacacagacacgggagggagggagggagggagggagagagagagggagagagggagagagagagagagagagagagagagagagagagagagagagagagagagagaaugagaauaugaauuguucuagaggaaacauaggcacuggggcagcagagcaggcgggcagaagaagggagccugagucugggccugaacuaauugucagcaaggguaacuuauaguuucuaaagcaggauuugcacaggacucgugguguuguccccagcaaauaauucuuuacuggacuggguaagagcugagucugaagaagaaccagaguugauuuugccccuuuuccccaauuccaucuuuagcaaaaagcaucugcaggaaugggggaggggacacaccauuucauaguagaauuguuugaauggcuuccauugaagagugaaagaauuuuguaaauauauauuauauauguacaccacuuuucauauaaagccuuuucagaugggauuggggauuuauuggggaacauuguggaugggcugucuucauccuuucccuguaggaaauucaugcacagcagucuuugacguuaaagaaaaagaacugcuucuuauuugaaguuccccuucuccaagaauucgcuaugcagacuaggguggcuucaagcucauugagaucuguuugcuuuuguguuccauguacaggaugguguggucuugaaauucucuugaacuaaaauuuauauuauagaaacauuugagcuacauuucucuuuaguuuaauuugauuauacauauguauauguauguaucugacuuuuguuucaacaauaguagaaguugcaagcugugcuuugaaucagcaaaaaguaucuuggguaaauuuaucucuugcccaauccuuccuuguguuucuuuagcacauugcuacccuccgccugccuuggguuugcuuauuuccuuccucuaguuuguucuguagaaacucgagaguccugucuucauauucuuguuuuuguauuuguuacaaaauaggaaauauaaaagguuucaugaagaaauaucuccaaaaacaauccuuuucagcaguuucauuuugauauggacucuugcaggggaucggcaccuucucucucucucucucucucccucucucuggugcuggggauggaacccaggguaggggaugcgcucuaccaccaaguuacauucucaguuuuagagaagcccugcgcuuuugaagugacucagagacugugucaggggcagauaggaugggucauugaguaagaguucuugcuacacaaacaugaggaucugaguucaaaucccuagggccaguguaagauguggagugugguugugugugccuggaacgggcauacucugggguguggagacucacuggggcuuguuggcugcccaggaagagacccugucugaaaggaauacgauucuguguccucugcccagugcaagcacaggcauguguauccauacacauguacauauuauacugaaaacacauagacccuuauccucagccuccccccccuuuaaaaauaagcuccccuccuuuuuuuuuuuuuuuggacaggguuuuuuuuuuuuuuuuuuuuuuauguugccagcccuggcugguagaacucauuauauaaaccaggcugcccuugaacucacagagaucugccugccucugccucucaaguuuugggauugaauuugagcaccagcaugcuuggugcuagcucuggugguugaagacagcuccagcccuucaaaccucuuagaugaggacauuggacuugagagaagagguuauuuggcaagauaggauuauaaaaaagccaagaguagagcuugaguuaccagucugggccuaggcuuuuuggcuguguuuucucuucgagcacagugcuguguuacuguaugccccaaacugcuuacaaauugaguuuaagagucaauuagagcaggcuuacaauuaucuccagcuccaggggcucugaccuucucuuuugaucuccacaggcaccaauacaaaugugacagacagucacauaguuagacacacauacacaucaauaaaagaaaaauaauaaaucuuuuaaaagucaauuagauuugaaauauuuuugauuuguguguguguguguguguagaaaguaagagggaacuucuuugauggcuucccuaauguugauuuuucuuuucagaagaggcuuucuuauuuauuauaguacaagcaacagaaauggggagggaaagaaaggaaagggaaaaaaaggucacagaaaagacccagcucuguuuggacaccgaugaggacagggcguggaagcuggaaacugagaugccggaagcaucaguacuuaguaggcccggaaaagccauuuuugaaacuagcaucucacucccuuucuccaagacaggacgggcagucagagaugacccuagugcaaggacuuucaugggugugcuaucuuaacugguccauuucugagugcauucguacucucuaguuuugguuuauguauguauuaggcaguguggcaaagugaucucuccuuccucucuugagacauauaguccuguuagguuccuuaaucagcuugacagcagucuguauuaaaauagaugcugaugauagcgacaaaacaaaaacaacugguagccacuuggucucacaguguuccuuuuugcuuugucuugugucauuuggugggugauaacuuuguauuuuuaugucuuguggcuaaucuauaagccugauuauuuuccugcuucaaccagaguacacacacuaaauauuuuggcuccucuuauaacugcuuuuuaaguucucacaggagugacuuuauuuuuguuuugcuucagaacaacaaaggaaaacccaaccauucuguuuuguuugcagacaguuuaagaaaacagagcaaauugguuuaugguuagucugugacuuugggcuaacuucaaguucagccccaggacaaagaugaccaggaauacccaagcuuuccugagcagagagaauccuggcuccagagugagcaauuuuggucagcaaagagguuauuuagcuccuaaaaguaaugcuugaggcuggggccgaguuucuggaugacuguaggccuggcuuuagccagugcaucacgaguaauuacuucuuaguucauucacuucuuggccaggggaauuauuuugaguggcggauaagaugcaauuuucuguguauuucccuuuuagcaucaugccaccgauaauauuauaauuaauagguagcauuaggugugucgggcacuguguuagggcuuuuaaugaacugucucauuuggccauuucagaaguucuggugguagcugcugcgcauguucucaguuuaugauucccaaguagagccagguugcucuguugcuccaguuuccuguucugugcuguagaaguccuggugaugucgagguuuucaguguguaacugagcaucgaugccaggcuuuuguggcaagagauaggcuugagggucccgaaccuugauaggccugagaauuauuuuggauucuuugugucccaaauuaugucacaccuucaggccccucauggcuacuucuguuucuuugaagccugaguauguauacaaaggcacaccugccuuguguggguaaacugaaguggaagagccugggugugggcuugcucugccauucaguaguuacaagaacaagccagucacucucugugacucuucauuuccuuaucugggagcuggaacuaauacuuccugcuuagcugggugguggggggaucaaauaagauagaaggaccgcugucaaguaaaaccugaagccugaugcauuuguucgaagugguugcugcuguuaugugggggcauuucaggguaguaagggaagaaaugggacuuugagucauuaguucccagaacaaauauuuguuaaauguuucuccaagguguuuuaucuuuuugauguuagguauuauuuuacuuagcaaaacaguauuuguaaacuauaucaagcccaugauuuuauagucagacuaggcugcauaugggcucauaauaaggaaauuuguuuaaauauaauagugaaucccgaggaagcagucugaguaaaugaucuuuaggugugaggugguuuugggaaacuacacaggugauaaaugcuuaguuuggggccagucccaaagccaaggcgauucugggaaagaagagauugcuuucuuaugggccgugaggguggggaugauuuagaugaccagauacauagucacaguggcgauguuggcagugcgucaucccugaggucccuuuagagagagagcuggcgcuggacuugccagagaaggaaugguugguggguggguggguggggguggggggggggugggcaaagagucccuggguggagaccuguggaagugucagaaaucucugacuagagaagucuaccgcgggcuuaucaccaucugguagggcuggcuuuccagugccuuuucuggugaccccucagaggacaggagauguaggaaacuuguuauuacuuccuuauuagugacagcuguagccguccuauugucucagaauuuccauggcauggaaaugccuggguugggggguagcggcgaugagauggccgaagcgagcgcgcggcucccacagaaccucuaauuuuagacaugcaaauaauuuucaguuccacuuuuccuucuuccuguuagagggaagccguacccugcugcugccauuucugaagcuugugcagacaaugcugguauuaugucacaaacuagcugcuucuccggggcaggaguguguguguguguguguguguguguguguguguguguauguaugugugugugguuauuuuccuggguagaugugccaggggccagcccaguguaauuucaugccuucugaauaacugagcgauauuaaaacauggcaccggcaugaacuuuauagcgaugcugucuuucuuuuugacagguaaugagacuuugaguagaaggaaagaauuguuucccuaaaggagugaaaacgugggauuuugugucguuugaguuguuuccuuuaguagcccuuuuuuauuuauuucugacccaggauaucacugugucucccaggaugcucuugaacuggcguuccccuuguaucugcuuccuuagugagcggagguuuacaggugcacaccaccaagcccagacuucucuuucuuccuucccaacccccacccccucucucuuucuucuuuacacagagucucacaguauagccuuuuguuagucucaaauucacuauauagacuagucuggccuugaacucauaaagaucucccuaucucugccucccuagugcugggaggaagggguguaccaccuugcccuggcauacucagcuauuaauaaacucuuuagagugguuuuuuuuuuuuuuucuuuuucguggugcugagauuggaacccagggccucucauguacagagcaagcacucucuacaucuuuagccccuggacuaguaaaaaucccuuggaagcccagauuaacccccccccccccgccccagugugaacccguguacauuagacccuccauuucuguguucuugcuucuaggguccagucagacgugcucagcugaggcuaggauuacuaaguagaauauuuugagagagcaaccacagucacaucauuuuuguuagaguguauuguuauaacauuccauuuuuauuaguuuauuauugcuaauaucuuacuguaucuaauuuauaaaucaaauuuuaucauagauaugucuuguuacaaagauuauuauauauaauguauguggaggucagccauggcuuuaggcucugagagucuuggagugucuccuccaugggaaaugcaaggcuacuguacuguaggcucagaaagcuaucaguccuauuuaaagauagaguauuuauuuauuuauuuauuugaggcaaaccuugaauucccagauaugccccugccucagcgucugggaguauacuacaugccuugccaaaacagacuuccaggaaaauuucuucuugugaugaacaggugcugagagguagaauggucagagguucuucauucucagcuacacaguaaguuuaggacuggcugcauuacacgccaugucucaugccccaguccugaaaaugguucugugggcuggccauguagcauuugccuaacaccagguuugauacccagcauuucccuauaaacacuacauuuuuauuugugugcaugcgguguguacaccaugaagcaugaguggcagucagaggaaacaggagaguugguccucuccuucuaccuuguuaguccugggguucaaacucaggucaucagguuugguggcaagugccuuuaccuacugauccauccugguggcccauacaagcuacuuauagagcauauuauauacauguuaugcuugguacguagccuccuaauuuauccaguuauuuuggagauuaugccaguuuuuaaccuguguaaaccuauucuuuuaacuaacuuccugaaagccagccauaugggccuuccuucccagugggcccucggcuguuuccgugugaccccucccccucccucaaguccuucuccuggaaugccuuugguguuuauuuuuuguaacugucacaguaaaacacaacgaguuaagaauuauggaagccuggggugguugcugugaaaauugcagagguaguaaauagcugagaggcucuccacugguguaguucugucugguccuaggauugcagaaauaggagcggcggcacugcuuaaagcucagagcucuugaaugguuuuuggaacuguugccccauugcaccuacaaauguggguguaaagagaccugcuucuccauacccucaccuggguugaggauuguuaaacuucuaugugugugcaaaucugagagguuaaaaaaguuuaucaugaaaauuguuuguaucuuuaauuuugaguuaguugaauaucuucuucagugucuggggugggguguuuacuuguuauugacucuugaaaaaaagaaaaaaagaaaaagagaaaaagagaaaaagaaaaaaagagaaaaagagaaaaagagaaaaagagaaaaagagaaaaaaagaaaaaagaaaaaaaggaaaaaaggaaaaaaaagaaaaagagaaaaagaaaaaaagagaaaaagagaaaaaaagaaaaaaagaaaaaaaaaagaaaaaaauucuuuuugggccggggagaugguucacuugauaaaguacuuggcgugcuaaaauaaagaccaaggaguuuggauccuggcgucuguguaaaagccuugaauagaggucugugcucgggaaagaggcaggguggaagcaggaggaucccuggaacuugcuggcuugccaguguagccagugagugagcucuggguuugguuaaaaaucugccucaagggcuggagagauggcucagcgguuaagagcaccgacugcucuuccagagguccugaguucaauucccagcaaccacaugguggcucacaaccaucuguaaugggaucugaugcccucuucugguaugucugacagcuauaguguacucauauaaauaaaauaaauaaaucuuaaaaaaaaaaagaaaaaucugccucaaaaagauaaauguagacagagauauagcagaagacaucaccugaaacucugcccucacgugcacgaguaccugcauacacaccacacacaucagaacuuuuguuuacugauuuguucauguacuuugcaaauuaaggaaaugaguucuuauacucucaucucuguugcaaaucagcuguccuuaauuguuuuugguauaacccuuauuccuuaggaucucagaugacagagcuuggagucagccugccuaguuggagaccugacucuaucaccuaacuaacuguaugcgcuuggguagcuacucugaucuuucugcgcccuguuguuccuaucucuacaacacugguaauagugcuacuucuugcccaagucauuggguaaguuaagugagauaacauucugccuuguaaauggauguagaauuauaaaaacauuuuagaaaacauugaagauagaagauagaaucuaaaguugaaggaaacauaaugacgcuacagauggucugaaguuggacguaagagauuaggucuaccacggauuguggacauucugugcacauuccucuuccuucccgugaauguaucaaaaggcagaguaguggagaguugauaguccaguuuaaguuauauuucucuugauaaguguguguauuugaauuaauaugagguaaaugaccaugggagaugaucaaggaguggccaaugugaucuuagcgccaaaagaagcacaaggacacuauguccauuacagaaaaaccugucuugcuuugagcauuucucuucgccuuguggcugggccagcuccggccgugcccaccuccugucacuggcuacauuuucuguagaguuauuuuaagcuaccaauggaaagugugaagaccuaguucuuggcuuugacugcugggagguguguggcugcgacagugggcucugacgaggccaccuguuuccacgcaggcagucaguacugugcauuuccuguagcugaggagccaucacugagcccugggcucuucuccuccugagcagacugcuggcaguucugugugcagagucuuuggauacugacggaguugcugcccagaacuugguucauggacuucggagucgcuuuccuccuagcugugugacguugggcuaucucgucuaaagcucagcaucucaucuaugcucagaucuuggcuguuguugaaucauuuuauucugcugagauguuagcaucacuuacuauuuaaaauaaaaaaguacuuauaguuuauaggugguuuuacacacaccugaacucauuuaaacccaccagcaucccuuugaguuugccacugugacucaggcucuguauguguguaugugucucccuuagacccuaucucaacaaaacauaaugaaacaaaagggaaacaugauguacuucagugcuagaacuugcgcaacaugugcuaggcccuagguucaagucccggcauuggaggaaaaaaaauuacaucauuuguuaaguauagcagcucacaccuguaauccuagcaccuggagacugaaccaggacuauugccaagaguuuagugucagccugggccacagagugagacaaaguccccuaaaaagggagaaaggaaaccaaaggcaauauauuuaaaacugaauauaaaauugaauaaaaugagucuuaaccagcacuuaaaaaugauagaacaggaaaucuuugaguuuacuggugagcacugugcugugaagcugcuucugcauugagcgguugugugugccuguuugugugugugugugugugugugugugugugugcacguauugcauguaaaguggcuuguaguagccagaaaaaaauuccaaaccuccaaccucaccuguaugucucugugugucugagcugugggaggugcccccugagggaaggagccaggccguguguguccaggcucugauuuacucaugucguuguguccuguguggcuggaagccaucaugugggugcaggaaugacuaaguucuccagagagacuuaggcagacacagggcugugagucccaauagggccuguguuucuugcugccagaggaucuugguggaagaaaccaugggucagugcuugacauuuuggcaagcgugcuugguagagagcuccaggcaccaccugguccauugguuuaaauuccauucuccuuuuggcuaccaaggaucacaucuaaggcuucgugaaugccuggcaaggacuugaccugcucagcuucuuaggcuuggguacuuuagaugagaacuuguggccagcacaggguggcugagacccuuggaagccaccaccauccacgagguagggggagugggggugcacaguguggagcccugacaguccuggcauuacccucggcccggaacugauuugcaugggguugagccaaccucaucuaggcgucuguuagugcuaacccagcacccauguucauuccauucccaugcuaguuuauuuauuuuuauauuuuaaacuuuuacuaucauuacuuuaagaacuuuuaauuuuuaucuuauguguguggauauuuugcuugcauguaugccugugcauuacacacaugccugcagaggccaucaggggauguuggguccuguagagcugcaguuaugaaugguuguaagccaccacgugggugaugggaaccaaccacagguccucugcaagagcagcugguacucuugacugcugagccauuucuccagugcuuauguguuuauuaaaaaaaaaagaauauaauaggacuauuaugauauauuugagcaaaguuuguuuuugagguugccuacuuacccaguuuauuuuuuuacauuuauuuauuucuuuacuuauuuauuuauuuauuuguuuauuucaggacacccaggacugugaauacagugaaauccugucuuuaaagaccaaaaccaaaccaaaccaaaccaaaaaaccaauaaauaaaagaaagcgaagucaucggcagucucugccgacucuguuaacuccaucacggcuuugcggggggaguuuggguuuccagugugaauccuauuuuacccagaugguguaaccuccuacacacaugugcugugacuuagguuuuucacuaaaaaaaaaaaaaaagcaauugggacagauggucucuuuaaggauaccccaggaagccagaagacagacacaaggcuucuucuugaagggucgcugcuaggcaguggaaaguaucugggaagucuguugaaaacaaacguggacaugucauaggguagauacuaagugugugaguguguguggggggguuauaagagacagaagagagaugccuacucugcugacccugagggacaaguucauuccuccguucuuuggggggccuugugccagcuugugaacuguggacacuacuugccagggaguagucucuuguggguaaccuagggauugcaccucauuucauugucuaguuaguggcugugauacagucuucaguuuuugaguauuucuuuugccaugcugaacuugacucagauaaacucaccucugaugcuccucuuaggagaaucuaaaaucacugaacucauaauaaucauauauauuucaugugaagaacugcuaacacuuuguauacauugacucuaauccuauuaugugggcacagagugggaaacugaggcucacaccuccauuguaagcguccuaugggguaccagggugagccgggcagggcaucucuacaggcaggucugggucucccgggaggacagcugggccuaaugguuguucucacagguggaugaacacaugcucagggcuguaagcacaugacaggagacccaggcuucccccaaccacacaagacaagacuaucuuuacuguggguuuuagaucuuggagcccuaaggugguaaaggcugugucugacuuuuuucgggucuuaguacugaucaaaggaaugacauagcagccuuguguauggccuccagccuuguugugaaugaacuuggaucuuacagagcuagaguguccacacagaucacaugacuucaggaugucccagaggcacaugggaagagcuucuguguugauggcagcguggauccguagcuaugugaccuugccauuugcacaagcauuguaacccccagaauguguaacuucauccgucccauuaggaagugccaggccacagagcuauugggcccaaugacaggaggucuccucagaucuuggugcuuggggagguucuuucauacucacccuuccuuaccccucuguuagcacagcaccuggggcugccgagugacacaggagaccugcuaaguguuguccugcacccaaggugugcucagcagcuucugccagccuuagcacuugcugucuugggcgauugccagauccugcuguguggggagugcaugcuggaaauugcagacaguagcgaguggggaucaauggaagaucuuacuugaaaugacguguuggggugggagagacucagacccuuagucuccaucugaccacaagguaugucacagccuuugacugucuuugggaagaggcacaugggauguuuaggguuuuuuuuuuuuuuguuuucuuuagagccuggcagguaggcuuuguccuugcucggcagcgugguuagggugagugacaaugacuucuuuuccuuuagcucagaggucuuucacuucaguaucauaaccauuuugggguggaccgcuuguuucagaaggcuuacccaugcagguagaauguaggauguagcauuucuagcuuccaccuucugaauguugguagugucccuuccuuaguugugacagacaacagugaauguuuuuuagagauuggcaaugucugcugagcagugagggaccagucugguggaggacuguguucucuauaauuauucugaagacuguuccauuuucucuuguguucccagccucaguuuccucuccugccaagugaggacgccagauaguuucgcuaccuugcuuggggugggacaggaagccugugguaaugugauaggauaguucugagcucugcugugggcaugugggggugaaagggagaccaauaguuacacggaguaguaaggccaggcgugccaaguuccacaccggagauaggcccuguuagagggagaucccauuacaaagagguucacugccaaguucucccucagcagcucccuguucagcuucguuuggaggccccagggcauacauacaacaggagagaaugcuuuuagagcuugugacacgggaggauggcaggaauguggcaggaggagaaacccacuuaaaaaggagcugccagccagggaaacuggauugguuuucuaaaaacucaguguucacgugcuacaucaggauccagggaccuccuagcuuagcuagcguugggcagaccugaucaggacacuacccagauuccagaaaaguuauucugucauaucuaccuaacugccaggggcugugcuggccucuuguuucucuuuuacaguuauugcguccauuuuagagaugagaugcccagaagcaaaggaaugagcuggcccagugcccgcggugugguguggcucuuguguaauuucacuucuauuacuuacucauaaacagcaacuuagcuuucaaaaccugaguuuuuccucacaggccaaauggggcuaauaaacaccucagaggacugugauccagauuccaugagaacaugugcgauagcucuagcacauaggaagcucuccauaaaugucaacggcguccauuguuauugucuaaaauaccagcgauagcagaggcaccugcuuggaugaggguuuccaggaacacaggaaggcuuugcccuccuaauccuaugcucuaucucaggccuggccaguaaauguuggaggugaagcugccaagggggugggauggggguggagaggacaaagagcucuagauucaggaaaucaggcaaagccugcccucugggauagaacaugugaucucauggucugaucagccucauacagguugagcucauugccaggcaaguggguaguuaaugauugcuagucaaagaaugucugcauuggaaacaaccuugggaacuugaagcuagggaaaccagaugguucuuaguuuguguccaucuugaaaugguugagagugacagcuuggcccccaaauagaagggauucuuagagucuuugggcuuuccugguucaguauaaagagaguacugggauugauuagucaugccuguuauggccacagggaaggcaaagggugguauaccuauuugcugaauuuggauauaguugauggcuaagacuugcucucgagaugcucacccaccaaaucauaaaacuguaauauauuauuuuuuuuaaaggaauuacacaagaauguuuaguucauguugggccugguggcuugugacuguaauuucagaacuuggaaagucgaggcaggagaauuuuugaguuugaggcuagucugagcaaguaauaaagaugaggaaaugaagcaggguaaguagauggagugaugauaaggagcuaugagaucuaaggaagaacacuccagcaagagacgggcccugaggggaauggaggggccaagucagccacaacugagcaggugacaaaaagucaccucaaaggggcaggguugaauugaggcugguggggaggugugacugguggucaggaucagacguucugggucuuggcucuguucagauccauauuaagagcaaguagaauagcaugacuccgcccgcccgcccgcccguaugaggcauugagaaggguaggugggagcagagggugggagggagggggggagggaaggaggggcuaagaccuaguaucugauagugugugauguuugagucccaagucucucaagucuuccuucuuuguccauaaugcuauguaguucuggguagccaugcuccugucuaagccuuguuuccugaagagauuuggccccuuugacucucaauccuggcuacauauuaaaaccacacaaggaguuugggaaacucagguauccagauucacuugaucuuauagagugccucaaaauggaaccuuccagaggcccccaacauggagucauaggugagaagggcccaucaaaagggggcucugaagucuugucuacucaaagugugauucuaaugcacgugugugugcaugcguguacacacacacacacacacacacacacacacacacacacaguguggagcagggaauacagcuuaguggcacagugcuugcaucccaugaaugagguucugcguuuaaucuccagaaccucaaauaaauggauggauggauggauggauaaacaaaugcaugcauuaccuuucgacacagugaguuccuccacacugaagacugugaaagaaaggggacuuucucaaggcugaaauucaaaaagcaaauguguguguguguguguaugugugugugugugugugcgugcgugcgcgcuauagugcccauguggaagucggaugauaacuuguuggagaauguucuuuccuucuaccauggguccuggggaucaaacucaggugucaggcguggcugcaguagucacauuauuggcucacacaaggcucuaaagaauauagguucugggaauugagcucaggucuuccugcuugcauaacacacuguguccccagggccugacuguaguuuuuaacagcugugguauacugcagaguaggugugcuguggucuacuuaauuuucuccuauugacuguuaagcaccagccagauuuucaccuuuuuaacaguaguucagagacguauagcuuuaggccucuugccuuuucugugaaguagagauuacucagaauuaacuuuuagacagcuuccugauauuugacuguaccugccagacacauccccaagagagaugcuuuguuuacacgacuaucugaauggauaagacugccuguuucaggacgccuacacuggcacuggguguuacuguuuuuuuuuucuuuuuaauauuuuuaaauuuaauauucacauuuucagacaugccagcugugugguggcugcugcauauuacuuucugaccacgugugacucauacagaaccaguuuugucuguuuugugugauccuuuuuuugagugggggaggguuaaucuaugauucuguuuuaaugcaugaguaucugucugagugccugauuaggggcauuucuuccuuucuuucucucucucucucuuucuuucucucuuucucucucucucucuuuccuuucuucuucuucuucuucuucuucuucuucuucuucuuccucuuccucuuccucuuccucuuccuccuccuccuccuccuccuccuccuccuccuccuuuuuuuuuuugacaggaucuucuacuaaacucggaacuugcaaucuggcuagauuagcugggcaguaaaugccucgaaucaaaccccugucucuaccuuacagcaccaggauugcaguuagguucugggauuugaacuuagguuuuuaugcauggucacccaguuuuguuuuccccucaaggaaaaugucuacuuuaaagcaaaucaaagaaugugaucugcacuugucuugagggaccuagaaaaauugcugauggaaccagagccagcugggccaccugucacaugaacuggcuucagggcucgucaggugcgcccaucucauuuucagaguucaugggaaggggucuugguguccaguggcuagcuuucaaaugaugagauugguggaugucucugcagaauggaagauggcuggauaucugcuagcuagcagauuggccucccuggcugagucuccagagggcagccuccacacccagaguggaagagaauacugaggucaaauuccagcuuugcccuugcugccugaccuugaccaagucccucccaccuucugcaucuucuaguaccaguagccuuaacguuucccacccaugaggacaucguguuaucagggauuuagcacaggaaguccugggcaugcuguugcucuugagcuaaccuaacuguggccugaggguuggggauaaaagaagaggaaagggccaguuuguguuucuuuucuguagccaguuccaguuuaguuggagacgugagcugagcuugccggagacggcuucaccucagcuucauguggguuucaaaggcacugcggcuaggggaguaacccaguagcuaugguuucugcccgugcuguugcuuugugugaauguuaggagccuagaccugcagugcaggaggcucauuugggguaccguggagggucacauuuggcaaauucagucuuauggcaagagaggcuugugcuggacuuggacuuggguaucugaugucugugugauuuagauugucucacagaagcaucaugggagaguuuucuuauguuguauguaguagucauuuauuuuuaguggcaauuacaaaacuaguuucauccggaucuaauucacauacaauaaaagccagccccuuaaaguguauagucacauuuuaaaaauuauauuuagggcuguaaaaccauuaucauugccaaauucuagaguuuuucucauuacucccaaaggaaauccuguauccuuuggaagucacuccugauucccuacuccccccagcuacucauuguguguguguguguuugcccaaucuguguuuguguaaacagaauaaggcagcaugugcccuugguccuuuuuaugacccucucucaugggcaugugcugguuuugauugucuuucacgaguugguggacacuuguuuuuugcuacuuggcuauuacaaaugaaacugcugugaauacuuuugcacguuuuuauagagaugcaggcuuucuuuuuaaaaaucuucuguauagguguguauucuguguaagcgguguguacgcgcacacucgugaggagucaggacaacuugugaugucagcccugucuuugcaccuuguuugagacaugucuuucaaggcuagcuggucugagagcuuccagccauucucuggucccaucuuggggugggaauacugggguuauaaaaccccacuacuguuccuggcuucaugugggcuuuagggaucugcacucaacccuuacuguguacacagcaagugcuuguacuugagcccuagcuuuucgguauagggagauuuaggcuuggagagagucagugacgggagcuggggccuuuaggaaguguuggauaagaaaaaccuguguggauuugcccugccuacuuuuaugugacccucugaggcagggucuguuccuaccccuuugcugaugggcuacacaguuagaaaguggcugggacugucuggcuguuaggcuuucugaagcugcccugcuccagucaguaugcuaggguuccagaggaaaaagccuucagcaaauggaucaugguggcaugcacauguuuguuaggauugguagggagagaugcugagggcuggggagggggaagccugcagcaugaccuucuguguaguugugacaggaaaaguauccuuuagaaucaugauagaggguaacauuuacagccuuugaugaucuuguguccuuugaacaucaccuuccuuaucuggaaccccaggcuuuuauccuggcuuccggccucccuugaggcugaguaugaaugaaggagugggagagggagggaagcagacagaugggagagagagggauaggggaagacaggugggagagggggcugggcgagggaggugggaucguuaccuacaggaaccugcagagcucagugaugguccagggggcacgggggcagcuagggaggaaauguagcaggugugggcagguagccugcuggucuaggaggauaucccaugcccacuuggggguucuggaacuugccaaagcuccuccuaaugagcuggcucucacccagccacuauugauuuuuccugguauuugaaugugagccuuugucucugggaagagugcuggcagccucccccauccuagaacacccucaucccuacuggacaucaccuacacugcugugaggcuucccagggcucugccagucuccugguggccugaccuauccggguuggccucucuguucaaguggcugacggugguucuuaucucugacucacagcuugccuggaguuugugaaaagccuugucagaaaauagagacagaagccucuccuuggagggguugucaugucgugaugauggucuuguuccgacgaugccacuauuuugcagguuguuuugaaucagucacuuuuuuuaaaaaaaaaagugugaugaacacauuugucuuaauaugaaaagccagacuuaugugaugcaaauuagaugcuuuuuaaaacccaaagccagaauucuccacccccacccccacaccugaauuagacugcaauugcucuuuuguguuuuccuuccuugugcucagugucuccacaguuggacauaggugggcccccuuccuguucugcgcuugaugucuuugcucugggcagcagcugcuugguugggcgcugcacuuaagaauuugagccgggcgugguggcgcacgccuuuaauccaguacuugggaggcggaggcaggcggauuucugaguucgaggccagccuggucuacaaagugaguuccaggacagccagagcuauauagagaaacaaaaacaaaacaaacaaacaaaaaaaacaaaaacaaaaacaaaaaaaaaagaaaaaagaguuugaguuaugaauauggucccuguacauuaaaaaaaaugaucagacccaaggguccaauccugagcaggaaggggccuugaugaaguguuuuauagauguugcuaucaggaccuagagaggggaagugacuugcccauggccacacagcuucucugugcucuuaaggcuuccgacuucagccacuuauuccuuuuggccugcccucucagauccuaaaguuccuauaguacacauauggcauguucagggaacauacuugccucugauaacguuuuugacagaugcugcauuaagcucugagguugaauucuugguaugugccauuccuuuggggagaagacuggaggagucuguuggauucuagagacacuaaccauuuccuuuccaucuggcagaggggaagcuggccaugccugacccauuucacagucacaccauaucugcuuucaguauaaaaaccaacccaauucuggaugaacuuagguuggcaaauuggggaagcugacuuugggagguagguuagggaagaaaaauaguuccuucuauauuaaaauuugcugacauaauacugaaagucauuguccuauucaugcuuggcugagauaggucacaccaugggugguaucagaggugcacuguuucccccaugaggauaaauugggaugaacuaggguggguuugcaaguuagaaaaagaagcugagcugggagugaaacucagggguacagagcuugucuagcaggcgcaaauccauggcuuucauuccuagcacuucaaaaacggggucaagacauacaaacaaacaaacaaaugcucccuggaacccagggguuggaaagagacucuauaaagcagcggggaucguggaacugaggacugagaugcaguccucacgccuacuuugaaagacuguugaaagacguaagaauaugcuuucuuuuaaagaugugugcaauaagacauaaaauauaaacccaagacaaaaagggacagugggcucaaccgagcaccuagaacgcccgcguggcuacugcucuggugcgcaugcgugucucugcucuccaaugugcuguuuggagcaaguaaggcaggccuggcugagccugagcucugcccuguaaguaccuuguuuccaggguggagacccccuuggggucgaaugacucuuucacaggggucgccuaagaccaucagaaaacacagauauuuacauugggauucauaacaguagcaaaacaacauuuaugaaguagcaacgaaaauaauuuuaugcuugggggucaccucagcaugucuuaaagagucacagcaggaaggcugagagucacuggucuagaccuuccuaagccaggcuucucauuuauaaagugagcauggugccuucuaccucugacacaucuagccuuucagaggaggguuuuuuguggcuguacucuuggaucucugugaguuagucagugcucuguggcucugaucagaccacaccagucuccaucugcugcacgaagcugaggaaagcucccuucuggcuggcauacauggcuccuacauacauaucaugaggcacacuacaccacguuucuuguacauauguguggucauauucuguguguguucacacacacacacacacacacacacacacguucaugugccugcacauguguuuuuaaaacacuaauuuaaucuucaccacagccugauauaaauaaaauccacacuuuacaguuuuccuuugugaacugagggaucugauaugcucagcaacuugccaaaagccagagagugguaggacuggauucuaacccuuguggccuuguggacccaggguaggcaauaucagagcuguguucuaacucacaggguggccagugagucuuccucuucauuuucuuuuucuuuuuuucaaguguucuaaaaaagcugaaaauauagauuaaaaauguuaagucuuaauuuuuuuccagugcuggagauuaaacauagggccauguguguacacaugcuccacuacugagcugugucucuaguccuuccuuuuaaaauuaagacuaaagagacauuucaucaauuaauagcacucgcugcucuuauagaagaccugaguucuguucccaggacccacaugguagcucacaaccaucuguaacacuagcuccauccgaucuuaauaaccccuuuugaucucuguggguaccaugcaugugcaugauaaacacacaugcauacaggaaaaacacucauacuuaaaacauuaaaaauuaagacuuuauuaaaaagguuugacuuuaaaauuugaaacaauuucucaaacaaaaauuguaaaaauagcaguucccaaauguuuuuuguucaaguuccccaaauuacauaauaugcaaaaaaaucgaaacuaggaaacuaacaguuuuggugcaauauaauacacccaucuauagacauuauucaguuuuccaguagucuuaccaauagccuuguccagguguaggagcuuacguuauguugaguggucguguccuucagucuucuguuuguacuggauauaacacuugagggaggagcaucagccaugggccaauggccugguguggggaugggguucagucuuaacacuacugacucaacccagcaaaaacauuuguagauggguagauggcuuaguuuuuaaguacuugcaauguaaguuuacuggcugguuuugugugucaacuugacacaagcuggaguuaucacagagaaaggaaccucccuggaggaaaugccuccaugagauccagcuguaaggcauuuucucaauuagugaucaagggugggagggcccauuguggguggugccaucccugggcugcugguccuggguucuauaagaaaacaagcugaguaagccaaggaaggcaagccaguauugaacaucccuccauggccucugcaucagcuccugcuuccugaccugcuugacuuccaguccugacuuccuuggugaugaacagcaguauggaaguguaagcugaauaaacccuuuccuccucaacuugcuucuuggucauguuguuuugugcaggaauagaaacccugauuaagacagcaaagugugaggacuggagaauccauauaaauggaggccugccuguaauuccagcuucagaaggcagagacaggggauuccccaggauaagcugagcauaucagugagcucuggguuugauugagagagccuguuucaguaaauaaguuggaagagcaauugaggaggauuucugacuucaaccucaguccucuacgugcauauaaagacaugugcacccauaaauggguacacccguaaccacauggcgugugcaaacacaugggauaauggaaaaagaaacaaaaacaaaacaacacaacaacaacaucaaaaacaaaaauaaacacaaacaaacaaacaaaccaaagcaaacuugaagaccauacccagcuuuccuuggcgaaaagugucuccuggccccaacaauuuugcugggucaucuggagucaggcuuuuguuuuguuuuucaagacaggguuucucuguguagcuguccuggacuucacucuguagaccaggcuggccucaaacuccuagagauuugccucugcuuucuuagugcugggacuaaaugugugugccaccacugucccgcugagucagcacuuauuuuugccuuuggucgggcccagcucugagguuagcagggaagaggcucggcuggaugccugcuacuguucggcuggugccaggcaugauguuaaugcuucuuucauauugucuguggaaguaugguggcaauccaguggcucuguucuguuguuacagauguggaaaccaagacucagaaaucgcacuaggagggagggccugcuguuugaacuugggucugagacagugccaagccccugauauuacuuaucuuacaugggauggugauaacugacucauuuuaguuuguuucuuaaauugauuacauuuguuguuauuaguucuguguguguuuguguggaguuuucuuuuuuccaccuuuguguggguucuggggauugauugaauucaggucaucaggcucgaguuguuaggcaauaagugcuuuuaucugcugagcuaucuugcugggacccuugauuuuaguuuuuaaaaaauacgugcuucaagaaagcacugaagccagguuugguagcguguggcuaugaccccaacacuugggagucugaggccaacacuugggagucugaggccagcaccugagaggugcugugcuucaaaaagaaaaagcaaaaacaaaacccagagagaaaguagucaggaagguuuuaggacggucugcugaagugacagagaacauuuguccccuugcacccaugauuuggguggcucuguguguguauauguguguguucucugugacuucauaugaggggggaaucuuugaaguguagacuucugggaugucugagaugguaacugcuacucuucuuuuuacacccucuucucuuuucugaauacuucugagacguacccuuguaaaucagcauguuuggauccacacccucucgcuaaguggcgcuaauugaauuacuccacagcuccaaggucaugguucaaagcugccaucugggcagcugugucaaaagguguuguguuguguuccaucugcccagaugcuaaccaccaugccuguugauucuacaggauuuccaugaguacccgcccuguguuagcuuccuccaguaccagcagagugaagguguaggauauuguccuccauagucagcacccauuauccagagggguugaauguaaaggcacaggugcgggucaccuauucaucugucucacggcagggguagacuuugagaaagaaugcuucaggcugcaaagacaacauagguacacaguagagagagaccagaguuaccuguggagggguccuuggaaggggagacuuccaggcugagccuggcaccuucccuggggucuguacacaggagcugcuuagagccuuucaaguuggcacugaagaugccagucuccacaguggaagucgaugucaagguccaugaggguucaugacauccaucuacaggcugcuuucauuucucucaaauacauaaauugaacaccuagaacuauggcaccauggaucagguggcucuguaggguuccccuuagacaugacugcaagccuaagcccuguagcauccaugggucagagaucaaagcugaauucuaccagaacuuggguaccugcaggagcaagggcaguuacauugguuacucacccaaugggugagugggucugagaacuugcagggcagcuagggagaugaggcuguugucccuccucucacccacuguuucgcagguacuugucaaucuuuuccuuccuggugagggcccaggagcucuguacuuacggugugguguaugcguguuacaggugccuaugcucaucauuuguguggccugaccuccugguucucugggagccugggugguggcuguggcuuguggagauaggcagcagugaguguuggcagcuguguggguaaauaaacuguaacacagggagggaaccaguugccaggcaccucugggcuuaguaagcuaaacagaacaugugacacauuccaugggcaaggacuccccggacauguacccagaucccuccugcccuacccacuucaaagaaaguaccuucuuugcaggggcugaucagaccccaagucucugagaucauggcucuugauuugggguguuucuuugcauucagguggccugggucaugggccugggaguucauuuugcugaaguuaggcugagccagcaggcuuuagaauguucacggguagccuauuguccagaugaagcauucuacaugggaagaacucgcuagguuugugucucagagugaaucaguggugguagagggguugguucgcagaggggaucccuuugucuggugcuguucugugacagcuguuucuccgggugcaggucccuuuuccuccuuaggaucaucuagagcccccugggguugaagaaaacuguuugggucugucucauuuuuugagggaaaaugaguguuguggucaggcaagauuggagaauguaggccaaagaaagucagaaauguuuuucuugugggaccuguaagauucauuaugcuagugacuccgagaaggaguuauaaaacauuucucugugcuuuuauuuuauugugucuuucauguuuucaggaaccugaaauauuuacuccuuaaauauuuauuuagcguccacuccgugcuggugauuguuuuagagccuuggucuacaucagcgagcagaucagaccaauguccuuugccuuggaggaacuuacauuuguucuaggaggagggaugagcuggucuuuauugaauaccuacucuguauuccgccaugagauuccacagcuaucuugcuugggacucauaaccugauaaaauauauucacuguuuuuuucaauuuaauucuuuuuaaucguauguguuaggguauguucccgugaaucuaggugucaauggaugucagauagaugagggcaucagauccccuagagcuggaguuacagcugguugugagccuccuaggaugggugcugggaacugaaauuagaacccugcaacagcauacacucaacugccaagacaucucucuagccuccagggcaccaucuuaacgcuuggguaaccaaggccgcaaggaguucaggauauguuuauuuucucugaauuguucucuuuuuggcuuaugucucugaauugugagaguugguggugagacaagcaacacuuuggggucugguguagggaugcugcacaccuugaugauauuaaaccgcgcaucccgguuaugagguuuaauggggaaguugcaccagaucugaaucaagcaggaaaagccauguuuccccagaacugcccaguuguuuucguguucuaggaagccagcaucuugugacugaucauguuucucaccggcuuuguuuacuaagaaccucagaacugaauuugucgcccaucuugacacuucugcaggaagagagcauauggcucucguuccuaggugcuaauccacuuccuggcuuuauuauuuuucucuaccuucaucuucuccuggcuugaucucuuugacuguccauuugaugugugugugugugugugcaguuugauuauuuuagucacuguaaaugacuuucuaaaacagagcugaauuuaucuaaaauuuaaauguaguaguaaguugauuagugccuagggaccucgguuuccauacagcugucuuggcuugggcuccaggcccuuucccuuucccagucagaagcuccaggcuccuuuguagugggagcuagucuguuuggccuuugcagucuuuuuuuguggguuccagaggaagcugcucuggcuguaguggaggucuuuagugguuugaauugaucugaaugucacauacagggcuggaaggaggcuuugugauguagcuugcuucucaguaagggcugcucagccucaggcaggaaagacauccugaugguuagugcugaguaaguucacaaucuaagguggucuuggaagagggaaccauagcacugucccacaggccaccccgugggaccuuucucuugacuauagauugauguaugagggcccagcuuauugugggcagugccacuccugggcaaguguccuggguuauauacaaaaugcaagcugagcuagcaaugaggaguaagccuccaucucugcuucaguuccugcuuccagguuccugccuugaguuccuguccugauuucugucccugcuggacuacaagcuguuagaugaagucagcccuuuacucuccaagucgcuuuuagucauggcuugucacagcaauaggaagcgaacagggacagacagaguggcuucuucuaacuauugcuugcagggaggacgucagccucugcuaagggagcggcacuccauugccgcuucagcucugucccauucacagcccucagcagugcuggacgagugguaggaaagaggguguugauaaagcagcaggccugaagaaguccagcuuccccugccagguaauagcugaggcugcauggcaguguacagccgcagccuccaggcacuugcuaagccagggaaccccaguggaaacucaguggagcaucugagagagaggcagcaugggaaguauggaagagguuaggauuugggaguuggauguuguggagcccaagugcuggccacgacuauguaugugugaguaaaauaauauuucucuuuaaaauaagaagaauccuguuuacacacacuaaagaaggugaagcaguuaguucaaggucacagagacaucagguagcugacccuauugugauguuauaugauuauauaggaaacaacuugguaccguuugggugauaauguguguguguguuaguuugguaggggcucagacaccauugggguugggaagguugugaaacccugagauuugguugggugagagcccuggggugcugaguauaucagugugcuuugucacuguaagauacacugcaguacaaaacagugcgccuccuggggguuggggggagauggaguugaggacacaggguuacuugggugguaucaccgaaaugcugugaagcgugaguuacagccugaaggcccccaaggcacucaucguagcugcugcguugguuggaauggccagaucaucuccagugugcagcaucagccuaucugcuggggacagacaccugaguuucuagcuccacuuagcaagccucaggggccccagaaaccuugucugugagaggaaugcagacugcugcucuuagcugguugcaccuaucugcagcugugugcauuacauauaaagagcaccuuagggcccgccaccugccaacaggcuguccugugaggcauggacaagggacagcucaguguauuacaguuguuuagagcucugggaugugacacuaggcugucaguaagccaaaaaagacagaaccauugucaacucugggagccuuggcuauugauuugagauugaggcucauucuguagccuaggcagguccuucugccuccgccuccugagugcugugauuacagaucacagccaccacaucuacugaagcuuuauaauuuuaaaaguacuuuauaaacacuaaagugcuuuagagacgcauuucccccccuaaacugacaggagcaaacucaauaugcauaaagauggagcgaacugccaggcuggagcagagaggagacuguagcacacaagugugaaugugauuuauuucugauuauaaaaauacuuuauaugacuuuauguggguuuugccaaauagagggaagcauaaaacugaggcaaauagaggaauacaugaaagcaccuauuauucuaagcagcuguaucaauuaauauaugggggggggaaccccuccagcuuuuuuucccugucuagcuuuuaaaaaaaauauuuaacaacaauaauagcaacaaccaaaccaaaccaaaccaaaccaaaccaaaccaaaccaaaccaaacuccaagcaaagcaaagcaaagcaaaacaaaacaaaaaccagaggcuugcuguauagcccaggcuggucucaaaauuguaaucuuucugcuucagcuuccagguucuaggauuaccugccauguuggcuccacucaguguuguuaggcaaauaguuuauaacccauuucaugauggaagcuacucuacacuuuuuuuuccuucaguuuguugagaguuuauuuuguaagaugcugacauagugcuggucacaaguucuacgucuggguugcugcuguguggagcugacagugugccuagucuacugagcccaggcgugaggugaccaugagaggcaggaagcccugcugagguucuugugagacacuggcuaaggcuggugagauggcucaguggcuguuggugcucgcugccuagguucuugugagacccuggguaaggcuggugagauggcucaguggcuguugcugccuagguagugaccgcaguucagucuucuagacccagaggagagaacugacucuggccaguuguccuccacauaugcacgguuguguagcuggguaacaacagcuaagugauguauaaccaugaugccuuugggccagagaaacagauucagugagagcagggcccuaaauaagugccagccaguggagggcugguuaccacuagcagaucugagugcuggcucccuuugcucuugaugagauuuggauuugagugucagccccuuuuauuagcggguuuguucauuuccugguaugaacugaccaguuauucacacaaguggcaugugcuccuggagaguuagauaccgaugaggguggggcaagggcuuucuuuccucugucccucuccaauggggagucaccucaccuaggaugugcuuuuuccgcuucauugugaauauaagugagaggaugagauggggugggggggagggagggcuaugggccuggggcagugaaagaagguugugggguccuauucuaccccugccuugggacacacuguugugggaaggaacacaggaguggcaaggggggccuuggcuuggugauggcuuuggagagacuguucucucucuuacuggguauaugcucauggccauucccgcugcuagagacuugcaacuuaacuggucucgaaccuccugcuaccguauaacccuacuuccuucucugaauugaguagagcgacaagccccagaaagggcagcccugccagauugguuuaguacacucuugcccauguugaaaauaaagugacccagguuaaaaugaaacaaggcugugcugggcauggugccaggguggcaauagugugcuucggugauccauuccagagggacauuuacucacccacccuguuguacuagaugcuaucagauucaaccuccucccccauuucucuuuuuugagaaggguuccaguuauguagcccugguugaccuuaaacuagcucuguagauuaggcuggccuugaacucacagagagaccuaccugucucugccuagagaaugcugggaguaaaggugugcacuaccacaucuggcuuuugcucuuuuguuucuuaacaauuugaggaaaaguugaguugcuuuuagaaaucaucaucuaaucugggcauaguuuuguaugccuuuaaucccuugguaggcaucggcugguggauuucugugaguucaagccuggucuacauaaccaguuucaggacagccaggguuccacauagagagaccuugucucaaaaagcaaaacaaaaauaaacaacaauaaaaaacaaacaaucaaggcaggaggauugaaaauuugaagcuggcuugggcaauauauugagacauuauguaaaaaaaaaaaaaaaagaaaagaaaaaggaaaagaaaaagaaaaaaguaaaaaaaaaaaaggaaaagaaaaaaauaaaguaugcggcagugggagaguaacauggcugugcagaauuagcaguguauaugugugcacagcagcaguccuggguggcagguuaugugugcagccagggacagaagaggaaccauaaauuuugcaggcaugguuuguuuugggucucuauuacauuugcuuugccuuacauauuguuuaaaagauggauuuuuuuuuuaaaggaaaaggaacuguguauuugagauaaggaguaaaauaaagugaaauaaauacuugggauuguagcuaucaaaggcacauuauuucugagaucacuguguuucugcacuguuccaauauuuauacagaaaucagagaauacaaagugcggacauguccugagauucugguugaauuuucauuuguaauaguguucguuuuccuuuguuucacugagcugaguuuagcgauauuucaggaggguucagccaguggcucuccaaagacaauaaauauugcuuuguggguagguccccacccugugccuuccuugguaccauuaugugguagccaaaagucagcacccaguaugcaaauguugggguggacagauaugagucaguuccuuaguuuucagcaugcuaugccauagauuugguggcagugauagagaguauugaccuggccaaugggaaugcuuuuugucucuuauucuuacggggaugucacucaccuguugccauggccuguuuccauaguaagucauuuagaguuccuugagcuuagggcuaugccugcuucugugacgcucacaucuggauguuuuuuuuaaaaaccugaacuuggugcuguuggcugcagagcaagggcccacguugcggcuggucaugguucauugcuggaggugggagcagccgagcagacacugguuucaaaaucaucugaaaaccacacugcagguauuucccacauugcuagcuucuagccuggugcuucuagaaacaacacugggcuauaucuuagcaccagacucuuuuucugccucucauuggugcggagguguuugagcucagcagcacggggacaagugaaucaaacaaugacaagccaggggauuuggcuaacucaccuuagaugaucugaccaggguugggugcagaaugauucccaauggagcaggcuggcuuuuuuuuuuuuuugaaugaaugaaugaaugaacacacuauuguucugugaugggaggggaugcuggccacagcacagaacuguuaauaaaugguuaggcuuugugccuagucccuuucuagaagcuuucaugggggcaucacauguagggaugaagcuaaaaaugggucugucugaaggacagcuguaucaagaauaaaucauaaaaugaagaccacuguuuaaaugaaugugcacagcacacugcaggcagccaccacuugcagaagauguguacacuggagcuuuccuguaagccuggcacuccuggucuuccauagcaguuucuaguguuaucauuugguuuugucuucauuuuuauaagacuuugguuuuucaggugaaaucuuuacauauguugcauuuaucaacagucuaggacucuaguccacaagugcuucugugagaugacuugagaacccuggccacaagagccaggcugccugaguucacauacccgaucuucuggcccuguugacaguggaugagugacuaaccuuucugugucuuagugccuacaguguaaacuggggaggauagaaugucugccaucagguuguugugagaauuaaacaugucagaggaguucggggcacaugguaagcuuucuauguguugguuacauaagaugauuaagaugcagugugggucagugagaauaucauuggucuguugaaucuggaaucuggcuuugccugcugucuaagcugcgugucuggccaggcccuuuccucucuuagguuuugauuucacaccuguaaaacuaagaaauucgacuuaagcaguacuuccuuagacuccgcaguaaagggaaagaggggaggcagcaucaggagcacaugauagaaacuucuagacucugugccugcucuaauuacaagguuuauuucauguaauggauuuuggcuggagagaaaaaaugauccugugugugagugugaguguguguguguguguguguguguguguguguauguuaugagugcggaaguagcugagugaaacgacccaaggauccuuugugcagaagguacaggucugcgggugagucggggggagacuggcagggauggguuggguaggcauuuuuugggagaggaaucugaagacucaagauuacauaguauggcuuacagcuaaauagaguaugcaagaaugugguggcugcuuuuagcaauuuguccaaaagguuaggaagugauuuucuuauuagggagaugcaaauaucucauauuacaggagauauuuggauaaggaaaccagaguuuggggggagagagcaagcggugaaucacagaaagaaaaccgaauguggaaacacggucuacaggcauucuccucauuugaucugagcagugcuugccugagccagaacuuaggaggccuugccaacagcuccucuugcuuccuccuugccuuuucuuuccuuuccauucugaugaucacuaggaauuuccccgaucugauugcccauucacucacuggcauuaucacacagcgaugaggaacugacuugccaaguggaaaaccauucacaggcuaaauguguggcuuugagucagacuguucccuggguuuuagaacuuugcucuuauuaaaguggaguuuggcugaguuggcuuagugggugaaggcucuugccaccaagccugacaacuugaguuugaucccuaggaccuacgugguggaaggggagaucugaucccucaaaguuggccucugacugccaccugcuuugguauuuguaccuuugcuguccauaacauaaauaagagcaauaaagugaaauuugauguuucuuaaaauuaaaaaaaaauuguuaugaugcuauacauuuuuugguuauaacaagaauuuugauuauuuguacucuucugggucacuucaugugccccaaagaggucccccacccccaucccucauguguguucacguauguaagugcagggacaugcauacuguggugccuuugugcagaaccucagguguuuauccuugccuucucucuugcuuaacacagcuaacugucuugagaguuugggggauaugucugcuucucugucuuuccgaaaggagugcaaggguuucagacgugugugcuguguaccccccgccccccuuuuaaaugugggaucuggacucagguuugugugucaagcucuuuacauccuacaucaccucccugcuaacccuaaagcccucuuucaaaacccagguccagcaguuccuccagcaggccucccaucccacccugcccuuguucacauuccucccacaccuucaauuacucugugucuaggguuugauguuucuuucuccagugagauugcuugcucgcugaagaugaagcacaguuauauuucuuuucuaccuuguucaacucuuucuuuaaauaaccaucagagccguggagucaauucucgaaucaucacaaauggcugaugcuaauaaggguaagcaugcggcccuuuuaccugguucugggacacugugccugcugccuggauugcuagcuggagacggcugaacauuugguuguauaguguguguggauugcaagcuuuacgcgugaacugugcugucauuuccuauauccauguggcaucgaaaccagggauaccugcaguuuucccagggcuggcagaacugucucauucaguuguuuuuugagcccugcuaggaaggucugacacacaguagguaacaggaggaguccaaguguaaagaguccuguggcacuagaagguauuagguuucuccuaggcuugcugcccaguccccuggaggugccuucugauuucccuuaguggugccaucuggcugggccugaagguauaguggaagaagugaggugcugggcugucacugcuugaucuuauagauaggguguaggguuugagugaggggcaaacaccaagaucuggaaggaucaacucuacuaagcuacauaugacaggaguuugcaaaucuuuuggggugugguagauacccuuugaaagaugccaagugacuaguggacauugguucucagucuugaagggaauggacauggguugugaacucugcuuaaagggaacauuugccaguuagcuucuuuguugucuuguaaaaguguagccgcagaagauccauguuuccaaugugaugucuguuguuucaaaaacagauggucaauucaacaaugcgucugcuggccccugaacaggggcugggggcuuguaagggcuacaagucaccuaggaaugaaccaaugaguaaacacacacacacacacacacacacacacacacacacacacacacacacacacacccucccucccucccuccuucccucacagggccaaauuagauggauguuauuccaucauccagauggucagaugccagcgucacuguggagauggacaugaugugcagagcaggcagaguuggcacugcagggaggggcaaggaugaugaggaccaaguucuuugccuacaagaaagccuucuaaguuucacaucccuccuccaggucucuaaugcugcccccucauuccuguuacaaguuugaauuucccugccucacauucuugggacuucagugcugcguaggagggacagaauauaagcaauacuuuggguucacuguguggccuuuaccuccuacucugguguuuucuuucucaauccuuccagauaccccaggcaggcuacaggcugccguagaccaguggguguuccgagucaugcccgugggcucucccuuccccgauuuuacucaugcugucccaucuuccuggaauacaccccccuccagauuauggaaauccuccccgcccaacucugccuucaaaaggcucaacacauagacacacuuucccagaacugggcugcccuccucauucuguaaaucuguaaucagucaugacucucucucagccuccaugacacuugccugugucucuagcguagcacuugcaucauacaucauggcucuucagaggccugaggucuucuagaugaugaggucauuguggaagguucacaucugacucauuaccauggccccucagggcuugguaacugucaaugaaguuuuuuuuuuuuuaguuagaugcuugauguuggguaauagagaacugacucaagaggaagcuguggaaggucugccgagaauugagggcuagggugguggcuggagcagaagugugagcagguagguagagcagaucuaacuuugcuucagacuauggcaacacugucugucuccuccuacugcauggcucacaguguggcuucgugucucguaagggauugaaagcuaagauauugguucuauacuugacccuguaaggagccgaaugaagggacagaaccaaggaaaccucuaagacucagcuaggauggcuuucuacaugcuugccuuuugcuauggcauacucaccaugaugguguccguauguccuuuaagguuguaagcaugcagggauggccuaggcuuguacacccccaaagacagugagaagaagcagugugucaucauaagaagugugguuuaggagccuagagaauuggauuucagcacuagcuccaccucuuucagccaggugacuuuuaaugagacucucagcuuaggauuuauuuccucaauuggcuuaagcgguugcuuggauccuuuggggcuaugacaauauaugacuaagggcuaggcugucauuacuguaggcuuguaaacucaugugacuccauuccguagcauacaaaguaugcacccacccagcacaggaguuagcauggggugguuuaagggcuccuuuggaucaagauuucaggacaaugguuagaugugggugaacuucagaauccccuugaaauacagucagaaggaguugagauauggugacauuccagggcaagacuguucccaugaaaggaaaggcuaccaagcaacaugugugcauuugguucugaugccgauuuggcuggccagaaugucuguauuguugauaauguggacuugaaucccacaaaauagaacaagcuugcuugcuugcuugcuugcacuaugguguagaggccagaggacaacuuacaggagcaagcuuucauaccacaugggguuggggacuccaacucaggcugucaggcugggcagcaagcaccucuauuuccugagcaucucagcaggccuguggcuuuguuccuguugaucaaggaagacuguucaguagaugcuaauggucaucuggccccuaagagcagugaaaagaauaaggcaaagaaagguaugguuuccugguugaccaguagacucaaugagagucaguauggcugugaggggacucagauagagagucaggaguaaccgcagagaaggcuagagcuaagaggagggagguaccucagacuuccauggaaaggaaaagaacaccuuguagauccagcacucuccaaagccagcgucauguugccugcuucugucuuauugacaaugaccuuggacaagccagcuuccaaccuuuguuucuucaucucugaccgaugccuuaagauucugugaaugaaguaggauuacauauugaaagcaccuggcauguuuguaaccuuuuccuuacaaaacuuuuuuggagacagggucucacuauguauccuuggcuggccuugaccguacagagaauaacauuuuuuauuuuacuuacuuaguuuguaaagacuguagcugucuguagugaauggauauggagggggcccugaagguagaagagaagggaauccaguguuaacgguuuuucauucacagcugccuggacuuguagaucagacacaaaggaaaccuuccuuuccugaguucuauguugccccaccuugauugaaacacaaaguccuaugguuuauccuuccauuuugugcuuuugauaguggugugaacccugagaugugucugucucucuuucagugaggaacagaacugacgugugguucuguuucugacuucacgucuacuuaccucacuguccucucccagugcccagccugagcccguggaccuagugagcccauuaucuaauucaugaaaaguuagaaaucuggacuuuuuuuuuuuuuuuuuuuuuuuuuuuuuugagaccaggacagcccaggcauuacagcuuaggugaguuuugaauuuguuauguugcugaggcugaccuagaacuucugauacuucugccuucaccuuucaggugcuggcauuacagacugugcuggggguggacccuaaagcuucauggaugcuaggcaagcacucuaccaguuggauuucugaguucgaggucagccuggucuacagagugaguuccagcauagucagggccauacagagaaacccugucucgaaaaaccaaaaccaaacaaaaacaaaacaaaaacccaacaacaacaccacuaugaaauaagacagaugggaaaaggaguggagagaagcugagaagccuaaccuaacuaaccuaagucugaguccuggggccugagcuggagaccgugguuagaccuaaucauuucagaagagagacccucgucucagaagauggaagggagagccaaugcccaaaagugcuccucugaccaucacacaugcucguaaugcagacaugcaugcacaucaucaaauggcuauaaaugugaggcucuccauuuuacgccauuguccauuuaacuguuagugcuaaacugccuugauuacaauagcuuauaguaaaucauaaaaucagggaaaagaguaccuaguccuuucuguuaagauccuccauuguuucuuugauccucuugcugucuauccuggccucaaaaauuaaccaauuaacggauucacucagcauauacaauuuaucucacacugacuguguacuaugcacuacagugugcuugggauacugaaaaacucagacaaauucccaucucuuugguggggaagauagauaaauauguuaacaaauaaaaagcagaauguuggaugggcuuuacaucugugaagaaaagugaaguuggauaaggggauacagcacggagaggauggaguagguucauguuauauguggugccaaggaaggcuuuucaccaucaucaccaucaccaacaucaccaccaucaucaucaggugacaaggcccaagucauggccaguugacuugugaauggaaaaguggacagcaggcuggugggaguuagaggaagacacuuggaacuucugaguucuagaugcuuauugguuaucugagugggauuuuuguauggccaguuggagcaggagccuggaguucaggaaggacauugaggcuggaauuauauuuuugguugugagccuagccuuuaacggcugagccaucucuccagaccaaggcuggaauuauaaacucaagagccauuaguuguguggaaucagcucugaugugauuaccacaucagagagguaguacuggccacgugguguccagacugccaauauuccuggguuauagccacuuaucuauaucacugaccuugcagcugaaucugggcagagugaccagugauuagauuaguaauuaaauccuuuuagcauggcuaugguuggaaauccuugguguggaaauccuuuggaaugaugggauugggagccgcagcaugggagggaaucacagaugaaucugugcuggggaccuggcuccauuguguguguguggugcuggacguugucaaccuuucaaaggacuugacaguuuugaaggagaaagaggaaggauggucuggaucagcaguagggaacagggaugggacccauccuacaucucuguagucuagacgacaguguuugacuguaguagcagcuuagcauugcgaagaugcuugcuagcuggcuucucuucaaagcacacuggggauuguggagcagagacuugugaagacuucaacuuugaacucuagggcacugaugcagaguagagaccuccucggacgcagaauaaccugugaacuuggccugaauugauugaaaccccccuuuucaugccugccccauucugggguggaugcuaaccuagggugucccucaaggaagaaaugcagucuaugcagaagaacucagcagcagaggugggagcagaaaaagaacaaaggaugacacauucugugcuccccguuaacugagcuguuuccccuuuggucucagggaagucucuaagugugugggugcugcucaggcuuccacagaauuuaggccuggacuucacaucaccuugguucugcuuuucuuaaauuuuaacuuaaacgaugaacugacagaauggcucugagagcuaauuaauguauuaguggccauugcuacaauugcacuaaaggacacgaccuucccccaguucucuugucaguuuaucuuacuuuuauuuauauaacaaguauuagagcaguaccuggcaugugauuauacacacuccugugcaaccucgcgcacacacacacacacacacacacuccauacaugcuuugugcauauaaacuuauuuaaucuccauagugacucuaggugguagaaacuacuauuuuucucaguuuacagaaaagaaaacagggaggagauuaaauauaauccacucaaucagcaagaggcagaaugaggguuugaacugggaggccugguuccggguuuacuuucuccaguuugcucuaaggccugcuagcuucuuuccaaaaaaaauaaugacaggggccuggggauggagcaguugguagaguguuuaccuggcaugcaugaaacccuuggguucaauuccuaguacugcuuaaagguaccacaggccuuggugguacacaccuguaauccuagcacuugguagguagaggcaggaggaucagaaguucaggguuacccuggcuauguagaaagauaaaaagccugaagccaauugagucuaaaaagaaugaugacaggggcuaucacaauaguuguuguucuguauauacugugcauugugcucuauaguuuagauguaugaguaauagcugaaugccugcaagguuuuagaaaccuuauuuauuacacagaggguaauaaaggcucagagucauuaaguacuuuguucugaguccaaagcuaagcagguggagaugggauucaaaccugaccugugugucuucugaccccugaagagcuguuacacuuuccuucuuugguaacuugucacuagauacuuccuuuuuagacucaucuuauggcccuuagcuccuaguagagccauagaggaaugguggccacauuucucaggccugauacaagucacccaggcagcccucaaaaccagaggcuuggcuugaaagcucuuaauccccuagagcuccuccauagccuucauucugguuugugccugagguuucccagcaucacgucggauguucuuuuucugcacaggggucaggcagauggacacaccaagugccaggguccaguuucugguuggcaucagggcaggcggguuuccucugaagugccaggguggcgugagcccucagcaaggguguggaccaucugugcacuccuauaaaggaaauuguggguuuuuuucuuuucucuuuuucucuuucuucuuccuuuuuuuuuagauaugggaaagggagccuugugucucaauugagucuuugugguguuguguuacagagagucacagaaaauguucuauguaaaugacuaugugcccugauuagagccucaauaggcaccauugugccauauugcuauuauuggcgauugcaggauacuaaaugauauucucaucaggcugaaaaacuucaguguuagcagugaaacucggguuaauuauacugcucugaauuagagcauagaauuaaguuugagagagaagccuauuucucuugccccucuguuucuucaggguugucacuggggaguuugaucagaauauuuuuuaacccaucuucuaaauuuguacuguuggcauuuugcucccugaguuaccaccccuuuuagugcugggaaacacagaaccaauuuauaggacaguuggagacucggucuauuuaauagugcauucuuuucagucaguagcggcguaaaaaauagcacggagauugaagucuuaggggaguacuuaguucucuagaggggccucuuuaauuuagcucuugucuuuccugccuuugaauuauuggcuccucugaucccgacucaccucuuugaagaagugacacacugaccuacaucguggcuggaacagauagaagagcaaucucugcucugccuggcucagcauucccggcacgaccuuccagggagcagucuagggcccaggcugguccucucgaguuucacccacugacuuccuugcuuuguuuuaauuguggaguuuugcuauuugaggcaauccuggugguaaaugugguauauauaccccauucucuccuaucauuuguuuauuaauuucaucuuacuaguguuaggucugugcgcgcucucucucucucuauauauauauguaaaauauuaucaucaugaaauccucuaugaaacgucuuuuuuuuucccccuuuuuuucgagacagggucucucuguguagccuuggcuguccuggaacucacuuuguagaccaggcuggccucaaacucagaaauccgccugccucugccucccaaguguugggauuaaaggcauacaccaccacgccccggcuugaaacuuuucuuuaauggaggcuuuguaguuaauuugugugucacuacuaacuguuucacuuuauguggauauuuaagucaaauccugugggauuccccccauuguguuacaaguugcaaccuauuggcaauuguaguguuccgaagacagccugagccuuuccuucuaccuuguuugcuuguggugucucuuguucaccacagugugccaguggagguggccuggagcgucuggagauuuucuugccucuaccacccuuguugcugaggagugcuggggucacagacacagggacuguggcaccuuugugaggguucugagaaucugaacuuagcuccucauguuuguauagcgaauucuuuacccauucacagagcccucucaccagccuacaauucaagauuuaaccccaaaucugccugccuuuaaauccagugccaucucugaugguauuaugucuccuguguccuuaccuguuggaguuccagagucuuccagcaaaaacaggucuguauugcucuucaugaguaagcauaucuuacuugcgaucuccagaaguccguuuacuuuguauuuccauggcugacuguuguuaagggcuuugcuagaugagaguguuccucaucucacaugaggacggguugucuuauguaguguacacugugugucucauauuaaaggacuaucacaugguuuggaaaauaucacauguaagagcaauauuugauuuaggaaggcugucucaagucagauguuuacaacauaaccugcacaguuuagaacucauauagggggucucagcauuacugcuggggagcaucagucaccagcuauggucagucaaaugacauuucucccauguguagagauguaaaauagaccuuccuuuugacuucccacccuuccucuuuuccagggauggaacucagggccucaaaugugcuaggcaagcucuagcucaugaacuuguguugcacaguucucaugaccacagucuuuuucuaaacucucuucucucagcaucaggagaagguacagaggagguuugggacacuuuggucagaugaacuagaaagaguuguuaagacagagagauacugcauguuggagggcugaguuuguggaagccagugggugauacagaacacaggcagauagccaccaugugguagguggcagagcagagaauggaaguccucacgcauggcucggauggccccggcccugcuguucacaaggcucacuucagaucacucuucuuugcuucuuaagcaugaccccuucacacgguuugucuucucagcccccggugccuuugcagcugcugugucugucauguggaacccuucucuuuauggcaugucacgucacuuugacuucucugcaguugaggcugcugugcugccuugcccauaggaagcuuguagugaauucuguucuucaugcccaagauugauugcuuccagugguggggguggggauggggaggcuugacaguguugacaguggagaugucaguuuuuacacaggcaacuuucccccuauuuaguucccuagggaggacauuuauuaagugacugguaauaucuugaguuuugagcacuuacaauaugcugauugcucuuugcaaauucuuuaaucuuuacaacucccagggaauuagguuuuguuauucaggcuuggugacccuuuggcccagcaaagcaaguguucaucccugacccccccccccccccaacauggccugugugaggcuaaagggcucaauugugacaguaaugguuaagggugcccuccaauuugccaaguggcaagucucagauuuguuucuucagaagacaagcuacgauuccguguuacucauuugaauuuuuccaugacagaaaucugccugucucugccucccaagugcugggauuaaaggcgugcgccaccacugccuggcgguucguguguuuucacuuguuugcagccuccacaaaugugcuuuccgcucuguuacuaccaagcaaugagggagaaagagaugcuucuaaaacauggguaugauggucucacccucccugguccccugguggccacucuuuucuccugcguuugccccaaucauggagagcucuagguuauuccaugcagguaugcacuucucuuuucugggccuuuugggcuauagauagauguuacuucuuuccagauuucacuuucucuccaccgccuuccccacacucaacccacuugggaguuuaggcaggucaggucuguccugggucugccucucugcugagcugugccgcugacugugcuguguuuggcgucugcuagccugcuuaccucuugaaccaggcaucuuggcucugucacuucugucucuacucagugccuugcacacgguaagaacucagggaaggauuagagagaaaacaaagaguguuucucuuagguuuguguaguaaguaccacuuguugaaugacuccugagugcauuauguagcuuaucauuaaccauaauggcauaucuagguacauggagauauugcuaguuacaucauggagaugaaaagcuugaggacucuauuucuuagguuaagaaauguuucacacacaugcacacacacacacacacacacacucacacacgcacucacucuggagagggguaguuugaauuuaugugaggaccaacuaggaaauguuuauugacucaguaaagguccuauuguuuugauugggucugucaggauuuauuaaaugcugucaggaguugacauccuuauuagacaagccuuuugugagagacacaggguugauggaugggggcauugugauggugggaauuauguuauaagagaucucuuuaguaucuucuuggucauaugaguuuuauuugcccacuaggacgugacagagacucugaguagucagagaaaacauccccuauguuuuucucaugaauaggacacucuguguucuggauuguggcucacuggagccagcacguggugucuuuuuuucuaacauugaaccaguaggcuuucucauuuugggguugucaaggggaagaucugugugucauggaaaacaccaccuccucucucaagcuugagaaaguuuguuuugaauuacaagaguaauuugucuuuuuaagugaaguccuggcugaauuugaacucauuauguagaccagguuggccuggaacucagaggucugccugccccugcaggauuaaagguguguguuacugugcucagauaagagugcucuuaaccaacuuaguagaaauuaauguguaaagccaguggcaugucuuggagauauaugauguauuccaugcuggggaagagggcagcaguugagagcacuggaggacuauagacauuuguaaaaauagaucuguagccccagugugugugugugugugugcccaauguaaagaagaaaaagggaggaauguaaaaagaggaguaaaagaagagagagaaguggggagagagaaagggagaggauguuguuucagagaacagagcuucccuaaauguaagacuuauacagauaucaugaacaauauccauuuugagccauggaaucaggcucaccuuugaccuguuaugaaagauuucuaagaguauauaaaugcaguugaugugcuuucuuagagaaagagcacaccccuacagcguggguuuugaccugccaggccuggaaccugguccaugcacagacaguggucuuuauagccuuugauuaucuuucuuuuaggcaggacuuucuauuuuggccccguauuuagcaaugaggucacauuuagucagaucuuguucuuuuccaagagaacaggaccacaccccucaggccggaaggacgcaggcagaggccuguggagaccagggcuucuuggcuugaggguggagggacuagagaguuaacuaauacagucaagagccucaguuuuuguccuuagggagaaaaaaaaauucauuguucaacuaaguagaacaagugccaccuguaugagauggugggcguuccaagcagaauagggaaggaaaugguugagguucuauuuuauccuuucuugaguuauucagcccucgcugcaccucaauagggaugguucaagacuggcaaggucugaugagaugggucaagggauccuuguggacaagugugggaguucccggagaggcgcagcuauaguggcaucauaccugauccugggccauucuacaggggggggggggagggggaggauaaggacacggggccugggggaggguguaagcgacucugucaauaccuuucuguuuuacgaguaguucugaaguccaugcugacuggcuggaugguggcaguaaaucuuugaugucuugaaaaaggaccacuguucuuugaagagaguugcaagccuuugccaguguuuugagacugggaaguucuaguccuaggugguuaauuugcuccaaggguuuuuguagcacuugguguguuucuucuuccuugaggacugggcuugagggaaggccuacacaguuuguagagcucaggcccucagaguuuuccccgagaugguguguuauauuuuggcuuuuccacuuguguuuauuucaagguugcucuccaacccuguccccaguggguucaaacuaguuacuugcucagcuggcuguaggguugacugccucaguggaugcccccaggaaggugggagguguguccuccagugaggacuacuguacagcugggaagauucacagcugcucuaaggucaguccucuuggguggugaaggcccaaggggcaccacaguguuugggucuaagccucagucugaguaguuaaggguggugaccuaucuucaaugcuuauuggguuguuagugauggugaacagaagauuaacuguuuaucaccuagguuugggauuucauaagaagccagucagguugguaggcugacagcuuggcugcuuuucuuucccauuccccacgugaggaaagggagaugguauaagaucaggagcugguguuucuucugcagcucccccaaaaccaggguaaggauagcaggccaagucaucaggaccucagagaccagcguaugagggaguaggagugguaacggggcgcagcaguggguaguggugggauagaggucuucacgguugaugaagcuuuguguguggucccagacagcuucuggucacaauagguuaucagaauuuuuuuuuggggggggagggagggguugaucucacaugcuugcugggacuuugccuguaucacugccucccagggucacaucugcuauccaaguacccccccccccccaccuuggcaugucuaucauguucuuucccugcacaaauggugggacuugggauuuuugucuuagggaacauuuuugugucuuggaggguuagcuuggauuuugaccuuguacguguuacaggugggcugguuuuggucugggagucugcagagucuguuuugucagccaguggaaagagaccccagagaagcuuugggagcugggcuccuggcagagugggccuugaacugcuucuucacuagagugccuucagugcccauaugaaccacacuaugaacuggacugcaccgugagcagugcaucaucuucugagauguacgucuuuguaguucuugcugcauggagccugguggcaagcuucucuuuacugucuccucaccucguccaaguaaaaaccuggggcugccugcucaaaauggcugcagcucucagggaucuuucuuaugagaauugaguuuguucccuuuuccuuggcuccccuccucuccauccucuggucugauggggacagaggagacuugcugggguaccugaguuaaguagaacccacuuuuuagacucuugcuguggccuugucuuucuuaucagcuccucucucugcaggccacagcccugcucugcugccuucugcaggggugagggaguaccugacaggaguaggaguuuacguuuguucuccuggguggaggagaucaggaugcagaugccaugcaugucaaguacaaccucuuuguuuucuuccuggucucucuggagcucugcccgggcaguacuguauggaggccuagggcuagcauuggcgcauccccuggcucguucaauccucaugcuaagagagccuuguaaugucucugucuuagauuggaggaaauggacgacagaacuccuuguuccaagggucacuuucauucauuuguucauuccaugggcaauuauggagucuacugugugcugugcucuggcuucauauuggcuuugguagauaggagugacaggcucucuggucucagaaaucugaggguuucucuaugagcucacaagcaaacuuugaaaaaaguuuaaaguuguaccuggccugguggugaagccuguaaccccagcugcucagugugcugaggaagaaauguagaagacagagcagguucaagauuggcgugagugauuuaucaagacuccgucucaaaguaggaagcaaaaaaggggcucaguggcucugagacaguuguucaguucaccaauugugcuugcuuugaaauguaaagaucugagucuggcuccucagcaccuaccuaagaagccaucuauggugugucucuaacccgguguugagacggaggagacaggcggacuccuggagcuugauggcugacuaguuuagcuuauuagugagguccagguucagugagagacccugucucagacauuaagugggggauaggcugaagagauggcuuagcgaucuuacagagagcucagagcaguucccagcauacacgggcagcuggcaaccaccugucacuccaguccuagagguucugacacccucuucuggccuccauaggcacugugugcauauggugcucauauauaccgguagucaaagcauacacaacaagaaaaaaacauuuaaaaauguagggagugacugaagaagauacccaaugcagcagaacucugggacacaacacacaaagccacgaaggacauuaacacacacacacacacacacacacacacucacacacacacacacaaagugaauaaauaaguagauagagacugugguaggugguaguccuccguaguagaguguuugccuggcaugugugaugcaccuaauucccagcaccacaaacacaacuguuugacuucguuaacaagccaagggaagcccaugacugagcuuguaaacgagacucagaagagucuugaggucugaggcagcagaggaugcugucugaugaaaugcauuugacugucuucaugcacauuucaguugggguuugggcaaaaguuuauuaaacuugcugaaagaacaaacagaaugaauaagcaaacccaacaacaucaacaacaaaaaaaccaaaccugaaacaaccccccccaaacaaagccauaaguaaaaaauaaacaaaggucaggugagauggaaccuaguagccugcuguauggccauccugucaaaagcaucaaacagcuaccaucccugaaacaacaaaacaaaacaaaaccucaccaaaacacuugaaaaaguuucuaaacuggacccgguggcgccugacaacaacccuggcauucaggguucugagacacgaggcucuugaguugaaggcuagcuugggcugcguagugagaucguaggugcugguggauagcucagagguagaguacuuggcuuuggguuugaucuuaagcacugcaccugcccuccaacacaaacacauauaaggaaacaagaugauuuaaaauauaaacuucucacauccuugacuugcauuacuuuugacuccugaucacauuuguagaaaaauggaaguguggaaauuccuccacugcacgugaacaugagggcgaccugggagggugacucagccuggugggugcucugguaguucuucggaaacagauuuuccacugugcaugcaguaugcacuucucauggggcuuuugugggguuccgagcuuucugggcuggcuguugccaguuugaugggguucuagucauuaguggcugucuugggggaugcuguggacgucacuguccauguaacccaacagauguguugaagggguuuagggucucaucugcuucuguuuccuugggcacgugccuuuaccagcugagccaucggcucugaggaacuguuuuuuuuuuuggugggaguacuauguguuguguguuugugugguguguguguguggggggauucaugugagugugcagaccagcuuugaacuccugauccuccuucuccauucaauguuucuucaacuauaaaagaaaacuacuaaaaaauaugugccuuggggcaagagacauggcucaguuaguaacagaacuugcucuccaaacaugacgaccugagcuuggauucccaggacacauaugaaaagcuggacauagcuguacguacuugaaaccccagcauugcggcagagacagguggauugcgagagcucacuggcaauccagcccagcugaaauucaagcuucccacucaguuaagagaccccgucucaagguaggagggcagugggugacagggugccugauggcgugggcuuugcaugcacacaugugaguacacauauuggcauacuuauaugacaauugguuguccccccccccccccagcccuccucucaaaccaaaucaaccagacaaaaaaaccacaacacaacaauacagaacauucaaaaaucucaguaaagucaaccguugccuggguagucggggagucuccacuuucucccaaagaacauucguugcuuagaguaaauuuucacugauguucagagucaaacauuuuauuucugagccuuccauuuuggcagggcucaagccugcacugguaauguuuggugcuggguaaugcuuuguuuuggaggcuguuuuaugcacggcaggaugccagcagcaucagaagcaccccuuuucuacccagcccaguuguaguaaccggaguguuugcaggcauagccagauaugcccaguggguuaaaaucucacucaguggagcacauugaguuauagcaacaaugucaaacuccacacugggguacucagugaauggagacaggccgaguacguuugacacggagacuggcuuaagaaaccuggaagacccuguuguuuuaacuauagggcucuguggggaauggcagcuugacacggaccuuaugugaggauggccuuuuagaaugaaaauuaaauugcagcagagccugccuuuggaggccucaucugugaagcucccuuuuuaggaauuugcagagagagagggagaaaaaaaaaacccuccuagcuuuagaguuacuggagcuuugugaauaaaagugcuuuuuguugaagagccaaccgaaagcuggaaggucuuucuuugaguccucugacacucaggaaauguacagcgagcugaaaacauuccugugcuguguggagcgagcacccuggcgagccugcuuuucugguucuauagccucugcagucagauggcuugugaaugcgugguuuuguggcaugucacagaaguaugcugguuuuuguacacagagcugauaaagccugcuguguuuuaucaacuaugguugcguucuugauuaaguuuauuuguauuguauuguuuauuggucuauguguauaugugugugggggcaggcaggucgauguuacgugucuucuuguauuacuuuccacauuauuuccuuagaccguguuucucaaugagcucagaauuuacuagucugcuggauuggcuggcuagcaagccccggguccuccugucucugccuuuuuaauguugcauuaccaugguucugugagaacucaggcuucacacacuuuauagacaaccaucuucccagcccuuacuuuuauuuuugaaccaagauuucauguagcccagaguggcuucaaacucucucuguagcugaccuaauuuggcccuucugccuccauuuaccaaguguugacauuccaggugugugccagugugccgagcuaaguuuauuucuaagagcaguuuuaggcuuacggcugcguuaaguagaagaaauuucagaaauuucauauccccucgucaaaccuacaaauucagcaaccacacuuggcaccauccauucaggauggcagaugcagcgacucuuccgcagugccguuaucucgcagacgcccugguucacuucagggcucacuugcggcagugugcguucuguggcuuuggauaggcacguaguggcauaggauggugauuccuuuuuccugaguuccuuuaggacccacguuggcccacacauccauuugucagaaugccucagugccugcuauguaccaggcuguuuuugagccuuugagcaauuauuuggaaaguuaauuaaacgucagucagaggcuuuggucauggcuugugcuaagaaaauguaauuucuuagcuucgcacacagcaguaaaagcagaggacuuacuuauuuauuuuugaugauaagcucauuuucucaguuuggugaaguagagcugucugguucggucugaaccagggauuggugugcucucuucuguagcaagcagccuuuuuuagaggcuaccucccuguucuuaucuuugguauaacugguggguguagcucuccuaugaaucuugguacaucuaacaggguaccugguggacauuucugucuucucauccguguaccacagcugccgcggggaaauggccaauuaacugaugacgucuuugauucugggguaccuguuuuuguuauucccagggccuaauaggaauagcuuccauccagggcucuugcuacuguugggcuauuaaguggggaaaguuaaguaccuggcacaagguuaucuuaggugaaacuggacugagguucagccuucagcuacccacgagccuuuucuugccucuucggugguuguuaaagaucaagaacuuagaaaaugaaggaggauguuaauggagagaugacauuuacagauaaacacuguccacauccacauucuugcuguauuucuuaggguuuuauccccagagcacauuauagacaugauuguaugguauuccugaagugaucauaugacagaaaugauucuuuugguguucuauuaugaaugguuucucuuauugguaacuuuuuuuuuuaauaccccguuguuaguaguuagcagucuagaacauauuuuuuuuugguaagaauuuuaaguuuaccagucuuauuacucugcauuucaugauuuugggcaugucauuuucauaaaagguuagguaugaagugcuaccgugagugugugcgugcgugugugugugugggcguguacgcacugaagcaugcacuguguuugagugucaaggcucugggguggugguggugguggugguggugggauccaagcuaaagccggaggacucuuacauuuggucuccaggucaagcuacuugagaucuuuuugacuuagaggaaguuauuugauuauauuauuuccacucccauacauaaggaaguauggaagauguuuuuucuccugaugacuuuguuaaccugcaaaaguggaaaaauaugcuccuuuuuuuccuagugacuuucaggguucugugaggugggacucagcugauggccuaugucuuuaugguucuauuucugcgaggcagccccugagcucugggcuuggcguaauuacucucggcuuuucacagcauccccgugagggccaugaaggaguuagcucaugggccauauaauaggacugggauuuaaggcccagcuccugugcguggggcucgggaagacucuguauguucugcucugucgucggguucccguguaguuccuaauuggugauuuucacaccccauugggcauuuaaugccaggaggccuucugagggugcuauuggccuuggguggauugaggccagugauguggcuuagaacuauuuccucagccgcagcuccugcauucccagugugugaaguucagggauggagacacccuaugggaagcaauaaccgugaagaaacugugcuuuuaggaggcagccaggaggaagugggagcaggugugccuggcagugugaucucuucccaauuucaucaucuggaaccaagcagcuaaacuuuuucagguuagagguuaggagauguuucuucucuggcaucgugagcauacauucuggaguuagacuccuuagguaugcauccuuccauccccgcaggcuuugaggaagacacucucaucugagcaucauuuccuugucuucuaaauauagucacauggccaagaccaugaugagcccugggacauugagagcacugggaaaugagcacccauaaaugaaauggaugaggaugauggagggugguacuuuagcgaacagucagguagcaggcuugcuccaugaacuucaguugcauuuugagaauugaccugucugcaaaucacaugccacauacucugucuguauugccugauuuuaaauggacucuucucucaggugaagacuaagacuuacagauguuggaagaccugcccagugucuaagugguuuaucaccaucuucugacuuugguaucauuuugaacccuaaaugucugccgccccuguggucuugcugaauacacugggucucccgauguuucccuugcugaugccuuuucaugggaaacguugagugggagcucugacucagacuggugcugauucuguauuaccauggagucuguuuuacaccagaacaaguuaauaagccugacugugaauuucaucacugguaaagucagaucaccucuggugucucccaagguguuugggaggaugaaaugaagggaauaaauguaucuccuaucuauccauacuccacuaugaugcuggugcauguagggacucaacauacaccaagguguguuuaugaaguaauauggagcauguuuuugccugggugauugccugugagcauggaaccguaauuuuucaugucuucaaagccccaaaucucugcaggucuccuagguaauccuauccuauccuauccuauccuauccuuuugcuugcuuuuuuuuuuuuuuuuuuuguccucuguucuuuucccuuccacccgugcuagucugauuguccugauaaguucuggucugggaaggcuuaagggcaggucuugugacggacaugugaaguagagcaccaugacauguucaaagcacucagaagagcccacggcacucuauuucaaggaaacuagcuugccaggcaggcugguacacaagggccugucugccguuccacaugcagauggguuugggaaaguuggggaugguggugucugagagugccauuccacagguaggccucccggucaggucuaggaaauaccacugugacucucuuaucuuuggccccggcauugaccuggggauuuuucaggacucugcuuggcucggcccugcuaaugcugggucuaaccagcaguguugaagaugugccaggguacucugaucccuuuccaggcuuugcgagucuguuuuuccagcucgguuacuugcuggcacacauaggucaauauacaagguguucuuggagacgccagggccuaauguugacuuuugcuuccugggauguguucuguggaggaaguggguuuucaggugguggugggaaugggauguggucuggagugauugguacugcacacagagaauaagguuagcuaggaggggggagcuucccccugcuuugugcucuugggcugaagugccucaaagggagcuuugugaguuggggaggugcccugaauucuguguguaauuuuaacauuugaaauagcaggcagaagcacacguguucgcuuuauugcauauacuuaauuuauuucugccaaaaauguauaagaagcaaguucaaauccugacuuugacauuuauuugcuaguugugugagcucuugccauuauauuuagccuugcucucugagcuucguguuccuggguucaaaaaaaaaaaaagcagaacaaaacucauaguuacaagguuuucuugcauaauugucuguaaaguacucaguguacaguucuugcuacaaagcaauuugguaaugguagcuuuuauccuaauuauuagagaggcaguuggguaugguagugauggugacaguccuggcagugacaguuacugagugcuuucagugugucagcuguucuuccaaguacuguguaucaguuagcacauuuaauccucaugauaacccaaggaaguagaugaugucauaaccucuuuauugauaauacaugcaggcacagagagguuaacuaacuuguccaccauugacuggcuaacgaacagaagcagaguggggccuuuagaaucagaaugucuggcuggcccaguugcauaccuucugguggggugaccaaccaugaaguauuuaaccaucaaauaaacgcaugauacagaaccuccaccacccucagacauugcugucuaguggcguuuaauaguagugcuuaggccucauuugcugauuaacuaacuagagaggugagucugagguuccaaagaguugugaaagucaagguagauguuauugucaauguuuuugacgugcuuaauguuggaguuuaaacaacacccccauaucaacgaccugagaggcacaguguaaaaaacaaagggagagaccaaacacuaucuuuauuacccauagcagcucagguggaggcuaugucuuagaugugaaccugagguucaguagugcacccaccagucguggguagagcgcuaggaucgguagugguauggauagucacaaguagauauucacagaggagauagcacacucuugcucccugggaagauggagcacguacaagguggaauuuuugugggaaguuccucauaucuggaaaccaaaagaugccaguuguguaaaggaaggccucgguccucucccuugagaacagggacacaguuuguaccauugggcccagcuuguuucuccccucaguuccuggccauucgguucuuccaguuguuccuaggaaaagcuuuggaguccuccuugaagccuguccuaugaaaccuguauccggccuaccuaccugucugugggcuugaccuacagagcaaaugcaggaucugaacguuucucauaccuccuggcuacugcuuggguccaagucauugucacuuuuggucuugauggccacuuaucuguucucucuacaugugccacaaacccucuugugucugcuucuacaaggcaacuagaaugccuuuuuuaaaaauugaaauuggauuacuuauuuuuccuugagcuaacccuccaugguccuuauuuucccucagggagaaagauccuuacaaagccugauacaaucugucacugucacccuuacuuccucccuucuuaccugcucugaauggcgccaguggcccugcuaccuccuagaccaugucagucucuugaaugccuuuggguuacucagaacuuccccuaaaguauagcuaguccuuaacuugcaacaguuuaacuuagauuuucuuuuuuuggugagaggagaggcuugagacaggguuucauguagcccaggcuggccucaaacuugcugcacacuggagggagggauguucuugaacuuccgauccuccugcuucuacacugaacaugcugggauuacacgaaugugcuaccauaucugguugcaguagaaauaagaaaguuauuaugugccugugcauuuucaugagccaugaugcacguguggaaagguauagccuguggauagucaguucuuuccuucuaccauguggguccugagcauggaucucaggucacaaggcuugguuaugagugccuuaacccacugagccaucucaccagcucccaacucagcguguuuuaugauaguguaaaagugcuacacauucaggggaaacucuggauugugauuugugaucuuucccuugcuuagugauauagaguugaagacuuuuugcauugcugcauugagcagugguccauagcucccagccagccagaugagauggccaauacuuuaucaucaguuaagcccacuguaggugaagguagguguccacagcagguucgagguaagcuuggguauuugguggugcagguguuuuaguguuauucagcuuuagauuguaaaggguuuguuugggcauagcccacguccugcagcucccucgaauuccugaucgaucuuuaacccuaaucuauuuuuacccaaagcauugauuugucucuguuauacaaguguugcuccuuucuaagcgaggagucagguugcuugaggaagcuugccugcuuuguuaccuauugucucucuagccucuguggcagcaccuggguacgcaggagggucaagaauaaaacccuauggucaauuuuggggguugugcucuguguauuugggcuggagcaagacaagcuggccuauaaggagguguccacuggcauccucuuccugaucaauggguagcuccuguuguuaagucccuuuuagggaucaggcagagaaaggacaauucauuaguguaagguuguguuuccccaagguugugugccugcugugccuggucuuacagucuguguuccuaugaacucuuaaccccaauuccuucugucccauuggcucaagcccuauucuuaaaagaauaagaauguaguuugacugggguuuucaaggagcuuugagcauaguuuuuuuuuaaaaaacaaacaaacaaacaaacaaacaaaaaacaaaacaaaacaaaaaaaaccccaaaaaccuaugagcauuuaaaaaaacccaaaaaaccaaaaggucucauguaucucagguuggccucauuauuuagcccaggaugaccuugaacuucugacucuccugucuguaccuaaauguuggaaauauaggcauucaccacuguucucaguuuauaugacgcuggggauuggacccagggcuucaugcauucgagggaaguacucuaccaaccuaguuauauccccagcaucccaucuugcuuuuugaguuauugcuacaguguaacuaagccuucaaaaaugaagauugucaggucugcaaaguagaugaaaauauuuauuuuuuauuuauguguauguaucuccgaauuuauguaccuguggaggccagaggaggcaauaaauuucuggcaaccguaguugcaugcaguugugggcucccugaugugggggcugggaacugaaccugggucucuauggaaagugguuacuguguuuaacugacaagccaucucucucgccccuaugaaguagcguuuuaaaagcgacuuauuuauuuuuauuuuauguguaugaguauuuaccugcaugaaugugucuggugccuguggagaccaguccuggaagugggcucugugguuacugagacuucaacuaaugaaucauuugaaugcagcuguauuuuuggauucauuguggagaagccccuuucaaagccugaaagcgagccgcaccagaaccuucuuucucgucuagugaaccagcauucugcagagacacagguacugccucuucacacugcacaggaucagaaacaauuuuuuuuuuaaaguuaaaauaauccaagcuuguguugccacacaaacaacaaaguaggccaggacauucgaagagccaguguuugcucuacccacccacagacuuggaaagaugcagaacgggagaagucggaagccagugagguaaugccagcuucuuuuaguggcucccuuuaauuuuaguaaguccggaagacgauuggaggcugauggguguuuuaguaggacuaacaccucaacaauuucuuuuaggaaaaaaaaauucauuaaaaaaaaaaagaggaagaguaccauaauccauuaauaaaaaaagauugcucccagccucucuuucacauuccagcuuucaggauaaugaauggugggcagguuuuugaggcuugggugcuuauggcuucuuuagggagccucaguugccugggccgcucacugcccaggcuggcaccaggggcccuugacuugccucaccucugucuccaugguggacauuacuggaaccccacugucccugcacucuaucucccucuccuaccugacucaaaccucuuuccuagguuucauucauaccaggaguggcaugugacccuguucuggcacaugaauacagguuaucagacuagcuacaggguauaagcaggagugauagacugguugacccucugccagcuuuguuucugagacacuuucugacacauuuacccacuucacgcccucccugcccaaugccaguaggaaugccugaccuggagccugggacacaggcuuguuuucugcagcuggcuguuuacaggaccaccggaauuggccuguauucccagcauccagaucugcagaaguaggaaccaggcaggaacauccuuaugggaacaaaugaggaucugcaguaaagagaacuuguuaaaaaguccaacucagauguaguuagccccacacagaguguagggacgauccugacuguccuaggcaccacccugaaacagugacuggcgcacacuagguguucagcacacauuuguugaauaaagggaacuuagcauccuuuccucacuuuccacugaacauucuguuuucccauauccaguggcaguguccuagaggguggcuuuugcuagucaccucccuccugguucugauggaaggauacuguguguuuuuagcugcuuuugauaugacagauacauuuggcuucccaacagaaagccagaggagaaaugaagauuuuuuagcaucauucaaaaugcuugccauucuucucgauuugcgaaaucacgagccgguuauuuugaguucacauagaggucagagcuugaucugcaggaaggagguuccccugguuuaugugcugggaacucucccccucuguuuauuuuacccagaggcuucuguuuuccuaugaagcgaggaucugguauuuguuggggaaacgucucagcuucugugcauguauuaaagaagagcucacuccuuggcuccaguuuugaucauuaguugauagauagauagacagacagacagacagacagacacacacacacaucuggguuuugcucugaaaaaggcuagcuccuaaguagguguuugguacucuguuuccgcuucgaaggugucuuaaaaaccaucuucucggacuggagaguugucccaaaguacucaguuuuuuacagaggacccaggucugauucccagcgcucacaucguggcuuacaacuaucuguaacuccugccucagggaucggaugcccucuuuugaccugagugcaucaggcugcauguggugcacuuauauauaugcacacaaaacacuuacacaauaagucuaaaauacuagucaacaaaccaaaccaaaccaaacuaaaccaagcaacugucuucucaagucuuuccucaaagcuacuuccagcuguaugcccuguuuucuguucagauguuggauuaggacccugaaaguccgugguucuucucuucucucucacaccgggauuguuguacaccacugugaggugcaaguguccgguuucucuuguauguaacuuccuggaggcuaaaggagacaguacaagccaagacucccagccuggucccggcccuccccuauuuuuucuuuuuuuccuuuuaguguuggauuagcuuagaaaguggcaguagugcuuggguucccaauguggacggcaaacauggaagaaacuuucccgaguccuagcaggccuuagaccucuucccuucucucccaagcuacauugugauuuaguucuccauaagccugcccaaggacucucauguucuacccugucuucuugucucugccggauaucugggguccuaccuagcaggucccuccugaugcagauuuguaucaggaggcauccgaaaguuuuuccuuuucuuuucuuuccuucuuuuuguaacgcucuaucucuuauuagacuuuaaaaccuuuuacauguguuucugaguugcugugaucuacguguagggcccauuaugaugcaugcucucugucuccccagugcuaggauugcuugcaugugcagcugugccuggcuuuucgcacgggugcugggcagugugaacuccaguccucaagcuugugcacugguugcuuucacacugaguugucuuuucagcucuccagugacacuuuugaaccauucuuuuuccaaacaggauuuaccugggcaguuuaccuucaggauccugguauucuguacuguacugaucugaucauuccuacacacacacacacacacacacacacacacacacacacgcgcgcacacacacacucaccccaauaugcuuugcaggaaaagcagaaugugagaaugccugcuuucucugaggugggccccacugcuaacaagaaagguuccugccuucucuuaaaucuugugcacaaauucacauugccuuggaggugguggggcagggccucaggcacuaagacugggaagaaaauaggugcaagggaugggucugggucugaacucaagauuuuucuguuuccuaagcuagacggagggcuggauucaugggaauucuucaguccuguuguugacagaugguauucugaguuguuguggguacuuugcagggccacaaugaaauggcuaaauacaucacaauuaaauggcuuuugugggccagggccacagugaaaaggggaauugauuuuaugcaaagacagaagacuguagaucuugguuuaacuuuggaccaucuaaaaccgguggggauauagaaaagagggaagcggagggacucucagagaccuuagauuaccggguuaggaggccuguuggagaggagacccuuccauugaugacacucuccucaucucuagagcaauuacagagccuccagccuggaagcuuccucccuggccugcaggagauacuauuuugcaaacaauggggggaaggaaagaaaagcggagcauuugccaaugguggcacuaaugacuuccuuagugcaagccugcagcuugugcuuuggaaaccccagcuuucagggucacuguagacugucagacccacucucacucucuauagccagggaagagaguuucagauuauagccaaguggcucuaaagugcgugaauuuacguggagauggaaagagaagggccuuuucuuuagaggaggguccuuuuaguucuagguuugacuggcuacacaccgacaguuguccaagccagagcacagggaaaucacaaggaaaagaaacccaaagaagcagcaggaacagacccaucccccuccuaccccaaagcauguguuguuguuguucuaagggaagagucuuuuuauucacuuuuaaaggaucaguccaaaaagcacaguucuuuuaguuucccaucuagguaagcaggaaaguaggaggaauaggagcggccugcacagugagaacauguagcuaggguguagauagggcaggaagaacugaaagcccuagaagccucucugagccaggggccucugcacguacugagugucuacgagucacaaggucugaaauucuacuggccugggacaccuuauuccagcuagugaacagucugccaauaaacugacugggcauccugaagaucaggccaauagcauucaacccagaauacccaguguaaaaagaugagacagcacaauacacacagauguucaucccuuacuccuuauuuggagagguggcacagccaacguacccaugacuguggcuacuuugguuaguucacucuuagaugaacaaaugggcuucuuuagccaucaugagccuuuuauuuccucuuaaauuucuguuuguguguguguagugcaggcuaaccacugcucaguaaccacugcucagguccugagaucaugugagacgcaggugagagguuggaugaauggcucauugguuaagauuaacgauggaguuugguuccuagcaagcauguuggauggcucgcaaccgccuauagcuccagcucugggggaucugacaacuucuuuuguacucuuuggauacuuacacacacacacacacacacacacacacacacacacacacacacacaaguuuuaaggauauuaaaaaaauaaaaagacaugaauagaccuuguucagcuggagcuuggacuucagaagugaugagauccuguuuagccugcauuccuauuagaguuucccaggcagaggaucucagagcuuugcguugaauacagcauuagugugucucuucucaagaaaugcuggcucacaaaaaagggaccuagcaugacugccgucugaaagacccaacaagcagcugaaagaaucagaugcagauauuugcacccaaccaauggucagaagcagcuggccccuguuguugaauuagggaaaaucugaaaggagcugaggagaagggcaauccuguaggaggaccagcaaucucaauuaaucuggacccccaaguucucucaaacacuggacaaccaagcagacagcauacaccagcugauaggaggcccccaacacacauacaguagaggacuucuaggucuguguucauucagagaugaugcaccuaagccuaaagagacuggaggccccagggaguuuagaggucaugugaggugggggugggguggggacauccacguggagacagguggguggggaggaggugugggauauggaacaguuggaggguaggugggaaggauaaaauauggaguguaaaaauuaauuaauaauaagaaagaaacaaacauugaaaaaaaaaggaagaaagaaacguugguugagccccuauucccccuaauccucauuuggcucuugugugaaaugaagaacaagaaagcuccacucuuuugugucuuuccugaaaauuagacaaaacauggacucugccuugccaaaucuuguguuuuucuacaucugcuguucuauuguaggcuccuuuacaguccagaucugccccauggagagagacucuuaggucagcucuggagagagagugagcuuugaacucaguucccggaucaaucuagcuggugcaaaggagguggcuguugugacuaagaugcgaaucugcuuucaccucuugacaauuguacuugguugugauaacagggugcugauaggugauucaugugucaugugggugaaaugcuuauugccugaugaugauggacacgugcaacuagaugcuaaaguacuuacuuugaccguggagcaagguguguugaugaugccaaguuuuuauucaaagaugcagaugguggaauuguaucugauguagaugauugcaucucuguauuuauaggcucucaaaugaaaaggaaguggcagaaugagggucugauaaaaucacaagugaagaaauaauuuguugaaucugucucagaauauacaaacaggauuugucuaccacacuggggagcacacaccucuuagcuagcuccucuuccccuaagucauuccuuuaggggguggaaaagugccauauauuugauugggcauaugauaaauaugauaaauauggaaacuccauauugucauagcauuggauucccauaguaugguaaggagugguaccaggggaccgcagcucacugauggagcagcggaucugagcaucaaauccgucaggcccucuucagaguccggguggaacaguuccugugcuuuccuuugcuuucaguuuucuucccuuggcaggcggacuuuaauucacuucaguaauacauuuguaugauggacuccccaccaggguuguuugauuuugcuauggcugaugauacgauuuuuaagcaagaaaauuccauugcuaaagaguuuuuguuccaugcauuauucuguguggaaaaugccuuaaaugggauuauugaaauauauguuuuauuauuuauccucuggcaguuuaucaguagcagcaaguaucauauauuauuauuguugggaaaguuagaacuuccuuacauuguuugguuaaauguggcuuggauguuuucaaaaguagagggcagucugguaauuuaauguuacaagauagggccuuuagcuggucugaaugucacauggcugcuguaauugcuguagaaguauauuguuaccuguuuucugagagguagagggauuugauuucccugggauugcauaauuauugguucacuagaaccacacuguacuguauugcaugcaggauaaaagaagggauagacagccuuucucaucugcccuguguugcagggaacuguccacagaguccagaacagacuucauuaguggcacacaauagccaugacuguugauugguugguuuguuguaaggaacaucgaacaucuggauccauggcauauuacuuaguauuuaguguuucuuucagucauccugucguccauccugugucacacauuuauauucucuggagccauacccugaguagcuguccaagugcuucugauaagguguuuugacacaggaacaagucacugacauagaaggcagaacucagagauuuguuggagacaaaauagagucaggaguuuaaauacagaauuguuucauucaaaagccacuguuuuaaaagaaauuauucccugcuuucuuauguguaguauaugugcauauauuagugugcauguguguguguguguguguugggcacauguagagggcagagacugagagugaaugucuuccucaauugauucucuacaucaccaccaucagcaucauuauuauuuugagacaggagcucaccaauuuggcuagacuggcggcagccagcugcaguggccuuugcucucagccuccucagugcuaggauuacagaguguaucauugugcuguggguauuucggaucugaaaucagguucucagggaugccuggcaaguacuuuacccacugagcaaaguguugguuaugucacugcugagacucaagaugacuugaggcaugaaguugacaaguaucuauuuuaauauauacuuggguuggagauuuguuucaugguuuuccaaaucccaucaaacugagaaccaagaucaagccaccacacucccaacucuaccagcuuagucuccaugugucuugaucagggcccuaaucccugcacccuggaggcugaggaaacagcccuagcuucauguggggaucccacuuuaggucaugcuccuccuggcguccuuggaaauggugcuucuauggcaguuaccuucuuuagcaagucuuacaggacagcccacccacucacccacccacccauccauuuuccuaaccuuguauuuuucucaugagccacauuucuugguuuucuuaucuguaagauggagaugauaguauguaacuugcagaaaguaaaggguuugcuguuuaccuuaguguggcuggguuguguucuuuggucauggagguaauggagguagcugcuauugccucuucccccuccuccucuugcagagucucacugugcagccuugguggccuggaauuuucgauguggacuaggcuguccuuaaacuuacagagaucuagcugccucugccucccaggugcuaccauuaaagcuguuuaucaccauaccugguaaccaugguuuuuaauuaugagugaagcacuguaaccugaaaauguccagacuuuuggccuuacaguagaagauccuuuuccaauucuccuuuuauaugaaaaucuccuuccaaauuagaaaaaagagauguucaauuucaacauccuguuauuuuucaguuuauuuucucuuguuuuuuccucccuugcaugaaggauaauaucauuuuuagaaauaaauuauuauauccagggacuggcggggugucugucuguguguguuuguauguguguguaaucucagcacuuggagguggggacaggauaauccuugggacuggauggccauccaguuuagcucuagauucagugagaaacucuguccuaaaaaaacaguguggaaaguaaacgaggaaaacacagauguugaucccugguauccacaugcacacuuguugauauacacaccuacacauaggaauacgcugguuucgaacucaugaucuaccuguucacaccucucuggugcugggauugcaggcaugugcuacaccucuggguagaauauuuaagcuagcuuacaggagguuuuuuaaaaauauauauuuuauguggcaaaauuauacuuaagacauuaaauuaugucuuaaaaauuuagauaaaaaauuucuaaaaauuaaaaaaaagcuuuauaaaaguguuuaaggucuuuuauaacauugaauauuuccauuguucuguguucuaaguuuuuuccucuuccagaaauaaugauuucagcuauuagcacauuggaacauuggacuaauuuguucauggguauauuuagaucccuuuacuuaguaagaauaagaaauuucacgcccaaauuucuaauuacccaugugaccuaaaguaauaugcacuuuagauuccaggccauauauaauguaaacuggcaucauuuugguggcaucaaaugucucuguacccauucuuugauccuggcaauguaggcaaacuuugugcaucuuaguguaaaacuaguuaaacuuucuuuuccuuguaagcaggaggggagcuggggaagcugagucagucacugcaccaugugacuugggugaagucauggggcgcagugccagugggacugucauggggacugacgcuuugcccggaggccauucccuccugucucaugccuguugacucucauguuugaugcucucuaacauguaguacaucuuuguuuguaagguaguuuuggggguuauuucagcacuugcuggaguaauugaagagaauaaggaauuccaucgaaugaggacgaagggucaguguugcacgcuagggaaggugcagugagggagaagugguggcugacagccccauggucaagaucaaguuucugcuccgaagagaagaccagugagaacuuuccccaugggguauuagcuucagaggaugcagcgaauagcugagaaccuacauuucuagcauuuuguuggucaguguuguauaacaagcagcgauauauuuuuuuuaagauuuauuuauuuuauguauaugaguacaguguagauguauagaugguugugagccaucauaugguuccugggaauugaauucaggaccucugcucgcucccacccaaagauuuauuauuauauccaaguacacuguagcugucuucaggcacagcagaagagggcgucagaucucauuacuauauagccauguguaccuuuuucccuucauuaauccuccagcauaugccuccucauccuacccccuaaaugggaguuucucuguguagcccuggguguugugaagcucacuuuguagaucaggcuggccucaaacucacugagauccacuugucccugcuuccugugugcugggauuaaaggugugccccucuguacccaguucauacugaagcuucuuaauguuucucaccaguuauuaagacgauuuuuuuuuuuuuugaugugggauuauguccuuuaccugcucugaagcccuuggugggugcuguuuugugucauguucaaccuugguauccuguguccugugccuucaccccuuuuucugccuucacacccuaaacacagccaaguugagcuagcuggcucagaguuuucuccgugagaccagacguuugugcuuucacauggaaagcucuccuuucccugcuguaacuacgaaaaaucuggccauccagucugcauuuugaaggcccucuuguccaugaaaccucucaagguuuguucccugccccaacccagguauacucuucucuuccugacucugcucuguggaugugauucaaauucugucacccacuuaugcaaggaaugauaugggugugugggccauguucccagagccccaugaugugagauaggagaucucuaacuugcacaagaugauagaaacaguauugauggugaccuauccagcacuugacugcagcagguucuugcucagcaucugaccuccucugucucccucauggggaggucacuuuugcuguugcauuacaguccuguuacaguuugcccuuucuuuucuuuucuuuuuuuccuuuaaagauguauuaauuuauuuaguauauguaaguacacugaugcugucuucagacacaccacaagaggacgucagaucucauuacggaugguugugagccaccaugugguugcuaggacuugaacucaggaccuuuggaagagcagucagugcucuuaagcacugagccaucucuccagccccaguuugcccuuucucuauuucuccagaaggcccuaguauagugcuuugaacauuaaaguuuugcugauagugaauaagguugaccuggacacagucauggugaaggguaaguggguuuucucuaccccccccccccccacuuucaugcuugugcuucugucuucuuccucuguuuuuuaacuuccauuuuaaccucuuuuagcauugacaaagcagcaggcucacuucaaagaacugacuucaaagcccucuuggcgcagaaauccuggccacugaagccuauaggcgcuggcccuguggccgcugcauuuaagagguuuuuugaguucuauuuuuaaaguucuucuaaaggaaggaggggaggguuacagaaacaucugccucuuuauaaaagucaaauauaacuguguaauuccaggaaaaaaauuaaaaaaauauuuuaaagaaagcaauuuuaugauuugaagaaaagaacauuuuuuuuuucuuuaaaaagaucgcuuguucuuccaugucauaguuacagcauuugggauagaauuacagccuuaguuugaaugcagcauuuucaagauaguuaagcaggauaacacagcagaauacugggcuagaguugcaggcuuuuauuauuucuuuucuuaaaagaauugcauugagagagagaauggggggaugugucugucugucugucugucugucugucugucugucuguguguuucucuguguguacaugcuauaguaaguguuuggaaguccaaggacaguuuguagggaucaggucucuucuaccauguggguccuggguauugaauucaagugguuagguuugguggugagcaucuuuaucuccuguuaguggcucuuucuacauuuuucugugaagcccucaacugagaguaguuuuugcaucuuuaaaugauugaagcaaaauccaaagaauguauauugugacauauuauaugaaauucaaacaucaauguucauaaaguuuuuuuggaacacagccauaguuacuuauuugauuugucuguggccugcaaagcuagguuauagacuauaugguucucuacagaaauaguuguugacuccugggauugacauucagggugaaugaaaguaugaaugggcagggagaggcaggcagaaccaaagaacauuucagaggaaaugcacaaugggaguuuucuuuucugaugggacuccuugucuugauguugguguuccagugggggcauugcuagagugugauguaugaguuuaaucucagaguaaaccccauucauuacccggcugguucaggcuccagugcuaaucucauggcaugaugcagggccauuugcuggugcagcacaguauaaauaggcuuauggugaaguucagaggcccacuucuggcugggugaggcugaggggaguaggcagcuguguucuauagaaaaggcuggaagaaagaaauagcuggagaggcucugaggaggcucuuuuccacccagcugcgccuucucaaggguguguuuguuaugaccuaagaaguuggagcucucuguuucuggcugguguugauucuucacugccuuuagggggauugacugagagcccugaguaaggagaaggcugggaggucagcuucccuccugucucaugccugccucuggggauccguauccagagauucugauucuuuggggaaagacacaaagaugaagcaagguauauugugaggucuaaucaggacaaggcauggccgucacugaguguggguguccugaucaagcauccccaaugccauggucagaggaaagcaucucaucagccccagacuguacuucuuacagcccguagaaaagcagagccucacuguagaagagauuuuaaagaggcagccucucgugcaggagaggaacuagaggcguaagauggacacacuuaccugcuaguuccuauguggaaucaguuucaggcuuuaauuauacacacacacacacacacacacacacacacacacacacacacagagagagagagagagagagagagagagagagagagagagagagagagagagaguguuaguuaguuucugggaaucuaauccaggauuuaccugugcauucuaccauugaaccccaaauucuuguuuucuaugcacccaucaaacauguaugcgcaccugugagaaauuaggaggucaguagguuagaugaggaccaagccaaaggcagugcuaaagucagccaagggaaggagcgauuguucuuggucucagcucugagcuccucucugugguaaagcuauccuagcucuagaggcaacuuagucucuccuauuguugaguccuggugauuucuagcucuuuacacuguguugucuucucuaggccugaaggugaugagcaagugacauuuauuuuuguaugucugcuucauuauguggaagacuugcaguaaacguuggaugaauggauguggugaauaaauauagacccagauucucaaacuguucuggggaaaaaaaaauugccuaaggagcucguuacaaauucacucuuuugacucuuugggaccccagcaucugaauguucaugcccagguguguuucugggugcgggugguccguacaccauacuuacagcaacucuggcacaggugccaagccuucuggaguagaggcaggaacagaacauuaaaaauagcucuccauucaucugcucaugcucaguggccaagcgcccccuccugcuggcgucagguccggaugugggccaguucucagcccaggggaaaugaacagugucuucuccgaggugcccagaacacucugagucaguggacugcacuggccagucaggcagaagggagcuuccacuucuuuguaaaccuuggugggaaccgaguuggcacagcgaauggggaggagaggaagugccauguggggcuugggguuggccaagguuucaggacuggaugugcuuuggguggcugcucaggcuguugcuauauaugcaguuuccucucuaaauaguaacuuucccuacuggcuuguguguugguuggugaccacaaaugcauggcugcuguucaggaggcuccugggaugagaggauggggcuggguggcugucagggcuucagaggaaagacaagauugcuggugucuccugucacugacucaugaggagaucugggagguguggcuuuucugugccccaggcuuacuuuuccaucugucaaaugggugauuuaaagggacagagugauaguguugaucuucaggaagggauguuugcaggccgguguucugacuaaguccagggcuguguguuagccagagacugcagauggacuuuuagaguuaacccuuucugggcacacauggcucgucaugguaugggugcuggugagaacagcagcacaagaagcugagaacuuggucauuuuuucccccuuacuccuuagaucuguuccagccacaguaggguuuccauaaauaauuauagagcuuagagcuccaaagagcagugauugccaagugccagccccauuucuuucuuugcucuuugaugggcuuggcaugaugcauaggguguaugaggagcaggggcuuucaacaucgcauccauuucccccuuuuccuucuugaucucuuccugcuguacuuccuccuccucuuuguagugcugaggauugaaccuaagccagacauacuuagcaagagcucugccacugagcuguagaccccagccccuuuuauuggccuuuuuuuuucuugccuuuucuucucuuuacauggagaaauacuaaaggccaagacaaggauaaaagucugugugcuagaguaaaccguguguuucuuucucuucucuucucuucucuucucuucucuucucuucucuucucuucucuucucuucucuucucuucucuucuuucuuucuuucuuucuuucuuucuuucuuucuuuuauugaacuuuacccuguagcugaggcgauccuugaacucaugauccucagccucccagugacugggaauuuuaaguuuguugaaguuuaguuuccucaucugugaaguagguaagcaguagccuucuuguggcgugucugccagccagugcguaugagccuucucugcagugcauggguugcagaggugagagggggaggauggagggggagugcuuggcccuggggguugacagccucugagugaggagaccucugaggcuuacaucucuuacagcacuggauggggaugcagccucaguagugagcacuggcagcucucuuaggggcaguucacccugcucuacccccaacuccacagcauuuugguaauaaaaauaaaaaaaaauccauauuucauggugaaaguuuugaaauagcaaggcucagguuggcugauuuggguucccaggaaaccacaccuccugugugcaaaugcccgauaacaguguuugguuuuuuuccacucagcaccugauguggaagaguacaucuacuuauuuguuugugugcaguugguuucuguuugagagcccucuuugcuuuagucacugcugaacuccuggcauccaaccuagaguggcaucuuggugggaugaacaaaugggcauuuacauucaacaggcauaagugguucuguaagggugguucugggaaacuugcagguuccugagacccuuuugggagccugcaagauccuaaguauuuucagaaugauaguaauuuguuguuuguuucuucuuaaucucuccaacaugaaucuuggugaacugguauuuuccaagcaaccaaugcuugaugacaaagucuuguaggguaaagagcuguuucagaguggagcagauacacuauaaauauaagcaguuguaaauuuaucaguuaccaaacucaaggugcaagagauacagagaaggauggauuuucauaugaaaagcucauagauacagucuuggcuuucacaacacagcuaauggucuacuuguugaauuacaguguggcaccaagaaaaaugccuauauuuaucaaaaagcccauagaggcccucauuuuaccagagccaaugauugccucauaguuuaccuacccaccaaacugcuugaaacagugaaugaagaggcagauaugagagccaggcgauuccuugaguauaaacaaacuaugaaagagaauuucgaaaaucuuauauugucauuaugcuaauuuuuuuuguauuggaaaauauaaauuuucauaagaugauuuaugcuaaugugauaaguuuauuauaaacaaaagcuuuuugaaggccuaaccauuucucuaaucaccaugggguucccaggcuaaaguguuuaagaagcagugguggggacaagucagaggauuauggaagggacugcaguggugauguagauggugcaggauucuuuucuaugugggugaugagucuuuguaucccuauguuggaagagggcugaucucucugccuuucuagccuuguagguuugggcagaugcugucuccaugugugcugagagucaguccagcagccuggguuggaacagugucuugguuuccaccaucucuaacaucuucacacuggcuuuuuggaacuuucuccaucuguuagcucuacuugccccuuugggagagaucugggaggaccaagacaaaacagguuucaggggaaggugagguggaagugaggguugcuugagauggcagcuuguuggggaccuucauguuugucucauggguuagugagguucugucuuugagaccuaaggcaguaacuggugaacguucauauguucauucuggaccaagacauuuccagccuguacccuagugcucuguuuucuucugcuguagccugggguggcagugaugaccuuacccaggcucuuuuccugggguuuaugcaacaucuuagguccuuggcuuggggcugccugccucuccugacugacugguuggucugcaagaugacacuguguguuuauuuuaguugcuccuuuauaacuuccugcugcgcuuugcagagcaguggaguuuuaaaaaggcugucugugugucuccaacugagccagggcauacacucaaaucuguuuuauuucuaaccucgagacauuucaggguuacuguguuccugguauuuuugcaaaucuuugauagaaaauggggaggaguuggguugggagaauuaaauaagccaauuccugcagugcauugauuauuuuuauuauaauuaucauuauuauucugaugaaugcuauuucucuaaaacagcccugagagaugauucggacaacucauguaagcucauucugcaagugcucuuccuguauaccaggcacaguugcacauuguauuugugagcauugcaaugugucggaguguagccacuguucuguagcugggaagagacaucgugaucaaggcaacucuuaugaaagaaagcauuuaagagacuuacaguuucagagacuuagucuauuaucaucaugguagggagcauggccguaugccuggcacuggggcacugagagcuacauccuggugccugaaggcaggcagacagacugacagacagagacacacagagacagaaagacacagagacagagacagacagacagagacagacacacaaagagaaagacagagacagaccagauagacagacagacagagacagacauugagcaugguaugggcuuuggaaacaucaaggucuacccccagugauauacuuccugcaacaaggccaaaccuacaccagcaaggccaugccuccuaauccuuuuuauucuuucaaauaaugccacucccuggugacuaagaucucaacuauaugaguguaugggggcuguuuuuacucaaacugccacaucaugauuaggaaugccugugacagaaguucccaaacacugguuugaaauggaugaaaagacuagguuugagcuuaugaaaagucccaguacucaugagguagaggcagguguguucaaggccagccagggcuaccuagugagaucuugugguggagagggacacggacagacagccacagacaaacugacuguaguucucaggaagguaaauguuacaguuuaaaggaccaucacgucagaguguguccuuccuccagcagaugaccaccuuccaguggguggcccuauaccccgaguaucugggcagcauauuggacucugggggauuauuaaaaccccuagaggacauaaaguugggaagggguggaucugaaagaaauuaugagaagugggaaaucaaaauacacuguauaaaaacugucaaagaauuaauaaagcauauuaaaauguggccuuuauuuguggggagcaaguauuuacuuuuauuauuuuauauaagacaauagguaguuuuucuuugugauuccugugucagccuuuauuauuuugguauguguaaugucugaaacaaccuuugucuaggaaguucugaacccuaauacaaaaccauaaaacgucagagcuacaugggcccuuaggaauuaggcauauuaugugcauucuuuaguuaaagaaccugagccuuacaggagguuugcagcuuguccaagauuacccuguacagucaaggugagugagggcucacauuucagauggaauggcuaugagcacuggcuugagucagccacaccugugcuuacguucuucuucgguuucuaucagaugaagcugcuguacuucaucuauuagaugacgauuugagaggcucauccugugguuuaaugagaugauuuggaucagaaggacaaaggaggcucucuuuccccuccuccucccuuucauuaauacacaguccuuuugauaagucagugaggggcuucacccagaagaguauauuuuuagcaaaguuucucuuagcugaugguuuugcuccuucacuguccagcgguuccagagaucugagauccuucucccuccuuuuccaaucucuguuccuaggcacaggucuuagaaggguaggauaaggacuggagagagagcucggugguuaagggcacuuaccacuguaauagaggacccgaguucauuucacagcaucuacauccucauaaccaucuguacaucuagcaccaggggauccaacacccucuucuggccucugugcauaccugcccacaugucugcuugucugccuguuugucugucugccuguauuucuugucuggucuggucuggucugucugucugucugucugccugccugccugccugcuugccugccuguuugcauaccugcuugccugccugguaccccaguccccaauaaaaauaaacguuaacagcaaaggccuugcccacagucagacucugcccuuucuugagauggccugcuuuucuuuccauauccaagaugauugacaaugauaauaacaguuauaccauuuucuaccucauuugggaguugaaccuuuuaauagaguuuagacuguggugcagucauuaccaggacauauugugagguuuugggacuaaggaacaucccaucucucucuugaagcuuuguguaaccaccauaagugauuuugugggauauacuguaguccugaccuacauugugcaguaccaagcucuccuggagacuccaucuguucacagaggaugcauggggacuuggcacauggccccaaaucaucuggcucgaugccauagauuuaucuugagauccaggcauggugauguguggugaugcccaucuuugucuuugugacccagugggucaugacuacuagaaugcccagcuguacucaggucucagggucccuucucuauaugcuuuugccauuaaaguguaucuaguguuucucaggauagcugcauuagguccucagcagggccuguguuuaugccggcauguuucuuuccuuugcuuggggcgaaggggagaaauagcauguggguucuuuucucaggccucuugugcuuggcuucuggggauguuagaaagcacaguuacauccuaaggaaaaucgauguuguguugucuucagccuagucagcugacaggcuugcucuagucauuugugaugaauuuaucaucuuucauuuacucagguaacacccuccucucucuuaaccuuaguguuacccuauccuuggucagcagguuguggcagggagggcugucuacuaucuuuuauuuuugagauaggaucucucuauguagcccuggcuucucucuaauucucugugcaagcccaguuggccucaaacucacagagauccacuuuccucugccuucugagugcggggaucaaagguaugcgucauuaagccuucuaugucuguuaucuugaggaacacuugaacauuuuauuuaggccauuuauuuauauccaaaaugugaguuacuuggaguuaaauaaaauuucauuuuuuaaaaaaaaauuguaaaugaagcuacaccuugggccagcaaccccuguaaccaccugcagauuccauuuguaaucuaucaacauuuuuuuuuucagguuuuauuuuuuggggaguuucucuuauagcccaggcucaccucaaucaagaucaugauacucuuauaugcuucagcgucccaaauucuggaaguacaggucucaucacugugguagaauguccucugaacguaacuguuaccgucuucaucagcugugacugcucaugugcauuccucuagauugggccugucggccggccuucccucauaggaggcagggaugcagaaggcccagcagccccuugcuugauaucccagccacacccuccugcaccuuccugccagcugcauggcauucuguucuaguuguucauggccguguggucuuaggggcuagaccagugguuuucaaccuuccuaauucugugacucuuuaauauaguuccucauggugugugaccccccccucccgcauaaaauguuguugcugcuucauaacuguaaucuugcuacuucugugaaguguaauguaaauauccaauaugcgaucccugugaaagguugagagcugcugagccagacugaguggguguaugggauguggaaaguuaccugaagucuggccaagagccgucuaugcaggcaugaggaaguccuaauccucucugggugagaccuuuggcaguaucccaguuuuaggcuuaauccaaggccaggaaacuuauggguucuccaaguuggacuuugguggaauaguacuuuggucucucauugcaaucuuaucuagaguaggaauccccucuggaaagguuuuauuuauuuauuuauuuauuuauuuauuuauuuauuuauuuuauuccuguaugagggaggacacauggacgugugcaugcuacuaguaacgugguuguuugaggacagaggacacuuguacuuggggaucgaacucaguucuucugggugggcagcagauaccuuuaccaacuggcuugcuugcuggccccaacucaguuaaaauguguuaaaaauguaguuagggucauguuauccauauaggaacuuuuaaauggagaugaugcaucuguuguaagggucaugugauauggagcguguugcuucgugcucccccacauugcuguuuacaaggccugagggggauuuuuauggcaaaugugagugugugaacucaaaggcagacugcucuguccuggggucuucagacagccagugagugcagagccucuccccagcuacacucuggauggugguagccuccuucagaaacacugugggguuaaugacggcccaccugaggcucuuuuagaacagcgcugcuuugacacaaguugaccguuaccacuuaagagaaaugagggaaaacauauuuuucaacaaagcagccaucucauucugacucuguaccccauuaagggcacaguuuuguuuccauugagcucugugguuucucauuggcuuggaagcaagccccgccccuuccagauacagcauuugucugcuucgggcccuuucuucucuuccugguguguucauuuaccccucucagcacugaagacagauguaguaagaggugguuucuucagggagaaguuaggcugcucucuucuuucccagacucuugguucacacuggccuuuccuaaagcucccgcacauagcagguucuggcuaguggcuuuucauuucggucuugucuuuucgcagagcugaguccagugguccucuucagagguggggcugugcaccaggcuagccugcauguccacugugcucuaagaccagaagugagagcacuggaacauucuuaccuuuucucagagccugugggcuucgugugaugcugugguaaggaguaccacuucccuugucuugggguuuccuccuggagcugugugucaccuggcccugcuugccuaggcauguggccagugaucuacauuuuugagucauucaggccgaguccuuauccugcucuuguggcuuccagaaauuuaggaaaccugcaggauuugucccagcaaacaucugguagugguagggcuuccccaaccugugauucugucauauugaguucuaagagaguucaagugagggcacugacuuaucugucuggagaugaggugugagugugugggguguuucuuuauucugcagugagcaaaguccuccuggcuuuggguggaggcuuuaggggagggucaugccucaaggaggaagacuguaugaggaauguuuagagcugcaggcugucauggccugggucaauucuuuccauguuuguaccuuguagucccuauuuguggaagggagccagaagcauccccugucucauagaaaggccacugugauuucucaugagauugaugaaaguuuccugccauauagaacuuucuauauuucuauuuucccagaaugucacuaucauuaagauauaaauuugcauauuuugcuaggucccuugaagaguuaacuguauaaauguaugcauacaauaaaacuauguacaucagggcaggauaggucauuagggugguguuggggaaagucuuuucaccauggcccucuucuuaaagacaggucuggaccagcccccucuaggagaaaaccagacuuguuuaugucacaacucucucuuggccccagcugugaccuuuuguuucuucaggugacugaaaaauuccccaagaucacuuacuuucucaggaucggagucagacagggagagcuaggugaaccuuuggaagggaggucuucugugcucaaagcuuauuugcugggacccaacaugggcaucauugaugagcacugcucugaagcugcuuuauucugugggcaacauuaagccuuucugaugaagccugcaaguuagagucucugagaacauacauuguauuucugggucgcccaggaugcuguucagaaaugcaggugcuucuugccgauauuaugggucagcagguuaauugucaaacauuauagcauauaugcuguugaaccaagcauguuauuuguuagacuggcaguuccaaacaacugucauauguguacuucugcagaguacauugucauauucgaagacuguuugaggugcagcagagcaguuagguguguaaacaguugugugaaagucauaggcaggaaggacaaaagaacaguggcccaaaccaggccauguagauccaggacuagaauguggauuuucaggcauucaaaggaucuuugaaggccuuuagaucugcuguggaagguagguaggcuaugaucccagccaccuagugagcuaugccacuccagcccuccaaccucaugacuuagccaucagccagccaaccaccucuacccagcuucucugauacucuuugccucuuucuaucucugugucucuccacaguccuuuaguguccagguucuugggcacguuccagcucccacuaugugcauaagcccgugagccgcuuauaaauauucccuuuacccuccuagugaagaagggauucuaugguccaagugcugaccauuugaagagaaccuuggauuugcuuggcuuugacaagcccaaucauuuaugaguuuauuaguagcagaugacgggacgugguucucaugacugauggcagcucacuuuucuguuacuacaucagcugaaaaccauuuuuuuuaaaaccuaagauuaguauguaucuggagaaagcgacugagucuaggcuguguggaugugccugggccagcugauuacgaucuguauuaaaugacagaauguguuacuuugcccuuccuuucugcaucuggcccuagcccaugguauuuauugggcacuguaugacuuuucuuauugcugugacaaaauacuucucauaggcaauggaaugaaggaaauaaaggagggguccuuggucucacgguuuaaggguuuacagucccucacaagcaugguggcagacacgccugggcacauuguauccucaggcagaaagaggagauggaagaugcuacccaagcccaaggaacgguacagcccccaucagagugggucucaguuaaguaacccaaucuagagagucccucacagccaugcccagagguuugucuccuggguuguucuggauccugucaaguuggcagucaguaacauccaucucagguacacuguaugccaggcacucucaaggcaacagaggcucaauaagguacagccuugaacucacaguguaccuggggaaaugaggucaacacuaaacaaauaccuauaggcugguuuaagugagguauugagcgcuauggagagagcacugaggaagagggaggaguguuaugucucgccccuugccgccuuccugucagugcuacacugggaaagucaucuggcuucccuagguaucuuucuguggaagugggucgugcuugguaacugcucuucuccugaugaauguuagcuucugucaaacauuagcuccggaugaugacaagaguggauugugucagugccuuacagauguaugucgcguguuauuagaaaaaguguuaauagugcaguaacaaaguagaagccccagugauuucagauccucacugugccaguguuuaucccgucugcacauuaaguauuuuuuuaagcauaucugcauaucucuaggcagcauguugguuagcucuguuuauuaaagugagucucacguaguuuucugugguauacuuucaacauccaguaucagccuuuugauaucuaguuuguguuguagcagcuuauuugucuccauuggugcgaaccauuaauugguaagagaauuuugaacuuuagcaaaguuucugaauaaugugugguuuuuuccccuucauuuuuauggccuauuggauaaaauagagauauauacauauuacucuacaagucugguauacacagaagccauugugugugcauuuguguguagggauagaggacaagggcaucagaaaccucaguaaauuuucaaacaaugcuauuaacugcaaauccaaugcuguaaugaauuuaccuuagcacugugaauucauucauucugccuaacuacacacuugaacguguuagccuacauguccccacgccccacacuacccuuucacccuguggauuugauuuguuuucauuauauuuuguguguucccugaguauguguguggugugcauguguguguguauacaugcucauugguauguggcauauauagguguguguggauagagggcagaaguugaguuucuaucuucguugaucuucugguauacugaggcacgguuucucacuugacccaagggaugccccugaggcaucuccucagccuuugacuuguuuuuagauucuaugugcagccagacagucacugugcagugauggaaugcugucuagcugugguccuguaagaugaaguugacuggaaagcaguacagguagucuuauacuggcuaugugaccuccugugaaucuuguguuuacccuguuucuuguauugagaggccacauugugaccuacaucaucuacauuugugugaaggacacuuuauggugucuuuacaacagugaaaagccuaacagccuuguucuuagaauguacucuuaccuuuuaaguaucaggugaccaggagugggauuguaaaaucuuucucuuccugccagucucuguuucucuaaguaacaggcuuuccuuuuuaaaggcugaaccuucaucucuuucucuuuccaucuccucuuuauucauuuauccacuuggguugguuccugugucguggcuguuguggacacugcugcaguaugagcggauugccauuauuaaggagguuccuucccagcuuaggacucuccucccaggaaugugcugaguguggacagacaccuuugggauauuguccacaugaucuucaggcuucuuucaguuacuugaugcugugauuaguggcauguaucuuguuuuuaaaccaauguauuccugagguaaauugccuugguugugagacugcugcuuuugggcaucacagauuucuccuuacuaacauuauucugaaagguucgcaucugugauagugacguaacugauaggucuguaacuuuccuuuuuuccuuuguacuucuuuugguauugauauuauauagcccaaaggaugaggaaaaaauucacccuuaaagucugcacguaggacguguaagauuagagugugcacaaauaaagaacuuuuccaaggagacauuuuaugguguguuucaggaacgcuauuaaaucuuuaauuugauucuuuauauauucuucauuauguaaaacuuguaauguuggcagccuuccauguguuccuuuacucugccaguuucccuuaucuuuaugacaucuccaggaauauaaccucugcuauuuaauagagaugaaucguuaaaugguugucguuuacagcggcacaucccugcgaagcagaauuuuacugaucucaugcaaccaaaugcaaugcagaaacaggugaaauguauuguuaguucauugucaguguuuuauagacagaggauagucuguaacaaaauacuacaggcuuggagcuuuucaguuagaaaaggguuugcuuugcaagccugaguuaggaugcuuaacacucaccuaagaagccagugugguggcauacacuuguaaucccagugccagggaggcugaguucaguaaauucuugggccucaaugaguagcuagguuagccuaugcuuuuuaaucucaggagagauuuugggaggcagaggggcagaggggcagaggcagaggagcagaggggcagaggggcagaggcagaggggcagaggggcagaagcagaggcagaggggcagagaggcagagaggcagagaggcagaggggcagagaggcagaggggcagaggggcagagaggcagagaggcagaggggcagaggggcagagaggcagaggggcagaggggcagaggaagaggggcagaggcagagaggcagaggcagauggaucucugugaguuugaugccagccuguucucuguaguaauuucuaugccgaccaggaaggacuacauagugaaaugcuaccucaauccaaaaccaaaaccaaagcaaagccaacugaccaaauaaaccaaaaaucccaaaaccccaagguggcugcugccugaggaauacccaaggguuauucagcacaacacaaaaucaaugugaagcucaaaaaugaagcuuucccaaucuugcuacccguucccucugaucuuguuuuuuuuuuuuuuuuuuuuuuucuuuuucuuuuucuaauauauacuccauggagaguaccuugccauucuaaaguggagcugggcagccacugguugcugauggcucccgcagcccuggcacucugugguggagcccucuuucauuacgcgucaaggugaguggggcaagccuuugacggacugugguuagagaaagcccagcauucaccagcgucaccgcugacccugucaucucugcugagccgagcagguguggcgugagcucagcuuccuuucagcccuuccuucucccuggugggccguuggcuccugaguaagauagauacaugcaguagaagagcuguuaauagcauuuacucugucuuaauccuuuuuaaucccauucauauuucagagucugaaacuuggcaggaugucagaagccacacugugagcagggaaauuuuuucuuugaacagcaggaaccuaguuuaaaaaauucucuaauauuuaguuuguuaaaacauagaagagaaggaaauuucuccuuagauaucugagugucauuaagaagucuugcuagggcuucauauuuuuuucuaacgaaugacaacaaucaguagcaggcuuagucauagugagauaucuguggcauuggcuuccugaguggaaaaauuaccagagucaguggcucucuguccgaugucacacccauggggacuuuggaccucauucuauuccugaugagacauucgcuuucguuuggacuugucagccuuuuugauuaauggcuauuucuuugcagauuuaaugcaaaaacauuguggaauucugguaaaaucuaggaagacuuagacuauguugagauuugucagaucugggacuggguaggcauuuucuuuccuacauuuacugcagugcauauguguaucggaaagccagauguggccuguaaggagcuugguugcuguguggaaguccuucgucauccagccgcuccugaaugcuagguuuuggauuggacuuugggucagcuucaggguagugaggauggaugcccaagaacauguugucuucaacuuccuggccuuccucuuccaaguucuggccuuuauugggcagagacgggucuugucuggagggcagcccugucugccauuugaaucccagcccagcccuggggugugagggcuggcagggagggguaggcaggccauuguaggagagaagacugggagcuccuggaggaacaguuaggguuggaaucaguugugucuuuuaaaaauuuuacccauuuuggacuugucuguggaagcaauuagggagaucacaggaccguuucugauucuugauucugugcagugucuauucagaaagauagaaaacagucaacuggaacaggggauuauuugagcacacacagaguccuguugucucagcagcaugcccucagacaauuugccuuuuagugaaguuuaaacccaugaaaggaaauaaaaaguguuuuauuagauggcgaagaaagauggacugggcuuaggagacuuugggaauuuuaguuuuuuuucuuuguuaaugccaacuuuggaagagggcaacucuuucuguaaugcaauuuauuuguacaaugugguaauuauugcuaauaguuaauaauuaucuucaguuggacaaaaugucagagagagagagagagagagagaauaugaauaugagggaaacauugcugcuucugaagaaagguguaccuuacgcauggggccugcuaacguuuaugaagugucugcuuugguggaucuagcuggguagucaggccagagcauuucuccaugaauaugcacagacugaaccugugggagcacugaggacucacugaaccugcgggagcacugaggacucacuggaccugcgggagcacugagggaggacucacacacuuuuacuaagcuguuaaagaggcagggcagagacaccaacccaaugggaacuugcauaacuguuccuuuuuuuuuuucuucuuuuuuuaaaauuucauuucccuuuuccuuuuuuacugugaaauacugacucauucaguuuggcacaguucagugaaguuuaugaacuagguauauguccaucaugccuuguuaaaagugugguuuuuuuuguuuguuuguuuuguuuuauguuuuguuuuuguuuguuucuugagagcacauaaagcaagccaggagaugcacacgugcuucguggauggauagauggugccagucacaggcagggagagggcuuacuaugugcugaguagcagagaucugggcuuuuugaccuugauaugaaaaauguuucaaguucuuagucagggaggaaaaaucacucuugguuucaauucccgugcaggucuauggggcuauaucuuaaaauaugcugcuuuacuggaucuuucgaagggagaacuggacaggugcucagcagcauacuggauaguuaaggggaccaugcccuuuggccuuccccaucaagacaggcccgacuagggcaggagagauggcuccacaguucagcccacuugcugcuuuugaggaggacuuggauucaauucccagcagacacaugguggcucauaacuuugccuguaacuccaguucuagggaucugaugccuagaacuuucggugcuagucauacacacggcgcacuuaaauacauguaggcaaacacacagacacauacaauaaaaauagaucaucuuaaaaacgaaagcaaaacccaggcuagccugauugaaggacagcuggaacccacugggcaaaccuagccuauguuccagagaagcaggcccucccuuuguuuuaaaaccauuaaauuuucuucaguuuauuuugaguuuuccugucacagcagccuccaguucagcccguucguuggguucguuggguuuguuggguucguuggguucguuggguuggguucguuggguugaagcugucucagguccugggcucuuucccugauacaccacucuuucucaccugugcugcugcaagccagcugcucucccacuuugcaggguaggugaguguccgagagaccugaucaaguacaagguucaggcugggugaagguggguaggucugucccuuuguuuuuguuuuuuuucuuuaaaaccaugugccacagaugguuuuguuacuuauuagagucugacugggcuggaccgacuguccagugagaccaggucuuccugucugucugcuccuuggcgcuggaagagcugaggcuguagaggcugccgcagagaccagcuuuucauggguucugaggauccgaacucaggccuucucauacuuucaugguguuaagaaaaagagauaguuucagugucucacacaaaggaacaugcaagcaagcaagcaaaaaaaaaaaaaaaaagguagcuuggcacugcaguuucucuuugugaaaagguuacaccaccacccaaaccacaacccaaaccagucuagagcucauacuggggaggucuguauucuaaugcagugggacaacugugucuuuuccccauuggcuggggccuaaccucaaugucuuccuugauuggcuagcuuuaaaagaauucugagaagaaaugaagaagguaauuguugguuggccaucucgugugugugugugugugugugugugugugugugugugugagagagagagagagagagagagacagacagacagacagacagacagagucagagacacagagacagacagacugacugacugagggguauuuuguguaagccaaaauuuuauuacuagguagguuaguuuaaaagauuuacauaaaaguuuuacaagguuggggaagauuuauagaguauugacccuugguagcugccuuugauaggcaggaaaaaauaaacauuucacacaauggcaaguacuauugggucacccucuccccagccuccccuucccacuuccuguucuuuauugccaccuccauccaguauguauguauguauguauguauguaugcauguaucccucuauccaauaucaauccaacuauguauguauguaucuauucaacuaucuaucuguguaucuaccaucuauucauauacuuaucaccuaucuaucuuaucuaucaacuaucuaucacuuaccuaucucauucuuuuuuuggcucaguugcucucuucgguucuuuacugcugcccagauccauccaauuuuagugccugggcccuuuuuccauuuucaucuuuuaaacccaccuuccuccuuauuaccuguucacccaccugacagccagugcauguucugugguaggugugaacuucaggugaaucuucaccaagaaguguccagccagacgggcagugagaaucccuagugguaagaguuaagcaccaggugcuggcauaucugggaaggaaacccuagcucuaguggggagagggguucuguaagggucaacgaaggcugucucauagaucagccagccaggauugagaaagaggggcaggaagcucucacuuucuagguaguagggcuggcuggagccagaguugggacuggcagcuggacuauugaggaauuugagguaugugaauagcggaagggggcaugugacaugugaacucuucaguuuaugucuucuuugcuuuaaagagauguugguuacaucuguuguuaggggaaaaaguauuucugcugagagguucagaggacaaaguagacagugguagacuguaaaacacuggauuuugccuaaggcaagggaagagaaaccacagugauuaugcauuccuuugucucucucacugacccuuaagcaguuugggacuagggaaggaaacuauguccuuucugugaagaggggcugguggaaaugugcuuuggacucagguuuguuaggccugcgugagccucucuuuccucuacccucaacagaggcaggcugagauagaugaucucuaaggcuugauuccaguaugacuggucauacaugucuccguugguugccuuugaagcccugaaguugaacaugccugguuuaucuuuacaccaaaaaaggccagaccagcuuugccccaggcccuaaggagcuggcgcuguaucucagcagaggaagugagugagguucugggagaggugaacuguguaauaguuuguucacaagcuuggagcauauauacugccuuaugcuaagggcuaacagagaggcucaggcuguguguuguucagaaucguggggcugcugugagccagcagcuccgugcacaccugaccgcccccauccugauuaucaggauuacucucugcugacacuaggcucacaguucaagucauuuuaucucccagauacccagcauucauuaagaaaggugcuguuucuaauaucucaucagacaauuggaaacccagaccagccuugagagauccagaguacuuuuuaaaauugagcugaauuagacaguuauccuuucucgaacaugccuugugcccgauagcauuucauugacuucucuugaguguuugaggaggcuaaguagggacauaaacccuguuugcaggugagaagcuugagacuggguuccguguagguaacugucagcucgaaccuacccacagggaugcagccagacucuggcugcaagucuguuuuugugguucuauccagggcaaacgugugauuuagggcaggacuaagccgacuauagccacugcuuguuuuugcaugacccaugggcuaagaauagcuuuuacauuuuuaaggaguugagagaaaaagcaaggaaaacuaauuucuuucuuucuuucuuucuuucuuuuuuuuuuuuuaaagauuuauuuauuuauuauauguaaguacacuguagcuaucuucagacacuccagaagagggagucagaucucguuacggaugguugugagccaccaugugguuucugggauuugaacuccggaccuuuggaagagcagucgggugcucuuacccacugagccaucucaccagcccaaaaacuaauuucauaauguaaaaauuguaugaaacucauguacuuauggaugaauaaagcuuuauuaaaacacagccauggguguuaguguccugguggcagacuucgcucucuacugacagacuuguguauccugcagaaccuaagauguaaugccuggccuuuuguagaaguugaccgagcgucggaucagggcauucauuaggcuuaaugggauguuaaaaguaaccagucaucuccuguguacugcaccagcuccccagucagcugccacuugaagaucccgggucuccuucuguuguuugauguccuaaguguccugugugccaugcauggcagugcccacaugaugugacuugcugagcugccaucuucucaagagcuaagucucucggagcagaugccugguuuucugcugagaccuuguauuggaugaugguuguccucaggcaguucacugcuaacaucucacuggagggcagguggaauucccuguguugucuaaaugugugggugaugcaggcuuucacugaaguggaaggaaguggaagguuguagagacaggaaaaccaagaaguaaccuucaccaucacuugcauuucugagacuauuuugacacaugguuaagaagggacucaagauccuaggcucuuagucaaaccugaugccauuguugcuaauugcuaacuugagaguguguccucuuaauuccugaacagugccuggguggcaccgucuuacauggcguuugcugucacucauagaggccugcuauguugcugugaggagcuuagcauuugucagaccugcugaauaacuguaggggguuggucuggugcugcuuauauucagaugcuaaauucuguaccucaagaucuguuugcuccaagaugauccuuauggauuccagccuugguuguguaaaccuugcuccccaauuuaaaacuauucauuaaauaaaacuggaggcagccaguuacaggggaaauagggagagauggaguuugaguuaucgugcuggagaucgcagguagugggcacgaggacaaggagagagggagaaggagaugaagaaggugaaggaggagaagacggagcgagcaagaggucuuugugacucauaucggaccagcagcacaugucagagucagaugucuccccaggacaccagacugcuggaggagaaacaacccagagaauuucaaagagcaaguguuuguuuggggaggacaauugggguaguagccagaguagugugucagagauuuagauuagggguaaucccccaguaauugugcagagccugauaaauaaauaacuaucauugcuugggcugcauuuauuagaagcuagaugacgauacauuuaauuaaaauauucuacaaguaaugagucuuuucuuuuuuuuucuucuuccccugacuuaguagcucaaaccaaacugcuuugaaggcccagcacacccaagccacagauuagaugagaaaacucaauaagcugugucguuggcugugggcuucagcccauugauuuccuacccuuccucaguucugaaguuuagggggauccacggggagggugugguuugugggaaugucugggauccugcgcacacgugcagugacguaacagaaguucuuuaaaagcaaaugagcuuguugaccccggcacccaugccaccauggcuucugggaucagaucagcccuggagguuguuggguagagagaggacugggagaggcuuagaggacagucagaggaagaguugguuggaacuggguccuggauuuucuucgcucaucugggagaaagggggagggauguuagagagggacucagacugcagcagggcagucucugagcacugggcccuagugaauggugugucuugucuucuuuuauccagaccuugagcagaugggcagugcacgagggagcugguugggcucagggacuggauucaguauuccaguuugagggucuggagucaagucaucaacugaagaccaacaaaaugucggucaggauuuuguuccuagugguggggguguuugucccacagguggauaacagauuaggaaauaaggaggugguuagugguagagagaauggugccauuuauauucucaguguggacguuguugacaagugacauuggccagaaggcucuuccucagagaagaacuuagaaagucaacaguucauuggugaucauaacuuuugauuuggguagcaaagaacaggucuaucaaaggccacacacucagaugucuucaggcaguuggaaacauaaauaaaugaucuaaaccuugaaaagucguacugucucucaaccugucauacgcucauauuugauagaggaaaccagcugugugggcaccuuguugcuuggcaacugugcugcuugcccucagcauuggggugauaguacugccagugcuguuugugcuuagcacuuaccccacagagagggucaccuagauccaauuaauggcuugaauguggccagauaagaacuuuuuuuuuuuaaaagaagacguugaacaucaaaauaauaguaauaaaaaagccaauucucccuauucuuaagauuuuaagaaacuuauaauuuuaagaaacacuguaggaaguugggcaugcuagaacaugcuggaacaugcuuauaacuccagcacuucagagcuaagggaggggugugacaaguucggggucauccuggacuacaaacugugcgugacuugucuuaaaaaacaaacgaacaaagcacuaucagucaaaugaaagcuacugcuagaaucaacaaugaagccucacuucagcacccccagguuuaccugugacgaggagaaagggcugggcagaggcaacgcccaagcccuuccagaucucuggggaucugugcucagucccaugcugugugaucugguggaggugcuaaagugugugagauccacuaucagccuucauaaaguccacagcuaggcaaaccaccacuuuccaucuuguauucucuguaguccauuggaagauuccauucaugguugaguuuaaaaggcuccuuagcccgcccuuucugaaaucuagaguguuugggauuguaugaaaacauuugcuuaaguaucugccgcacuaaaucugaagauuaaagcucuccugucucagaagacgagcagaacacuccccucggcugucuuggaacuugccauccuccugcauccgccuccugggcacuggcaugugaaccaugaauacaguguagagcaucaggagagucaccugguugcacucagauuucuugaaaaauuuaaaggucacuugaaguuucguugcugucgucuggaaugcacagacacauccaugauuauacugaucugaaauguggaauuguguucuuauacguuauucauaaggcucuuuuggggguguguggggguuggcaguaacagcucugguaaaaauacugacagaagcuucuggcccaagauuuucuaaagccuccuucaguucugcaucucagaguucgcaaggccucuuucagguacggccucugaccacguguuccucugcaccuuguggaagagcucauugugccuccaccugccucuagugcagcauagaggcagcugggcuuuuuuuugguggugguacccauuccguccacugaagcuucacccucagucuuugggcuguagagcuaugggugaugcugacucuuaagauggcaggaucaaauucugaguccuuuauuugcaugcgagguagaguguaugcaugccuguucucaucuugccacgcugucugcuuuccugcucaggcccugccuuugggcuccauggcggaauuuaaugccagguacugagaccaguucaccaggugaugccugacucuggggccuuucagcugugguacuugcugugugcguuuggugggacgccccaccugugugcuguucuuagaaggcaaggauuugccuuucugcggacuguauuucggggagcgguuggauaauacucacagagagauaagcuagagcaaugaagaaagguggccuuucaccaucggacucaguucgcaucagacccuauaaaauacucuuugauuuuaaacauugcuugaagccguucacauucugguuaauuacgucagugaguaaauauagcuguugucaucuggugugugggcuuggcuuuagaaggauaaagagucuauuguuaccccuuguaccucaguccguuucacucacccucgagcacccagcauguagaauagaaaaccuguggccuccucacuugcuagaaucacaggcugcuccgugauuucaguuucuuuugcaaaagcugcuucauucauucagucccaaugagcugacacaaggugucccucaggccauuugucaccuuggcuuuccugguaccuguugagaccugcuugcggaugaggcugcagagugcuuccuggaguuaaggccgaggguuccagggucaggcggaaggggugcaaaucuuuacuguaagcugaaccgugucaggacagggacaugaucucccagcugugcugucaaccucuguaagauagggaugaccauggcgucugcucccuguggucucaggaggcuuaagugagaugaugaauguaacacccaaugcagugacaggcuaggaggagagucgaugaacguuacagcaaguguagaccucccagggggucuguguagggcugucugucggccacaguuuuacauguucugucaauccccuguccuuuuccuuagucauauuuccuagagucuuuaggcaaggucuaaagacugcucaucuaggccccucuacccugaccauuugcucugccauuuucuuugaaguguuuccaggcuuaagguuaagguuaggguuaaaagguuaagguuaagguggucuggaucaccuuaagugcccccucugccuucgguagccugcaccaaucaaggauugaggcggggguugaguggcauggacugaaagcuucgaggucaucgggugaagugaaaggguagcuuugggguuuggugaggaagaaggguguuaggacaggaugagagaacacauaugggauauagauuguagaugaccuuucguuauuuuguaauugaugaaaugaauggcuuugggagacucugaagccccagaacacaaaggucaaggaaaguggaaccugcccuuuauuguucuuguucucauuucuucuuuuauuuuuaaagauacagaucucacuuuguagcucaggcuguccuggaacucauucaguagaucaggcuggcuuugaacucauagagaucuaccucccucggccuuccaagugcugggauugaaggcaugugcuuaauccugaacuucuugacccugcuuggcucucacccagcagaucaacuggcucucugaagauaagccuggguuaucuucucugugccccaacugaccccugcccacccaugugcaccccaagaggaggcuuaccucuguguucugugccaggggugcccuugauuucugccuuccuguuuggacaaugggagaugggagagacagucacuucagcuugucuccccuuucucguugugggccuccaggauucuugcacauugcuguugcuuucucauccacagccccacccacuuccccacuuauccuggcugagugugacaccuguaucugucaggcuccugacugacaccgcacacucuuaagaagagucaucugacagaucuguuuauuuucccauugaggaagguccuaacacacagggggagagagagagagagagagagagauagauaugucaucccggugaauggaugaggagacaggaucuggccucauucaccuucaguguucauggaaggcccugcuuuaggcguuguucugcuuuguauuccaaauuccaaauacaggguucuguauagaaucuuagccauaaucugacagaacagaaacgaacguccgcagauaacuaccuguucuggcucuuguuaguucuauguguauggauaaugucuugggagguuuugaaaugccacaagccuugcuggcccagggugcagcugccucugcuguucagaccucagauuauaaggacagaacacagcacggaaguggggggaucagaaccaugggagauccaggacgaaggguguguguauaggggugcauuuagggguuccaaagcuuauagccugagggagucugggauaauggggaacucacaccagagaggggaagaggaggacuuaaagggucucuuuuggugugugguguugucauguggacuggggagacuucgaaagguuuagguccguguucccagugaggucucugcggccugguuguagagcaggaagaacucaggguuccuucucuuauucuccuuccucauuucuuuuccuccucagaagauuccuuucccuccuugagcaggauggggaggggcugggcaaagaccagauuuaauugucagaggaaccauuuggaagugugucucagcggcauuuagugcauccacccugcgccucugucagcucuucucgcuuagaaucccaugaagaaacccaguuuacguagacuucauuuguaaccaggccuugucucuccccagccccuguggcccccggccuauguuucacuucuguggagucucuguucuggauauuuuauauacaugaacagucacguguccggccucuuucccggagugccaucuuuuugagauucuuucacguaucaggagucagugccccguuccucuuuuugaucuagugauuuuccucuuguagagcuauuggguauguauagcuauuggguacauuuuucccuuuuggcuaugugaaucgcacuucugcaacgccuucaacagcucccuggugcaaaggccgagaugucugguuccccucgagcccuaagccccaggucaaacucccuaguccucuguaucacagcucugcuagguuacaagggaaaggcuggggguggggggacucagagaagggucagaccucaagcuugucucugcauaccucauuaugcccagagggaaguggggaguggaaagcgcugguccugucucgggucugcagcaucucucucugggcuuucuccucuggacacagcuagucucugaucuugggcuguguaacccgagcagcacagaccuuaucuguggauggagaugcucauuuuuguugccaccacagccaucugggcaugggcacgcugaggacuccuggacucccggaaggaauccugaggaaugcuuacuguuuucccugugccacggagacugauuccagggggagggaagucucagcuccuccuccgggagcagcaggagcugugcuccucaccauguccagcugucagcagggaaguuguccccagacucccuuuccugccgguaaccuugggguacucuucuugggccugggaaccugucuccugucaucccgcaucaggcuuaccgcauccuucuguuuggaaggguggacuuucuguugaugucauuuuuaaaaguaugugugaagugcccuucuagccagguaucuugcaggugcuguuuacagccaucuuuuuaucugguuugugaaagacgcugagguccuggcugugccuucuguucaccugggcugaucccaggagaggaguccuuggccuuucaggauugcugcugugcagauucagguuaagagaaagucaccccucguuguccugugaacuagcauaaguuguuaucguuaacaggugcaaaagcagauagcugcguggucagcaggguugcucucuccuggcaaggagucuggagguauugguugacuuagcucaagguucaaguucugcucauccucuuccuggugcucuucaacauguugugaagcugcaggcaucacgggcagaccccaugaaauccaccauagcagcaugguaucccccccccccccccccccccccccccguguaccucauuguacuaucuuuugcagacucuugauaccauuuugcuaggccaagucuuaguucccguggcuuccaaggaaagggcugacauuauuuggaagucagguccaaggacucaaggacgagagcgcagagguggagagggaaguuggcaaggaggugauagauaaccaugugcuuugaaguggccauugcuucaccaugagcuccaaagagacccagccugccuugucuauccagucugccucagagcacggggaacccuuaccauguuuuuaaaaaucaucaucaucauuaaugggaaaggaacaugcugauauauuuuuuauaauuaacuuuuaagucuucacuaaucacuaguaauuuucuccacuuagaagguggcagagcugguaguuauacacagggacucugcagucugaguaccacgguucaaauccaggccugccauucaccucuuuauuaaugagucguuugaaagacugaguuugugucugggagcauuuuaaacagagccugguagucagugcucugaaugaauugacgucaacaugcugagcacagggacuccgagcugugauuccuuuuuaacuccaacagaugauacucugcuuuugcaggcaguacuguuuaccugacucugagggcguggcugcugcuguccucuuucuugggaugacgaaagaggcugcuagcugcggcauuggcgcuuuagacgcgugcuuggccuuugcgggugcguccuacugggauauuuaugauagugcucucugacuggaguuacuuuuagacuugucucuuuuccucauuuuuggcaaacagcuagagggcaggaugguuucaggugguccuuagaugaauggauuccaggaggggcaacgcuguauugauaccaaggcggguacuaugggcaggugccagaagccaccauccuaaagagugaugguuuuguaguugaacugggcaaaauacacuugcuuccuugugcuggcauggccucuuguguucucccccuccccuuggguccauccuagacuguguuguugacauauugccuggcucagaugagcuaagaaagguuaagcuugagagaggagaugguagaaaguuuugggggaccuuggggauuccguuccaucucagcuaauugguucuuuucugugacacuuauugagcaccuacuguaugcacaguguuucugcuccuguggaggaaacaguggugaaggagugagggugguuuaguuuuccuggcugguuauagaagagacuucugaagggguggccuuuuugggcaggcccuagaaaauaaguuuuggggcacugauuuugcaagagggaauauauguuuaaauguccuaaggggaaaucagcuucaagaauacgagugucaccaagacuagaggagccugcuggguacuuaaggguggauuuuuaaucugagggcaguagggaauuguggggcauuuucccuucuuuugguuauuuucuuuuucucagucaccauacuuuggaaauuccaauuaccaaaagcauguauuuaagagacaaugggauuugcgaccuugaauuacauuaggcuuuggggaaauaauguaugguauggaugauagugagaaccgccgaagggacucccuggcucccaaacgaaagacuaacauugccaacuaaaucuguaaggccucacauucugcuccuucccaaagcuauauaccagauaauuagaaacugauugcccucuacugauagacuaaagaagguuacuauuguauagugagagauuacaaaccuauugacugcacuucagccauggcuuuaacaguaggcuggcccuggacauggcuaaagggaagagcuuguggccugcauuuccuuuuguauucucuguaaggcaguucaccucccaggggcaggagggagcacuggcuugcggagcugugaaaaacacuggguuuauguagucagcagccccauggccucagugaacccaguuaaucuuuuguauaguugacuugcucuuucccuguauuuacagccccaggacgcccucuccauggccgucugccucccgugcacucgauacccacccccaacugcucugcuucugauuugcauuuucacgguugaauggaucugcugacuucccuuuucuuuuccguuacagguccugugcgcaggugcgggugaguaccuugcuccuuuccauucuuguguuguuugcuacugcccccuaguggacacaguugcauuaauggcuaacauggggggaaaaaaucacaggaaaaaaagauaacaagaauccacuuaugggguuggagagauggcucagugguuaagagcacuagccucucuuccaggggaccugaguucgauucccagcgguggcucacaacugucuguaacucaaguuccagagggucuggcauccuugcacagacaugcaggcagaacaucaaugcauauagaaacauaacaacccccccaaaauacaaugaagauagaaacuguaagugaaaggagcauucaguuaguuguuuaaccacaacuauaaaaauucuuuguuuucucaacugaaugacggugauauagcacuguauucccaguuccucgggagucuacgucagcagauucuuuugagcuagggaguuugggggcuuccugggggacauaguuaaaccaccagcucauaaaaucauuggauuucuugugauuuucuuucaccagcccacacccaugugugagauaaauauacugaaacuguaauacugaauauuucuauuuuaugugauauguauuauuuugcaagcacuuucuuauguugcuguuuuacuacacuuacaauaugguguugugggauuauagaaauucuuggaaagcagagauagccuccuauauuuuuugauuuugcgugucagccugggagugagucuauagcucaugguugcguacuugcccgauacauaugaaguucuggcauccuuugaaagguaaguuauacaaaguuccuuuccucuuggcccuccagugcuguguggaggccugagucccaguuggagcuggguacuuuuccuggucuguaggaagacaagauaaauacagaugccugccuaauauuauggugacgaugguuuauauagcuaaauacauccagcugaaagcacuguucugggaucaagaccuuacuguuucuguaggaggauaauaguaguuacuacuuuaaaaaaagguauauuuuugggaaaaaaaugguagcauuuuuugccccuaaaauucaggacuuuuuuuuucuuuuccagcaaagccaaaccgaaccaaaccaaccaaccaaaaaacaacccaaagccuaggacucauugagauaaaaugauuggcuuggucuccccaaggagggcagagcuugcugaaccccucuaauaaggcaaaucuuuguuaauagcaguaauuaugcagaacuuucacagacaguggggugcccacacaggcaggcacugucucucccgugagccagccugguagauaaguuggagaauagcuggagcucugcagaauuucacugcucuagugcagucuagcucagaggguggaguguuauugaaugcucauggcagggaacaaaacuccagagcuacccuagaaggcuuucccugggaacuaaggacuccagagccacgggaggggcucugcguuagucugcugggugacccucaggaucacgccacauucugucuccccacacuucaggagguucuuucucucagcccugagagcugugucaucauggugcugccuccagccccugccuacauacuaaucugcucuucuuauaugaauggcagcuuuauggggagagaccccccacucucaugaccucauuuggacuuaaccccuugacacccuaucuugcaagugugcacacauuuggaaguacugguauauggaguacuuuaauguauggguuugggggaugacaucauuuagucuauaacuuacagggagugggauuuaggugcagacuccagaaucgaugucuggauuaaagcuauagaguuacccccgugacaggcaguagggugggaaauugagaagguguuuacuuuacauucagaaggguguguccugaauugugaaccccagauucagcuacccacagugcugacugaguuccaguuccauucuguaccaaagagaccuaugagacacauccacguauuuuccccaggagcuggaaaugcacauucuucuccacuggagauggagcacugucuggaauagaccuauuuuaggauacacaggacaucucacgaguuuaagaauucagggagccacugcaagcaucucucacagucaaguaaaaccuagaaaucagcuauugcgaacucuggaaacuacacacauuuggaaacuagcaacaugcucuuauauaacaggcucacagaucaauaaugcaagaaaaaaagaaaaggaaauuaaaacauuugagaaaaaacauauuucaaaacauacagaacguggcaaaaagcuguuccaagagggagguuuauguuaauaaacgacuuuguuaguuccuccuugaaaggucggggacccgauucaacagcaccccgaagacucuucggugggucaagugagacucaccccagggauuuaaacaugggucagcacacgcacccgaguguaugugguaugcugcguugauagaaagauggacagaauccuugguacugugacugucgaaaucuagcagucuguuuccccaugcugcucagauccccucuaugaauaaaauccaagcagcucuucuugcuauugggaugccauggccguccuccugcaggcgaggcacgugcacacuuagcaccuguaccacagcugggacauugcccuccagggugcugcucgucugacugccuccucggauguagcucuuaccacuuucuccucaccaccguuguggcugauuguaaaugguggcacccagugcugugugagccuguugacuuauagaagaagcucacgccugaggaggcucacagaucauaaaguguccaauuucuccuugcuuuccccuuccuccccuuccuaugaacuggaugaacucgcaccuccuucaagccaggugaggcacaccauccaguucgugcugagaagacugucagcagugguuucucucgcacuucgagaauaagggcucaccuuguauuuuacuguuccuggggcauugcucuucaaucuugaacuuaaccaaguuccacucucuugcugguauuacagugaauaaccacauggcuuccauugguuuggagucuugcauucuuggccuuguacagggauauucagagaguugaaacaauuuugaaugaaauuuuaugaccagggcgauuaggauugaggugucuuuaugaacugaucuugucuauauugucaugauggcuuaaugauaacccuuugaaguugguaugguacauuagaguuaagauuggguuuuaaggggcucaaaccaagucacucacccaguggguagaauagauuuucaugggcuguuuugcaagacucauuuugccuuguaucagcucuuguaucagcugaugucaagguuuaaacucacagccacccucuuuuuguuuugucuucaguuucaagaacgcacauucaugcacaggugcauauauguuuggauguauuuuguuucagggaagucaaagagacaaaugaagagaaauaaaauuaagucccaacaagguagacuuuauucuuacauuauuaccuuguuacauauaauuaaucucucucucucucuccauucucuucauugaaauagcaccgaauccuauauuugacauugaagcugucgucagcccaacuaguguguuauuaacauggaagcacaaugacucaggcgcuucagaauguagaauagagaauaagauggagagcaaucugacguuuccuguuaaaaaccagacaucauguaacauuacaggcuuaagcccaggcacuucguauacauucuccaucaucucuguaacaaccaaugagaccuugaacaaaacuaucacaacagguaagggacaggguaaacagggcugguggcuacagcagcagaggcaugggguggugaggagggagguuuggagcccucagggcaggacucauggaaaagaucauaucagacacuguguaugaaagauauuaucuugucuccauaaagcccgagggcugaaggugaaaaccgugggaaaguuaaguuuuuucuaagaucccauaguccuggauaucaagugacaggacuagaauuuggagagccugagucuagucgcuagagauugugauacccauacagccaccaagauccaucacauuguguaguuuauugguguuaaauucuuuagugauaaagaaaaugagagcggggauguagcucagugguauaguguuugaguaguauguguaagacccuacuucaacucuuaguguugucagcauccucauccccacccccacccccaacccccagggcuggagaggugguucagucuaugaagugcuugcugugcaagugugagaaccagacuuuggguccucagcaccaacauaguaaguacugggugggcauggaggccucccuguaaucccagguuagcuacaaaaccaacccacccacagugaccugauuuagaaucuuuguaucugaaauaucugaugugagaagucaaaccaacgaccagucauaugagagcuggaggcugccuuagagucauuuauccagcuucuuggcugucagcccucugcaggccgcaggcagggcucuucucugugugcagcaccgccccuggucuccucacagcacacagcggcaggcuguguucuugagcuggucuuccugcuuccccuggucucccuguucuuaucgcacagaggaaagggagagaugcuaggcacuggugggaagauugcugcaugucugagcccagccuggggccacauagugaaacuaacuaaacaagcaauaaaaacgcugcaaaaaaacaaaaaacaaaaaacaaaaaauggaaggaaguguauguucuuucagcugaaauguuuaaauugucaagcaaauaaggcgauggaagggccugggcaugucuuuuaaaaucuucuuuaaagaagaauuuccaauuccuuuugggaucaaucuugaacaauaacacagaauguaagcaguuuggguuuuaaggguucuuccuucucgagucuuuggaugguguuuguccgcugccuuugugaugucauggggauguuuggacucugauauaaauggcgcauauuuagugggucacuuaggcaguggcugaaggaaagauggcugcagaugcuuuucucacuaauacccaugguguguuuuugaaacagagcccuggccagugucugaucuccaugucaccucugugggugugacacaggcucgucucaccuggagcaaugcaaauggcacugccuccuaccggaugcugauugaagaguugaccacacauuccucagucaauauuucaggucugaagccggggaccaauaauagcuucgcuuucccagaaucaaaugagacacaggcugacuuugcaguugcagaggaggucccgggugaguuacaaaauuguguaucagguuuugauuuuuaucauuuacugcuuuuaaacaguacuaugcacuguauuugcauaauacauaugcauaauacauauaaauaugcaauguauuuguguaggguuuuagaauugcuggcagguuuuccugcugagguguugucugaucucauaccuuaaugaggaagagugcuucuauucuacaagugaacacagggcucagugugguaguugggcuucaaacuuuuagauuuggaguucaggaagauagauaugccauuucacuuuucaucucaggugagcaguaacaggugauaaccaauggucagccaaaucagucacccccauugaggagagggauccuuggugggcgagcucagcagaugucuucuauguuuucuguaggagucauuuguagacuuuguagacuuugcaguggauuccugguaacugugaaaugagaaagaagagaggcuaaaucccuauuuuacaccaaggaaacaaagauacgaauuggguauuagaaucagaaaccagauguugagugcuaauagugaaagauaauuuaugguccaugauagauagugaagccuucaagaaauagaccacucucuacucuuucuccugcuuugguccgugagucagguugcuuuucagagacccccaaacccaguaguucaaugagaaauggucacccccugcccuuuuugccacgguuuggaguguuguccuggaaaaacacuggaauggacuuacguuagcaaaaguaggguuauggagcaaucugagggagaccauggugggauggcagaagauaacuucccaaagaaaggagaaugguccagcauaucagaguucaaagaaaacuacaaauuaucugugguguuuauagaguaauaguacaaagugaaguaucugguucuguucagggaaccggauauuucucaggaggugguagagaacagauauuuauggaguacccuguuggaugugccauccuaugggauggugguggaaggugggggauguguucugugguuaauuucuuugccuccugucuuugaagcagaugccaaugguaccaagagaaucccagugaccaaccuaucccaacuacacaagaauucucuugucucuguggacccacccucuggccaggaucccucccucacagagaucuugcuuacugaccuaaagccugauacucaguacaaugccaccaucuauucucaagcagcaaauggcacugaaggacagcccaggaacaaaguguuuaaaacaaguagguuggauuuugugaaauggauucagccugaguuuuauaaaguuuuaucuuuugcaauccuauaucugaauuauuuauugcuuagcagauaguucuggcuucacaucuguccuugcuaucugcagauuagccaucauguuuguggguuuggccugcccuugagggccacacugaacuuucuguugagacccuugcuaacuuucacuuugcugucauuagcugugauucacgggcacccucugugaguucaguauuugguagcuuuugugauuagugcugccgauggaauaagauguacgguuucugcuuuuagauggaggauugggauaaacauaugcagaaaugucugcaccuggguccuuugcguucagauauguagcuucgcaguucucagggacuugguguguguuugcuuagugugucuuagcagaaaauaauuugaaauaccauccuaggucaacagacuugagggagugaggaucaaagguagaggaacaaggacagaaaacaagcuggcauccaggaagugccaggccacccuauaucuauugaaguccccauguagaugcuguguaucugcuugaugaauggcugggcuggguaauugagcuggugugccuugacucucaaacaggcgacuagcaguuccuaccaccgagaguguuggguacugcuuggaaagggggcagggcagcuucacaggcaggcuucauggcuacugucugcugcuuacucuauggacauugcgaggugucuuagucagggucucuauuccugcacaaaacaugaccaugaagcaaguuggagaggaaaggguuuauucagcuuacacuuacuuccacauugcuguccaucaccaaaggaagucaggacuggagcucagucaggcuaggaacuuagaggcaggagcugaugcagaggccauggagggugcugcuuacuggcuugcuuccccugccucccucagcuugcuuucuuauagaacccaagacuaccagcccagggauggcaccacccacaauggucugggcccucccacccuugaucacuagcuggauuucauggagacauuuccucaaaggaggcuccuuucucugugauuacuccagcuugugucaaguugacacacaaaaccagccaguacaugaggugaagccugauuuuaacuaacauucagucccaaggagggucucuuacagggaggaucugaagucucucuggaggaggaugugucuuggauuaacggagauggggugcaaggggagucagggaggcccugaucagaaauacagaugacagaccuagggugugaaagcagagggcaagaggauagggggaggguuuuugaaagauuuaugacucuguauaaaaagcucuuuuauccaaauauuuauaaaagauagcaucccgagggugacuggguaagaauguguucagaagaauggcgugugagcgacagcagauggcuugaaguaucaagaagccucagccaggauccagccaggagggcuacagaaggaagcccagguguuggaaaacgaggacuagaaccucggauaaguggaugcagggaaaggaggggacuuagggaacagcuuggagauccugguaaguucuggaagguuuagugugauaucuagagagugugggagucuacaugugucucuugagaguagcggauggggaggggaggaagaagaggcauugccauugguuauaagccuguaaggaaugacugacagcucgcccuggcauccaugcugaaggagaagcgacucgugccuuucuucuuuccucuucuggaaaugguaacgugccagugagaagggcagagguuacccuggaguggcugcuugaccucaggguccucagugaccuuguaacaauggcuaggacucaggacuaggaagacuggcugaagagacuggguuccuguaggugcuguaauuggcgguagggaguccuacaggagaagcguguaugagaggguggauaggguccaaaucuagaccuuguaucucuuaccaugccugcugagcuggaucuguccagaggagggggcauuugccugauuugcuaagaggagucauaugguugggcucuagacaacugccuuucaaaauccauugagaaaaacuaaaguuauggugguuguauuuguagacucuugguuugggucauacacauccuggguuauauugaacugucccaggauuugguaaauacagaagcugcuguguguucauuaugugguguuguguuuuguacuauguguuuguuaguuuuggcugacgugauaaauuaucgcagauuggacagcuuguacaaaaaacauuuacaaacaaguguuuuucacauuucuagggguuaggagugugaauccaggugcuggagauggucagugucuggccgugggucuccuuccguauaucacaguacagaugagucgcuuuugggccucuucauaaugacacggauccuacucaugauguuccacucaccucaugauuaaucaccuccauaaagcccuuugaagaccaucagcacagcaguuaggauuuauguaucacugauauguguguguaucucauauaucuuauauuucacuccugcagcauauucauacacacacacacacacacacacacacacucacuuaaaauacacacaaagaaacacacgcaauccccaucugguauuuuucaagugacugauugggugggccaggguuaagggaacuauuagaguauauuucaaacccaaauaaguggcugguggaaagccaccuccagagcugaaguaaggguggagauaguuuuucuggagcccagugaaagaagacgcaggaugucagaucgacgaguccugcuaggcagcccucaccauccuuuccacgccacucauuggugcagagugcucacaggccauggggaaggcccccagugaugucacagguagagcgcagccuccugggacacaggaugggcagaagaaagacaggaugggcugauagaguugauaacugaaggaugucuaguguucucacauguuuuucuguaagguuaggguggauaacccugucuuauaagaaaguggcuuagugacuuuccuaaggucuaccugacugguaaagcccagccagguuagaauccagugugcucucuguucaggugugagaucuuuaauucaugauuugaugcguguguuuguucuugaguggaucuguacuugaaggcuuuucuggcuuacccccaagcccccagggcagcacaugugaaagucugugcgauugccugcucuggaauccaaggucugcucacaaacugaacacagaacaucugugaggugcaguggccaggcugucuucacagaugucugacuuuggugagacccacgcacauuucuggucauggugagcugauggugagggcgacugacugaugaacccuccucucuccucucuucccguuuggacuugacugcucugauugucuuucacucccucuugugccuuuaaagauuccacccagguuucugacguccgagcuaugaacaucagugccucaagcaugacccugaccuggaaaagcaauuacgaugggucccguacuucaauugucuacaaaauacacguggcuggggggacccacuccgucaaccaaacugucaauaagacugaggccaucauccucggacucagcuccagcaccuuguacaacaucacaguucauccuuuccugggucagacggagggcacaccaggcuuccuccaaguguacacuuguaaguucgcuccuugcuauuuggucggcuuugcuuuucugcugucgugguaaacuuugugaucaaaggaaauugguggacgaaacacuuuaugccagccuacacuucagguggcaagcagucuuaucacuuaggguaguaaggguaggggcugaagcagaagccggggaggaacauggccuauuggcuagcuuccuggcuccugcucagcuagucuucuuaaacaacccaggcccaaaugccuagauguaauaagccuacaguggucuguaugcccauuucaaucaucauucaagaccuuuuuucucacagacauggccauaggccaguccaaccuggcaguuauagagcugugguuuccuuuucucuuuagguuguuaucaagguuacaacaaaaucuaaccagcacacaguggcucaccuuucuuguggucugcuaugugccaagaauagauaccaggcaagagagcucuguucuguccugaaggagugccuggcauugcacaugguuccacaggggccccucagggugugugaguaacgagagccgucauugguugacccuaaucacaugcucagugacuugugaugggcugcuuuugcacugugucauugagugcuaggacauccuugugauguaguuggcauucgccuuacauuauggacguggagaccaugcgugaggugaugugugauggagaugagauuaggccuuuaggaggcugaguaacauguucaggauaaagccaucagccauggccagcacucugucccagagccuggggauccuuacugcugucacugccuguggguaauuggccuggugucuauacuuugguggucaagggcucuuucuuagccagccuuugaaggggcuuauauugcaguugauucucuggagaauguguguccaugauuaugacgguuggccauccugcucccuggagacagacuuuacauacuauuguuuuugagaugagcuuucucugugcaucucaggcuggucuccaacucgggaugcccuugucugagcuguucaaguguugguguugugggcagggccgcugcugcacccugccugggaaugcagauucuucaccuaaccuuacucacugucuuccacagcccccgaucaggucucugacuuccgagugacaaaugucagcacaagggcaauugguuuggcuuggaggagcaaugacuccaaguccuucgagauuuucaucaagcaggacggaggugagaagcaucgaaaugcuucgacgggaaaccagagcuauaugguugaagauuuaaagccuggaaccaguuaccauuuugagauaauuccacgaggaccagacgggacagaagggcuguccaguacagugaaugggagcacugguaagcgucuggacauggagguuucuuacagggagccagcguaacucauagauuucuuauuuuaugaguauuauuuuucuuuuuaugagaaagaaucuuaaaaacauuucauggcuguggugcauaucaacaauacaaaaauaaagucaagcaaaaaaaaaagucacauguaaaguuaguaauuauuacaaacgcuauagguacggaggucaaagggcuuuggggacugguucuuuccuuccacccugggcucugggaauugaacuuaaguccucaugcuugugcggcaggcagcugcucuuacuuaauggagccaccuugacgggucccacccagguuugugagagggucucaugucacucucuaacuuacuaugcaacugagguuggcuuugaacucugccucucaggugcuaagauuagagucacaugcuaccauagccagcucccugauacuguuuuaugaugcagauggacaucuauauuuacaaaccuggcugucuugguuccugugugguuuuauaaucugcuuucuucucaccuguuuauucugaguaucuuacccugucaaguaugagucauuuuauuuuuaucuauuuauuuucuuauuugcuuuugaaacaaggcuucacuguauagcucuggcugcccuuuguagacccagcuggcuuuucacagaaaucagccugcuuuugcuucccaaaguguuagaucaaaggcaugugcuaacaugucuggcacuguuuauuuuaugggauaauuuaaagucagccuuguauuugugugcaguuuccuaugaguaguuuccuaggaauggguagcaagaaggguuggaguaaggccccggaaacguacaguuacuguccacuaacaaacagcugucgucaccgcuugggacacgguuggacagcauuaaaggcaggcuugauaaagggaaacaaaugccuuccgaucauaccuuggcuaucugucagaaagaauugaaagcagggucucagguagcucuuuguauaccaguguucauucacagcagcccaaagguagaaaccauucaguauccauugucacacacaugaacaaaauauggcuuuaucuacagccuacacaauagaguuuuauucugccauguggagugaaaucuucaaguauguuauaauguaaauguaucuuguaaaucugugaagugaaauaagucacacacaguauuuuacaaaguggaauaagucacacauacagaaagaacauuuaauuuauuuuauuauuauuuuuaaugacaaggccucacuauguagcccuggcuggccuggacggcauuauauagaacagcuggucucagauuuacagagauccuccugcuucugccuuccacaugcuggguuaaaggugugugucaccacgcucccaaagacaaguacuuacgcuuccauuuaugcaaagugccuagaauaggccacuccacagaggcagagcggggcucguggggagggaauaggagguagugucacauagguacagauuuuauguugaaaaaugaugaaaacauuuugaaugugauaaugguaauguuuaugcaaugcuauggguauauuuaguacuggcaaaaugcacauugacagaugguuaaugauaaauaguauguuguguguauuuaccaugcuaaagggaaagggaacauauguucuuagcuguucucaucugguuggauuccuuuccugccuguguccacagcuacaccucuuguuuacaucauuguuaaaauuacaugacuaauuuuauuuuauucuugaagguuuugcucuguguauguaaugcccuugcccauaguuagcauggccuuccugcuaacuaugcuaggugugcauuaaacucaacuucaaauacauucuuuguugagauacagugcagggauaaaaaguggauccuuucucaguacauagcuucauggauuguuguaggucaaaugcaucaggaucccaguucaggguaagaaauagaguguagggcuggcaacauggauagcaguuaagagcgcugaaugaucucacggaggaggaccuggguuugauuuccuccgucuuuccugcucaaaaucauccaggacgcuguuuggccuuugugaacucacuggagaguuguuguuuuuuuuuuuuuuuuuuuuuuuuguuuuguuuuuuuguuuuuuuuugaggcagguuuacuuuguagcccagacuggcccugaucccuagugcauggucucuggccucauuggaaaucuggauaaugaagaguugguucuuuugacaaagacuuugaagugaagcuggaaucaugauuaaauacuuuccuuucuuuucucugacuagaccccagugcugugacugacauccggguggucaacauuagcaccacugaaaugcaguuggaguggcagaauacggacgaugccucuggauacacuuaccauuuaguucuagagucuaaaaguggcuccaucaucaggaccaacaguucucagaaguggaucacaguagggagccucaccccaggcaccuuauacaaugucacaaucuuuccagaaguggaccagauccagggaaucuccaacuccauuacccaguacacacgugagucuugugggagaugaggcaggcagaggggcugcuuccugccucucccauggaggaaguacaguaacugauggggagaggcugggcuaugccucuggguuacagagugggaaguuuacuagaaacaucaaccucaguaaaggcucuucuguaugguaggacugugcgcaggagcuaugugaacacagcugcucuuuguaagcagaaaguagcaucauaggagaguggagaguguuguagagccugcuguucacucuucagaaaaauaaagagaguugcuguccuugcugccgcuggagauccccucagaugaggaucucuucugugacagugacugagauguuuccccaggcuucagauggacggacaguggaaguguuagccuauccugugcuugacccucuuuaauagucagauuccaaaaggagguuggacauuauaguacacuauuucucuguaugagauaauguaugggaagguauaugauaacauuuuaaaagaagcacucucucuguaugaggcaauauauuagaauauauaugauaaaauuaaacauuaaaagaagccuagacauuuuaaauucuuuucagacuuaauuuucugaaugucuuuucaggaaaucaucuuuugaagugguacauauuaauuguauuaauucuuuauugaaaaaaaaucaggcagcuuuuggauauaguaaauaaaagaggccuauaauucaaagugguucauucuuguucauuuuuuacuuuuaaaccaagggcccagcagugugucccacauugaaguaaacaccaccaccaccacggcagccauccgauggaagaacgaggacgcagccucugcuuccuaugccuacuccguccuuaucuugaagacuggagauggcagcaauguaaccagcaacuucacaaaagacccuucuauucuaaucccugaguuaaucccuggugucucuuacacagugaagauccuuacacaaguuggggaugguacaacaucacugguaccugguuggaaucuguucuguacgggugaguaguccuguguucuucccuuugcggcacucacaugcaggaaccuucccagccuguagguuacuguaccugcagggcaaccguggacauggagaacuccagcccagccuggcggcucauuaauguugacgcuguugcccuugauucaccaagaauguguuuauugagcacgugcuucuuaaagaggccccugcgcuucuagaacuuuuagccugcugaacaaaacggauaagagauaaaaguaggcaaguagauagguggugauuauggcuaagaggacggaagagagaaagaaagagccaaggaagggagaaaugguauucuugucuagggcgugaugugaagaugcaccacggaaaggauacauauaaaggugacugagcauagaucugagggcgugaagagccaacuucaugagcaucacaggguuuugaccuaacacugcuuuggagaauuuauuggaggccagggacgggaguggaucugccugagcuugauagcgaggggcaggaggcauuagagcucgaugcuuggccucuucugaucuuucccaugauguaguuaaugauguguggcuuucaguacuguugcucagucagacugcauccugguggucugcuugcuugcuuuguugcuucagugggguugcugggaccacuguucuacaagagaaaaaccuacaugagccuguacggcuagcuggggcaggagcugggagcuaaacuugacuucucuagaagagcagccagugcucuaccugcuaagucucuagccccuuuucccagaaucuugcuuggugacugacacccauguggcauuuaacccucagacaguccugcacugagccccugggcaauaaggugacugaugcaaggucguguggucugauauugcuuuauuuagugaagccgagcaucuuccuuccuccacacccaugcuuucuccucacguguugagccagguugucugcuucccuugagccucaucuugcccuguucuuugcuuugcagaaccugaaccagugaccuccuuccacugugaaguggucccuaaggagccagcauugguucucaagugggccugccccuuuggcauguacacaggcuucgagcugggggucaggagugauuccugggacaauaugacacgccuagagaacugcacuucggaugaugacacagagugcaggacggaagucgccuauuugaauuuuucuaccucguacaacaucagcaucgccaccuugucaugugggaagauggcgcuucccgcccagaacaucugcaccacuggcaucacaggugggccuguggccaggagccggcuaccccucgagcagcuggcucagcagugugcaagcuuuuagggugcuuacuuuccuuuaaaguauuuuuaucagcagcuuaccucauuccgcagcaauccagcuuaaaacugcagaguaugagagauguguuuccacauccugagcaguucugagaaacacuugcuuccuccucuucuccucuccucuccucuccucuccucuccucuccucucccucucccucucccucucccucucccucucccucucccucucccucucccucucccucucccucucccucucccccccuccccuccccucccuuccucuauuuucccuauuucucucuauuuucuuuuccccuucucucccuuacaguagggaguuccauuauugcaucuagaaaggcauuuuguagaaauguucagcuauauccgcagucuagacaguaggugagccauguccgugggacacuugucagcucucggcugcuccacuccucagcacauuuccauccccucuguccuccuugauaaugggaggaagacucugaaacacgacuugaccauuucuacuuauaaauauuccacauggauuacuucaagauaaggacucucuuuuucuuccaaaaauagccauauaauaugaccacggaauuuagggaaggaaacuuaaaugcaacaacauuauuguauauguagggacucacuucccuggaaucuauugacaagagccugaguugcuuuaguggaagaaaagaccacacacuauacagagauccccuuccccacucuuuaauuuccugucaauccuucauauuccuucauuuucuaucucuccucuucccccaccccccuguuugggaagaauugguuuuaauuugucuguccagugcuccccugucuuugccaaacuuguguuuuagaucaggccaugggguggugguguuauauccaccuuuguguuuuuugacuuuuagcuauucuuucuuucuuucuuucuuucuuucuuucuuucuuucuuucuuucuuucuuucuuccuuucuuuuccuuucuuuuccuuucuuuuccuuucuuuccuuucuuuccuuucuuuccuuucuuuccuuccuuccuuuccuuccuuccuuuccuucccccuuccccuuccccuuccccuuccccuuccccuuccccuuccccuuccccuuccccucccucucccucucccucucccucucccucucccucucccucucccucucucucucucucucucuuucuuucuuucuuucuuucuuucuuucuuucuuucuuucuuucugguuuuucaagacaggguuucucuguguagcccuggcuguccuagaacccacucuguagaucaggcuggccucgaacucagaaauccaccugccucugccucccagcacuuagauaaauauucuuaagggucuaaaaauauugcugacagucucuaaagcaucagugguuauccuaagagagucuuuuacugcagggaccugacuuggaaagugguugagguauguuauagacagaggcucagaauagauaagguggacccagguuugaguucuguuucucccauguaccagucacguaauuaaccuugcuaagagccucagcugugaaaggagaagcaguacucgccuuccaggacugcugugcugcguauucugcauugaagaccauacauauggcugcucagguuguguacuguaaagucuuaaggaaagcagucuguauggggcucuuuaaauugugucguacacagugguacccuauccuguggcacaccacuuugguuguguagaacauagcaggaacagugacuauguccugucccgcuuuguagcuccucuuuccauggugucaucucuguguauaagcugcagaagagcagagaccuuggcuaagucugugcuuccauggcugaggauagcacuuggcauagagcacaggagcuuaucagaacuagauaucucuagguugggacuguagcucaauuggcaagcacuugcugccucgcaugcaugaacguuugaguucagucuccagcacuguauaaacugcaugugguagcacauaccuguaaucccaacacaugggagguagaggcaggaagaucagaaguucaaggucaccuuggcuauuauuagcacauaccuguaaucccaacacaugggagguagaggcaggaagaucagaaguucaaggucaccuuggcuauuguagggaguucaggguagccugggcuacaugaaaacaaacaaagauagauggugguggagggugggaauaagccgaccagacccagccauacacaaacaccauuuuacucagugauucuuacuuuuuaaucgggagcuuccguaugcagaggauggguauacguuuagcacauguuaaauucaaacuugcauuuuuuuugugucaagaaguauuggaggaaggagaguuggggaaggucuucaccaggguuuauugcuugcuucguaugugcugaggauuaagggaugugaaggggccugugauuagcauucaagaggagcaguggguaaggucccauaguuugcugcugccaggcuuagggugggaagugugaggucccuccugacuaguuaaagcuggagagcugaugguaaauguuggggguaucuguggugucacugucacccggccucugcaugguccuuauucccguccugccucucacuuugggauguguuuuagaugagcucuguauaaagcuuccuacacaggagcaggucuucuugagcguggguagaucuucccaggcagaggcacauucuguagagggcacuggagcauguucuuugccugguaguuuuucuucuucuuugguuuuaaauguugagugguuguuuuguuucauauugcuuuagacccaccuacuccggauggauccccuaauauuacaucggucagucacaauucaguaaagguuaaguucagcggguuugaagccagccacggaccuaucaaagccuaugcugucauccucaccaccggggaagguaagaaggguccagcaugggcuaacccgugugauggcacugucuuggcuacuuucuuacugcagagauaaaacaccaugaccaaagcaacucguaaaacaaaguguuuagcagguuuacgguuucaaaggguuagcagccaugauggcggagcaaaggcucaguggcaggaacauuugagagcucacaucuugagccacagcuaggaaucagaggggcuggggcacacacuggcacucacacucgaaacaucgaugucuaccccucagugacacacguccuccaacaaagccacauuuccuaaucauuccugaaaagcuccaccgacuggggaccaagcauucaaauccaugacccucugggaccauucucauucaaaccaccacuguguaugagguacaucaguggcaccaacagggagggcagcuguuuaccuggugcuuucaaggaucagguaggaaguaccuuaagcugcccuggccuugaagucucugucacaacuauucagcaccuuuguggugguauggaaacauuacagaagaugcaggagagacaagagggcccaucccacaguugauuuacccaacucugaggcuggauuuggacccuaggccauaaccagucaauuuaggaggaugugcccuugaaagcaagcacaaaaagauuacuuggggcauucugagggcaucuucuggguggaagaagaggggaauuggauggcaacucuguggcaguaagaagggaaugcucugaggacagcucagauagcagcaugguaucugguuucacacaaaccaggucuagggaguuagcaugguugguaaaguacuugccuugcacuggcccugaauguaaucccugggaccuauauuaaaugaaaaacugugcauugugauaugaccuuguaaccucggggccagggaggcagagucaggaggaugucugggugucagcaaagcuggcuuggugaaguuccaggcuagagagagaaagagacccugacucaaaagaagaaaaaaaggagaaggugccugaggaaugacaccugaguuuauccuuuggcuuccacgcacauagaggacauagacacguaugcaugcaaaguagcucacacacaugcaccugcaucccuaugaacacaaaucaacaaaacacggcauuucccccgacuuuuaaaacuguugagccuguuucuaagcucuuucaacaaauugcaaacucagacccaugcugaaugaaaaagacccuguuaugcggugaccagaccagucagcagcagcuggacucaagaucuugggcuaggaggucaggaacuccagcuucacagugugggcagccugcuuugggcaggucucugcuagcuuucuguacuuuguuauucuugcuugagaauaggggccgcaagcuuuugugagugacuccugacagagagaugaggugguacaagccaaguccuaagcgcucuccugcuccuagaacuccuugagagacaguggcugcugccuacuguugcucagcaccugugucaucaggcagccauguugugacacaugccuuucugcugucacucaucuuuuaccuucuguguuccucucuuagcugcccaaccuucugcagauguuuugaaguacacguaugaggauuucaaaaggggagccucggauacuuaugucacauaccucauaagaauagaagagaagggacagucucagggcuugucugaagucuugaacuaugaaauugauguggggaaccaauccacuacccucggcuacuacaacgggaggcuggagccucugggcuccuaccgguaauaucuggguccuugcaguugccuucugagccucgugaaugucagguuguguacuaugagguaaauacaccucagucaccuuauuuucuccuuugccuccccacagggcuuguguugcuggcuuuaccaauauuaccuacaaccuucagaaugacggccucaucaauggggaugagagcuaugugucuuucaguccauauucagaggccguguucuugccccaggacccagguagagugaaacaaaagcccugauguggauuuugugucuugugucugcagaaacuugcugaccaugccccucucucagguggcuuggaggguggaggauuuuggcucucugaaauugacaugucccuuggucuuuggggucagccuagcuccccacucuggggugcuugaaggaacagcuccccacuucuccucuaaacuggucacacuucuucagauuacuuaguccuuugcuuucuaggagucauuugugggcuugugugaguuaguuaagaguccuugaauuagaaggagccacaggaauugucuugucuaagcucugcuuagaaagaaggcuuuuaaggcuuagagagggggugugcccaguguuacacaguggcuuaaaugcaguucugaaauucuagccuuaaacuccuugugagguguucuuccuacucaagaucacagagcuagauauguggggaucucagguagcugacuggucuguuagccugcuuuucagagcuacugagucgaacagauuacccagaaucgaauuucagggcguuccugcuccuucucuuaaauagcucccaaaaagggugggcaugguguuguagguaguuuugcucauaggugacaagaaaaaccagugaucuagcuggcucagguccccacauuugcagcagaacagagaccuaggucagggcucugcuguuuccaggacuauccuucaaaugggugaagggagaagaaaucagcccugaaaguuguucuacuuuuucauccaaagauauuuacuuguucgcugugugcacacacucccucucucccugaauccugcaugggcaggcuggcuguguguguagcacauggcccuucgugaacacccauugaaaucccacuguuggggucuuccccaggugucaucugcggagcaguguuuggauguaucuuuggugcccuggccaucacagcugugggaggcuucaucuucuggagaaagaaaaggugauauugcuuauuaaucaucaggugcuauuguugaagggaacuuucuauuauauggaauggcaaccguauguauaaucagagggaagaguugaaagagccccuguguucuucacagugucaccaccuggccaguccucuuuccucucugaccuccucccaucugcgucaguccuacacugacuugcuggaugcgacuuucaagucaggauucuaugaauguguuaagaguuucauaggguuuuagaguugggcaaguuugaacucagguuccauccuugcucgugguuggaagcccugacacucuguggugugggaaugaguccccggcuuaaggagcugaggacacugacaaaugucucacuccaugacaacauuauucaucguucucuuuguaccaccacccugugguguaguuaacuagugagaacagugcuguguaccuggauuuguugucacccugagaugacacaugaauggcuguccugcuuuguucaugucaaaccugaugggggucuucacugcagcaucguuuugaguagcugccugguauuuaacaucguucacuuaaccauuucacuggauauuuuaauuauuauugacuacaguuacaugggugugcucaugauuauuuuccuaggauaaauuccaagcuggguagugacugggucagugggcaugcguucuuuccauuuugacaugcugccuaaacugcaguguguuuuggcuccagguagagcugagccaacagaacagugcagguccucacagcaucugugauggaucggaggccauuucaggacuugccucuaguucuuuguauuaauuuacaugauggcucccuaaaaaacagaacacagaauaagggaauguaaacacaugcacacacacacaccacacacacaccacacacacacacacacacacacacacacacacacacacagaaauuccaaaaaguugcuugauuagauuuugauucuucucaguaaguuugcagauaguuugcauguccugcuuggccuguuagauggcgggguacuagggagucggccauguucugggcugggugcuaugagcaggccguaguguccuaccugaaccccaggcugugaagagaggugucuguggcuaugagaaaggcggcagagcaggaugaaguucuuugucuaaugggccuguuuuuuuuuucuuucaaaauaggacagaugccaagaauaaugaaguguccuuuucucaaauuaaguaagucucugaguuacaaacuuauuuuaagauucucagucccccagucuguucagugacuaucuauagcauuuuuuuuuuuuuuugauagaaauagcugucauuuccccugauugacagauuggccacagucauauggaaguucuugcuguuuucugcaaggggucuuuguuuuauuaaguuuaccugaaacucccuuuauuuuugucccccaccccauguucuucaguuuuacuaauaaauagggcgugccuucucucucucucucucucucucucucucucucguguacaugugcacacacauaugcauccccaugugugcucggaggccagagaggauguugggaucuuacucuuuaucuaugauugcucuguucacuugagacaggguuccugcuaaauugagagcggugcuggcagccagcaagccucagucaugcuccugucucuaccccaccugagcacuggauuucaggugcauguggccacaccaguucuuacgugugggugcugaggauuggaacucaggcccuugagcuggaguaguaagugcucugaccuacugagccgucugcauagcacccuaccaccaauagauaauugucaguuuucaaaaaugaacaggucaucaagucacacgcauggucaguuauagaacaggucagcuucccugguucacauuucagugcuuuuaaaauaacauugcauuaaucuccagcccacaccccucacuauggcuggcuuuguucuuuugaguugaugcuuccuuccaaaacgaguacaucuuucuaauuguccuuuuuuuuuccuuuuuucuuuucuaugaugaagaccuaaaaagugaguaccuucauuuuuaaagcuucuguuuuuucuguuuugaaugagaaauaagcaagcaaacaaacaaacaaacaaaaaccccaacaauugcuuuuuguuuucccagauccaaguuaauccgaguggagaauuuugaggccuacuuuaagaagcagcaagcugacucuaacuguggguuugcagaggaauaugagguauguuuuuguuaacucuguggucugccagucugucguauggugaagcuuugggugagaggcagcccagagaggagagaagguugugucugacccucuggggcacacgacuguuggcuaggaagcucacagggaccuucacuucugguggaguuuguguuuagucuuguggauaccugaagauuauccagagagacagcuaugguuggcugaagcuaggggauuauuaacuaguuccuaauaagcuguaugagcagcauagaagccaggucugcuguuuagaggucuggggcugccacagcucuggucagagcugacuugggaggguuauuggaacccuguuugucagucucucgccuucuagacuccgcuaccucaaacuagggacucugcuaccaggaaacugugggagugcagaaggugcaugcgugcuuguccccugcacgaugugcccgcugcugucugcucuagcgcuccuacaauccugcccacggcuccaucauaauccauucucauucugacacauaauccauucuuccggauuccugagaucccaugggaggucucuggcuaugucguguuuguccuuacacugcucuugucucaagugcugcccuugcuaagugccaugaagugcguagcuggggacaacggacuuauugucucacuguucuagaagcaggaggcuccagaucacagugucagcgggaccugcuccccuuagccucuaggggagauccuugcaugaccccagcuuuuggaaagcccaguuguccuuugcuuugggggaagcauggcuuccgucugcaccaucaccaccaugaggcguccucuugugagucuggugucuuuuuuuuuuuuuuuuuuuuuuuuuuuagguauuuucuucauuuacauuucaaaugcuaucccaaaagucccccauacccucccccccacuccccuacccacccacucccacuucauggcccuggcauuccccuguacuguggcauauaaaguuugccuguccaaugggccucucuucccaaugauggcugacuaaaccaucuucugcuacauaugcagcuagaaacucgagcuccggggggugggggggguacugguuaguucauauuguuguucuaccuauaggauugcagaccccuuuagcuccuuggguacuuucucuagcuccuccauugggggcccuguguuccauccaauagaugacugugagcauccacuucuguguuugccaggcacuggcauagccucauaagagacagcuauaucuggguccuuucagcaaaaucuaacugguguaugcaauggugucagcauuuggaggcugauuaugggauggauccccaggugcggcaguuucuagaugguccauccuuucgucucagcuuuuguacccauauuauaacgacauuacccuauuccagugacuucaccuugauugccucuuccauggccauagccuaugagagccuacucuaagguacuggagguuagaugcuuggcaccucuuucuagguugcaguaguuaacaugaucugccucuguauuccuacuuaguucaaccgcaccccaugcuccgauuaaacauacaacucguuuuuuuuuuuuuuuuuuuuucaggaccugaagcugauugggauaaguuuaccuaaauacacagcugagauagccgagaacagagggaagaaccgcuacaacaauguucugcccugugagugguuuuauuccuuucgucuucccuuguuccuggccaucacacugugaauggcagagagaugggaaucagugauuccuacccggcaacuccaccaccauucagcaccagauauuucucucccucaucuccccccagaucuuuuccaccuccccacccauucaguuuugagaccuggaucuugcugagucaaguagauuagcuggccauugagcuccaagggcccuccuauuucuccuucuccaguacacggauuauaggggugcauuguggguacuaggguuuggacccggguccucauggcuuguauggcaagcacuucacugguggagcuaucuuuacaacuccaaauuuagaacuuuaucugucuaucuauguugcgguaaaucucuaacccaaauaugcccagcaaugaaaacaggacucaauuaauaugaauacuugcugugugccuagauugggcagauucuccacuacacuaccaucuuccacaucuaugagaccccuuagaacuugcgguuucuccagcccaugugcuucugcuccgcuuuucuuccuccuccucuauguccucucccucuuccauuuucuccuucuucccucucuccaccuucugcuccaccuucccuuuuuuucugcccaaucauuaccucugcuuuauuuuacaaauuaaggugggaagcagguuuacaggaaaucacccgagugcugacucauuccuuguucguagccacuuaccggagaacggaauuaacaucaaauauaauuagccucagggguauccacaacauucuaucuaucugucugucuguuugucugucugucugucuaucauccauccaucacugaucugucuaucugucuguguaucuaucuaccuaucuaucuaucuaucuaucuaucuaucuaucuaucuauucaucugucuuuaauuuauugauugucuauauguauggguguggcagugccacagcauaugaguugaggucagagaauaaucucucccuccaucauguggacguuggggucaaacuuaggccauuagguuugucagcaagcaccugaaauggccuagccaucucaccaucccaguaacaacuuuuuaaagcuguaggagaaaguuaacuuggaugccuucuuugccguaguagaauaggcucugaguucacauucugucugcuguuuccccaguuagaaggccuuggaaaugccacuuugucucugaaacuccugauuuccuuaucuugaaagcuugugggaugguuuuguugugugaauaugguugcuuggcaccugcucugcucagagcagaugcccaaggcugcaggagugagggcuucuuuagacugaaggggugagaauguaggccuggcugucaggcugccuagguuccaguccuaggucuccaaaggcuguugugcauuuucucugugucacugucauagccuauccacagggaucaaaugagaucaugaauguaauaugugaagcaacauggcagccaugggcugccaguuuguacuaaaaaaauuuuccugcuugcaacuuuccugaagcauggcguagaaugaggaccuuucuuucuuuuaaugccacagaugauauuucucgagucaaacuuucaguccagacccauucgacagaugacuacaucaaugccaacuauaugccuguaaguagguggcugcucucacggcccaggguucaucugaagaggagugugucugucugugccuuugauggugacugagcugucuguuucuagggcuaccauuccaagaaagauuucauugccacacaaggaccuuuacccaacacuuugaaagauuucuggcguaugguuugggagaaaaacguauaugccauuguuauguugaccaaaugcguggagcagggaaggguaagugucuuuuaaaaauucauaaauuaauuuuuauuaugguagaggguaucuugaaauccaucugucuuuuaaaaaaggcauuuaaaaaaugucuucccaaacaauacuuucauccuuagaaaauguucuguauuuuuagcuuucagauagaagauuuaaauauaucuugaagaauauuuuuauuauguuucauuguggggucauauugaugucugugauugacucugugcugcuggaguuaaugaguggauagaacugaguuagugcaguggacacugcaagccuugcagugggcaccagagguuagugcaguggacaucagagguuaauucaguagacaccaaagguuagugcaguggacacugcaugccuugcaguggacaccagagguuggugcaguggacagacacugcaugcuuugcaguggacaccagagguuagugcaguggacacugcaagccuugcagucgucugucgucagcucugugccuauaaagccucucugugcggucuccuaaaucucugauuuucagacuuaucuccaggugcaucucagcggcccccucucuuccuguguggccuggaacucuccugccauuucugucacagaaaggaggaucuguucugggaauaaaaaucucauauuucuuuaaauagagaugaguugaaaaaacacaugcuaaauuaaaaaacuguguaccugaagaaugacaauuaauauuacuuucuggagaguuauuaauuacuauuauuauucaguauuggggacuggaucuggggucuuggcugaguccacacuacaugucucagugugcuaugcuuugccacugagcaauaccccagcuauuagugguucuuguucuguuuuguuuguuaguuuuuugagagagggcuucacucuuauccuagguuggacuugaacuuagagcaauucuccugcuucagcuuucuaaguaaugagauuguuggcaugagauccuaugccuagaauaagguauauacucucucucccucuccucugcacccugcccccaaguguauauuccuuucucgaguccccgagucagugauucccacaccuccuuauccaccagagucgucugcaggauguuucugucuccuuguugauugagaaggguucugacagcucgaugguguggcugcugguggccagguguucuccaugagugcugcugucugcugucccagguggcaacuggaaccuguuggacaucauuccuuaaaaucuauuuuuauuauauuguguguaugauguguauacaugugugugagaggguauaugccacaggaaauacaugguuaaauacgugguccaugugauguuucuggaaaugggaugugaguccuggacucaggucuguaggcuuacacagcaagugaucuaccugcugaaugaccucacagaccugaaucauuucucugaaagacccacuuauguuauuuugaguuguuaguccaugaguguaucucuguguuugggucaaacagaccccgauaagggacugagcaguuaguuccccaugacaguuccaugguuuuccuugcgagguuuugaugaugguggaugugugaucccugaccuuguguucuagaccaaaugugaggaguacuggccuuccaagcaggcucaggacuacggggacauaacuguggcgaugacaucagaagucguucuuccagaauggaccaucagagauuuuguggugaaaaauguaagucaagauugaucggagaaaaucaauggguauuaauacugagaauaacuaauauuugaugcacgaggaaagcaucuuuugcugcccauaucugcaggcuuucugaggagccucagcuuuacuuucuugaggggacuuuggugucguuucugaguaaaugagucuuucgagcauggcaaugacacuuugcuucccggaggccuuugugucaucuggguggggaugugcacggggguugcuuacugcuaggaacaguuuguauugauuccaggauuuggauucuaggguacaugcacuguccucccuucccccacuaaguuacaaaaccaaauccacuuaaaucacaggcuuucuagaagcugagucuccuuuucuuugaaaguagagaaaauguucugagucaccguuaacaccaacugagugugcaaacggguuuaacauuuuccagcucauagcaagggccucagauggucauaucucuucaucuggugagcucaaguuggagucuuugacaugaagacaagauguggaguuccggaaugggcucacgagccacagagcucagucucagcauuguuuauucucacaagacuguuuauuuagaagcuccucuaagagaugaguaagcucuguguuuguuuccauuucucuuggguauauauauauauauauauaucuccagugucuucuacuuuauuauuauuacaaguucuuugauauuuucauacacgcucacaguacauuuaaaucauacugucaguaucauuuguggagguugaacaguuuugaagccacaugcauagcuagcuuuuggagacuggauaacuaaacugugacuacaugcaaacugugucaccaucgagcuuuuagcuuccauacguggagcugacauacagccagcuccuuuuacccccacugugucauucagcugugaauucaaccaacccagauggaacuuauucagaguaaaaauuguuuuuguauuuaacaugugcauuuaggcucaucauucccuaagccauacaauauuacaauuauuuaaaaauacauuagguaauauaaaugguuuagaaauggucuaaaguauaaucacauguuguugacugacagggauguguucugagaaaugugucugugugaacaucauggacuguacguacacaaaccuggauaguacagccuacuaugcacuugggcuguguaggguauaccaucauuaugucaauaugacugcacaggagcgugugugcagauuggaugcacacaugcuuguauuacguugggauccugagcauccacagauuuuccugggaucaauccauauggauccugaggaaauguggaaagguaguaucaacaguacauacuaggagacgacguuuugagagagugucuuacuagacagccuaggcuggccuugaacucaugacccucugccucagugcuggaauuacagauuuguguugacaugccuaguuuagcauuuauggaacugugcaugauagagaagccuacauauagacguugugguguuacauuuuaacagagacugauagauuggguucuaguuuguaagaugaagauauaggugagacauaguauaugagauauuaauucuuacuaguuacugggccucaaagacucuggucucagggauguuucagguccuccuuuggggauguuuaucacacacugacgugaucacuuaaguaaggucacagucagggaggaacauuugcaauaugucaggcuuauuucugcaggcuuugcccauuuaaacugacuggcauguuuacugucccuggcugccucugcuuggaguucaccuuuugugcauagaguuggcgaaauaaagacaaugcuacugcucucacucuaguucuaaauaguuguuugguguuugcuaguugcguaguauuaccacacacuaucuagagagcccaggacucaccagguggcucuugccccacagauguaaccuccugccauacuuagggaaacgauuuggggcuguaagggaggugccguuuccaggugggccauagaacagggcucaugaaguucccagggagcuugcauuaaugaaacuccauagauucuagagauuucaugauucccaccaaagccuuuucuuauuuuaggcuuauauauaggcuuccacguggcauuuucuaaaauagugcuuuauaguuaugugaaauccaugcaugcauuuccuuuuuauaaaaugagaacauuacagauagagcuccaugucuuuugacuaccauccuuagucucugcccccgcccccuguucuuaccucccugcccccuggcccugccccuugguccccuguuuccuugaccccugccccugcucccugcuccucugcucuuuggccccugcucucguccccgcccccgcucugcucucugccucccugcuuccugcacccugcucccuuguccugucuccuagcuuccuguccccugaccuccuguccccugccccugcucccuugcccucugcccugcuccuugcuccucugcagaacugcuucugaaaguucuauguuccacagucucuuugugucucuuccucucuuccccacuccucccagcugauuucuucucucaguaaacccuuaugauaauauucaugauguuaguuguccucagagaagcuccugaguauccucucuccuauuucucaaacuuuccauagugugaauuuauugcuuuauaaugaauaaaggucagaaauuagcuucagucauggagaugcccauugcccugcugaggggacauaugguaaggucagguacagacaaaugaauaucguugaaucaaggacaggaagggacaggacuagccccaggggacagaguuuugguaauuacaggcacaugcuuggucuaagguagaguuaaacacuguguaauugacuaguuuuguuguaacaguguccucugucuccugccggccagauguuaaaguagcagacugaguuuguauguguauaugugugcauugugguguguguguguguguguguguguguguguguguguguguguguauuucucuuucugugugugaauguguguuucuuuuuuagaucacuauaguucuaaauaguuguuugguguuugcuaguuguguaguauuaccauacacuaucuagagagcccaggacucaccagguggcucuugccccacagauguaaccuccugccauacuuagggaaacgauuuggggcuguaagggaggugccguuuccaggugggcuauagaacggggcucaugaaguucccagggagcaggcguguggguguagggcuguuacuggcugguagcugagaacagaagugaucuaaacucaaaauugaacugggugcguugucuccacauagggugaguaucgggggucauccccauuuccucugagccuccgcugcccaucuuuagaaggggagaugaugcccuuccuucuugggaacauuaugaggauuaauagggauaauagugauagggaucagcugcccguuuuccuuuaagugcugaaugguucucaggccugcuugauuucacucaccguugugauacugucagguaucuugacucuuggaucucuaacccguuccuuuagaugcagaauagcgagagccauccucugcggcaguuccauuucaccuccuggccugaccacgguguuccugacaccacugaccugcucaucaacuuucgguaccugguccgggauuacaugaagcagauaccccccgagucaccaauucuggugcauugcagguaugcacaguugggaguguaugcauuugugacaacuuaaaauguauacauuuaugaauacccccucuccccaccaccaaagcaaugcccaagagaaaaugcaauaggcaguuggaaauucaagagggcacuguggccuuagucccugagacuauagaaagggguuggugagcuauauagcccaugggccagacagggucugcuuguuuuuauauauaaaaccucacuggaacccagccacacccacuggcuuacucauuugcauugcuuuuauacugcagugguguaaugugcucagcugaggguauuggccaucuggucauuuacagaaaggguaugucugugccuacaauagaacagaaagaauuuagcauuaaaggcaaaagaauuaauuagagcagaggccucaaaaaagaugcaacuuuguguccuaggcugcaggaccauuugauuggcauggggugugagaagguuagcaauauguuuagucugcgacuuuuaacucgcuugaagcugcaguugaggagcaauguguucgccucagugauaaugaagauauggguaccaguggaggacugggagaucuguggagagacaacugauggugaugugcuaauuucucugucuucuagugcugggguuggaaggacgggcacuuucaucgccaucgaucgccugaucuaucagauagagaaugagaacaccguggacguguaugggauugucuaugaccuucggaugcacaggccucugauggugcagacagaggugagcccagaucuguguuuggcacguuaccauucccaucugucuguaaaagcucacauggaaucacaugcuggacucuucuagagcuuucuugcucuugacugugaauuucaguugucauuaaauuaccugaugcaguaguaccaauaggaugacacaugcagauaguggcaggacucuuugucuuaaagcaucugauuuuuuaagcagucuucuuuuuuuuuuuuuaauuuuuuuuauuacguauuuuccucaauuacauuuccaaugcuaucccaaaagucccucauacccacccacccccacuccccuacccacccauucccacuuuuuggcccuggcguuccccuguacuggggcauauaaaguuugcauguccaaugggccucuuuuccagugauggccgaguaggccaucuuuugauacauaugcagcuagagucaagagcuccggugaacugguuaguucauaauguuguugcaccugcaggguugcagaucucuuuauuuaagcagucuucuuuaaaauaaagagauuauuuauuuuuauuuugugcauauggguguuuugccugcaugcaugucuuuguauuacaggcauucgguacccacagaggccagaaaaagacauugaauccccuggaaauggaguuagagguaguugugagccaccauguagguagugggaaucacaccaagguucucuguaagaccucugcaguggucucaacugcugagcugucuccccggcccucagauuagucuuuuuaagacucuugguuugguuccuagauuuuaaauuuauaaaauuaguuuuuaaauuuaauaaauuuauuguuuauuaaaaacuuauaguuaguuuggucuucauuucugagaggaucugaccaucuuuaagcugacagagcacuucucaaaaauagcacauugccacugaagcagaaauguaauucaugcguacacacucuugaagauguuaaagaacaguggucaucagagcuauacaaaaaagacugagcagaaaaugugugcucgguaugcacugugguguauguaaagauguuggaguugccuuaucugaagugucccuuguaagcuuugaaucugaggcuuguucuuaucagagugugucaggaagugauuuccagggguggauauucccagaccaagaugagagcagaauauucaucguggcucaggcuguuacucuggaccaauuuagaaacuuaugaccaugugcuaugucugagucuagcaugguauguuagaggucuggguacauugugugcuuuugggugagacgcacgauugugggagaaagagugaaaauuugcuucuguguuagaguuucauuuuucugcuacaguuuuauagagugagaagaacagaaaucuuauuaucugccuguggauuccuuccucaucucucuguuggggggggagugagggagggagggagagaaugagagagagaaagagagagagagagagagagagagagagagagagagagagagauuuugauugcuuucucacuuuuugcagugaugcugguuaucacagucaaacacagcuugaaacuauggcuagucuauuuagcuggcuugaucugaggucacgcccucuucugaggccacacccacucagcauuuucuugguuuguugaucggcuguuuaguccugcugcucuguggcaaauacuuuaaccacugaucugccucuccagccuccugaucacuuuuucguauuucaaaaauaauauauuaaaaauuaacacuauagaacugcccagaauauauucuucccccuaacccuacuuccuagacgcuaggaccuaaaggaaggccuuaguuacuuuuagcuuguguaguacuuuggaucccacaccucccaggcugauguguuugaauauuuggucaccagacagggacguugcuuugaaaggucauggaaucuucagggagcagagccuugcuggaggaagucgaucacuaccuggugggccuuaagguuucauaccugguuccacuuccugucugcccucugcucucugcuuccucuaugaccagcugcccaaggcccugccaccaucccuuuucagccauggugggcuguaucuccucugcugugagucaaaagaaguuccuucuugucaggcuugguuacagcagccagagauggaacuggcacagcagguggcgcuauagaacguuuugaauaugcacaugcguacaucuguggucuccuuugaaaagacuggaugcucuuaugagguuugcuuuuacggcaccuagccuuuuuuuuuuuuuuuuuuuuuccugccacagcauauacuuccucuauuuaaacagcgaccuguagauucugauagauacacuuguauuaguguuacuuuuuuguuguuguuguuuuguuuuuuguuuuuuugagacaggguuucucuguauaguccuggcuguccuggaacucauuuuguagaucaggcuggccucgaacucagaaaucugcuugccucugccucccgagugcugggauuaaaggcgugcgccaccaccacccgacauuaguuauuuuuuugaaaacaauaauuguguguaaguuuauuuugccucaugguuugggguacaguuuuucaugguaagccacugugauauaacuguggcagcaguaggaugacccuggccacauucugccugcaguaaggcaggagagagaugacuguugguacgcaacccccuucauuucucacuugcugcagaccuccgccccacauucaggaugugucgucugucccucaucaggugacccucuccucuaaugaccuccuagucacacggaggagugucuucuaggugauucucaauuucauccagcugacaguuaagauuagucuucacgcuaccccgaggagggggcugcacucagguccagcugaugcccuuuaacccuucuccucuuuagagaguccuuccgguuuacucucacuccacgcggauuccuuaacuuucacuguccugcgguauuuaugcuugauuuccucugcaucuucauuucacccuccauaagguucugauguuuccuugauaugaagacgugagggugcccgcucugguuaagugucacugguaaagaaggcuguguuaugugcuuuuugaaugucauuagguuguuuauagaucacggauguguuggacagaugggaucauggugaguuuuccuuuaagaaucgucucguguucucauuccuggggcuggugcuuauucuucucucucauuuccuuucccaccaggaccaguauguuuuccucaaucaguguguuuuggauauuaucagagcccagaaagacucaaaaguugaucucaucuaucagaacacaacggcaaugacaaucuaugaaaaccucgagccagugagcauguuuggaaagacuaaugguuacaucgccuaguuccaaagcaaacccuuucugaagcuaaccggaccgucacacccacagugaaggagagcgcccugacgggacauguuuuauaugucuccuuucucaguucuuuguucuguucuguuagaacuacuuggagggcauggggcugugcgugcaaaagcauggcagauagccaguggggugucaggggcuguggacgggugguguggaaaucagcugccuuccugaucacuaaugggauggguucacuuuuuguuuuuuuccuugagaauuguggaaaaccaggaaaagugagcuauguuuuguuuuccaaacugguuuguucuccucuuuucuccccuugucuccccccucucucuccccccuaccucucuguuuuuuuuuuuuuucaagacuuuuauaugauucacaugcuaaagccaggauuauguuggguugaauauauuuuaaguaucagaggucuauuuuuaccuacuguaucuuggaaucuagccgauggaaaugcgugacuguggguguuucucacgcagggaggggcacauggcgccucuucugcguggguuucuauuugaacaugugccuuuucugaauuaugcuuccaugggcaaaacucaguagaugucucuauuuuuauauugaaucucagaauuggaauauacagacuauuuaagcaguagcuuagcaucagagagucgccuccucaguaacauuccggcucccauucgauuagaggaggcucucucugcggcccacccuugacacacguuugugccccacaguccccuucccuuucuuucuuuuccccucccaguuuucgccaaagacuuguguuggugagauuuucaucccauugguugggugagaauagaaauguaaaccaucaucaugagacucucuguggguggggguggggaggaagagaggaaucaacauaccauggugugcaccccuucucaucccgucuccuccuuucucuccuuucugucuuugguaagaaggauuauuuaaaggugcaauaugugacguagugguucacgaugcucuggguucuuaguaauguuuuacucagguugucauuuuauguaugugugugugucugugugucugugugugucucuguguguuuuauagcguggugaucugugaacauuucagugugaacucagaauaaccccuuuuccccucgaaguccacuggcuuuagucuaucugcagugacacacaucaguaucuacuguauauauaaauacuaaacucuuacaccagucauuccuaugaauugagguguacaaaguuugauuuguaucaaagauguaauuauuauuuuuaaaaccucuuuucacuacacugcugcuguaauuacuuugaauuuuuaaagaaaaaaaauguaguuuuuuuuuuuuuuuuggcuucagguguguauucaccaagaauuucagaauuuaugugguuuuauuuuauugguacauaaucuguaaacuucucaaggcauuaacaugacaagauuugugucuuuuauuuuaucuuguggcucagguuauauuugaagaaguuucaaguuuaucuucuaguaggcaaugaagucuauauaaggucuuaugaaggaaucgccaggucccuggacuccuguggcuguuuuccacaguaacaacacauccugcuguauguuugggacaaugguauccuguugaagaugagggugggucuucuccaaggaccuggccacugugggccccggaacugccuucugauguucugccuucucuguuccucgugucaccagcacuuugauggcugacuggaccugaucaugaguauuuguaggguuagagagggugacccauaauugaaaguccccugcuguguuucagcgcuguagugcugugguguguaccccccccccccuuuuccuuugcgguacugaaaggauugaaagaagagggucauggcauugucaugcuuugggggagaauuuuacuucucacauggaaacugcacuuuuuuuuuucuaaauccuuugcauuuugauguucauuuaguguacagcccuacagagaaugggcuggcccagguagcuugggccccuugacucaacuucacuggggaacuugacucugcaguugugaaucagggaagccaugcugucuccagguguggagugaagcugaccuugggcucauuauuuccaaaugcccugucaggucugucuaggaugugcugacuucggggugcuauacagaggggccuguccuggcaauaguucugugcaccaccucucugccuccucaguuuguuaggaaccauuguagaggguggugagggguccaaucccaugcagcgccuaugcccugccucaucugccagaaagcaugaggaaaggacuugccccuaaaguaguccuguagaagauuagagucccuuaaaaaaaucaaagcaacauaaucauaaucacaccauauaaaauugcaaaacccagagccgucuccacuucuucccgugugggucugcaaagucuuuaggccucagccccaacaagccauucccagucccaggaggaaggcuaguggcagagaggucuggaguuccaaaugggcaggucacaagaaggucaccaugccauuccacaucuggaggaggacugugugguggaguuugcauagcacagccauuggaaagggaagauuaaugacagaggcuaggguuggccagaggcagaaggcccuucuuacugucugccccaagcccucaguggaacugugaacaaaaguuggaagagccuggagaaauuugaaugauggaguucccccgcuaagacacugagaaaagcagccaggaugagacuugcugucagugaaagggcuacagacugguggucaacugcuuuggaggacuugagccauugacuggugucuucuaaggagaaaaaggcuuugccaccagagcugaaucuagcaacgauuggcaccagugggacauuugguguccauucucugaggccacuuugugaucuccagccagacuuuggcacaauggaccugcuggcuuugugcuuugugaaguuggaggcucuggggggugggggugggaguggggaggaagcagggaagggucaacuaugcagcugguucauucauacuuguuuucugggauggagaagccuggaauuaucccccacccccacccccgaaaugcuugauugugcuuguugagcuaaacaagccggugacugaagcuaguucaccucaaaacagaguugggaugccgcauuuuucagauugcugcguagcaacuguguguuuaacaccuguggcuuuuucucccuggggcacagaauagaaguguugauguggacucuaaacuguacuuuucuuguaacuauuuuggaaugaugcacauuucuaaugucuguuauacuuguacagaguauugcucuugguugcuuuuuuuuuuuuuuaaaggaaaaaaauggccugaaaaacuuuuuuuuuaaagacuuacaaauaccaaauauaaaaauaugucaacacauuaugucuucgauugauucauuucucucugucucugucucucucacucucucgcucuucugccucucucuccccccuccccccuuauuuuacaucuauaccacuuaccauguacuucacugguuuuguuuuauuugaccagggaauccuuagcaagaucauguuuccacuggaauuuucuauauugcuuuuuauggcuacuguuucugauaccacagacugggugguuuaagccagaagaauucuauuuuuauaaucuggaagcuggagauccgagaucaagggcugguagggacucccuccugguauggccucuuccuguccauauauggccuuuccuuuauacaggucugaggauccuagcgaugcugguuauggccuuaugcgcagcaucucauuuuaccuucuuugcuacugagaucccgucaccaaguagagucacauucugagcuaugagagguuuauaccucaggacguggcaaugugggugcauggggcuaauuguguguuucuuaguuugguagagagauaaccucaccuuaggaggcccccagaauuuuuagggggucuucuguugauguuucugaggaaucucaaaauuguugggcuacugugacaaucugauagaucagugguucucaaccuuccuagggcugcaaccuauuaauacaguuccucaugcuguggugacucccucaaacauaaaauuauucuugcugcuacuuuguaacuuuaauuuugcuacaguuaugaauccauguuuucugauggucuuaggugaacccugcagaacggucauuugaccccuccaagggggucacaacccaucgguugagaaccacugugguaauacuuuaauuucgucuuuugugucuccugauacaaaaugguuuuggggguuaagauagggccucauguaauccaaccuucuaauccucuugccucuacuuuccgaguucugggaauaagcaugugcuaucauuccccacaccauuuuuuuuuuuuuuugaguuauuuaaugggaaauaaaacuucaguguaauuucuuuuaguauguccaaguugacugacucaagggccuuuguuguuuaucacuuuucugauuaggcaaaaagcacaaacuuggggacagcugauaauguaguuacucaauagguuuguucugucuaaaggcagaaaguauguacuggacauacgugguaugagaauauaccagcccagacacggaacaguaagggcuuuucuaaccuuuuccuugcggucagcauuaguuggcagagagcugaaguuugucacaagagagaggaccacggacauguugcaagaccugggucugcucagaaaggcauggguugacaucuugcuaaagcccaaccaguuuaggaugaagcuucugguugggagcccuccccuguggguuuggucccugauacaccaggccaucacaucuucucuccugccgaugacccuggaacucaucaaaggguaauuuugguguguuaguuacauuucucggugucaugacaaaaguaucagacuagaagcaacuugaacagaggaacaguuugagggagggauuauaguucaucacagcaaugggagaggcugcugguuauauugcaucugcugucuggaagccaagcaugaguaggaaguagggccaguuuaugggccuuccuuugcacuuccuccauguagccuuacuacacggagccaucaccuggggaccacguguucaaacacacaagcuaugggagacauuuuguauucaagccacaauauucaguaaaaaaaaaaaaaaaaaaaaaaaaggucggaaaaaaagacacauaugaaugccauuagaauucgauguguuaauauucugagaugcuucaugcauugccuagggcgcagugauggcuauucaaccucaguuuuaugucuguuaugcuggcagugaguuguacauauguggacaaaccagacaucucugccugugugcaauuugaggaccuagggaagagugaggggaauuaacauguauauaccgauacacuguggccagaacaagucagcuuuguaguaucaaugggucagagaggauugaagagaagggagaagaaaugguguaugcugagacaauuuggcaauuguguaguugggagucuaagcuuauuggggauuaguuggaagcaaggcuuagucagccauggcaaggagguggggcauuggucugugaguaauagaagccaucagaguuucacacuggaugguggcaugguugggccagucacggaguagacaguuacagagggagacugacuuggugugauucagcaaugguuuaggaaauaaauaauggggacuugucaaguggugugauguguacaugcauguacauuaaaaguaucaggaguggggacuuuugggaggugauucuguugggaggguagaguuacauagcagguugucugagaccauuuuuuaaaaagaaauccaguuaacagcauuuauggaagaaaauggcaacauauuuuaaaauguguuggucuugcuuuacagaguuccuugaaugugacuauguugcuucauccacagcugaacgauuuuggauguuggguucuagguccuggcuguugcuggucugcuaggauccagggccuuguugacaucugggaagauguaaguagggagaacagauguuuagguuucccuagcagaaguaaucgcagcucucauauuucuccuggagucacagguccuuuuagggcugacuucauaucucuuaggccucuuggagaacaggagauccuagacuuuuaugguagcuguuaaccaggaaaacuuccuuauguuaacagguaaauugucccgcugaaagccucaguuuuagauguggccacuagauggagccagagcacugguaugaaggagcaccagggccguguaaggcaaaagaggacccagaaaaagaaacuuaacuuguucacuccugagaaaccugcaagucaacaagccaaggaagugccuuugcaugcauuugguagccuuuccaaucccgcuuauuacauaauauguucauguucauggcaaaaaaaaaaaaauaaaauaaauaaaaaaggaaaacaaaauaaaaaaaaucuuagaacauug

SEQ ID NO: 12292 - RNA, 5348 nt, Mus musculus
aacagaaaacaccuuuuauuaucaacuuuagcccucagaccagcggacagacuagagguguccccuaggcauaguauuguagguuggcuuucuucuuggccugaaccuccaggaugcccuccauguaguccucaugagugaguuccguggcuccccugcgcaaugcgaucauacccugcagccggacagagaagacccagaaugccucccugcacuuccaacuuccuaagugugggucccugaccuacccagggaaagagcaaggcuuccaauaacccacccacccacgcugaccacucaccgccuccacacacacggccuugcacugggcuccauugaagucaucagugcaccgagccagcucuucauaguucacaucaggacuggagaaacaagacaccacagagcuugauuagucacggagagggaacagcaaagggaagauguccuacuauguacccaucgcacaauaaucaacuugcuuucugcuagcaggcaagucuuuacugacuuuucuucucaguauaaaugagauuggacaaagcuauuuacaggaucacugauacaccagacuucuagaacccugcaucugagaucccaggaagaaaguuugccugaguugggaacaugggguuauacagacaaaagacaguaggauugcugaugaagccgugcaucauccagcacgauguggcugcccaucaucugcccucaugccaggcacugugccugagauucaccguggcuaauucucaaguuucaaaaacaacagacuuuagagguuuaggucacgugcuggaaacuggauagaucuaacuucagcucaucugguccugguuagauucuccuacgccaugcuugggcugugcccaucuacugggcugugcugugaaggccuauauucuucaaugggaggaugaggcacaggugacuuugagggucugagccccaacaaaacucuaccucaggcugugggggagaaauggaggcuaugugcaugcacagggugggguuggaguggaucagaggcuggggaacaacaguacaggaguuuaaaaauugggggcucaaaaagcuguugcacugcccggugugguggcucacgccuuuaaucccagcacuugggaggcagaggcagguggauuucugaguucgaggccagcuuggucuacaaagugaguuccaggacagccagggcuacacagaggaacccugucucgaaaaaacaaaacaaaacaaaacaaaacaaaacaaaacagcuguugcagcugaccugacauucaucuuccgugaguggaucugcaugauucuggcucuggccuccucguugggcauuggaaacucaaucuugcggucuaggcggccugagcgcagcagggcuggauccaggauguccacccuguuaguggcugcaauuaccuaaggaagaggggaagcagcaaccugaacagaagagcaggccauccacucacaagcacaaguuccaguaggaacagggcagccggggaauggggaaggcagagcccgagcugucaguccugagacagacggugagcccuguccucaccuucacuugaguguugggcugaaagccguccagcugguucaguagcuccagcaugguccucugcaccucucggucuccugccuuuucacugucgaagcugcgguacacaggagcccgagaugccagugacaucacggcauaagcacaggcuauuccaauuuguccagggaaaugguugccucaacuugaggcucccagcccagggacugguacagagaaagguucaccaauaauuaacugcagcauucaaagcuugcagaggcgucugggaucagugcugggcuagugacaaacagugggcagaaauagccagggccagggcucuggcucugagcaaugcaugaucccagagaacuuugcucagaaauaccuagaaucaggaacccagacagccaaccccaaggaaggguuuuugcguuuauaaacaauggcuggcaaacacccagugaauggaaagagcugaaaacuaaucagauacugggaggauaugugugucggggagagcgagacuggaagaacgggccacacaaaucuaguauuuaugcuaaggagcaauggggugaccuaggaaugguucuaaauaguguaugacagacuuugaaaacaugugaaaugaccagauuucuuuuuugagagcaagguguuagcugugagaauuuaggaagcagaaaaauagaaguguuacuacccagggagagggggaaacaggaugagaaagaacuagaauuuagcauagcuuggaguugugcucccagcucaccccucaccccaagaacccucaagucccuagccguccuuuaccguuugguaccaauggcauccaauucgucuaugaaaauaauagauggugccuucuccuuggccagggcaaaagcaucacggaccagcuuggcgccaucuccaauaaacaucuguaccagcugagggccugccagcuucaagaagguggccugagagaagggacagaucagagcaaaggcacaagaggcccaaagagucaagccuaugucauacagcugcaaguaccccuacccccaccuugccccccacccccacacaccuuggucugagcagcacaggcucgggcaagcagagucuucccuguuccaggcggcccauacaucagcacuccuuuugggggcuggauacccaaguucucaaacuucucuuugugguucauaggcaagacaauggcuuccaccagcugccaggaagaaguccugggugaggaaagugaugcccugagggauccuacagcccaaaucuagucugcaucuuuccuacucuaaugcaggagucuucucuccucucacaccuggucugcacuggucccauggcucagagaguaagaguguuugcugugcaagcaugaagaccuaaguucaaaucuccugcacccauguaaauauccaggccuauaaaacacaaguccauaaccugggugcugugggucagagucgggaguuugcagccuaguuccagguccagccagggaccauguaucauagggaagaguagaguacagaucaggcuauuugacauuuucuguguauguaagcacuuacacaaguacuuacaccacacacacaggaaggagggagggaaggaaggaagacacuggggcaaaaacugggagccugaguggaguuuuugcucuggcccuuuauguggacaaucuccaaucucucuggaauccaggcuucgagcaccugacagucuuuguuuugucuugguuguuuucuuuuuccuucccacaguaagggaauacacucuggucaguuagaugaaaaaguaaaaaggcuggcauggccucccuuaccuccuggaucugcuuguccaggcccccgaugucacuguauugcuccgugggccgcucguccaccuccauggccuucacccgagagucauauucagugggcagggucuccaggaucagauaggagucuuuguucacacccugagaacagagcauggagcuuuuguguuuaucccgguucugucuaaugcuccagaggacagugauuuguagucuaaacagagagcuacagcacuggcaaauugcaagaaucaaagaggcugcagacagagucgcugcagcaguggcaaggcagcuuacuggagaaucccugcccgugcgcagguaucacucaccaccaggucuccuggcuucagcuuuucugcauccaccaacccaaucacuggcaggaaguaugucuguaggaagaguuacaggcagucguagcuacacggaaacucccccaugcugcccccugcccaacugugacugagccaaccuuaccugucggguagaaguuuugaucaccgcacacuugcccuuccucugagaguccaggucaauguuggcaccauccuccuccuggucauuggggucaacguccagcaacuaagaaagaaaauaggcucaguucccuucccaaaauccacuacugugugugcucaaacaguucccuaaacccacaaggccacaggccuuccuucccuccucagucuagccuuaagcuuaauaaacauagaugauguguuaggggguugacaacaccuuuguugaggugcugcuucuguuugcaaaguucaucugccccaagaaggaacaaaagaagaaaauggcagaaaucugugacacuucuaaggucuuugcagacuuaaacauugcuuuuuacacucuacccuaugggccccaucccuagaugucuccaagccuccugccuccuccucuucccacacacagacacacaccucgaugacauuggagacaagguacggcaggguuuuguucacuuugauuuucucacuguucucuuugauuuugucuuucauggcuuggaguucaugggugacucgcaauacuucacucuucaugaucugggauaagagaaaaccaauguucaacccugauucagccugcauucauuacagcccucuaauagaugagguccagguuacccgggagacccauccaaccagaucucaggcuuucugaaggcccagccuguacauguccaaacugcagaggucaggacaagaggccagugggaaaaccuccugacaaagcggcugugggacagggcuagguauuuuccauggguuugagugugaauucaucccucucugagccucggguuccucaucuguaaaauggagaucugagaacuccgcugccugcaccggagccaggagcccaccuugaucucgcugucuaacagccgugugcgcuggacaaucucuuccguggacaucuugagcaccuccuccccaaugccaucuugcuguucaaauaagagaagaaguacuuauuuacuguaacucagagcugccaucccacggucccacagcccccucagcgccugcuuccuuaacccaacagcaggaugaagucgggacaacccaagaagcucugcaaccaguccagaccggaccuggccuuccagccaccuccuuucccggccuccaagaacgucuaaccuuauagcccaaacuuugggacgccccucaggucucccaacacucaccucagcuucaucccacacggucgccaucuucuccugccgagucacuggacucucgggcgucggcagcagauucauuuccugcaugaagaggccgaaacugggagugcgcacgagccccugagggagcccagcgcagccuuucucaacgucuucucuccacccguggagaacuucacccgcgauuccugacgcgacagaacggguucuguccgcgucuccgagcgaaucugccgcugggacuccacgaacca

SEQ ID NO: 12293 - RNA, 57004 nt, Mus musculus
cacugagcaugcgcaucacuagggcgguuagauuugaauacuucagggacguugagaggugacguccgacuccaaggagcgcgaggaccccagacaagucaagcagguggucgguggcgggucagaaugcuccuuuccguucugggcuccugagagggcucggguucuguuugagugcugaagggcgggcgcggguugcugaggucgcucggucgucggggcgaucucggaaaggcccugcagccgaccggaccgcgcgagcgccaacggcccgcucuccuucuccuggagcgccgcguuucgcuucuccuuucccaaagccgcuccauucccggggucgugucgucugcgcggugcgccgugggccuccggguucgccccgcccaucaucuuuggucagggcuccgggauccggucccaccgucucucgccaacuccuugugguauguguuucugaccgacguucccugcuuccguggucugaaggcgacgagugaacuuuaaauuguaggcuccguccgagcacaauaauagaguuucggguuucugcagguccaacauuaguaaagacaaaucgguguguuagauuacauaaauuuccuuucccauccaaaagacuuuggauucccuuugggaagaaaaauauugccuacugcaauuuuuaaaauguacuagacguuguaguuugauuuaugcucauauauuugaaugccgagucaacugagaguggcacuguuugaaaggauuaggaggagggguggccuuguuggaggagauguguuaaugagggaugagcuuugagguuuccaaaacucugccugcuguuuguggacguucuuggcuacuccuucagcauuguguuugcucgcagguuccccaugaugacugcuauauaagucucugaaacuguaagcaagacccccaauuaacugcuuccugcuauaagaguuguggccauggugucucuucacagcaauaaaacugugacuaagacagaaguuaacagagauaaagcauguggcuaaaacccaaagcagcaguuuauucuagacaccaagguugaccguuaguuuucauuucaguuaaauugguuccguugagucccuuguaugucucauagguucauugucuugugcuaaaguagacuucauggggauggcauuucauuggucagauuguuggagagaugauuuauaaauauggaaggaaauauaucguaagguauuuggucauuaaagguuagguucaagcaguguacuucuugacuaugugaauggcuggaaaccuuuacaaguugauagauguaaauggaguaaaauguuugggauggugauauaaaugauguguuugaugcugagaauacgagaagguacugauucuagauacuggaucgaacaagcguuuccaauagaauuuucugugauaauaauauucuauaucugcacuguccaacaugguaucuauuagcagucauuuuuggcgcacuuaaaauaugguuaucaaagaaauguaguaugauuaccaaaaacuugaguuuuaauuuguuucaucuuaauuucauuguauauaaucauucaauuugacagcacaggucuagagucuguaucaguggagucugaaucagugaaaauguuuguauauuuugguuguauaaauucaggaauggacaaagagccagauaguauuuaggcucugcuugcugugggucaguaugauggucucugcuacaugauguuuugguggugauguuuauuuucuucaguuaaaagaaaguucucaaagguugcuuuggcccacuguuggucugcagaccccuggauuauuuagacugguggcucaaacuuuuugguucaaacaguccaaaagaaauacuuaauauccucauuuuuauauagcuugguucaauaaauuuaaugaguauguccuaacaacuugguagccauuugguaaguguaaguugaaggaaaagauaauaaacuuuuuucuuaaguaaucaaguuacuaauuaaguccacuagcuuuuauucauaccaguugccaaagcucuuacuucacaaugauacgguauuauugaugguaauguagauagauaauauuuugaauuaguucaugcagugccugauagauuucaagaauggcuguuaaaaaaacuaguaguauccaaaaaccuguaaguauauaaguaaaaaccuguaacuauaugcuauaaguauaccccuaaaugccaaauguaguuuucuagacaaucaauaauuaguaugaaugugaucaaaagcauuuuauaaguacgguuuauuacagugguuuaggggcuugaccuguuuuguuaaagguguaacacauggguuauauaauaaaauacacauuuaaugaaauuagagacuuccagaaaguuuugaaucucauugguuaagugguaacuaguucacaaguuggagaggaaugguucucaaagacuuugaaacaacaaugguuuagguuaccuuggguuaauaguuccuaguaguuaccuguuuugaguacagaacuuaaaacuauuccuguaaaagauaagcugaacuugaaaugauuucuauagagcagugguucuucagccuugcuaaugcuguaaccuguuaauacaauuccucagguugucgugacccucgaacauaaaacuauuuuguugcagcugggugugguuggcacacaccuuuaaucccaggauuugguaggcagaggcaaguucuaggccagccugggcuauagaacuagcuccaagacagucaaggcuacacagggaagcccugugcugaaaaacaaaaacaaacaaaaguuuguugcuacuuuauaacuaauuuugcuacuguuaugaguuguaauauaaauauguaauaugcaggguaucugauaugggaccuuugugaaagggguuuuugguucccaaagaggucacaauccacagguugagaaucacuucuauagaagagacaaauguacuaguuaauaguuguaagugcugcauguuuacuugugaaggggacucauucagaaaauagccauugagcuccuaccauuuaaaaguacugcuagaccauaacaggaaacucaagacacaccacuuuauuuucauaacuuucugcugugguaaagguauuugagcgaagugauagaaacacccguuaauauauaacaaguuauauaacaagauuuuaaaguacaguuguaaugcuaccaagaagacuuugucuuucuugccaagagagaauagcacuuuauuaguacacuaauuuguggaagaacucuguauaggacuagaacagcgaguguggcuacuaaaaucaggaaguagucaggaguaaugaagucugagagacagccagagaccgucucuucuaagccuuauaggucccagugaagaaggucaauacaguagcaagcaauugcuuuaaauacauacauuuaugagcugaagagauaguucacuaauuaagagcacuggcugaucuugagaggaagaaccuugauucaguuucuuuuuuuuguuuuuuuuuuuguuuuuagguuuuuauggauucuuugaguuucauauuauguacccccaucauguucugcuccucuccccguccccucauaucagccuuuugcucuugcauccuccuccaaaauaaaacacacacacacacagacaacaacaaguccaaaacaaagcauagaaaacaguagagacgguaguaguauguuauagugugacccacaguacaucccucugaccacacauuucacuugaaauguucauugcgaucagucauuggucugguucaagaucucuggcuucugugacaccaucaguauuggauccucuuugggacuccucccaguuauucuguuguuguccuguaucauggagauccugcagcuuuggauucuggggugggccaucucagagcccuggaucugggucuaagugguaacagcugaucagcucauuaguucucccuuaauuacaccaccggugcaagcuuucuaccacugcucuggcuaggccggccaauaccaccaucagcaggaggcagggucagcucuccugcucucaugcucuugggacuaacucaccugugccccuuccaccagagccagcuccacugugcugcccagucaaggcauagggcccacucucccaagugcugcagccuaugaggggcugggaccgcucuccugcucucacacccuuggggcuggcucaucugagccccuuccaucagggccaacuucacugugcugcccaggugcccuguucuucugagcgcuagccagugagggacagggcuagcucuucugcucuuaugcccgcagggccaacucuaccaauuacagcaaguggcaaggaggaggacaucaccccacacucacacacacaccaccucacaacauaggcgugggcccaacucucccgugaucucguccuuguccccucaacuaggaccagaagacucuguggcccagaagugcagggacugcucuuccucuugcagcagucugcaaggaacaggaccugcuuacccacucuuaugaccccagggccagcuauucugacugccaaagguggggagggaugagagcauccacaccaccucauaguagaugagugaguggcagggccaacacucccuggaucucacccucaaggcuggugguucaccugugcuccaccaccggggucagcucugugugcuguccaggugggguucagggcccauucuccugaugcugcagcuggugaggggaggggcagagcuauaucucugggaaacuuuccuuccugcuggaggggguugcaaagagugccaccccauggcagaugaguggcagggucagcucucuuacacuuaugcccuuggggccugcucacccauaccuccaccgucaggaucagcuuuauucugcugcccugacaaggcucagggcccacuccacugagugcugccagcugugagagauggagccggcucucuagaguacugcagccaccucacagcauagacgugggcccaauucucccacaauuucguccuuaggacuggcucauccuuguccccucaacuaggaccagcucuacucuggggugggccaucucagugaggggcagggccaguuuggcacagccccuggacauccaagugguccccgguggcugcucugaccaaggacuuccucauguucuguaguggaaauaugagccacagacaaggacaccgaccccugcuacaugaccccugccacugaguaggcacaaagucagaaauagcaccaguggcagggcuggucacucacaacagguuacuucuuucuucccccgaaugucuaguuccaucuuucuucuugauguucaagcuguuccacuucucuuucucucccaucugaccaccaaaugcuuauacauuaugguggcuccagcugcaggcuggccacauggcuggcaggucccugggugacauccuccaucuauacugcauggccugucuacaagcagaugucuauguccccccugugccuugcacuggagggcaggucuauggaugucaugaugguccacaggucucugucuuccuucuuccucccugcacugucugaauuugauuugauuuuuuuuaaagauuuauuuauuuuauuuaugugagugcacuguagcuauccucaagcacaccagaagagggcgucagaucccauuacagaugguugugagccaccaugugguugcugggaauugaacucaggaccuucagaagaggagucagugcucuuaaccacugagccaucucuccagcucccuugauuugauuuuucagcagauccuuuuuuuuuaaggauuuauuauuuauuauauguaaguacacuguagcuguccucagacacuccagaagagggagucggaucuccuuacggaugguugugagccaccaugugguugcugggauuugaacccagaaccuucagaagagcaguugggugcucuuaccagcugagccaucucaccagccccuugauuugauuuuuaugaguucuaggcauaaaacaacuuuugacuaucaagccagaaugaacaaaggguugccacuuacucugccgcugcuuaguauaaaaacaguaucaccaacaaggcgucucuuugccccuugucaggggguuugguucaauuuccagugcuuauguggcaucucacaacugucccuaacuccaguucuaggguauucaguuuccuuuucugaccuccacggacauacaugcaaacaaaacacucauguacauuuuguuuaaagcagucaagccaguuguggugauccuugcuuuaaaccucaacacucaggaggcaaaggcagaaagaucaucugugaguuugaggccaguauggucuguauauauugaauuccaggccagguggggcuacauagugagacuaucuuaagaaccaaaaacaggggcugcagagauggcucagugguuaagagcacugggugcucuuucagagguccuggguucaauucccagcaccuacagggcagcucauaauugucuguaauuauaguuccaggagaucugauacccucacaccaaugcacauaaaacuaaauaaauuuuuuaaaaaacaaauaacaacaaaaacucuaaacccaaauacuuauuucagacuuaaauucagacuuaugaaagucuguucccuaaauuuggcuuuuauuuuaugugaaaaauauuaucuuuuagguaucuuauuuuuccuuauuguuaaaaguaagaacauugauacagagaaacccugucuugaaaaaaaccaaaaaaaaaaaaaaaaaguaagaacauugacuguuaguagguauaugguauuaauuuaauguuaugauagaaauggcuaguaguaguugucaaacuuuauagcuauuauuuuuaaaccugagaugucuuuucuuaccugaaaauaagguucuaguuaaugcaugcagugagaaaaucuuguauguauuuauuuugugugaguuauacugcagaugugaaggucagaggcuaacuuaaugggagucuauucagguuuucuccuaccauguggauuccagugauugaccuuggguaguuaagccuagugacaagugccuuuaccugcugagcuaucuuaauugaguagauuuccauuuccaauuccacucaacacguauugaguaaaauuccaauuugaauacuugacuauaguauauaaaacaugaauauuguuggaucuaguuguacuuuccuguaaucaagguugcuuaggagacugagauaggagaauuaaaaguucaaggacagccuuguacagaaugaguucaaggcuacccgggcaacuuagagaauaugaauugugcuguugcacacuugggcuuucaagaaaaacugaaaaucuaauuauuuuauuuuauuuuuuuaaaagauuuuauuuauuauuuauuuuauauguaaguacacuguugcugucuuaagacacaccaggagagggagucagaugucauuaaggaugguuguaagccaccaugugguugcuggaauuugaacucagaaccuuuggaagagcagucagugcucuuaacagcugagccaucucuccagcccccuaauuauuuuaugaaaugaaaaaaaaaucuugagauuuuugcaauuugggcaauuaacuaaaaaauuaagaaucauugcuggggauggagacggggugaggggccagggggggaaggggugagcgggugucagcucuggcagguccucuuucuugugcuuauucuucuugaggcagcagcagagcgggaagagcauccuucgguggggguaagauuuggucuuacaagguauuuaggauugcuauaucauaauaaaacauuuccuaucuuaagucuaagucacuugccgcaguagcugaccugccuuugaacuccucugaggcuugaaacugguagcaccucauccuaaaacagcagagaguaaauaaagcagccuuugcucgagcucugcaggaacugugccgcucucacuuucagccugcugguugaagucacaggaagagaaagcgacacuuugaaaaguggcuuuagaguuuauuucuaaauuguaaaaaauuuccuaagaaagcucuuuaagaaaaaugggaauggggcuuguaaaaaaggggggauaagcgggacaaggagcacuaaaagaggggauaaggagaauaaugccaagaaaagugggacaaggagaagugcucuccucuuuguccucagcacuuauacaucuuucagcauacaugaucacgugauaaaagguucaucacaaaauacauagauucaaaucauauaaguuuacaauagagauguuuacaugcauauucauuagacuaucuggcuaaacauucaucaccugucacaacuccacaaguucauggagaguuaaaaccauaauuaaguuauuagugaaguuuuguauagauaaauccaguuaguauuuuaucuucuguccuagcaccuauaauaaauuguuaguucucuuuuuaugaccuuuggucaaugguuuuucaaccuuuuggacugugcucugaguaguagaaugccuacuuacuaucuccgaagccagauugacagaguucucauugcaguuuugauuaccagaaaggaccuaauaccaguccgacuauaagagagcuuaauaaauacugauauaauuuuaggaauucuuauaggauugucauuaagaauuaagucaucuauuugucuauauagcaucacuauauaagacuguauaucuuuguucuguaaagauuugcucaaaagggugggcuaauacguaguguuauauuauuauuuuuuuaauauaaauuauuauauuuaaguacauuguagcugucuucagacacuccagaagagagcaucagauuuuguuacggaugguugugagccaccaugugguuucugggguuugaacucaggaccuuuggaagagcagucggugcucuuaacugcugagccauuucaccagcccccauaaucuaggcagcuugcugaccuguacggggaacgaacccacgaacuuggcauuaucagcaccaugcucuaaccaacugagcuaacuggccagguuaauaacuauaucuauauaucuauagaugaagauauaccaggaaaagcauauuaauagcagcagucuuuccuaaaaugaauuucuccuuguccuugccuacuggagcaaacccaucauagauuuuuuuuuggggggggggucgagacaggguuucucuguguagcccuggcuguccuggaacucacucuguagaccaggcuggccucaaacucagaaauccaccugcuucugccucaggagugcugggauuaaagucuugcgccacaaugccuggcagauuauuauuauuuuuuuuuaauccaagauggaccaucucagaaagaucacuugcuaguuauuagcuuguuggcuucugacacaccauguauauguuaaaacuuagggacagguaugguggcacaugccuuuaauccuaguacuuguagcaauucuccuugccucuuaccuccugaguucugggauuauaguuauguucuaucauacccagcauaauucaauuuuccuaagauauauccacuauuuuagguauccgauugacuuccauuuagagguugaauuauuauguaauccaaguauuauauuaucgaauuaucaugcaaauuaggccagauuuuuauuggaaaguccaugccaucgugcucagaguuagucuacaaauuuuaucuugauuugggggggaggggguagggauggaggacaagagggauggcuucccucuugauacagcccaggcugacuuggaacuugauauguaacugagacuagcuuugaacucuuucuucuccugccuccaccucccaagugcuaggauuguaaggaugaccacaauaccuggcuucgauuuuuacuuugaguauuaauauuccaguauuaaguauaacaugguacuuacuguccuacauuucucauguuuuagagcucacaauguagucuuugcuucuuauuuuuagucuucuaaagucauauccaugcuccuaaucuaccauagguuauauuuuucaucuuuuuuuacuuguuaauacuaugugccuuuuuuuuuuuuuuaacagaaaaaaguuuucaaaaauggaugggguauauucagaagcuaaugaagagaaguaaguugauucggugcugcugaaauguuauuuucuauuacagaaaggccacuucaaauuaguuaagaacuaucaguaaugucugaaguuguuuucuauuuuguuccaaguaaaagaagucaguauuacaaagcaauagcuuuucugccaugucuguauaaguucauuagaguaagaacuuaagacuugaaggacuuucauagagaccaccucccaucucauuaaggucuuaugagaugaauugauuucuccaaaauugguaccauaaacuagugauccguuugcagccuaaaaaacaauguuguuugagacagucuuacuaugaggcucuuggcuggcuuaaaacucauaaguagaccaggcuagccucaaacucagagaaucaccugacuccaccuucauuaaaggcaugugccaccacaucuguuccuaauuuuuaauauauaugacacuuaauuuuucagauaauuaccaaaauugaaaaaaucucaagauuucauacaauaauuagguuuucaguuuuucuugaaacaccauguuggcaacaaaucucauauucucccuuggaacagguaacuaguagaauguaauggcagugaucuuuagacuaggcaagaacuaacacuaaacuauacucucaacuucuucuaggcccaccucuuugguacuagaaauugaauuucagauuucauaccugcuaggugagcgcucuaccacugagccucaacccucagucuucuucuauguuuugguuugagacagggucucacuaaauugcaaagacuggucuugaacuuacuugguaucugaggcaggcccaaauuugugacccuucugcgucagccucuaaacagcugauuacaggcuguaccaccaggcuugaccacaaugugccuuuaaaacauuguauucuuaaaugcagaguuggaugucuuauaacacauaaaggaugaauugaugacagcuuugagaaauucaguuguuuaucugcauauacaauaauuuuuccucuuuuucuuuuagugacaauacacagagaccuguuagaagacagcauuccucaguaagaaauauuuuuauuuaaauuaauaguuguuacuuuuuacugaauauaauuacaggaauuuugauuguggcuuuaccuuggcaucccagcuacuuuuuguuuguuuguuuacuuuuugagacaggguuucucuguauagcccuggcuguccuggaacucacuuuguagaccaggcuggccuggaacucagaaauccaccucccucugccucucaaaugccgggauuaaaggcgugcgccaccaccgcccagcucccagcuaccuucuuacugcuuucuguguaaagacucaaauagucugguuauacauuucaaaacuguacuaaaauucauauuuuugcacuuuuuuguaauuuaauaaacuuuugguuagcauauuucuacagcauugugauauuuuaaguguuuauauaauaaauuaauuucaauauuauaagugcuuaaaauguauaaauuucuuucuuuuuaaaauauguauauuuaaccuggcauucaaacuauugcaagacaaaaguuuacccaaguugauucacauaguaaauucauguuauauuaugaaacugaaaaacagugguauaggaugcuguguguagaaguuacccauaagggauucugacauaacucugcuggaauuuucuuuccuuuuuuucuauuucaacugcuuuuggguagguuuugcuaacaggcauaauuuauguaauuauuucugauugcuaugauauaucuaguacuucuuauuucuacguuuaauuucuguguaaagaguuugauguauuuucucaagguaggaaaauaggacuuaguacugaauuguguuagugugauuauccuauuauaggacaugcccucauuauugaacugcacauuaugaaaaaacaaacugcagacuguuagauggucucauaccccugaguugguguggagcguuauccagaacacuuagaagauuuugugcaaaagaauuugggugagugggucaggagaaggcauaaaugucagacauuuaagucagaaacauaacagugaauaauaugacuuugaagaaucucagggauuuuaauugaaauguuagcucucuacucauauaacuuaaauugacuaguagcuacauuaacuuuucuugacuaauucgaauuauugccuuuagauuuugaaacccccaaggaguccucuucaggaccucaaauguggaaaucaaacaaaccagguaagucccgagugcaaaugcucugcaauuucagggacuuuauuuuggaggacuugguuugcugagauuugguuucacuuacauagacugagagacuuugaaccuguggcaguucuccaccugagcuucccaagagcuuggauuauagauuucugucaucaugccuggcuucagagaucaucacaaaguuuauuaguuaugugaagagauaauacuauaaauguuucccauuuaaauguauacaggagggggcuggugagauggcucagugguuaagagcaccgaaugcucuuccaaagguccugaguucaaaucccagcaaccacauggugguucacaaccaucuguaaugggaucugaugcccucuucugcugugucugaggacagcuacaguguacacacauauaauaaauaaauaaauaaaucuuuuuaaaaauguauacagguaaguaucgcauugcuuccauuuucuuguucaagagcuagagauauaacucaaugcuuaccuacugugcaugagguugugguuauugaauaaguuggcauuuauaauuuuaaaauuccauaggauuagaauagggaauaguauuuugacucuuuaaccuagaacaggaucuaguacaugcuuuuagcuaucuggccuccguguauaacuuuguacguggauguuagggauuggaaauucaguucucucacuuauguggcaagcacuuuaucuacucucugucaugccuacugugacugauuagaccuuugaccauauagacugcuuaauauagauagcauacuguucuugguucuuuuuaaguuguauuuuuaacuuauguguauaugugaaugccugcacauggguauguauucuauaagccuggagcccacagaagccagaagagauaaccagauccuuuggagauguaaauacagauaauuaugagcuucccaauuggggugcuggaaaccagaccugaguucucugcaagagcuguacauauuuuuaacuacugagccaucucuccagccccuucaaagagacacauagucuuagcagcauuaaucacaguagucaagagguaggaaaaaaaucaagugcccaucuauuuuguuuaaauaaacaaaauuugcuauuuauaaauaaugaaauucaguauuaaaaaucugacacacaauagcaugcaagugucuuaaagaaauaaaugaaaagaaaaagucucaaaaagacaaauucuacucauaccacugauaauaaccaaauaccaaaauagaaugcugguugccaaggauuuggaggaaggaucuaaauguguauuuuacuuauuuguuuuaauuuuguguaugugucauaugcacccucaugugaaagugcccauggaggucacaaaggcaucagauacccuucuggaccuggaguuggaggugguugugaaucuccuaacacgggaaaugaacuaugauacucuguaagaguuguaugugcucuuuacuacuaagccaucucuccaauggcucaauauguauaguuaucguuuguaagaugaagaucuugagagugguuacacaacaagaugcuuucaucacuauugaacuguauacuuuuaaagugcuaguaaagaugagggugcugagaugacucagugguuaagaacacuuuuugcccuugcagaggacacagauucgguugcagcuaaguagcucacagcuaccuguaacuguaguuccagaugaucugaugcccuuuucugacuuccauggcgccugcauguauauggaauacauaaacucacacaagcacacauaaacacauuuuuuuuuaaaugguaaagaugguaaauuuaacuuuauguaguuuuuaccacuaacuaagaaguguaaguacuugucaaggcagagugguuaagauguaaauuauguuauggcugggugugauggcacaggccuguaauuucagcacuaggaacaugaaauuucaaauucauccuugggcuuuauagcaaauuugaauauagccugaacuauggacuauaauaauuacaacaaucacaaaagauaguaacuuauguggauuuuacuauaaugaaaguuuuuuuagauggacaaguugcugcaugcuuuuaaucccagcacuagagagcagaggcaggcugaucucuaugaguucuaucuaaccuggucuacuuagaguuccaggcuagucauagcuacauaguaagacucuauguuacaaacaaacaaaaagcuguuuauuuguaauuguagaauacauuguaauaagaucaauacagcugaccacauagcuccuguuuugugcccagucuuucuuguuauauauuguuuguuaguaugcuuauuucuacuugauuuuagccaaaaggucaaaaaacaauaauauguuuauuuuaacucuuacugaaaaucaugcucuaggaguggugacacacaccuaaaauuccagcaaucagaaaccugaagugcaaggauuaugaauuugaggucaacaugggcuauguauuugaaaacaaaguaacaacaaaagaaaauacauauuuacaugaaccacggauucaauccugaguacuacagccauccaaagaguauuuggaaaaucauauucauguucauuaagugcuuuuauauugggcuguuuggaaaucuucuauuauuaauucaaaauaagaguugaucccugcuucuaauagucuggagaucuaguucaccaugauuuauauuaagaauuguauccuuuacuguuuucucuuaggaaccuaauccuccaagaaaaaggaaaagcucucgucgagucagcuuugcagauacuauaaaguaaguugaaaagaaaguacauuguuauagguuuuucccccuaucaaauacaugggugggaacuaaauuggauagucuguuugcuuaaauaaauauuagagugcaugugugcgugcguguguuccuguguaaguaucuuccucacucuccacuuuacuuuuugagacugggucucucuggucuggagaguccgcucagcaguuaagagcacuuccagagguucaauucuuagcaaccacaugguggcucacaaccaucuguaaugggaucuucuggugugucugaagacagcgacucacauacauacaauaaauaaauuuguuuguuuguuuguuuuuuguuuuguuuuuuuuauuuuuuuugagacaggguuucucuguauagcccuggcuguccuggaacucacuuuguagaccaggcuguccuugaacucagaaauccaccugccucugccucccgagugcugggauuaaaggcgugcgccaucaugcccggcauaaauaaaucuuaaaaaaaaaaaagagagagagagacauggucuuucuaucaacauggaacuuauugacgcagcuagacuggcuucuuuaugggacccagggggccuccagucucuauuucccagcacuggaugggagucuaaacucaggucuucauguuuacauagcaagcacuuuacugauggaguuauccucucacaaccagaguauugcuuuauuuugaaaaguacuuuuuacuuaaaauguauucgugugugcauguauccugcccuggcaugugucuggaggucaggggauagcuuuuggcaguuacuucucuccuucuacuuugggggauugaacucaggcuguugucuuucacaucaaguacuuuuauccacugagacaucuugcuggcauguuuuuguuguuguuguuguuguuguuuuucaagacaggguuucucuguauagcccuggcuguccuagaacucacucuuuagaccaggcuggccucgaacucagaaauccgccugccucugccucccaagugcugggauuaaaggcaugugccaccaucguccagcuauauauuuuuuuaauuccuuucaaaauauauauuuaugggacugaagacauggcucagcaguuaagagcacugguugcucuugagaggaccugaguuugauuccuagcucucacauggcagcucagaaccaucuaugacucgagcuccaggagacugggcucucucuuuuugccucugugggcauggcauacaugugguguacaaacaccaauauacauaaaauuaaaaauguaaauguauuucuuauuggugagagugcuguguaugagugugugugauuugugugugaguguggguacaaaauuguuuuucaaauguuauuauucgguauuaucuauauaagagaagcagaaugaguccugaaaggcaguaacaaaacaaagauaacuacuaauauugcuacuauuuaccauuguaguagagguuccagccagcaaaaguaaaggaagagauuuuaaaaauuagaaauacuauugagguacuuuaugccgucaauaauaaaacaauaggaaauuuuuuaaaaauaaaggcuuuucaguauucuuuuuuucucuucuagaguauuccagacagagucucacaugaaaacagagagaaauucagaaauuucagguaaauauauaauuucagucccugcuaaucuguuuucuuuacaacuuuucugugguuauguacucauaaccccccccucucucucucucucgugugugugugugugugugugugugugugugugugaagaaagcauacaucuuaagacauguagagucaagagaaaguugagauucucuuuucuuucuaccauguggucuucaagauugaguuuggguccuucuuggcaguaaaugccuuugccgccuaaguuauuuugcuagcucuaucauacuauuuaauauuuaaguauuuuaucuuaagggauagagaaguaguucuauugguaaggcgauugccauaccuacaugaggcccugaguuuggaucuccaguaccuauuuaaaagcccaguguaggcuaguuguggugaagugguggagggugacagaugaagcaguacauaccuuguauugguuacuuuucuguugcugugauaaagcaccaugaccaaggcaguuuauaaaagaaauagguuauaagagucuaucaugaagcugggcgugguggcgcacgccuaugauccagcacuugggaggcagaggcagguggauaucugaguuugaggccauccuggucuacagagugaguuccaggacauccagggcuacacaaagaaacccugucucaaaaaaacaaaaccaaaaagaaacccaaaaaacauguacacaaacaugugguauacaguuguaauccugucacccuggaggugaaugcaaaaggaucagaacuuuaaggucauccuugguuacauagcaaguuuaaguccaaccugcgauacaugagaugaaauauaaaaaauaaugccaggugugguggcacacaccuuuaauucuagcacuugaaaggcagagguaguuggaucucugaguuugaggucagucugaucuagauagugaguuccagauacauagacauugucucaaaaagcaaguagauaaauugcuagcacagauaagauuuauuuuuuuccaaaacagaucuaauaaucacuguuuucuaucauuagaaaaggcucucagggacugcaguauaacucaguaguagaaugguugcuugccaugucuuggguuugaucuucagcauuggaggaggaaaauaugagcucagaaucuauuuauuuauuuauuuauuuugguuuucugagacaggguuucucuuuguaucccuagcucuacuggaacucaaucuauaggccaggcuggccuugaacucagacaucuaccuaccuuugccaccugagugcuggauuaaaggcguaugccaccugccaaucuuaaagauauuuaauucauaaguccuuauaaagaccuuaauaacuauugucuuaguuauuauuuuuuuauuguucuguuaagcaccaugaccaaaaacaacuuggcaaggaaaggguuuauuuuuguuuauaguuguaguucauuuugaugggaagucaggucaggaacucaagacaggaacaacauggaggcaggaacugaaggaagagaccaaggaggaacacugcuuacugguuugcucaacauggcuugcccaucuugcuuucuuauacaaggcagguccaucugguaaggagugccacaaaccacaacaagcugggccuuuucacagcaaucauuagucuaggaaaggcacuacagacuugcauauucucaacugagguucuccuuuccagaugacucuagcugugucaaguucacagccaaacagccaggacacugguaaauacuucuaacugaugacaguccuaagaaagaaaaaaagacuuaugguaugauguuuuucuuacuguaaucuuuuucuuauuguucuauagguaugaacacuuugcuuugugcuccaauucagacucagaugcaacaaaaggagguaugaaaucaugcaaauaucuucauaaauuaaacucacauaguuaacaaaauuuuauuguagugguauaauuuugagauaacuuaccaaagugaauuaucauaaccuauuaaaacuuccuauauuuucaguuaauugagguaaauuaagucauugccaauuuaaauaauacaaagaccuuucaaacaucaaugaucacaugaaauaucucagaauuuuauuaaaauauagaggguuuuuuggggggauugaagauauagcucagugguauuuugccuagcauaugcaaaugucuauauucaauacccaguaucacacacauggaaaauauguauuguguguagguaggauagacagacagacaaguauauguccaguugaaaaggguaaacucuucagagauuguauauauuuuuuaaauauuuauuuuguuacagaauguaugaguguuccacuuuauguaugcaugcauugugugcgagaggauaccagaucccucugaacuggaguuagagacaguugcuagcugcuauguaggugcuaggaacugaaccuugguccucugaaaaaguagagaaugcucuuaacugcugaggcauuuuucuaugccucaagaaucuacauuucuaaccaucucuugaaugacacugacaugcaggugcacagacuguacuuugaauaacaagaaauuagagacuguaucuuugaaaacaagacucuccaaagaaaagaguguaauaugaacuagccaucauguaccuaugccuuucuaagauuuuacuuaggguugguaauucaauacagaugccuuucuaagauuuuuuauuuaggguugaagugacuauucaauacagaauuuucauuauaguuucauuucauacauucagugcuuuuuauuuuuuuagugcaggaggcauguaacuaacuuugaauuuaaauuuuuccuaaacuaaaaggaauuuauuuauagauuuuagcuuuuaaaaagaaauguuugaugccuagagagauggcucagugguuaagagcacuggcugcucuaucagggguccugaguucaauucccagcaaccacaugguagcucacaaucaucuguaaugggaucugauccccucuucugguguaucugaagacagcuaaaguguacucacauauauaagaauaaauaaaacauuuaaaaaaaauguuugagauaaguuuucaccccagucuggcuugaaacuuacuauguaacuaaggaugaauuugaacuuuuuuuguuguuugagacaaagucucacucuguugugcagccuuggcuaucuuggagaacacuguauaaacuugguuagccucaaaaucacagagaucuccuaccucagccucccagagugcugagaugaaaggcaugcaccacucugcccagcucccuugaacuguuugcugauccucuugccuccauuauagaugugaauuaacuuaucuggucuauguugugcuggggauugaucauagggcuuuauaauaacaugguaaguaagcauucuaccaaaugaauuauaucccuagaccuagggaaaaaaauguaauaagaaaguacauauaauaaacuauaccaaggaaagcaauauagcuuggaaccauuacuaauugugcuuacauaguacauguuaggggcuggagagauggcacagcaguuaagaacaccgucagcucuuccagaguuuaaucuccugcaaccacaugguggcucacaaucaucuauaaugggaucugaugcuuucuucuggcaugcagguguacaugcagauugagcccucauauuaauaaaauaaauaaaucuuuuaaaaauauauaauacauguuauaaaauccuuuuuucaaaauguauuuggagcuagagaauuggcuuaguugguaaauguuuuggaugcuuuuccagaggaccuggguuaacuccuacauugcaauuuguaaucaugugugacuauaguucuaggcaauucuggccuccacaggcaccaggcaggcaagugguucauaggcacacaugcagguagaacacccuuacacauaaaauaauaaaacaauaaauuauaaaaaauuauauuugaucuaauauuucuauuuuuucauuauaguucucaauuacagacugcaaccaugaaaggaaacaugcaaaugaucagacagucaucuuuucagaugaaaaccagauggaucugacagcaagucacacuguaaugauuaccaaaggucuuucagacuguaccaaaaaugaaaauucuacaaaaauagauaccacguccuuucuggagaauuuaaagcaucaugcugcaaauucaagaauuaaaaaggauuuagcauguuccacaguuuccuuaagucaaaacauuuucucagaaaagaucaauucugacaacuucauaaaaagauugaagacaggaaaacauauuucgucuucuacagagcuugauaaggaaaaugcugagauaccuguuuauuccaaagacucaaacagugccucuucaacauaucaaaugcaugcaucucuugguguagaugaaaauaguaguaauaggacuagaaucuuuagagaacaagaugaugguaugaauuugacccaaugucauacagccuguauuaagacuuggauuccuccauccacggaggccaaaauaggagaauucaaaggugauaaaacaauuuauggcaaugaguguauggaguugacaacuaacuauacgauacagguuuugucaucagaaaauaauuuaucugaaagagaaacucaaacucaaaaugguaugaauguuacaacaguugauggagcuacagcuccagcuccagagaagaaaacagcccuuaaggauaaacuaaaugcugcuuuucaaggcucuuucccaaacccugaaaauaaaauucauauuaucaaaugucauccuauagagucagaaacucauacagucacacagauuucuagucaaagugccagcacauuggcuguaacuucaaaaucuauauguucuaguccagcuauugagggguauaagacaauuuuucauucuaguagcaaugaugcaauggaacugacuaagugucuaucagcuauggaagaggaaaaaaaauugcugaaggcugaugauaaguauucuaaaauauguaccaauccagaugcuggcccacucagagagaaaacuauuuauuuagaagaggauagcauggacauuaccaaaagucacaccguugcaauagauaauaaaauauuuaaacaugaucaagaaaacauuaaaaaagaaauaauagccauaccaauauuugaaaaggaaauggugcuccgaaaucuuaugccuaugucaaaagaugagaaaagggauguaaauuauauuucaguuccucaaguaucuaaggaaagcuuacaacggagucagacaaacacuuuaucuguuucauugacugacaaaaagauggaauucuuggcagaugaagauauggaucugacuaaaagucacacaacuaaguuaagucaaguuauuccuacaacuuuugacuuagcaucaaagaaugucaccaaaucauacucucacagcaaaagcccuuuaaaugagugggaaagccuggauaaacaaguagugcuaggccagcauucuaaacuuccuuuaccacagaggaaagauagagaugauccugacuguucucaucauaagauaauguauucagaggaguuacaaacuauggaucuaaccaagagccacacuauuguaauuggcuuugguccuucugaaguacaagaacauaguaaaauuaauuuagaacacaaaaacagccaacuuacagcagaaagcauacaaacagcugugaacguuccugcagcaaacucuagaguaguaacaacuaaugauauggacauguuaaaggacagaaguacacauaagccagaauugcugaaggaaaagcaaaacaucaaaaucuauggaagaaaaaguauugguagacugaaaauugauaaaacuauauuauuuucagaggguaaugagggugauauggauaucaccaagaguugcacagucaaaauaaaucauagaucuuuauuagauaagcaugauucucauuuaguaucuuuggcaggaacuucuaaaaccauuuugcaugcacguggucagguugaaauggaaaucaauagaagucacacaacuccuuuagaauguaaaauuaucucgcccagugauauaacuccuggugaucuggauaagacuaugaugucuauagaugaucaugaggaacuagacaugaccaagucccauacuguuuucauugacuaccaagcagaggcaaaagguguacuuccagacagacuugacuuucaauuauccaaaaaggaaagccuacagaagccgaaagugacaucucuggcugaagagauuuacauuucaaaaaauagugaaagcaaccaucuaccagcaaaaggcagccagcuaacaauauuagaggaagggucuaauagcgggcuuggagaggaaacuaaugaugcacaaaagccuggauuucugaaugaacuucugucaggcaaaacucagagaagaaaaagccuuagccucaaaaacaagaguauuacauuuccagagaaugauaaaaguuauagagagaucccucagaguucugcaguagaaauaaauaaugaaacuaggcuggaagacagaaagggcuucaguuuugugccauuggcaggaacuuccaaaccaguuuugucugcauaugggcccgaggacauggagauuucuauaggucaaaccacugcuucagaauauaaaacugucccaccagaagaaauaacuacuauaccuauggauaaaacuguaauguuuguagauaauuucggugaucuggaugucaccagaucccauacgguuuucaucgauugucaagccaaagaaaagguacuugaugaauauacuaacuugggaauacagaaaacaaaaacuuugagugguucugaaggugauacccauauucaagaaaucacaaaaaacccagcagcucaacacaaacaccauaugacaacuguuauuccuucuaguacaguaguuagugaucaaaguucaaugaaaaucaaguuucacaaagcugauagagaugaggaggucaaaggaaaggaaguggaagccaauaugcugaaacaaacuaaaccugaaagcugucuguuaaauauaacagauggaaaaaauguggauuuuacaagcaguuauacagcugauguuuguagauccagugacaaguauuccucuuuaccaaauauuucuucuucugauaauucgggugguaauacuauguccuugugugauaaaaauaaggagaaagcuuauaauugccaagugccaaaugaauuuacuuaugcagcuaucuuaccaaguacauaucacauggauucuaaaaaacugucugucuuuccaccuuguccuucaaaagaagucacucaaacugaaagugccauagcgcugcuuaaagaugaagauccgguagaagagccucugggggagauggcuacauuuaacucaaagcauguaucucuuaaccuggcaaaggaucaaacagaggccuuuguugauguuaguguugcuucucagccucaucucucagcccaacaaaguccaucaacucaaaaagggcaggauguugcccguagagaugaaggaauauuagcuaaagcugggaagaaggcuuuaccuuuucuucuagaaaaugucgcugcauccacaugggaaaaugaguccaaaauacccacuaauguggaacacuuugcuguaaccuaugaaaaagaacugaguauaaguauucaaacagauaaauguaauacaaauguacagagcccuaguaacucggcccugacaacacaagucauucagacgcaugcaaaugcugaaggagcacuagacuuuuuaguuccaucuacuguuucauguuuuaguaguaccaaaccaagucugaguaauuugaauagaaaaacugaggaggucuuagacuuucagacuguuaauuuauuaccuccugccgaacaguuacuugaagaaggaagucaggcacauaguaugaguauaguacaagcuacagaaauauauagacuagguuccaggaaugauagagaugaagaaaguaaaacuuucuguaaugaggcugaaacuacaucuguaccacuaaaaacagcuguuaaagacaaaacaagaagauguucauuggggauauuuuuacccaaauuaccaagcaagagaaguuguaguaucacugguguugaugaccuggaacagauucuagcagaugcagcugacuuaacucaacuagaaacucagccagucuguaguaaagauccaggcauuggaucuguugcagccaaacugaauuugaguccaucucaguuuauaaaugaggaaaaucucccuguauauccuggugagauacuuucaucagauucuguuagccuggacauugaggaaaguguucugauugacacaucucagagagagaguuuaccgucugaaaacaaaaccgaaaacugcagggcccaaaaaagaacccggguugaagaaaaugauguuacaaaugagaaaaaaaucagaacacaugacagugcacaagaucaagagguaagcugucuugagccaaaaaauguucuugaauuuuaaguaucuaagcaauagaaacuauuucuacuuacuauagguuagugaaauauuccuguguagaauuauuagaggucaguugguaaaggauuuaccaugacacgauggccuauaccuguaaucccagcacucugaaggcuaaggaaaggggacugcugugacuuugaggcuagccaaggcuacguaacagaaucuuaucucaaaacaauaauuuguuguggcaaauacccacaaaaauggaauuaaaauuguauagauaccaaauauuauaauugugucuugugacuuguaucaggugccucauaauugcuuguaaccccaggggacccaguauccucuccuguacucuucagauaccugcaucacacacauauaccuccauacagguauaaacacuuguacauaauuaaaaaugaaaauaaguccuuagcaaaacaaucacauaaauagccaaauaugauagccuaauauuccaguacucaggaaauucaaguaggaggaucacaaguuugaagucagccugaguuauagguugaaguaaggcuuggugugugugugugugugugugugugugugugugugugugugugugugugugugugugaacaaaaacaauguaaguaaguacaaaaaaugauuucuguguugcuggaguuugcuuugaggugaggugaugagaaaauagccaaagcuuugagaaacuaauaauaguaauauaaugcuuaaaucugacuagauuuuaugaaaauuaguauuuuguugaaauauuauauaucugacuaaaucaaugguuguuaaccuuccuuaaugcugugaccucuguauuuauguauuuuguguaugaguguuuugucugcauguacauuuacauaacagagggcagcagauuccaugggacuacaguuauugaugguugggaauugagcuccggacuucugaaugagcaaccaguacucuuaaacccugagccauaccuccagcucccagcuuugacccucuaauagagaaguuccucaugaugugcugaccccaaccauagaauuauuugcaaugcuacuucauaacuaauuuugcuacugcuauuaaucacaauacaaguaccuguauuuucugauguugucaagcaaccucugugaaaggguucauccuaaacccccaaagggauguaguucaguuuuuaagacuuuuuaaaauauuuuuuaaaauuuauuuauuuauuauauguaaguacacuauaguugucuucagacacaccagaaaagggugucagaucuuguuacagaugguugugagccaccaugugguugcuggaauuugaacucgagaccuuuggaagagcagucaguguucuuaaccgcugagccaucucaccagccccuaaaauauuuuuuuaaagguuauuaaucuuuuaaagcuuaggccuuagcugagcagucucccagcaauucuaaaccuacuaauccugguucuacauccugccauguggcuacaucuaccucucugcucagcucuggucugucccuucaccucuguguacccuggcugagucucccaccucugauucuucucccagaguuccucuacccagaagaucugaccagcuaucaguuaucauaucuuuuuuuuuuuuuaauuugguuuuucaagacaggguuucucuguauagcccuggcuguccuggaacucacuuuguagaccaggcuggccucgaacucagaaaucugccugccucugccuccugaguccugggauuaaaggcaugugccaccaugcccggcuccuucauaucuuuauuaaagccaguuagaucuaauugaucuugauuaccuuaggcaggugagaaaggaacaaauauuuacaaaacaugagacuagugaugggucauagaaauaacaauacuaagauccggcuauuuaguucugugcaggugccaaauuaagaauugaauauauaagaggcaagaggauuucugaguucgaagccagacuugucuacaaagugaguuccuagacagccagggcuauacagagaaacagaaacccugucuugaaaaaaacaaaaaaacacaacaaaacaaaaaagaauugaauauauagagauauaccuucauacaguauaccccaacaaaaugaagcccuggcuaaucuagaauuugcuaucuagaccaagguagccuugaacucagagagucagaacugucugucuucugaauucugagaguaaaacacugauacuuucugugguggcucacaaauuuaaucccagcacuuuugaaaggcagaggcaggugaaucucugaguuggaggccagccuggucuacagaccuaguucuaggacagccaaggcuacacauagaaacccugucuugaaaaaccaaaauaaauaaauaaaauucuacucugcauuucuuuaguguauggugagagauacauuuuuguauggguauauuugcuuguuaguguguuugccuguguguauaggcaagaagucagugucaggugucucccuuuaucauucuccaccuuauucugaaaccaggacucucacuaaaccuggagcucaccaccaauucagcuaggcuggcuagacauugagcugaucuccacuucccuuccuucucugcccuccacuccugggaugacuggugcaugcccuguggacacuagggaucgaaacucaaguccucauuggaccaucucuuuagacccuaguuuccuauucugagguagcuccacuauuggugacuagcagcuaaauaauugcauaaauugacuuacgguaucuuucuauaacugagguacaacuaagaaauaauuuguuuguacuauauagcacauuaacuaccauuaaaagccuaaauugccugauauucuacuucuuucucucucucucuuuuuuuuucuuucuuuguuuuuuuguuuguuuguuuuuuugauacaggguuuuucuguguaauccugacuaucauggaacuugcuugcuuuguagaccaggcuggccucaaacucacaaagauccaccugccucugccuuccaaguggucccaagggcaugugucaccacugcccagugauauucuacuucuuucauaaguuauugcauaugaauuauguagguaaauuuuguuagaaacaguauuuuuggcuggguggugguguagugugccuuuaaucccagcacucaggagucagaggcagguggaucucugacuucaaggcuagccuguucuaggacauaaagaaaccucguuucagaagacaagcaaaaaaguuuuuacugguguucaagauuuagucacuaaguuccaagcucgucacuuuaugcugauauuuuuagauuauguacuguguaccugaggacacuuuugugcauauguaugauacggauggaggaacaugccacagcauguauguggaugucauggcaacaaaguugauaucuuaacuuuguggagucaauuaucuucuuuucccuucauguggguucugggaauggaacucaggccacuaagcuuacauagcaaguguguuuacuuuuaacuggcucuuacgcugauguuucuuugguaauuucagauuuuugauaaucauauggaagaggauaucaauaaaaaugucaacaguguauugcugaaaagccugagcaggacaccgucuaguugcagcagcucucuggauucaaucaagucugauggacucucucuggaugucagcaguaagauacuuaugaaggcuaaauaauaacaguuauuugaaucuaugauuaaugaguauauuucacuuaagaaguauuuggauguuauauaaauccuuucaguguugaguugauagguaauuucacuuuugauuuuuuaaaaauuuguagugaaaugacacguguuguauuacagagaacuaguugauuuccuccaaaagcuuauaauuagaagggaaacauugaauggaaccuuaaagcuauauuucagauauuuuguuuuaauaagugaaaagcuucccagaaacaugggaugcaucaggaucaugaacagcacacaaguuugaaagauaaucaaaauuaacuuuacauuuuaguguuuguucauuuguuuuugguacaaggucucaccaccuguaguuuuggcagccuagaacugugauguagaccagauuggccuuaaacccagaggucugccugcuucugcucagccaguguuggcacuaaaggugcgcaccaccauuucaagccugucaguuuagcuuuggcuugcuuaccguuuacauaaauuuugcuuuguuucuagcacagcguaauagccaaauggaaucacaguuucuuggugacacuaucucugaagagaguuugaaggagguauguuaauguauuucucauuuuaauuauuuuacauuuauuauuuauuuuguguguguguguuugagugcauguaugccauacuacacaugugacagucugaggacaaccuguagaaauugauccauccuuccagcuugugggucucagguauugaacuccggcugucaggccuggcuguugagugcccuugccuacugagccaugccaugggcugcgauuucucacugaaguuuuuauuuugcuuguuucuuuguguuaaaacagcaucuuccuuuguggcccuggcuagcuuggagcucaccauguaaauuaggcugaccucaaacucccugagaucugucuuuaucugccuccaaaguccugggauuaaagccauguguacuaccacaauggcuuaugucuugcuguuuuguuuuugucuuuuuguuuuguuuuguuuuuuaauuuuuuuuuuaauuuuuuuucuuccuagaauuucucuguguagcccugacuguccuagaacucagagaccgaccugccucucucugccucuuggagugcugaugucaaagucaugugccaccaccccucagcuuuauuucuuacuuuuaauacacuauuuuuaaaugucuuuuguugcuuuuuuuuuucuauuuauuuauuuacuuacuuauuuuuauguaugugaguacacugucacucucuuuagacaccagaagagggcauuggaucccauuacagaugguugugagccaccaucuaauugcugggaauugaacucaggaccucuggaagaaguuuggcuauuuccaaacuuaguagauaaagcuguuuagaaaugaaugauguuguuagagacaaagugaauucacuuugaguguucauauaaaguucuuuuuuuauuuuuagaaacucaaggauggacaaauuacaauaaaggaguucuucauacuucuucagguccacaucuuaauacagaaaccuaggcagagcacucucccagccaaaguaagugcaauuucuuggcaaacauucaucaaaauaucaccagcccacauuaauauaucauucuuuuuuuauugucauuguuguuguuaguuaaguuagguuguaccaaugcaaacauuuauuaaaagauaaaaucaugaacuagggauguagcucaguugguagaggccuaccugcuaugagugaagccucaagucugccaagucuaacaucgcaaauuuggaugcucuggugauguucccuuuccucacacugauguacuugcagucccagcugugaucucucuaaacauuccagugaugccuuuugaggcaagaucucagauccagcuugcagcucucccaguuugacauccgugaguguuuuuucuccaucagugguauaacuaacaauaucuugaugucaauagauccaagucauacucaagaagaaaagagacuugaaaagucauagauaucaaaagaaauggguauauguagaucaugggaaaugagguuuauagcuguggacaucaucugucccaagauuuggaugacuguaagucucuguagaguagaagugggaaacauguuuuuagugggauuggagauguugcuagccuucauagacaaugucuguagcucccuuauauuucuguguguuguaggagcucagcuggcugcacuaguagcgggugcuuuuauaguuauccuugauccuugcaucuuuauggagaaguucaagcuaaaauacuguaacccauaaaguauaauuaggucaaagaucuccuuggccugaaauacccaaguauuguuuauauauaaguuguacauuuaaucaaaaugaguaaaaauggcuuguacacauaaugucuaauucaagaugcaacaaauuaauuuaccaacugaguauaauaauaauuauccaauguguuccacagggcaugagucuuuuauccacuggcacuucugcuauuuuacuagacacauaauuguaugcuuuacuuuuuuuaaauuuauuuuccuuuuauguuuauugauguuuuauaugcaugcauguucuguggaucacauuugugcaaugccuaaggaggacagaagaggucauuagauccccugcuacugcaguucgcagauaguuguaagcuaccaugugguacuuggaccaaaucucuguccuguacaagagcaacaagugcucuuaacugacaagcaaacaaaaaagagauuggccuuguauugaauggugaugccauguaauauuuucauaacuuucuuuucuuguucuuuuacaaagaaucuugauuucauuuaguaucaaacaguguuagaaaacacaaucuacauuuuccuauugccauuucauuuugagucaguacauauaguuuugauuuuuaugccuuuaaaaauauuuuuuaagccgggcagugguggcgcaugccuuuaaucccagcacuugggaggcagaggcagguggauuucugaguucgaggccagccugguguacagagugaguuccaggacagccagggcuauacagagaaacccugucucaaaaaaacaaaaacaaaaacaaaaacaaacaaaaaauauuuuuuaagaacuggaggacuguaaccagguaucuucaacuccaacacuuagaggcaaagaagugcagaucucugugaguuuaaggucagccagggcuucacagugaaaccguuucuaaaacaagcaagaaggugauaaucgagccagugagaugacauaguggguaaaggugccguacacucagcugacuguguaaguuugauuccgcaggacccauaguggaagaaaacugacuuucacauucaugcugugacuugcaugccacauacauaauaaauaaauauaauauaaaauaaaaaaauaauuuuggcaguaugcugaaugugguggcccccaucuauaaucccaguuccuaauagauacaaccaggaggaucacagguucagucauucuugacuucauguauauuucaagggccaccaagugucugugagaccuugucugaaaauaaaugugggaggggcccaaggagauggcaccaugauuaaaagcagucucugcuguugcagaugauuuagguuucagucccaauacccauguggcuguucacaacuguauaacuccauucccaggagauuugacagccucuucugacuacccagggcaccaggcaugaaugauguacauaaauacaugcaaagaaaauauacacacccagguccuggggacuaaacacaguccucaugcuuauauaucuuccagcaacuuaauagauaaguccaaaguuuagaaauugaaauaacauauuaaccaggacagccagggcuacacagagaagcccugucucgaaaaaacaaaacaacaacaaacaaacaaacaaaaaagaaaucauauuaugugcuaugcugcuuguaaguaauggaugaagaguuauuugguuuuuuuguuuguuuuuuuuauaaguaaugaaauuuaaaaccuuguuuaguuuuuuuuuccucccaaaacgagauuaaaugcauuuauuugucuuuaaacuagaguugcaaaacauaacaaacuauucuuaaugagugaguggguggguggguugguugguugguugguugguugguugguugguugguugguugguugguugguugagauaaggucucuaguucaagggagccuggaauuuagcagaagauggcuuugaacucacaaaggcaaggccauuuugccucagucuccuaagugcugggaauggcaggcaugagccacuacugccuugauuucuuuuuuucuccuuucuaguuuaaguaaaguaguuccuacuaagcuuaauuuuuaaguauuguuuuuuuuaacuauacuuaucuauugcguguauguguauauauguacaugccuguauaugcuuugaggugaaaggacaauuuaugggagccaccuugcuaacccuugauuuucuuaaaacaauucauguuauuuuuaaacccuuucaauccuauaagucaauauucuuagcucacccgaucacccauggaagaguggacuuugaacccagaacaucauauuacucuauacugaacuacacacccagcccuguuuguuugacuuuaaaaauagacucucuaaaacuugaauuuguuauuguaucugguauuguccuuaaaaugccaguuuugagcuagguauaaucgugcaccucuguaauuccaguacuuggggagaucaggaggucagugugaucuucaguuacauaggaguuccagucuagccuggguuacaugagacccucucuuaaaaaaaggaaaagaacaaaaauccacaccugguucucccagacauggugucacagcguggcaagagguaagacaagaggauccuaaguuccaggccagccuaaacuacauaguaagguucuagcuuagguuuuaaaagaaaaagguaucaauucugauugauugauugauugauugauugauugauugauugauugauuacuguuuuuuuuaaguuuacuauaaacacauuaccuaccacagaagaucugauguugagacaauauguuuauggacccaggauacagauuuauaaagaagacugugagcuucuucgacaaaagauugacgaguaagaaaguuuuauuuccccugugauuguuuuucgaggguuauaauaaacaagugaucuguguaguauuuuaauuagaaaacugcaguaugggaaaaagaauggaauuaacaggcaguauuaugaauagaaacccaauucugggggcuggagagauggcuuagugguuaagagcacugacugcucuuccagagguccugaguucaguucccagaaaccacaugguggcucacaaccaucuguaaugggaucugaugcccucuucuggugaaucugaagagagugacaguguacucauacauaaaauaaguaaaucuuuaaaaaaaaagaaagaaagaaagaaaagaaacccaguucugucuacaauacuguauagccuuguauaagucauuugcuuuccuuuucuacuucauaaaguaguaaugacccagcacuugggaggcaguggcaggcggauuucugaguucgaggccagccuggucuacagagugaguuccaggacagccagggcuacacagagaaacccugucucgaaaauaaaauaaaauaaaauaaaguaguagugauaucuauucaauggauaccacgaggaauagcuacuauuugcacaaaacguuuuauaucaugaugaauaaaaggauaaacugaaauuauuauguuauguuauaaauuaguugaaacagaacaucuucaaaaggauauaauaugccaccccccccccacacacacacaccaauaagacaggguuucucuguguauccuuggcuguguuucccugguuaagagcacuugcuucaaagucauaaggauaagagcucugauuccaauauccacaucaugccuauuuggccuccaagcccaaagauguauuuacaugaauaaauaaauaagcccaagaaacaaaaaagccaggccauucuggucuacaugauaucuuuucuggggaaaaugauuguaucuauuacuugguaggauggcauaggccuucucauccuuguacuuaggaagcaaaggcagguagaucucugaauucaaggccacccaggguugcaaagugagaucuuaucucaaaauagaguaauaauaacaauuguauaguauucaaaaucaaaguuauuuugguauuucuaauuuuugcuauauuuuuucccuuaauuuacauacauaaaguauaguuuuacuuagaauauagcucaaugcuuggaucuuuguaaauauuacacccagauuuacaauuuauuuaugaaacuacuuuaccuagaauucaaaauaauguuuaugucaugcuauuuuaguacuuuccaguuacuuuugacccaaucuaacaaaaauaaauaauuuuuaaguguugggguuuuuuguuuuguuuucuuuuuuccuuugugugugugugugauacugagaauugacuuuagagcuuugagagugcuaggcauuuaauuucucugccaaugagcuuuauccuuagcuguacagagcagauagcuuugaaguuauuuauuuuauguguguggguguuuuguaugcaugugugucuagugccuguggaggccagaaagggcuucaaaucgccugaaauuggaaauacauggugagcugccauguggguagagcuguggauguggaacugguccucuggaagaacugucaguguucuuaaccacugggccaucucuccagccuuacuuagguaauuuuaaauuuaaaauuuaaaauaaaacuguuaaguauuucaucuggacauggggcauacacucauaaucuccauaguaaggaaaaaagaugguaaauucauagccauccugugauaacuauauuccaggucagcuugggcuauguaaucagacccuaucuacagaagaacaaacaaaugcaaugaggaccucuguuguaugguuaaacggaccugaggucaaaccucuagcaccaguguaaaagaugcuagcacaagcaucuucaaucucagagcuccuaccggaagaugggaggcagagacaagagacccuagcugcucaagggucaugugaccugcuauacacagcauuagaaaaacaaaaaagggauucgggccuuaaacaggugauaacaagauuguccucugaccuccacacacaugcccauagacacacacuaaugugcacauauacacauuguguacucaacaaacaaggggaaaagaaggaacaaacaaaaaaugaugguagaccaauugucugauucuucuuuguucauucaacauauuuauguagcaccugcuguuuaccagaaucuacauuaauuacuagggcucaucacugaauaagacagauaagauucuuaauauuguuuuagaaagugaaaugcaggugccuggacagguugcuagugaguaugaucauaagaagcucacuacugccugcaacuccagucaggagauugaugcccucuccuuaacucuuugguuucuuucauguacauaguguacauaaacuccuucaaguauacauaaaucaaucaaucaaucaaucaaucaaucuuuaaaaaaauggaaucuagccuuaaaaaguagaucuuguuuagauuuguuuuguugcuugauauauuuuauaauuuguuuuguuuuguuuuguuuuugguuuuuuuuuuuuugaggcaggguuucucuguguagcccuggcuguccuggaacucacuuuguagaccaggcuagccucgaacucagaaauccgccugccucugccucucgagugcugggauuagaggugugcaccaccaugcccggcauuauauuuuauaauuuuguguugaggauauauaucauucaguggagcacuugcauaauuuugcauaagggucuagccuaauucucaguaucacaagugucuucuuuguuuuagauagagauuuacuuccccuauuuauuaguaacuauugaaaguauaacagcuuucuuauuguuuucuuuuuugaacaaugucucauugccaggccaggccagaacucauguuuuauagcucauacuaagaaaucacagcagccuuaauaugcauggugugugccacugugccagguuaacuugucuguguuuuauaaaugcuaucuuguauaaauuagauaaacuuugagcuaaauugagaacuuuuacuuauaaacuaacuacaacuucacaucaauuauacaaugacaucuuaaaccugaaagcacugcuuucacuuacaguaagcaaacagaguguaggaauccuuuuuagaagguuccuaauuuuuuuuacuuuaaaauuuuauuuuuauuauuuuaaaguguaugugugugugugugugugugagagagaaagagagagagagagagagagagagagagagaacacagaugcagagagagagagagagaacagaugcccaaagaagccagauguuggaguuucuagagcuggaguuaauagcaauugugagccacccaguguaggugcugugaacugaauucagguccuccaaauagcaagcucuuaaucacuaaaauuaguacuuauguauaaguucuuuuuuguuuguucguuuuuuugagacagugccucaaaagagaccgaagucuaggcuaguuauucuaggcaaugcuccuaccccagucucccaaguguuggaaauauagguguguaccaucccuugauugcaaaugcagccaucuuauacaauucuauauguacaguaucugcuuugcauaagacaauaaauaauauaagcaauguacagguagugguaagaaggcaucauccuggagguagucagauuuuuauaaggaagguacacuagccuugacguauguaguguaggcuauggagaacuaggggcagucauuucuggaaaagccaaaugccugaacugaggaggaaggaaaaacaaacagaagaaaacaaacaaccccaaggagcagaugaacagaguacuauaguuggcguccaggugugggugggagccuuaaaggguaggaagcuugaauuuucagaaugauuggcucgagucauggagaggaggcccucagagugagggguaauguuacuggcaaggucucuagagggucuugguuaacugcugccugaaugaagauugguggugggcugaagugagccucaacagccuccagaggcugcugcacuugcugggauccugaccucuggaguuuagagccuaagcuguuaguggucaugcaaggaaugaaucccaaaacauauugggaagauagagcaagcagagggacaccaugaugggcugugggaguaagucauuggggaaaguuugagaaucccaggaugggaggacuagacuccuggccuaaucuaccaugcccacagaggcugagagucucagggacucagccuagaucuguccuaagacucaaaaucaagucuuugcccuuuuuugcugaauacccuggaagcuggaaccuuaguaauucagaaauucaggugcuacccccgccccccugcugccaucucuacccucuccaaguccugccauccccuaaagguaccaauggacucuggccucucugacccuggaauuuaucccacauugugacauucucuguguguguguguguguguguguguguguguguguguguguguguguguguguguguguguguguguguuucaagacaggauuugucuuuguagcccuggcuguccuggaacucacucuguaggcaagguuguccuugaauuuacagagaucagccagccucugccuuuugagugcugggaugaaaggugugcccgacugcauucuuaacuuuuguucuuuaaauguugaauaaucacgcuagcuguguguccugagugaacuacuccuguguaggaaaaaaaaaaaaaaacuagaaauaauuguuuggcuguauguuuaagcuuguuuauucaagcagaauucuaaauccuguauuaacauuguuuguuuuagauuaaagauaucugcauugaaccaaaauaaacuauuggcggauguaaauaggaacuugugggaaaaagugaaagacuacucugaugaagagguauuuuuaugccauuuucugaauaagaauugacacauuuugauacauuuggaacuguugcuuggccugcuguggugauauacccaaccuuuaaugcuagcucuuggaaggcugaggcagguggaucucugaguucaaggccagccugaacuacagagcuaguuccaguacagccaggacuacacaaggaaacccugugucaaacaaacaaacaaauaagcaaaaaagaacuguuacuugauaguauggaguuuuuuuaauuuagucuuagaucuaauguguugcuguggucuuaucuaauuauuaccaaguaauuguuaaauauaaccuuucuaauguaugauaucuaauuuaaccuguaaaaaauauauaagauguucccagcuucuuuuucuuuuugcauuuuccuuagguuuaaaugaagauuuccuuuaauugauuagcuauuuuacauguacccuaauauauaaucauguuuuguuaauuaagagccaaucauuuucuaguuuauaaaauaagugaaagaaucaaaacugaaguuuuugauuauauucuuaaauagauaugcagagccuaagugugauggcauauaccugugaucacagcacuuuagaggcagaagcugaaagagcacacauuuaagaccagccugaucuguauagugacuuccagcuugccaauuugcaaaugaaaaauucuugucuuaggaauuggaaucuagauuaggcaaaacccagcacaggcaauugaacucgccuucccagaccuaacuuaccuucucugauuuguuuuuaguaacauguacucuuuaacucucucauacagcugaagaacuaugggauuuaccuuaacaaaaucaaaucacguuauaccaagaugacaaaagucuucaaucaccaaggaaaaguggcucuguauaacaaauuggugcauucagcugagguaauuugagauguugauauauaguaauguauaguagauauaaaauaugacaugcuucuuaggagacauguaaaugaagcuuggauaaaaguuuguuuaucaaaagugaaguucuagaaaccagaagcuucagguuuuggcacugggaguuaaaugaaguauaguuacuaauauggccuaugucucacauguugucauccauuuuacauauugaaauaaaauacuugugauucugugucccuauucacacggaaggcaguguuaucuucuuuauauccauauucaguugcauauguauaugcauauguuuauccuuuuucuuuuaaaaaggccuuacacacagggcugagacuguagcucagugguaggacauuugcuuagcauuuguucagucucccauuugggagacagaagugggaugcucgugccagugagcacagcauuuaugcaugcacacaagagcaagcacaguagccuggugaugcuuaguaaguaucagcaaacaaguacaugaaguguuuuauacaguuucaucuuuuauagaaauaaaaauucaaaaauaguugugccuguugcacauaccuacaggaaacugaggcaggagaauugccauaaguucuggaucacauagcaagaaccugucucaauaauaacagcaauacaaacaaacuaacuaaaacacacacuuaaaggcuguaguucuguuuggccuguguccaucugaucacagaaaaaaauuaaccuuuuuaaagcaauaaauaucaauauccaugcaguucaugaaacauguauagaaaagaaaugcuauaauaaagagaaauacaaaauaacuucauuugucuuuuuacauuaaaaaacaaauuaaguccggacuaaaagucuugaccucaaaauuugucuguucaugccaguuugguggcacaggccuguaauccuagcuacuugaaaguccaaggcaggaauaucacaaguucagcaucagccuaggcaauugaguuguaagacccugacuuuaaauaaaaagugaaggaaaaaaaaaggacaggaauaaagggcaguagaucaugugacuaacauguucaguuacugguauugccaaauaaaaaugggaaacaaauuuacccauuuauaaucacgacaguaauuaaaacuauuaaaggauuguuuggaguuuaagguuuacaaucuauaauauuuuguguuuagaaugagaagaacaaacuucagauaaaaauaaaugagauggacacuauccucaagaagaucaauaacugucucgcugaaguggaaacagguaaagucuugcucuccucuauggcugaggauagagugcagugagagaucaccugccuagcgugcagaaaggcuuaggcucgacucccgcaacuacacaaacuuaaaggauaguuuucuauagaggcuucuauaaguuagaaaguuuggucuuacuaugcugucuuagcagcuugaguacuuaaaguggagcaaaauaaaacccuuuuuugggcuaaugaguuggcucagugcauaaaggugcuugccaccaagccuggugaccugaguuugaugccgggggcccucaugguggaaggagagaacugagucccauguguuuuccucugaucuucauaggcaugcuguggugcuaacccaccuuccaaaagaaguaaaugucauaaaaaaugauacuaaaaccugguucgcuauaaucauccauaacaguaaagaagagauauccaaaaaauuaaguucuuuugcaaggcucuucauaaccuauaccauaaucuuguauggcuuugcuucuuugggggacagagucuguauagcccgggguggccuagaauuugccugagcuacucuugaacuugugaucuuccugccuugccucccaagugcugguguuaugagugugugccuccaugcccaguauucugggauuuugguuuuuggguuuuuuuguuuguuuguuuguuuguuuguuuguuuguuuuugagacaggguuucucuguauaguccuggcuguccuggaacucacucuguagaccaggcuggccucgaacucagaaauccgccugccucugccucccaagugcugggauuaaaggcgugcgccaccacgcccagcuugguuuuuguuuuuuaaucacacuuguuuguuugugugugugugugugugugugugugugugucugugugucuguguguguguaauuuuaauguuauuuguuuaugagauuuuucuuuuacuuucauguucccugguccuuagucuguuuccuuuuuuugacacugcugauuauucuuuucuuccuaaaccauuuauuucauuuacccucugaggcauuacaacaccuaacucuaauuccauuauuucugggcuuuccuuuuagcuccuaugugggucucucuugcucaaacuaacccaucaguacccaggccaggugguucaugacugccuacaacucuagauccaggggauccaacacccuuuccuggcauccucaggcauacacucauacacacaggcacaugcaaacuuagguacacacacacacacacacacacacacacacacacacacacucaaacauacacacacauacagcaagagguaaaauuagcaugcuuuaguaaaaaagcauguuuuuuuaaacaucccuagcauuaugaauugcauagaaaaaaauaaauacaugcauccugcauuuaauugaaaaugaauauaugaauauuauaguuuuaaaauaacuuacaucauuacuuuacuuucuauuucauaauaaaagaaauagaaaccuuuagacuaaaccuuccaaacuuucuaauaacaaagaaaccagaccuuuaaucuguuuauucauuauuccuucuuuucucuccccuaacaccaaucuucccauuuaaacugauuuugccaggugugguagugcauacccuguaauaccaguacucaggaggcugaggcagaagauuugcuaaugaggccagccugaacuacauagugaguacuaggcuacccagcccuauauagcaagauacuaucucuuuuuuaaaaaucaaauaaauaaaugauuucuauuaugucuucucaguaaucuuauauugacuccucccuuuaucauauccauuuccauuuaauuuacauaccucgaugucaucuuuaaagcguacguaggaguguggcuuaguugcuuaaguguuugcuuagcaugcacagaacccugggauuccauccccaacaguaucugauggagucagauaugaauguacaugccuaugaccacagcacucggaagguugaggccucaaguuacaggucauuuucagcuauauaacuaaguucaaggucauccugagguacuuaagacucuuaaaaaaagagggaaaaaaaucauuggguaaaccuggcucaaaacuuguagucccagcguuugggaggccaaggcaagaagacugccuugaucucaagacugguguggguuacauuguugaguucuaggcuaaccugaauaguaggagauccuucagaaagggggagaaaagagcuagagaggugacucaacaguuugugagaacugucugcucuuccagaggaccucaaguucuauucccagcacccacauagugguuguagcugcauucccaggggaccuaauggccucuucugaccucauagggcacuaggcaugcaugugguacauagacaaaacacccauuuacaaauaauaaauuuguuuagaagccuucuacaccacauauaaaaaucaaauauaaauaacaaggcugggauggaguuuguuggcagaguauuuucaagucucuggauuugaucucaggacugaaaaaaaaaaaccacagaagaaaaacacaacagcugugcuucccuccccucuuuagguagcacuaaauggcuacccuuuucuucuuucauugcucauuuuucaaauuugcuuaguuuguaacuuuuuguuuguuuguuuguuuuuguuuuuguuuuucgaggcaggguuucucuguauagcccuggcuguccuggaacucacucuauagaccaggcuggcuccaaacucagaaauccgccugccucuaccuccuaagugcugggauuaaaagugugcgccaccacgcccggcaguuugcaacuuuuauaugaugguacucagaaauaagaacacauuaguagcccaaaccaaacaugauuugugcccuuguggaauuuuuuuuccucccauguccuaucauguaggauauacugaccucuaaaaugguugagaguguccuuaaacacccgaugcuucuuccuccaccuccgcaguacagacuguacaugugcuaccauccccgcuccuuaugcaacuuuuaauccagaagcaacuguagacacuaaacaaauaagcuggguaugcuauuacacgcuugacaucucagucuguaggcgacagagucaagaggaucaggagucugaggcuagccuguguuacacaagaccuuuguucaaaaacaccaaauuauccuucccccaaaaguaauuucauaguaaauucuguggaugauauuauaagguacugggauacuucaauagaaaucugaucuaguuaagaggucaaagcagccuuaccuauaccgaagagacuuuacagcuaaaauaugaaagaugaauaggaguaaaaaggaaaaaagagaagccaggcaugguucacaucacuaaucccaucacuugaaaagcugaggcaggaggauuacugugaguaugaggccagccugaacuacagaguaaaacaguuucuuuauaacacauacacagauaaauguguguucaugcacacacauacaaaaaacaacagacuauucacaauaaacacauuuaguaaacccauaccaacuacauguguuugaagauagagauaaaguaaaauagagaacaggagggaaugucuucuaaaagcuugauuuguuauuggggcuaggaauaggacagccucucaaggaacucuaaauaugcuuauaagaagugaacuaucacagucagcaauuggauggaacacagggcccccaauggaggagcuagagaaaguacccaaggagcuaaagggaucugcaacccuauagguagaacaacaauaugaacuaaccuguacccccuagagcucgugucucuagcugcauauguaacagaagauggccuagucggccaucaguggaaagagaggcccauugguuuugcaaacuuuauaugccccaguacagggaaacaccagggccaagaagugggaguggguggguaggggaugggggggaagggcaugggggggagggcauggggggacuuuugggauagcauuggaaauguaaaugaagaaaauaccuaauagaaaggaaggaaggaaggaaggaaggaaggaaggaaggaaggaaggaagggagggagagagagagagagagagagagagagagagagagagaaagaaagaaagaaagaaagaaagaaagaaagaaagaaagaaagaaagaaagaaagaaagaaagaaagaaagaaagaaagaaagagagaaacuaaugaacuagccguguguuuauuaagcacuaacggcuuauagagcgagcuugggucugaauagauaaguaaaugcaagcugauugucauggugcacaucuguaaucucaaguacuguggagguugaguuagagucugcaugaugaauuccaaaccagccugagcuacauagucaaacccuaucuuaaaaagguggguaggggaauauuuuugagguaaaaugcaagcuuggaguaggcacuguaaucccaguccuuagaagguaagggcaggaagaucaagaguuaggucagcuuacucagugguccagcuggcacucuaugagacccaguuucaaaaaggaaaacauuucaaugcuaacaugagacaaacugggcauggugacacaccuguuauccuaguuacuugggagacuuuggcaggaagaucacagguuuauggcuggccugaacaaggcugucucaaagguacuagaaagcaucaagagcacuagaugcauaagcuugcugaugaacccauuuaggaggaaagaaaugacucccaaaaguugucugcugaccucuagugcucaccacacucacauauacacacauucauacaugcacacacacacacacacacacacacauacauacauacacgaacacuaauaauaauaauaguuuuaaguacaagaugagaucacugucauuagcucagaguucacuuauaugauaccauaggucuuugaaaucauaguuuaggacuuuauuggcagaggauggguauuugggaaaacaguaaauauuacuaauauuucauuugaccaucuauuucucugauauuuaauauaucucuaaugcuugauguuuaccuuagaaacuaagaauuuggagaaugaagagaaaaaugaugccauggaagaaugggauucugaaaugagagaugcagagaaagguaacuaacuuaguuaaggugacaaggccagagagaacagcacuguugagaucauucacauguuagaugagauuagcuuagucagaauuuuucaguaaacuaagugaaaaaaaucuauguuucaaguuucuccugguguccuuuuuaugcuuguuuuauuuuguuuuguuuuuuuuuuauagaacuggaacagcugaaaacugaagaagaggagcuucagaggucagcuaacaguuggauguuaaaaauauuaaggcgccggauguggucacucauauguuuugaucccugugcauuuuagguccaccuggucuacauagggagcuucaggcuagcccuagccaaggcuacagucucucucucucccucucucccucucucccucucucccucucucccucucucucucucucucucucucucacacacacacacacacacacacacacagagcaauacacauaaaauaaaaaugaauacauuuaggaaaagaaagaaaugacauguaaauaaugacaaagccaauuaaauuugaguugacaaauauuaauuugacagauaguaaugucaacugaaauuaaguugacagaacucuggguauguugguacuuccuuauaaucuuagcagucagaaggcugagacauaaagauugcuguaauucaaggauaauagguagaugagauagguuuugaacccauaaagaucugccaucaaugcugggaucaaaggugugcaacaccauagccaaccucuaccucagcuuuuaagacagaauuucucaugaaccuagagcucaccaguuggcuagauugacuggcuagcaagcaccaggauucaucugucucugaaggaucugucccaacacuguuagaacaccuugcuuugucuuuacucggugccagggauccaaacucggcuccuuaagcuuucacagggaaacuucaucaacugagucaacuccccauccccaaaacauuuuguuacuauucugaacucacuaacaaauacuuuguuuuucugugaauaccuaauuuuauuugcagaaaguucuuagaaguagagacacagaaaacgcagacccuugcucagauagaauuuauaaaagaacaaacaacuaaaacugaagaauuacuggaucaauugagguaagcaaaaguagauagcauucaguuucuggucuauccugugccuuauuuauugcuaucgaccucuggaggauuugagguuuauuauuaauguuguuuaaaguuaggcuuucucuauguuguccauccuggccuagaauuucugaauccaaacaauugucgugccucagcuucucaagaauacccacauuccaaccccccacuacccagccauugcuauggccuuaaacacccacagcuguggcucucacccuccuuauucugcugcccuucaauaaagcuccucaugccaggcgacucccccgaccauaaauuauguuauugcuacuucauaaguguaauuuugcugcuguuacgaauuguaauguaaauauauguguuuuacagugagacaaccacuuugacaggguuguuugacucucaaagguugagaaccacuaacugaccuuuuuuaaaaaagucaguguacuucaaaccugagguaaaaacgucuaggggaguaaaaacucaugagcuuaaaauacuuuaaaauauuuuugugucuggaaaacugguucagugguuaaguguacugaucuugcagaagacccaguucauuucccaguacccacaugguagcucacaacuaccuauaaucaguuucucagggauccaaugcuaccuucuuaccucaggagccucccucauacauacacucaggcacacacauacacauaaaauaagaugaauauucuuuaaaauauaucuuuaacacuuuuuuuaacgauuacuuuuuuaaaggauuauuuauuuuauauaugagaguauacugucucuaucuuuagacacaccagaagaaggcauuggaucccauugcagaaguugugagccaccaugugguugcugcaaauuaaacucaggaccucuggaagagcagucagugcucuuaaccgcugagcaaucgcuccaaccccucuuuuuuuuuucccccuccccuuuuuuuuuaauuagauguuuucuucauuuacauuucaaaugguauccucuuuccuaguuuccucuccaaaaaucccauauacccuucccccucccccugcuccccaacccaccuacucucacuuccuggcccuggcauuccucuauaauggggccuagaaucuuugcaagaccaagggccucucuucccacugauggccaacuaggccauccucugcuacauaugcagcuggagacacaaggucuugggguacugguuaguucauauuguuguuccaccuauaggguugcagacccguucagcuccuugggaacuuucucuagcuucuccauuggggaccuuguguugcauccaauagaugacugugagcauccacuucuguguuugccaggagacagcuauaucaggguccugucagcaaaaucuuguugguauaugcaaaagugucucuccagccccucuuuaacacuuuuuaucaaauagauccccuuccccuccaauauaugaucaaaguuucaaauacauaagauugacccaaguguuguugaacauaccuguaaucacagcacuugggaagcagaggcaagagaauuauuauaaguucuugaucagccucauuuacauagcaaguucucagccaaccagagugcacaguuagacuugacucaaaaaaaaaaaaaccccacaaacaaacaagcaaacaaaaagcacaagacuguguagucauauuuucuuuuccaagauuuuguuuuagguuauuuauccucaaaagguaucuauuagucauaaagcuuccacuggugaucacucuguguguguguaauguuucacaaauuuuuguguuaucuuuguacaaggcuuaacuuguucuuauuuuacucuaugugccuauuuuaguauaugugcugccaaaguuguuguaucauguuuugagacaccaucucacugugugacacaggccagccuaaaacucaaggggaccugccugcuucagccucucacgggcuaggauggaaaaugugugucguucuuccaacuuggccauucaaauuauuuaaauagauaauuucccaauccggugcuccuauugguacuauaugaaugauaucacaaauucuucauuugggcuuguaauuucuuggcuugaacccccagcauugggaaggaaggaagaaaggguagacuuacuuguucuuguuugucauucucuaguuugucugagugggaugucauugaguggagugaugaucaagcuguauuuaccuuugucuaugauucaauagaacucaucaucaccuuuggagagccacuagguaaguagcaaagcuaaaaugaccucuacagaaaaauaaaugacuguauucucuaaagauaaaaaccuacauuuuauuauaauaauaacuuuuaacaaaauggcaauacugcugagaaucucagaagaauaagggacuuuaauaauaauacuuuggggaaguuugcuagagaucaaacccaggaacuccuacaugcuaaguuuaugcucuacugcuaucucacuaugaaagaauuguauguuguagaacaaagaauauaguagaauggaacaugguggcauggcuggacaggaucaucugcuaccuggugagacccugucucagaagacaacaaacaauaagaauaaaaagauaguugguuugaguucuuuuagauaaugaaauuaucucuauccaaauaauguuuuuuucucgcgugcgcacacauguguguguguguguguguguguguguguguguguguguguguucuguuagagaauuuacuugaaucgcuguucucuuuuuuuuuaagauuuauuuauuuauuacauguaaguacacuguagcugucuucagacaccccagaagagggcgucagaucucauuaccucugguugugagccaccaugugggugcugggauuugaacucaggaccucuggaagagcaguuggcacccuuaacugcugagccaucucuccagcccuuuuaaguuuuacucucaauauguauauguuuuucagcauguguguauauguauguauauguggacacccacagggacaggagaaccuguuggaucccuugaagcugggaauugcaagagauugugagccugauaugcugggaaccaaacuaaggcaucucucuccaccucacagcuguuuucuucaugcuaucuguaguaccuaggacacacaagaauuuaauaaaacauuuaucaaaaagacaagacuuggaauuugagaagcaagaaguaacuuacaccuaguagauauggagaaguuggucccacugucuucuuauggcuuuacuugauguuuuauuuguuugagagaaggucucggaauguauacuuagcuggccccaaauucagagaucuaccugccucugccuccugaaugcaguugaugugcaccuuguaccuguuugauucuugggaaaaaaaauguuugcauugaaauuaauuuagucaagggaguuugugauauuuuucaguuauaaaauacauucucuguguacugaugugacccaggaaccagauaguguuggcuuggcuguuuuucucccuguuguggggguugacuuuauuuuccauaauuucccccagguuuugguuuuguuuguuuguuuguuuguugcuuuuuguuuuuguuuuuuuguuugguggggacagguuguuguguuuuaguuuaucaagauaggcucucuguuuagccauagcugugcuaaaacucauucuauagaccgggcuagccucagacuuagauuugcccgacuacauucuaagugcugggauuaaugacauguaccaccaagccuaggucauaaauugguuuugaugugacccaagccugaaggcaggcacaguagcaaggucauaaauugguuuugaugugacccaagccugaaggcaggcacaguagcauaugccuuuaauucuagcacucaagaacucuuuaaucccagcacucaggaggcagugacagggggaucucugugaguuuuaggcuagccuggucuacagagcuaguuccaggacagaacagcucuguuauacagagaaacccugucucgaaaaagaaaaauaaggggggggaggguauuaaauaaauaaauaaauaaauaaauaaauaaauaaauaaauaaauaaauaaauaaauaaauaaagauaugucuuacacuuuaauuucuuucaagggccuacuaaaccaauauaauugaaugauaucaggggaucuuuaccauauacagagaauaaugugauucaagaauaaaccuucaauagaauucucaaguaggaaaaauauuuaugaccaggaaggauauaauucauuuaguagaauacaugccuagcauucaugaacgucuuggguucaguccccagcacugcauaaaccagguaugauaauaugugccuauaauucaggagaugaaguuaggucaagagaaucuaaacuccagagcuauccccagcuacauaugauuuuaacgccagcaggagaaaagagaaaaaucuccuuuucuguuuuuuuuuuuuaguuggucucccuuuuuuggacaaggcuugcaggaagauuaaugcacucaguuuucagucucuguuagaugguaaguucuaaauauuuaaaccucuaaauuuuguugguaauuuauagguacaauaacguccuuaaaauauguuuuaaaauaaaacugcuuguauaguauucuaaauucugaguagauuuuuuuaaagauuuauuuguuuuauauaugugagaacauugucacugucuucagacacaacagaagaggacaucagaucccauuacagaugguugugagccaccaugugguugcugggaauugaacucagaaccucuggaagagcagucagugcucuuaaccacugagccaucucuccagccccugaguagacuuuaaaagaaaugauuauauuacuccuagauauugaauaaugauuaauaauagcuauguuuauauuugaaauuagcacuauggguacuuagucucuauaccauguauguauauuacuuauaucaguacuauaaacagauauuauuuucuguuuuaccaauuaggaaacuauagaucagaaaaauuaaaugcuguucuuauaauuacauagauaauaaagaaagccuagcuuugaacucugucaaaauucaugcuuucaccaaaaucuguuauauaugcuuaggcucaaaguuuuauagaauggcuuauauaacuccguauguuauggucauguuuaaaaauaaaaaaauuguagccaggcuugguagcucacgccuuuaaucccagcacuugggagggacagccagggguauauagagaaaccgugucucaaaaaaacaaaauaaauaaauaaauacauuuaaaaauaugcuucuaguuugaaaauguuucuagcuuauauaauauuauauucaugccuuauuuaaaugauuaauaaauaaugcccuuauuuucauuuuuuuccuuauucagaagauaaagcuccucccuccucccuuuuaguucacaagcuuauuuuucaguacauugaggaacaggaauccuggaagaagaaaugcacagcacagcaucaggugccccagguaaagucuagugaggcuuugcaaggaaaucuugcacuauuagucacaaauagcagaauugaaauucuacguguauaauauuccccugaaauuauaaauauauuugguuguccacacuuugaggauuauaauagcuacuaaaccucaaaagguuuucuuugugugcgugcauaugugugugugucuugagcacugggauuaaaggcauaugccaccacugcccauuuuauuuaauuuuuuaguucccauucaaaauaaugugauguuguuguucuuguucuuuaguuuuguuuugugacugugucugucucuguagccuuguuugacuuauguagccaagguuaacccugaacuuuuuaucuccuugccuucuguaucccagugcuggaugcaaaccaaacccugggcucugugcauagucggcccagguggguuuuuuguuuguuuuuaaagaauuguuuauuuuaugaguacacuguagcugucuuuaaacaguuuuguuuuuuuguuuuuuuuuuuguuuuuuuuuuuuuuuuuguuaagaagagcgcaucagccaggcaugguggcgcacgccuuuaaucccagcacuugggaggcagagcaggugaauuucugaguucuaggccagccuggucuacagagugaguuccaggacagccagaacuacacagagaaacccuaucucgaaaaacaaaaacaaaaaaaagaagagugcaucagauccuauuacaaaugguugugagccacugugugguugcugggaauugaacucaggaccucuggaagagcucuuucuuaacugcugagccaucccucuagccccaacuuuuuuuuaaguuuuauuauuuauuuuauguauauagguguuuuuccugacuauaugucugagccaaaugugugcauugccugaggaugccagaagaggguaucaaaguccucuuaaacagaugauugugggcuaucauauggauguagaauuggaacccagauccuuugaaacugcagccagugcccuuaacuacugagccaucucuccagccacuagacuugaacuaacugagcaacaucccuaaauuccaaaauaaacauuucaguaugaucuuuucauacacacacacucuuauacuuuaaaaaucuguuuguuuauuuuuucuagaugcuucaagaacucucacugguagugaaccauuguaggcuucuuggagaggagaucgaauuuuuaaagcgaugggggccaaauuauagccuaaugcauauaaaugugaauaauacugagugaguauauucaguucccuggagcuguuuuaguaagguauuauaaguugaauggcuugaauagcagaaacauaauugacuuaauguucuggaggcuagaagucugcagucaauauuaguaggggugacgacaucacuacccauugagagacagucacaaacaaaaggccgaaggugccugaggcucuguccccaguaugcuuaccuccacccuacugugaaugugcauucuugugcaaucucucccucuccugagcaaguaacuauuauaaucaaugucuugcucuagauguuuuaccuucuuuucuauuugauaaggauaagaaauuauagccaccuaaguuucuuaugcaaguauaaaagaaaaaucuguuuuuaauugugucugucuuuuauagauugaggcuuuuauucuccaguugugcagcauuugcaaaguuugagauaacuuugucucccucggcccauuaucccuuggucccguuaccguucaccauucacaaucacauugggaagacuggguaaguacacacacagcccaauaagaguucuggcuacuuuuguauucuucuuucauuccaaaggaccuugacaguguuagcaaauacuuugcgaaugugucacuuccuuuugacuuccuuuuccaguauuuauucuuuuauagucaguggucuuauuacugucuccaguuuugcuggagucccaucuuuuaugauggcuuugguuuucaacacuucucuguaaauggaacuggagauguugcucaguugguagcaugcagaaaggcuugggcugcauucucacuaccauauaaauggagcauagggugcugcacaucuguaaucccagccgcuuuacaggaggaggaagaggacggagcaggaucagaaguucaagcucauccccagcagaccaugaucuacuuuacaccuuuucugaugaugcugugacauauuagaagcuguccuucauuaauucauuagcgaacaacagcuuaggauuuuguagcuggagaccagauggcucaguugguaaagagccugccacacaagcauaaagaccugugaucccaucccuagcacacggguaaaaucagggugaggugauacacacccauaaucccaguuccaggaagggcagagauagcaagaacccgagaagcaguagccagucagucagugaaagaccugucucaaaaaguaauuuguagagcgaacgaggaaaacauuguuugucuaccucugguagacacccacauacacauaaacacacaugugcaugcaugcacaaacacaaaacaaaguggggauuauggaaggggcuggagagauggcucaguaguugagagugcuguucuuccaggaguccuggguuuaguuccaagcacucaccuagucgugacacauuagaacagacagccugucaaaagaguacagcagccuacaaccaccucuaacuucaggggacucacugcccucuucuggauggcuccaacaccugcccucacauguacccauuccuauaggcacauaauuaaaaacaaaaucuuuuuuuuuaagcaauuagggguauuggagauauaacaaagugguagaaugcuugccuagcauguacaaaggccuauguuuaaucucuagcccuauaggcaaacaacaacaacaaaacaacuauaucaguauacuuuacaauuauauauauauauauuuagccuuauuuuagaauacaguuucaaguaaaguucugcuuauuuccagaaauauauauuugugcuuccuaagaacuugagauaguauccaaggacaugaguagcccugaaggggagagagguauaaguuuuucagggaaaguaauaaaaaauacccuuuugucuuuucuagccaugaugaaauugcugcaauuaucucuaaagugcccuuagaggaaaacuaccugaagaauguagucaagcaaauuuaccaagaucuacuuaaggacugaaaguuuucccguaagacccacagaucacagcuauaacaacaaag

SEQ ID NO: 12294 - RNA, 6542 nt, Mus musculus
uuuguuuguuuuaaugaaauuuauuucauacucaucaaagcaaugugcuggugcuucauucauaaaaagucucauccauauuauaggaaccuauuuauucucagcuucaaugaaagaccucagugcgggcuaugaccaauucaucccccacacguugacagcuagguucuguucuagagagugcugccuaauguccccuugaaucaacuuaaauagaucaaccaaucaauaaauacauaaauaaauagguaagugguugcccaucagaggcaaggaggaaaacacaggcucucuuugaacagaaugugccaugguuucuugugacccugagcgaccugucuuggccgaggacuaaggaguccccuggagauugagcugucugcucauucacgaaaagggagcuccuuaacaugcccuggggaaggcauuagaaacaguccagcccauacuuuaggaagacacggauuccauggugaagucaauuauguccugaccacuguuguuucccaggaagacaggcuugugcucugcuugugaggugcugauguaccaguuggggaacucugcagacucaaacuccacuuugcucuugacuucuaucuuguugaagacaaaccguuuuuccaucuucuucuuuggguauugcuugggauccacacucugcagaaaaguagaaaaaagaauuguguuaacgucuguguccgugugcauguugcauguaugacagaaaggauaaagcuaccacgguagacauauucucagggcugcuggagaagagaaugaaaaagagguuguggaacuugaggccacauucuuuacugcugaaccccaucuuucuauaaucacugaaggaaccuuuguuauauauauauuuuuucugaauccuaccauaugggugagaauuauauuaaagcucccaaggguacccaguuuccaggcauuuuugucacaguucccccuaaaucccuggauagaguggcaucagcuuggaaaugaagcuuuuguuaggaaugucacaagugccaguacaggucugaggaucguugguugaacccuuucacugcauucuccaaacuguucucugucaaaggaggaaaaacugucaccauauacaacucuuucauccuugaugcuacgacuucuguugggggugauaacgguggccugacaugacaacagcaucaaaaaggauugauuucccaugguggcagugagguuuaugugcacuuaaaaguuaugcuaauuuuauucuauauuuauguaaaucgucaagaagaccucuaauguuuucuggcgggucaggcagguggaugucugggaaguaaguaaaggcagagucuucggugagcagugggggaggcuucucuacugauggacucaccuccagcugcagggugggugugccgucuuucauuacacaggacagguauagauucuuuccuuugaggcccaaggccacagguauuuugucguugcuugguucuccuuguacaaagcucauggagaauaucacuggagaaaggagaggagucugggucaagggaacagcaaugcagggugggcucaagcauuagacgugacaggcaaagccuaugcagucccccgugugaacccagaaugagccuccucagacacaagauauggacuagcagggcuauacagucauagucauagacaguagcaaggucaguaggccgauccaggauucccucaggaccucuuaggagcagcaaugaagaacgaaaggugucuaacuguuaagcucuaagggcuaaagcuguuauguggcuggcaggcuguguguccgucuacgugagaaguacaguuuggucgcuaugaaaacaaagcugugcuccuaaaaggaccuaggggccagcacguuuugaggaaaauagagcaggaggcagguagaacucuauuagcuggggagaguggcuccaaaaaagagaccccccccacuuugaucuuagccacaguaccucaauuggaggccccuggcugcuuuuaugacuuuaucaagaaauaagaauuauucuuuuuaaaagguauaaagcaauaagauucuuuucaccuggaccagaguagacagcucccuccaaagcuucuaagaucagaagcuaaaaggagacagcacacacugcugcuguuagcucuuguccccucagcuguggugguguggugccagguccacaccaucaucuaaagaggcccugaccgcgcuuggaaugcuuguuauuauggaagagagauguaugcuccugauagucagcaaaccucccuucaaggaacugugugugugguauuggugggaaggauaucagcacgagggauaggacugggaacaaaaauggacauaucaauucucuaccaucuacauuucagccucaaaugagggaaaaagaacccacaggcaguuauugcauguccaucaaaugacuucacacuaauguguuaucccuauaugacugggcuggaaaaaugguccuuuuucguucugucucugucucugucucugucucucucuccuuccuuccuucuuuccuuucccuuucuuuuuccuuuucuuuuuuuguauaaugaccauaguguuccauuuuaaaacacagggacccaguaggcugccaggaggccagaaagggaaaccaagaugcuccuacuuaccuuguugguugauauucuguccauugagguggagagcuuucagcucauauggguccgacagcacgaggcuuuuuuguuguucaucucggagccuguagugcaguugucuaaugggaacgucacacaccagcagguuaucaucaucaucccaugagucacagaggaugggcucugaaaguucaagagcagauguuguuuaggcagauaauuagaaaugcaagcacugugaagugaagcagcagaauuuggcuuauugagcaacaccuaagcaugugcagucaagauucuauucuaauuuuaguggggguauaaaaacacugggagugggcugggcaagaacauuggauuuggcaucgugagauaagcugcaguguuauaaccauucacuagggacuagcaguagugguccuugcaugaaacgaugccaguaauaagaccagcuuaacugggaaauugugagauucacaaccucuaguauaagccaaaguacuuggcaagucaaugguugaguugcaaguguaagcaucauuaaagccuuuuuauaaguuaaucagcucaagauagaacugauuuguuuggagguuuccucauuuucuucuaaugguuggaaugucuagcacuaagggucuugcacuugaggggcguugaguucuaagaggugggcugagaaggaccagagcgaaggucugcugucugcucucaguccucauuaaguaccuucuucaaagaugaaggaaaagaaggugcucauguccucauccuggaagguccacgggaaagacacagguagcugccacagcuucuccacagccacaaugagugauacugccugccugaagcucuuguugaugugcugcugcgagauuugaagcuggaugcucucaucaggacagcccaggucaaagguuuggaagcagcccuguggagaaaccaggcagugagcacaucaagucaucagaccagaggacuccuacaucaaccccagagaacaccaagggcccgggagauaaguucuuaaccacaaucccugucuauguggagcccagagaauuuaauuggccuacccagggguacauggcaaccagacacaggcuuccuggcauucucuauaguaaaccucauuucuacuuuaucuuucuuguacagaccuugccucacuguauaauuagaccuacuuaaacguuucaucuuuugguauccuugcugcucaaacaucauguuauuuaauuucucaugacaguauguucauguugucuucuauucaacggagaucacccaacaggcucucaauggcuucccauacauucuuuuucucauaggaauauuuagcagacacuauaagcauagcuuuuguuuguaaaauaugucaccacuuuucuguucuuuggagaaacaccacauuaaggccuaaacacaguugccuugaggcaugauaacaguuucaaagcuugaaggacagcgauagaucauuucaauaguguaaaggaaagguugauugggagagaaguuucuguccagaguagaggcucccagggaaagccauguucuggagcaggcagugggggacagagccuggcugggaaagugagaggcgucacccaaggcugaacuaacuaguuagaguggucuuaaaauacauucauguaagcuaaggacuagauucuguagcugggggagacuguugagggauugggaagaggucugagagaaacagcugccuccugaguggggcagugacguggcuggacugacgccauguggcauuagagcguucucagucaucauaggaagggacagcugggaugcaacauggcucuucaugagagcaagucuggaaagugcccuugugcuaggauggacuuggccagcacuuaaaacacuucagaauggaagguugugacagaucgccaacauuucagagaucuucugaccuguguuucccaaaggacacaguggggacugucuaugaucacacagcaaugaaaggucuugucuaaggccacagguuauuuuuaaaaauccuaacuaacuuuuuguuuauaucacuuauuucuuauuaucuuaaucuccccaggaacaugcgaaacuguucuuuggcagagaaggaagagaugcuaauucugaaggucaugcucucuagauccagaguucgauuuaaguggucagauuaagcuccaucucucucaaggggggacuaaauguauguugaagaccauacugucuucuuagcauaaaacaccaugauugccaucagcaagccuugguguguggcugugguaaaugaaaccugugugggagccaggucaguguguggguugccuuaucuaugucacugaaagaggcaaaauaaucccaucacaaaauagccugggagcaaggcagucccauaucccuucccguuuggguuuuuuuuucccaugccacagucccuccacagguuaggagccaagcucagagucucaccuucaucuuuugggguccgucaacuucaaagaacaggucauucucaucacuguaaugaaaacagauguggucaagugauagcuccuuaucaauacugagcagacagacuuccauuguucauaaaaccacaccuaccaugacucuuaaagcuucccaaagacuucugggaaguucuacagugcuacguaaguaacagucuagaagcagauucugggccagguaagugggugcucugguugcucucuguugacuucugacaccuaaauucuagacuagcagaguuagcuaaagucugagcucucugccuuugcuuccaagccagacuuugcaaaagagucucuuauccuguccauguggaaguuuuucuuaccauugcaucuguaggagucccuguagugacagcaccuaagucccuagguugggcuugggagugaagaggucagucuuuaagcuagguugcuugaacucugauagccacugaaggagaugaguuggggacucucuggccucugaaaguagauagcccuccauuccugaaagcagagugcuggauaugugaccacucuccaguacccacugaccugucaaaagguggcauuucacaguugaguucaggaacaguugccauagcugcuucagacaccugugugaagaaagaaagugggugggcauccagcguuagcuccccgaggggcguccuucauauguguuucucuuagcucuaguucagggcaggcaugcuaaacuggucucugaggaaugaaggaacggaggagccguuguauaggucuagaacaguggcccuuuuggagucaaguggcccuuucacaggggucaccuaagaccauuggauaacacagauauuuacacuucauaacaguagcaaaauuauaguuaugaaguagcaaugaaaauaauuuuaggguguguggggggucacuacaacauggggaacagcauuaggaagaugcucuggaaggaagcaacagcagagccaaacccuaauaaagaagcuuuccuacaagacaggagcugccuuuuagaugucagcggcuauacagacaguacucauuuccagaguacuucacaaaccauggagguacagcuacuuuuuauaaauaaaaagcccaaaguccaucagugggggggggggaaagagagagagagagagagacagagagagacagagagagagacagagagacagagagagacagacagagagagacagagacagacagagagagagagagauagacagacagagacagagagagagacagacagagacagagagagagagacagagagagagagauagagagagacagagagagagagagacagagagagagagagacuuacuugcacaaggaagcuuggcuggagaggaucccagaugagccuauuaggccucg

SEQ ID NO: 12295 - RNA, 9688 nt, Mus musculus
uuagguuuuauaggaugaaaugccagaauuuugauauuuauuaucugaaauggguuuaacauuuggagaaauauguucaaacacauaucccuggaaagaaaagcaagcugacaggucagagaacagggugcaggcaggaaacauaugcucaauuuugcugcgugucaggcaaauguagaaaauugggugcuuuggagaauagagagauugcugauaggguaaacacaaaauacaagccaauuucugcuucuuuaugagggcccacaagauaaucaauuguacacauauaugacuacaauguuaauaaagaagaaauauuauauuuuauuuaguacuuuggccagaucagcccccuggaagggauuauaggcuuaagaaagaacaagaugccaucaucacuuccugacauagucacaguuuuccuaauuauucccacugguccugcuuuguucuugcugcagggaggguggcgagagcuuuucuaucagaucaguaaugucugguucuuauccaaauauucccccuaauaagaaugaaaguucucacggauuggacaaccacucugcaacauuccugagaauugaagaauauaaucuugaaagucagcaaaguagauuauccuuuuuuuuuuuuuuuggacuugaacuugugaacuuuaacaguagugcugcaagaaacagacagcaagugugcaagcacuuugcucagcaaccuuccauguagacuuugcaucuuaaauacacacaacugaaaaacaacuacaauucuuuuugaaaauuauauacaaacccgauauuucuucugauuacauauaaauacaaauuaacuaucuuuuuucccuaaaaagugguuauaauaguaaauaaauacaaaauaacucugaccauuauacuucaugugcuggaguugaacccauauaaaauguacaacuaaauacauuuuaaaucuuuaaggaauaauucucugauuaaaauauuuguuuucccaacuucuuuucguagauauaaauauauuuucaaaauagcuguguuuuuuuccauuccauuccauaaauaaagucuucauugggaaauauuaaagugucagcugguuuuuuugggggggaggcagggggaguaggguuuuuucuguuucuaaaauauauauauuuauuuauuuauucuugcugugcuaacgacacccgcagcccuccacaaccauguccugauaauuuuuuagcacaaccuuuucauuuucaucuagguacaacauggagauugcgcugagcucuguggggacacagcaugccuuagggauuuuggaauucacagaguucaccagagucugcacuauggcaugguuaguggaguucagguggucagcaaggggaaaaggacacuccccauggcaguaaaaggcaugauagcccggaggugccacgauccagucauuccaccccacaucacugaaguccacauacaaagggugucucuugcagcuggacuugaggcgcuuccgcuguuuguguuuggcuugacgcuuuucucguuuguggagcggauguccuuuuccaucauguccaaaagucacuagcaauggccuuaucugugaccagcuguguucaucuuggugcaaagaccugcuaauccucacaugucucuuggagacaccuggguucuccucuaaaugggccacuuccaccacaaacccaugguuggugugucccugugugguccaccgcaucacagcuggggugacgucgaagcucucccacugacuuguguucugauucacuaaccugguguccaauagucuggucacaggaaauuucaaguuggcugcugcaggcuuuauaauuucauaaauauuaauucggugcuggaaacuacuguuucccaaagcuuccuguaucuguucccggaagaucuggaguucugcagaugugagaaacucgucacuggggacagaacuuaaauugaagaagaagcgccgggccguuuucccacucaucucuggaaguuccuccacggcuucuaguuugaucaggguggagagaaaaaagaaacgcauuugguaagagagccaaugguaacuuaauuccuuacgagcauuuaaaacuucagugcaugguuuaaguuaaacuacauaaaaaccugcaaccagaaauuaaaaaugucaggccuagagauacaaugucugccccucuguccauggcccugaguuuacugcuuaacacaacauauauauauauauauauauauauauauauauauauauauauauauauauauacacacacaacauguauauauauguauauacacacacacauauauauauuaaagugaaagcggaguuucuuuucccuuuucuauauggccacauuaacuuuguaauugcuacguuuuuaauccaauauaugaacauagcuucuagguagcuauaauaauggaggaaauagugaaacacuucuuuggaauucacagacuuuaaggggaaaaaagucagcacuguaguuaguagagagcuaaugacugaggaguugaggaaaugacuguauuucuuaacuaagaaaacgagcuuuaaugucaaucccuuaagcagccugugcaaacauuacucuacaauuuagaugauuuacaaaucucaauauacagauuucagccccuuaauuaaagacuuugaaauucaacaucaaugaugacauuuugcaaagcacacccuaccauuuugcucagaacucuagagacaaaggcauccacagggacauaguucuucagaaggguauggggugacauuaggcugcuguagcaauucacgauaaagaaaucccuuccuacuuccuguucucucguauccaucucauccucauucggaauaacuucuguguugauccagcagugcuuagacuuugaccugcacaucagccggucugggaagaggccugcacuccugcaucuccauuaagcucuuaagcaagggaugcugcuguuucuggaccacacagagucaagguuuaaaaggaugcuuuucauacucgagcguauacugaugaaggaggagacuuuuauagaaaaagccuuaauguuggccaacacaugaggguucaugcuauguuaagccagccagggacucaaggggggucuucuaaagcucuucucuuugaacaggaagauuaccagaccaagcugcgauucuuucauaauccucuugcaucuguuugccaaaaaguucuuggugauaccuuuggggagccauuuauguucugaacuccacuaucgguuaaugguacuuuaggacaggggcauuccuagaaaguaugaaggacuguauuuagcuucuguuauaaaaagccuuucaucaccauucuggugucccuuaauguuucugccuaaggcaauucaucgauagaaaauaaaaacaguagcaaaaucccguggacccuaaucacaccggcaucuccugacuuuggcauggugacaugcacuuuauuuccuguacagacagaguauaaaggcugacuacccagggccuuccacaaauugcuacaacagucaacaaaagggaagaggugagccucaagauaaauaauggagacaggucauugaaguaacagaauaauaucucaccaagaaauaaagccaaguuuggaccauaugaaauugucaucuuucaacugcaaacauagaaacaguacucccuguggccuaucacucuggagguaagaagaauuuucaagacagaauaagugggccuucacagagaacaauauuacuacccaagacagaugccaaaggaaagagcaaucucuagucuuucagcagcguuuccaucagccuaagccuugaaagaucuuaucccauccuuuauaccaagguaucaaacaugacuauucauugaaauuauacagagaauucaagaauuuacagaagaccucaacaaggccaacuuccucagggucaggacacacaacaccucuucuacuucaagggacaaguuucaaccucuucuugaggguggaaaauugaaaauaucuuuuaaauaaagaaaauuacaggaaaagacuucuacaaauuaucacagcaaaccugggguucugaaaauacagaguagguaauguacacuuuuuggaagcuggaauagcuguuaauucucuguaaauaucccuuguugaaucagcugaacuugcuaagugauuucaggauucugaccugucuccaaccugagugucagccuccuagaucuuacagagagaaugguggcugccauacugccugaaagaggagcaagugggacagccaugccauucuagccucuucuagaaacaaaacccagauuuaauguucuacacuauguugauuauuccucuaccucaaaauaacccaaaagauauggcuagggccacuuccuagaacaaggauaugauauaaaaagucaccaggaaacauuaguucauaugcugaaugcuuucuucucuuucuuuuccuuccuuccuucuuuccuuccuuccuuccuuuucuuccuuccuuucuuuucuuuccuuucccuuucccuuucccuucccuucucucucucucccuuccuuccuuucuuucuuucuuucuuucuuucuuucuuucuuucuuucuuucuuucuuccuuccuuccuuuccuuccuucugccaaaucuggugucaucaccuuucuaugaauucucuuacaagaagcacauuaagaaagagccaugauuuucuccauuuugugaaugaaacaguagagaauucagagagguuaugugacuuccuuaggucacagaacuguuaacuugaguguacugcaaugcccaaguucuagccauugaaagauauuaccuaauguaggagagaaaucaaauccuaagccauagcacaaaucacuaggaauugguaccugauaccaugguaacugaagauugaguuuugcccugaagaucaaaacuuauugcccagcacccuuuagaugcagacagagcuaaaugaacagaaaauugaagggacacagccaaaugggacaccagaccuuguuuagauccugcucucuguggcuacuuguuugcccuaaaguagggugaguuucauuucaaaaguuaucauuaagcuuggaggauuuugcaacacuuuuuggacagaaagcauuccuccaucaaaacaacaacaagccuaaggcuauuccagaucagcagcugcaucucaccgcugcaacaagauucaaggggcuuugggccacacugugauuuucuacaggauaaaguacaugacaaauaaauaaaguaaaugacaaagaggaagaagaaaagguuuagacacagagaguuaagguuuaauuuuuaaggcaacaaaggaaguggcagggaaggaaagcaggguuugguaguugucacuaaccugccaaggucccuguucuccugaacacagauccuacaagggaaccugcagcuccagaaagggauucucuaaagaccaagcgaaaugccacaaggcacauguagagaggacaaaagcagauuggaaaugucaagagggauugaaaggauccucugacaaacaagagauacugagaacaucuguggcaaggaacaucuguaaacuaagcaacuguuuuuccccccagggucuucguaaucucacugcaauagccagagguagagagaaguauuccuggaugccgguauucaaccccaugcuagaauuuaggauggaccauacuuuagaguuguacuuuggaauauccuagccuguggcuaguuucugggcaguugcacuucugcuaacaggaucucucccucuuugaaaacuuuagucacagggccacauaguuuguuuauuccauaaagaaaaagaaagacugugcucuucauagucagaagagcaagcuuggauccuucaguauaugaucugccacuaaaggagaagucucuguagggccaauggagucaaucaauuucaaacaguuucucaauggcagccaguuggggaggccuucggugaccuuggagugggguuggaggguggugauucagcaaagccugggcucuccuggauaaaaauccauggucuuaauguucaacaggagauuuugucuggaagacucugccacugguugaaagacuacuaugguauguuuugucucaucguggcauuaagccacuuucuagaacuuaggaagaagucuaccaaguaacacauggcuuauuaagguuuuucuaguggcacaagaaugcuuaaaaacaaacaaacaaacaaacaaacucuagguuacucaacaaugugaaaagucuucccaaaugccauguguaccugaucaugaccaaaaaaaaaaaaugguuuuccugaaauuuacaguaaacauuacaucuaauugcaccaagguauaaaguuagugcaaguuuauuuuaaacaagucaauaacuucuauacaguuuuacaacagaaaaaucacuuuuaaacuacauuuuuugcuuaugaacugaagcucacuaaguuuucaaauaagacacacagacuuuguuuugucuguguuuuuaucaagcuauuuccaaaggaagaguaagaaaaauguagauuuuuauugacgaaccuuucauucaauuggauuuuugaguuucaauugacuuaagcgauucuuuuagcuuaguuaagauaaaauaccuccuucauuuuuuauaggucaggaauaauuuucacguuagaaaagacuaauaaggaaauacaugaauauaugguuuucuugcuauaucuccagaggcagugggaaaaacaccugugcuggauaguagguuuguuuguuuugaucuauaaaaacuuuccaaugaauauuaaccaggagagauuagcuaagcccagaaucaccuggggguggaaggugggggugaacaccccagaaucucccugcuuucaguaggcaaaccuugaggagcagaauguggucuaagcuuugcucccagaaagcccuagacaccaguuugaaagagauggauuuccagugcccuucauaaccauuggcugccucaagacagauccaucucgcgcucugugaccugcuugugggacuuuuuccuauuaucacccagacuucucaagguuugagucagucaucccuuacuggagaugggguugggcuaucauuucagagccuagauuucuacuuaaaauuuauccccucagcaaggcaaagcaaaacuuuaaaaagggaaauucucucccagcuccccacuguucuauaaauugcagcucacugacagacaacucugaauucuucuagaacuugaaggaacugauguucuauggagaauacauuaagucaaaagcacauugaaaguggcacacacagaauugagcuaggucaugauuuuuuacuaacugcuuucagaacaucggugcaagagacuucaauaggccucuacagccuuucuaauccaggaaauuucagcugaaauaaacaacauuauucuaucuugggaaaucauauucauauauuuguuuaaaaaccccauugccuugccuaggaagguagcaggcagugggagaaaaggcuuuuaucugaaggcuugcgcugucuccacuuggagauuuaagauuuaagcaaagaaucgaaggucauuguggaaacaauaugacgaauuguggaauugaucucccacggggauuagauagggauucagaaaucuuucaaacuaggcccagaugaacaguaaauuugaaugcuuugaggcccuggauuugauuugcuaauacuaucuccgaacauucugcccuuggcucugccuagcuuaaaacuacagcgugaacacaagucacagaucugagcuuccaagcagauuuaaggagcuccaacucucuaccuucuguggaaaucucgcaugcugugcugacuaggggcuagucagucucucacccucuuccccaucacucgauuucccuccaguucuagggggaggagccugucuuuuggcuacuugccaggaaagggugaggacucaccagcggggaaucccuggcuggggccacagaggggaccguacagaagccgaaaggccuucuacugugcuaguggaggcccgggcugcccgccuagucuccgcccgcccgccguccccgccccgccacccgccgcccgcucaccuucgugauggaagcugcgcacgguguuggcgcggcuggcugcccucuccagccgguggucuggggcgggcgcuccuggcuggccugagugccugcgguacagaucuagcauauaggggggcaccacgacguccuugcugggggugggucucugcuucaggccaaacaugcugagcagccucaacucaaauucgcugaggacgucuuccgaaggccgggacaagggucggcuggaugccgcggcgaacuucuugcggcccagcucuggaaugaggccggccgcgccgcccaggaggaccuggggaagcagcaacacuagaagacagcgggucccggccaccauggucgaccugcggacagggccgacgugagucacccacguuccccgcccaguccuccgcccgcccccgcggccucggcucccauagagcucgcuggccuucuccaggaugcccuccuggcaugucauauucgcgggcuacagccuggaugaucaagaggauggaggacccccaagucccagccggacuucuuacuuggggcuuggucuuaacucccaauuaaaaagagcauugaccgucuguacccuuuucuugugacacuagcugggaaugcgggugucaggaagcugggaagccauagguuggucggacacugcaucccugacaaacuuauacagugcagcgcucaugugcauauuaacagacacaaaugcacaagugacuuccuuagaggcgcuguauacaauuuccugguaguugagcauaucaaacuuguagauucaguaagcgcuaaacucaagauuacugcuaaugacgccacuugcaaguuguggccuacgccccuaacuauuuaagguugacccacaggcaacccugucccccuuccccagacuccugugcagucaagaaauccaugcaccuuccugcaauuaacuaaauagauaguguuuaugaaugcacguguaagcuaugacacauucgcauagucaguaaacacacauggagaaccccaacuuuuaguaucuuccuaaaugggaccuacuucuuaaggauagccaaggaucucuaaggcuuggaguacuuacuggucagcaaugaacuaguaaaaucuacuggccauacucuuuaaauggauuucugcauuuuuuuuuuugaaagcccaaaacagcccuuauaauguaucgaaaacuuggggaggaggaaccggcuggaggaaggucgcaggccagugggcaaggcagagggaucugggguuuggaaugccuaaccccucuagggauccgcugcacgugcaccgggugaggguauguuuacguccacuccacuccaccaguccucccaggcgcccugcgccguugggcgggaagcggugucacccgccagccaaccccggguccccggcccguguccucuaccuuuaggagaccgcaguccgucuaagaagcacuagggggcacguccauugagagagucuccacauggaaaaagcucuguccgagggaccuggagcagcaacugggcuucuguugcuuuucuucgccuccuccuccuucuccggguguucucccu

SEQ ID NO: 12296 - RNA, 4093 nt, Mus musculus
uaaaaucggcaauaacacuuuaauauagauuuguggaauucuggccauucuagccagaacacacauuuauaagccauaaauaaagcacgcagaaaccauaaauuaaaucagacccgagaccuggauuucaccauguccagaaugggauguguuuuucuccuuucuccugguccgguacaccagacucuuacauuauuuuucuuuccucuuuucaacaucaguacaacccucugguuuucuguuaaaacuacaugguuuuacaccaagucacucacaaaaguuuuuuguuuguuuguuuguuuuuaaagucagacuuuucugcaacaacagcaauagagaacaacaacaaaaaucaaacucugcagaugucuugagaagcaguagucuacauagaggagaccaaaggcuccuuuaaaacaaguuuauauguauacauauauauuuccauucccuucccuauuuagaaugacagaucacuguggcccaucuauuuagggacacagacaggugagacugcucccuugaggccugaagugugguggcuacuuuuccucaaagcucucccaaagucuccacucagccucucauuucccuuguccccagugaccagagcuagcagggccugaaagccaucuucuuaggaugaguucauaauaggccuggaguacacuccuugguaguaggaagugucugcagccaggggcgaggcauccaggcccgcuuuguucgugacugggcccauggccaagcugccuggcaugggggaaccauagcccccuggguagugcaugaccuguucguaggccuugagguccauuuuguggggcugaugguggugguggcuguggugauguugcugcucggacgacaugagguuguugauagagaaggggugguugaaggcguaauggugcucgggcuucaggugggccucugguggcaggccuggguggugaggugggcccagcaggugggcugcagccugcugcugcugcccaggcgagggcgccggcucgggaggacucagcgcagaggcaggugcucccuuuagcucgcuuaggccaccucgcuugugcuccugacacggagaagcgcuggaauggggggacucggugcccgccggagucucggaggccgagcccgcggccuccccgagcugagccugagaggccugggacccaggagcggucuucuugccuccgcuacuggccgcacccgcggcuuccuucagugccaguugcuucucacacuugaagcgcuucuggcggcgcagguagcagccguucucgaacauguugcccgagucugggugcaggguccagaaggagcccuugccaggcuugucuggcgagcggggcaccuugagaaagcagucguugaaggagagagaguggcggauggaguucugccagcgcugcugguucugccgguagaaagggaagagguccaugauccacugauagaucucgcucagcgucagcaucuuguuggggcucugcuggauggccauggugaugagcgagauguacgaguagggagguuuggcguguguguagcugcgucgguaugucuuggggucccgagcgcggcucaggccggccugcccguacauggggcucaucgaguucauguuggcguagggggcaaggccacccauggccccggccgccugucccccgagcgggcucagacucggacucaggugaggucccaugcccgccacgccggccgccccggcugagccgcucaugcccgccauggcgccggcgcccggggacaugccagcuagcgacgggcucauuccagcgcccacauaggaugacauguucauggagcccgcgcucauguugccggaaccgccgcccauggcagccgcggacaugcucauguauguguucaugccauucauccccaggccggcguucauguugcucacggaagaguagcccugcggacagagcccggggaggagacagguuagcaccuaggcugagcucgcccgaucuucccacccacccaccaguuggacccagucccccgcaauucgugcaagccucuggaaucucuugcuuucccuggaucccagugcaccaacaccaaguccucugggccccaaagagagccggaaaagagaucgcccuagggccagcgggaccugaggcucagccucgcccagauucuagaacuucagugaccuggaccaccgccaacucaggcgccccaaauguauuuuacucucccuaggggcuccucaaaucagcuggccagcacacugagucagcaccgaggccggaaaucuccguugcuaucccagguagucaaaagccaccuuuggaaccucacuggggcagucucaagcgaaaaucaucucaguguccucuauucugggguuucguaccgggaccccacuccuuagucauaggggagugaagcgcagugccugcacagaguccgggagcagcuggaggcaucgcguggaggaauaaggaagggaccgccaacucggcuaggaacuguuagugucccggcuucguagcgacaaacuuuuuuucucuuuguccacuggucuuugauucuuugccuguaccucuguccccaacuccuacccaccuucucuuccccagcuccccacccccucgccagccgaccucccaccccuccccagccgcgcgcugccaaacauaacucuguuaggauagugcguggcucggccacgaagaggauuuggaggcgccgcaagucaauauuugaucacaaaguuaauauuaucucaaggcuaacagugugucguauaaaaaagagacccauuugaguagaaggagggcggaaaaggcggcuguccaggaaggcuagaggugggggggcggguaccggugaagggagcgugcggaggcuggggacgcggagauagcugucaccccacuucucccuggccagggcaagagcuuaccucgggcuccgcguaguagcugcuccagucggauggcucgugcccuuccaucuucacggcucccagcauacuggaagccgagugcauggcgguuuaaaauuuaacagccacaacaaacgaccagcaaucagcccccacccccacccucuuaaaaaaaaaagucagcaaugguaccguccccucccucccgcccucucucgcgcucccccucucucccucucuggacuccacuuccucucucucucccgcggccugcggcgggaaguagcugggagugggcgggaagguggcuggcggaggagggggccgaagaacccuggaggccggaacccgagacucgccgucgggcgugcacucugucgccgcgcucccggggcugccggugcaggcugaggcuggcagugucgagcugccgggaggcggcgggaagcuagcggcgugggggcgggcggggggagagcgagaggagggggaggaggaggaggaggagguguggaccgcgcagcggacaagugccgcaaugacgugagcggcuggugauauagcgcggugcgcuggcgcuggccuccaauccccagaccccgggcagcccauuugaauaaucagcucacacuuaggugagaggaagccagggcuagcguuccgcaccugccgcugggcgccccgagcuagcccaucuccugcugucccuggcacucccaagaccccgaccugcaagcaggcgugcuggcgcccugguggagucccuuccuuuacguccacggggagucuuccguggacccagagaccugggaucaagccacccuuggagaaacucaggucuccugcucccgccccgccccuccucaucgccccaagcacgggguucgucaauccgaaggcgcguaccgccuugguggccugcaaagcgaggcaagccagauuuauuuaucucggguuuccucccuuuuagugcacauucccugucaaaacaacaagcaggugacagccaauuugcaaagcgcuguccuauuuagaaaaacuguguacacaccuuuaacucgcuggccgcugcuccggaggccccuccccguuacaguuaagucccggggcggccucaggaggcgcguaggacucgcguggucuggccgcccuggucgucag

SEQ ID NO: 12297 - RNA, 4093 nt, Mus musculus
cugacgaccagggcggccagaccacgcgaguccuacgcgccuccugaggccgccccgggacuuaacuguaacggggaggggccuccggagcagcggccagcgaguuaaagguguguacacaguuuuucuaaauaggacagcgcuuugcaaauuggcugucaccugcuuguuguuuugacagggaaugugcacuaaaagggaggaaacccgagauaaauaaaucuggcuugccucgcuuugcaggccaccaaggcgguacgcgccuucggauugacgaaccccgugcuuggggcgaugaggaggggcggggcgggagcaggagaccugaguuucuccaaggguggcuugaucccaggucucuggguccacggaagacuccccguggacguaaaggaagggacuccaccagggcgccagcacgccugcuugcaggucggggucuugggagugccagggacagcaggagaugggcuagcucggggcgcccagcggcaggugcggaacgcuagcccuggcuuccucucaccuaagugugagcugauuauucaaaugggcugcccggggucuggggauuggaggccagcgccagcgcaccgcgcuauaucaccagccgcucacgucauugcggcacuuguccgcugcgcgguccacaccuccuccuccuccuccucccccuccucucgcucuccccccgcccgcccccacgccgcuagcuucccgccgccucccggcagcucgacacugccagccucagccugcaccggcagccccgggagcgcggcgacagagugcacgcccgacggcgagucucggguuccggccuccaggguucuucggcccccuccuccgccagccaccuucccgcccacucccagcuacuucccgccgcaggccgcgggagagagagaggaaguggaguccagagagggagagagggggagcgcgagagagggcgggagggaggggacgguaccauugcugacuuuuuuuuuuaagagggugggggugggggcugauugcuggucguuuguuguggcuguuaaauuuuaaaccgccaugcacucggcuuccaguaugcugggagccgugaagauggaagggcacgagccauccgacuggagcagcuacuacgcggagcccgagguaagcucuugcccuggccagggagaaguggggugacagcuaucuccgcguccccagccuccgcacgcucccuucaccgguacccgcccccccaccucuagccuuccuggacagccgccuuuuccgcccuccuucuacucaaaugggucucuuuuuuauacgacacacuguuagccuugagauaauauuaacuuugugaucaaauauugacuugcggcgccuccaaauccucuucguggccgagccacgcacuauccuaacagaguuauguuuggcagcgcgcggcuggggaggggugggaggucggcuggcgaggggguggggagcuggggaagagaagguggguaggaguuggggacagagguacaggcaaagaaucaaagaccaguggacaaagagaaaaaaaguuugucgcuacgaagccgggacacuaacaguuccuagccgaguuggcggucccuuccuuauuccuccacgcgaugccuccagcugcucccggacucugugcaggcacugcgcuucacuccccuaugacuaaggaguggggucccgguacgaaaccccagaauagaggacacugagaugauuuucgcuugagacugccccagugagguuccaaagguggcuuuugacuaccugggauagcaacggagauuuccggccucggugcugacucagugugcuggccagcugauuugaggagccccuagggagaguaaaauacauuuggggcgccugaguuggcggugguccaggucacugaaguucuagaaucugggcgaggcugagccucaggucccgcuggcccuagggcgaucucuuuuccggcucucuuuggggcccagaggacuugguguuggugcacugggauccagggaaagcaagagauuccagaggcuugcacgaauugcgggggacuggguccaacuggugggugggugggaagaucgggcgagcucagccuaggugcuaaccugucuccuccccgggcucuguccgcagggcuacucuuccgugagcaacaugaacgccggccuggggaugaauggcaugaacacauacaugagcauguccgcggcugccaugggcggcgguuccggcaacaugagcgcgggcuccaugaacaugucauccuaugugggcgcuggaaugagcccgucgcuagcuggcauguccccgggcgccggcgccauggcgggcaugagcggcucagccggggcggccggcguggcgggcaugggaccucaccugaguccgagucugagcccgcucgggggacaggcggccggggccauggguggccuugcccccuacgccaacaugaacucgaugagccccauguacgggcaggccggccugagccgcgcucgggaccccaagacauaccgacgcagcuacacacacgccaaaccucccuacucguacaucucgcucaucaccauggccauccagcagagccccaacaagaugcugacgcugagcgagaucuaucaguggaucauggaccucuucccuuucuaccggcagaaccagcagcgcuggcagaacuccauccgccacucucucuccuucaacgacugcuuucucaaggugccccgcucgccagacaagccuggcaagggcuccuucuggacccugcacccagacucgggcaacauguucgagaacggcugcuaccugcgccgccagaagcgcuucaagugugagaagcaacuggcacugaaggaagccgcgggugcggccaguagcggaggcaagaagaccgcuccugggucccaggccucucaggcucagcucggggaggccgcgggcucggccuccgagacuccggcgggcaccgaguccccccauuccagcgcuucuccgugucaggagcacaagcgagguggccuaagcgagcuaaagggagcaccugccucugcgcugaguccucccgagccggcgcccucgccugggcagcagcagcaggcugcagcccaccugcugggcccaccucaccacccaggccugccaccagaggcccaccugaagcccgagcaccauuacgccuucaaccaccccuucucuaucaacaaccucaugucguccgagcagcaacaucaccacagccaccaccaccaucagccccacaaaauggaccucaaggccuacgaacaggucaugcacuacccagggggcuaugguucccccaugccaggcagcuuggccaugggcccagucacgaacaaagcgggccuggaugccucgccccuggcugcagacacuuccuacuaccaaggaguguacuccaggccuauuaugaacucauccuaagaagauggcuuucaggcccugcuagcucuggucacuggggacaagggaaaugagaggcugaguggagacuuugggagagcuuugaggaaaaguagccaccacacuucaggccucaagggagcagucucaccugucugugucccuaaauagaugggccacagugaucugucauucuaaauagggaagggaauggaaauauauauguauacauauaaacuuguuuuaaaggagccuuuggucuccucuauguagacuacugcuucucaagacaucugcagaguuugauuuuuguuguuguucucuauugcuguuguugcagaaaagucugacuuuaaaaacaaacaaacaaacaaaaaacuuuugugagugacuugguguaaaaccauguaguuuuaacagaaaaccagaggguuguacugauguugaaaagaggaaagaaaaauaauguaagagucugguguaccggaccaggagaaaggagaaaaacacaucccauucuggacauggugaaauccaggucucgggucugauuuaauuuaugguuucugcgugcuuuauuuauggcuuauaaauguguguucuggcuagaauggccagaauuccacaaaucuauauuaaaguguuauugccgauuuua

SEQ ID NO: 12298 - RNA, 7810 nt, Mus musculus
guaugcaucaacuguuuauugaaaggcgaagcaagauggaggaggugagaagcagggaccuggaaaguacaaccagagggggcacaaagguggugggaagugccugaacccucuuccucccacccaggaagccccgugggcuugcaagggguugccagagacaggauccgacgcuguccuagagcgcccucuagcguccuacaggaggacauacuuuugucuggaccacccauaggaagaaagugcugggaccuaaaggagugcacacagguuuauuaggcucaggaucaaguccagagggcauugcugucuaggggguggacuuugaggggcaaaaacauuccacuuuuccuaauccuuggaauuuauauuuuuauuaccuuucuuugugauuggggguuaggggugagggucaggggacaacuguggggagccaguucuccucuuccaccuuguaggugugagagauaaaacucagaucgucaaucacgccaggaaggcccugggccuuccugggccguuucugagcccucucugggucguuucacgagucugaaugagcaguucuugguugaguuugcuccuauccuggacaggggugagauuggagcaugggacuugauuuggggggaguggggagcuauaaggguccuagagagauuggcacuacugagaggaagaagucaaggugaugaaagcaaggagugccaggcgggaagggucugacuucuccagccugcagacuuacaagucccgcuggggcuggcuggucugcacagacugcugcccaaaagggcugggcggggucaagaacggcgacugacuacuggucucauggaaggccggggacagcuucucaggcucaucccugaauacuuccacggggcugucaguuucagugacgaggggcucugccuugauguccuggaacauccaaccagaggcgaucaagaagaggcagacagccagcaugauccccgcuacuccgcacagcgucgcuccuaccacacggcaggucaugagggcuugguuguagucggcuacuggauccuccaucgaugagaacuuacuuucauuaacaagcucuaguuuggggggcacugcauagccaguggucaaggcugccacacccagcaggagaaacagagaggccacggccacggugaccugaggagaagcagacggaucggcaaggauucaggcucaacuguggccgggggucauaagaucaugaaaugggccucacagaacaucccucugggacuuaauugauagagaugggaggagaacccaggguuuugcacauggaaggggcaaacacucuacuauggagcuacaccuucagcccuuuuugaauuuuaguuugagggcagucgugcucugcuacuggggauagccuggaacuuucuauguagcccucgauggccuugaaagcuugccuccuaaguauaggaauuacaggcaugaaucaccauacccacccuagcaaugguuuccaaagcuaaccuugaguucuguccauuguuaucuaggcucuauuauuauuauuauuauuauuauuauuauuauuauuauuauuauuauuauuauuauugaguguguauguguguguuguaugaaggggaguguauauaggacauauaguagcaaggggucaaccucugguguuucucagaaacaggaucucucaccaggacccggaacugaguggccaguaagccccagagauccuccugucucugugucucuuuucacuauuguauuuauugauuuugagacaugacuucucuacguaggucuggcuguccuggaacugcuauacagcccaggcugaccuccaacucaccaaguuccagcugccucuuaagugcugggauuaaaggcauguaccuccauauccagcucuaccuggcauuuuuauguggguacugggauugaauggagggcaagcacuuuacugacugagcuauaucccagcucuguuuggcacuccuccuuggguaccaucugaccccaugauccuuuucagccucugucucuuuccuagguugaugcucauacauccucaaaucucaucucgaaccguuccucuaaggcaccuucccggagacuugggcucgggcaggugucauuucucuuuacaaagcccagagccgagugacccuuuagugcagccaccucugaacagauuuggccauggauuuuaguuuuuaggugagugauggcugccuauuuuacuggacugaacccuaugagaacaaagacgggacauguuuugacucacugggugucuugugcucgaugcagugcuaaguacuaguugaacaaugaaguggaccauacaugagaguucuuaaagugggagguugggggauggcucagggguuaagugcuuuccauggaaacacaaguauccgaguuuugauucccagcacccauauaaaaaaaagcuagguuugggucagggcaugguagaaagaacaugacuguaaucccagaggcuggcuguuuucugugaguucuaggccagcuggggcuauuguauacagugaaaucuugccuuaaaaagccaggcaacauaugucuauaauucuagugccacaaggguggagaccuccagagcucacugacuagacgaauucagugaaagacugucucaaaagguaacgugaagaaaaauaguggaagauaucacaccuaccuccccaugugcacacacagcacacacaacaccuaccuucccaagcauguauacacauguacaaucaaacauguacacauguuucaaaaaaaaagaggacaaacaagaugucucaguaggacaaggcacuugcugagcaagcccgacagcccaaguucgagcccagucagccauguaaagguagaagcaacuccacagaguugcccucuaacccuggcacacaugcccauguacacucaucauucacacagagauacaauaauaaguaaacaaaaauuuuaaaagaggccgggaaugguggcacacacguuuagucccagcacuugggaggcagagguugguggaucucugugaguucaaggucagccuggucuacagagugaguuccaggacagcuagggcuauacagagaaacccugucuuaggaagaaaaaaaaaagauguuagcuaugucugguggcguuuguaaucucagcuaucaggagacugaaauagaauaauggccaguggaaggccaaccugggcuacagagugaguuuaagguuaucccaggcaaauguuggaagcuuauuuaggauguuucagugcaaucccucauaacauacacacauuuauccccccgccccccacacacacgaguuagcaccuugccucaccauuagagcggagccccuugaaagcagacggagggacccuuggcuucaguuucucuacaguauuuagugaagaaguauacaaagggacuacugauugacaccucaggcuguuaugagcaucaguuguguguuucucacaugucucuucugccugccaaugguacccacagugggaaaccacagugagauguaggugagaugaacuccacauccggcagcuguguuuccccuccaaagccgugauaauuagcacagcguuggcaaauggcccaaagagagucagacuucuaggaacaaaaugcuuucauuccuucucgauuuaauuucauuuauucacuuauuaacuuauuaauuaauugauguauuucaaggcggggggucucacucaguugcucaggcuggccuacaacacacuauuucuauuccaggcuggucuugaacucaugaucccuccuccucggcuuuccaaaguguagaccacaguuuuauuaugccucccggaagucaguuaauuucuggcauuuuuagguugaucuuucuuucuaaacagauguagcucaggcugccucaaauuugcuauauagccaaauacgaccuuaaaacucuggucccccugcgucuaacuuccuagggcuaggaucaaagugucaccaauacacucaaguuuaugccaugcugggauucagacccuggguugcuucauugaugaccuagaacucacaggaaguagagagagugacgugacucuguagaguugcccucugaccugggauuauccgagaagacuuccuggucagaguacuuuaggcagaacuaacucucucucucucucucuguuguauauaccuguauauacacaucuguugcauguacauacaaaugcauacacauguuggagauugcuauggugcugcuauguauucaaaugcuaaauuuuguaccccaagaucugguugcucccagaugacagaauucucacacauaccacuuuuguugcacaaaccuugcuccccaauuuaaagccguagauuaaauauaaguggcuacagccaauuacuggggagaauagaggugggugggguuucagggaccaugaggagagaaggaggagagagaaggagggagagggagaaagaagagaggaacagggggucuccauuagaugggaugggccaggaaaauguggccaagugaacacgcccccugaggacagacugcuggaacagaaauaacucuggugagacucaaacagcaguaccuagggagcauagcuggagaauuaaacagucuagcauacagaagaauagacuagggauaauuugcccaguaauugugcuacaacugauuaaauuaaguccuuaggacuuugccucaauuauugggugggugggggcuggccuggucauauuaauaacuaguaguuauuauuaaauaacauuuaaaaaccguuacacacacaugaacacacucccgugaucgugcuuuuaaaagauuuuucaguguguuuauuucauguguaugaguguuuugcuugcaguuacaacugcagcacacgcaugccuagugccuguggagaccaaggagggcauuggguucccugccacuagaguuucgacugcucgugagccaccaugugcaugcugggaguuuaauacauaaugauguuuuaaucauuuuuuuuuaaagggccaugagucagcacuguagcaccgagaagcugggcugugugaauugauaacacaaggagcucgcuugaagacuucagaagaagcugguaaacuuauuagcccuuggcuggauccaccucugccagaaggcauccaaccuccggucucuguugucggaaccuauucacaccguacuuuuggcccuugaacaugaagacuccuggccacccuagcaucucucuuauagccaugaucuggccucaguccaacgccaccuucuccccaaagccacaggugccaucccuuuguccuuaccuuccaacacagugagggccagggucgguugauauaccgaauggggauucucucuggguuauaggggagagugguggugcccagccagucauuguagaagagauuaggauagaagucaaacccauaccauguacuuuccuccacacuggugccaugacuacagacacaggggcgacugcagcucaucacggaucccugugggcacagcaacagagggaggucaguagaguugccuuucaucccugagugagguccccucuccaccucucugucaccucgcccucacaggccaccuacccuuucagcauccuuccuuaaguucgugcacgagccaggaguuuuccgcuuaacacccccccccccccccguagcugucuguccgccugaguguuuucucugaggaccaucuggcaucuggaauguggcucuggagccucacugucggacugagucccagggcccacagcgucuuugaugugacuuuagauuggguccugaccucucgggcuucccuuguuggugaaauagaacuaauaacgaccuugucugggaaauagggcuaacgaugacagcuguuucacucaaugaucuucuguaauuuuuauggcauugucuucuuccaauuuacuuacuacccgugugauguacacauaugugcgggcaaacccguguagaagugaaaggaaguguuucagagucaccucuccccuuugaccaagugaaucccccagccaucaguuuggcagcagcauguguccuuacccccaugagccaucuugacaacuccaauuacuauucuuuguuuuuguuuuuauuuccuuccucaacuuuuggggcucccauguuuacagugagagauccuuauguucccccucaaaacuucuguccuuuuagaaccauuucucgggguaacuuucauagacgauacucgugcaguugggugggagucuucacacuguauaguccuaaaagccugaggcagauuuccccuauacacaagucccaaggaauugugaguucaggauuaagggcucuugguccuuuugacuacuagauuuccaggaagaccauuuaggaacccacaaaaggagacucugagaucuuggggauggaagggaccuguguccaucgagguacuggggggaaaaacguggcucuuucugcugcuucauucccaucucccucagcgccacgugcagcuucaaccaaaauaaaaccaguggacuuguucugauggagccuucuguccuucaaucagcgagacaccagaaucccugcguagauacauacacacacacacacacacacacacacgaggcacacauaggcacgggagugcugacgggaucgugacuguccacucgccccacaauucaagggaaggaagaaaaauaggaggaauaaaacaacaacaacaacaacaacaacaaacagccuagagaaugauaaaugguagaggccaaggcacagcagugaccuaaaaugagggccagauaacaggacugcaagagaaggugggggcagcgaugcggccagagcagagaucucagaggcccuguuugggagugcgcuagugaggaaaaugaacgaggccugaagacgccacaaccagagcgucaaauagaggcccagaaggggcggggagggauacagggacaaagggccagagucagccccuccccuguaauucuugcucgcccugccuccaaaugcaaagggucuguucauccagcagaugaugaaggaaggugaccuugacugugcguccccucugccuggccccgccuccucccaucuuaggguggucugaagcaggucugggaguggaggaugggaagaggacagggagcgacaggaugcugaggagcccgcgggguugccauggaaacauccaggaguguguuccugaccugcaaagggagacguuuaaugggaaaagagcuggaagaggaagaagcugcgugguccaggaaaagagacuuuaaugcuagggacuugucucgaaggagacaaaccugugggccacaggacgcacaaaaucuguccuuaaguccgcucacuccagcgcagcaggaaggaaagcccuccuugugcgauggcuagaggagucaaaaacaucagccacacucucugaccugaccaucucugacgaaauaaacugcguacuuucccugaaaggaaacugaggcacagagaaauagaaaugaguuguuagaaaggggcgggugaacucauucugugaagccucugccuugucuauaagcccuggggugucgaggcccucagugccaagggacucuguagcacuucacuucccaaagccagagcauagggagcagaugugccagcucugacaggacacaaucauacuggggaugccagaggugggcaggggcgcuaaggguaggggagccagccgggcggggguugggccgcaggggucugagcucaccucuggaccugcgucuccg

SEQ ID NO: 12299 - RNA, 58633 nt, Mus musculus
gggggguuguggguagcucgccgggagggaaaagaaaaccccgaagccggucgcgccgcccgucgggccggagggggauauguucgaggacgagccccacgccgagggggcggcggcggucgccgcggccagggaggcgcugcaggcccugugccaggaacugaaccuggacgagggaagcgcggccgaagcccuggaugacuucacggccauccgcggcaacuacagccuagaggugagcggcggcaggugggcggcggccccgacccucgccaggccccacccccggcccgcccccgccccaagccuaucgggcggugggaguuccccaccuacgagggucuccgaggagugcggggagggaaggguggguguagcucggccaacccacccauuuggauugaggcgggaaaccgaagaucggaaagugagccgccgguucugcggggguucccuaggcucccaacuuucaaacuugauuucugcgcgccgcccagugccccaaacggcgcggugcugccguuaaaucgaucagaccugaucccgcgguaaaaugaauuacucaucgcugcucagcccuuugauuaugucuuccccaacucguuugaaacaccacuggauccccauuccacagagggagaaaguggggucgguaagaaguuaauuuagcgcccaaggugacgcaguuugccaugcaaccugguacagcaguuugagcccuuuaacuccuccauucuuccaccuaaucgaguguagcaguuaguucguuuauaccaugcacuguaguuagauagaucaaagucagcacacacaaagcucuucucagccccacguuccucucugccaggccguugcucuaacgauugaugugguaucuggcucugaauaaaauaaauggugcuuguuaucauuauuagguauucccaguaacacacacacauauguuaaugauauauauguguguguguguguguguauacauauauauauauauacccaggggguaucgagacagacuauuucagcaucuaacugagauguacaaaagcuuucauuauacacaugggcaggauucacauauaggauuccucugacucagacugccagcgaaauaauugcuggucagggaguaggaaauagggagcaacuguuguacacaugucuauacuccuaugagagaaaaguaccugagacuacacacacacacacacacacacacacacacacacauauauaaaauuugucuuuacagcaggacagugacuacuauaccuguuuucuuggugguguuacagcucaacauccuuuuuuuuuuuuuuagagaauuagagucacucuaauauagaaacccagauuggucauaagcuuaguguagaaguagacuuguauuggcauguguguggaauucauguccaugcauucagcagaucaagagucuuuggggaaaauuacauuuguccugagcaugaacagacuugucauuccacaaacaauguaauguuauuuauauagcauuuacaucaaguaaucuagagaugaucauagguuaugugcaaaugcauugccauuuuaaaucagggacuuaaacauccuuggauuuugcuaucuucuggaguacaggagccaucccccaggggguauggagacagacuauuucagcaucuaacugagauguacaaaagcuuucauuauacacaugggcaggauucacauauaggauuccucugacucagacugccagcgaaauaauugcuggucagggaguaggaaauagggagcaacuguuguacacgugucuauacuccuaugagagaaaaguaccugagacuaacucacauguuuucagcaaaaggcagaauagacuuaaugaaagauagugaucuacaaaagaagguucauaaccggaaaacggggagaaucugaaaguaugagagagcuggagagcuggccuggcagagaacgugcuugccgagccccuggauccccagcagccacauacaaggcaggugcaguggcagugugggcuguaacccagggggguuacagguaaugagacauggaagggugaagacaggcaaaccccaggagugcucuggccugcuccggauucaguuagagacuguccuaacaggcugagaaugauagaugaagucacacaacaucuaacucuggccgucacucaugcauacaugaaugggugagugcaugaacauacaugcgcacacacauaugcuauucaaaggaaauuuuaaugacaucucaguugaaaaaaauauaaaaaauauauuuuuauauguauauaauauauacuauauacauguaauauauacaauacauauauauuauauguauauauuuuguuuuguuuuguuuuguuuuuugacucccuggaaaagcauucagaaaccccaggucuuauuugaucuccucagauaagcaugguugaauacaauguguauccaagucacugcaacuagcugcuuguuucaaauucuuaagcaaguuaaacucagcccagguugugugcuuuuuuugcaggucacucugccuggacuauucaccugugacuccagagaaugcugacgaucuaaauucuaaauccauaguuaggcagagcugauugacacuuaauuguuugcuuuuagaaagcacuccuuuaugaauugaguuuggaggauucuguccuguauuuuguuucuucuuguucuuuuuuucuucuaguuguuggugaaaggcacuuggagcaaaggcaacuuccucccucugcugcccacuaagaaucccugccacagacuccaccccccucuaacuccccacaggagcccugcugaccagcuucuuccacccacucuccucacucacacuuucugguagcuugcugcuuaguaguuuuagaucuucuuuugugaagucuuuacugaauucuagucaaagucagcuauuacacuguauuucccacacuuucucuuucguuuuuauaaccuguuuuuguuauguuuuguuuuuaccaguuacaggaagcaguuucuguuucuuuucuuagcuuuagaucuggagguuuagaacugucuuugauuuuuguuguuuaguuguuuuaagcacucuaccauugagguauauuucuaaccuugucacaaaaauguuuuaacuaaaauuuuaauuucuaauggggacccaugcguuggugcguguguggcgguuagagaacaaccccuguggagucaguucucuccuccauguuugcaugggucccagggaucacagugagggagggcuucaaccccacagcaagcgccaucucuccagcccugcaucuguaauucuuucuagcauucucauuuuccuugagauuaugaucuaauuaaaucacucuuccugccccuuuccucccuccaaccccucccauguacuucccuuuugugcccucucaaauucauggccguuuucuuuauuguuguuccgugugugugugugugugugugugugugugugugugugugugucuguguguguguuucuaacuauaugaauacguaugcuuggugcauauguuuauguuuucuggcugagcguuugaugcuggagaaacaguuguuugugcucuuucuccuucccucagcaucacugguugccuggaguuuuucaucuugguucuccuuuccacauuagcaccucuacagaugccauccuuguucaggcuuuugauuagacggccauguuggugucugcaucuguaauuuuuuuuuaaagauuuauuuauuuuauuuauacaaguacacuguagcugucuucagacacaccagaagaggguauccaaucccauuacagaugguugugagccaccaugugauugcugggaauugaacucaggaccucuggaagagcagucaguacucuuaaccacugagccaucucuucagccccugcaucuauaauucuuuuuuuguuuuuuuuuguuuuuuuuuuuuuuuguuuuuuuugagacaggguuucucuguguagcccuggcuauccuggaacucacucuguagaucaggcuggccucaaacucagaaaucugccugccucugccucccaagugcugggauuaaaggcgugcgccaccaccgccuggcgcaucuauaauucuuaauuaucaaacuucaacuguauuacauguagucaugagguguuuucaguuugaagacauuugaaaccaaaagcagaauauuaaguguugaauuuccaguuguuacuguuuuuagauacguaaacugagaccuacaaacgauggagaacuguuuacuagcuaacgauaauuuacuauggauaaauacaacccugaaucuauaccucacaaaaaauugacauugcccuucauauuguagauaauaauauuaauauaucauaugucagauuauuaacauacuaugucaaugugacacauuauauacuaauauuaauauuuuugacaugugacaccuuugaugacuuucuacucuacuuuuucuuuucuuugccaaauugguuaaaaagaaacauaaaacauaaaaaaauaaauaucaucaagacuguuuuaaaacugagaaagaugccagauguggcgcaugccuuuaaucccagcacucaggaggcagaugcaagcagaucucugugaguucaaacccagccuagucuacuacagaaguaauuccaagacagccagugcuacacaaagaaaccuugucuugaaaacaaaacaaagucaaaaauugaggaagauaauacaaagagauuuuaguagaauucuuucaguaagacuaaauuuggaauuaaguaagagaucuauuuuguagauuagaaauuuagaaaauuuucugaauuuuuuuuucaugcuaugguucuaagaaaaagaagaauguggggggucuguacugauguuugggauuguguuagccauauuuucucagacaaaugaacuuauaaggccucuuccagacauguauuguguuugcauuggccugcagggagaaguuauacacuggcuggcaugcucuuuauauguugcuugccgcaagagcaucauuccuacugugggaaagggcgucauggaaggaaacugugucucacucaccagaauacugcgcucagcuaaguuaagguaagacauuuugaguuuuccaaauguuuuagaaguacuagauuugggcuggagaggcuggagagguggcucgauuggguagaguauucccaucaguaccaggcuucagcgaccuggauccucagcgcugggggaacgagacaggccaauccugggggccucuuggcucgccaguucagucaaaaugacaccucaaucucaaaauuaaaguggaggguguguagacauggcccagugcuuaagagggcuugcuuuuccacagaaccuggauuuggcucucaacacccaugucagggcucacaacucugaaacuacauuuccaagggcuuggguaccuccuucuugccuucauaggcaucugcucagacauggcauacacacacacacacacacacacauacauacacacacacacacacacacaaagauaaauuuuaaaauaauuuagaaaaaucaaguggaaacgugauugagggagauacucagugucauuuacuggcuuccucuuguagccauauaaagaaguguaugaacgaugggcguggugacacacgccuuugaucccagcacucgagaggcagaggcagguggauuucugaguuggaggccagccuggucuacaaagugaguuccaggacagccagggauacacagagaaacccugucucgaaaaacaaacaaaaaauagaaguguaugcacaugugugcacacacauaugugcacacacaugugugcacucacaaccucuugcgcgugcucgacuggccaggaagaacgacgcugcaacaggauccuucugcacacguuuauugggagagcuugauuauagaggcgaaaagaccuccgagcccagaacuggugcugcuuuuauaggccuaggaggggcgugucucacacccggauugguuaugcacuaagccucauuugcauguuccucaucugauuggcuacucucucucaguaccuuacagaaccuuauuaucauaccucauuugcaugucucacaucugauugguuauacucucaguaccuuacagaaccucauuaucauaccucauuugcaugucucacaucugauugguuauacucucaguaccuuacagaaccucauuaucaugccugggccaggcagugucuuugcaaaaaacuuuacugcauauguacacauugguuguuuguccaaucuuaugcgugguggccagcaguagucagugccacucagcaacggcacauguggcuucccacaacaacccaugcucacagaggcugaacuuugauuuuaggcuucaguuucucucauucuaaguccucugacuugguucagccccggugugcuaaugcauguccuuuccuguuagacccuaacccuaacagacuucuguuaccgacauuguagcucugucuuuacucccugguuuuuucuuaagggaaacaguuuaaagcuuuuggggaacagcugugguccagucucacugccacucccguugcauccuuccuacuuacuccaucacuuugucguucaucaucaagucucucucucucucaguguuuguuauguaaucauuucaaaauaugcuguauucauuauagccuuucaucuugaaguugcuuucagugauauuuuaauuaauuaguuauuaucuuauuuuugagaguggaucucaguuuauagcccagauccaggcuacuaucaaaacuggcuccugcuucauucuuccagcuuguacgguuauaaaugugugucagcauggccuguuucugugguauuucuuaaucgggaacuuaacacaaacuuuuuucucuuaugccccuuuaauaaggaauauuucuauaauuucugucucuuaugacauuauugggauuauaggcaugagccaccaugguaauaacaaccaguuuauaauaaagauuuaaaaaauuauguggccagugaugagaaaaagauuguuucuacaacaguggcuagguuucgcuuaauguuacuguagcaugaaucuucauuuuuacccaugacaauugagaucuagugaagagccuuuaaccgucuugacuuuauucauuuuccacaaaccuaaaauuguuguuguuguuguuuuaauugauguaaacugacacuacacguaccacuccccauuccagaauggggcuuuaauaacugcuuccuucuacgcggaugcucaggguuaggaaggagacaugaccucaaauagacuuaucagugacuccccucccccaccccagaggugcacaccagcauguaccugaaucuggauuagugccguuccuuguugccugcccaggucaauaguccugugcaguuggccaaggaacgaggagaggguagaacuaagacccacggaaugcuuaguagugacaagaaauaaaauuaaggaauggaaaucaacuacacagagaaacuaucucaaacaaagaaaaagaaugcaaacacuugaacaggaccccgccuguaguagucuggugcuuugugaacaacuuuacauuugggagacuucuuuuuccuucacacugacuuugugagccucuacacuguugacugacguugacuucauagacuacaucuagagcauuggcuuccuguagaggaugaaagaaucagguaggugcuuuuauugcccguauccuagaggaccacugucacuucgcuuuucucaguccccgagaugcuccuggaaccagugugguuaguaguacugggaguggaaguuuaggcuggagugagggcuuauguuguuuuaguuuagguuuugaaaacaaagacuuuuuuuuuuaagauuuauuuauucuauguauaugaguacacuguagcugucuucagacacaccagaagagggcaucagaucccauuacaggugguugugagccaccaugugguugcugggaauugaacucaggaccucuggaaaagcagucagugcucuuaaccucugagccaucucuccagccugaaagcaaagauuuuuaaucaugaagugacugugucauuuucaguucauuauguggacuaauuuuuaaauuaccuuuucuuucuuuuuuuaaagcuuaauacaguuuuuuaguaaaaugaagaaauggauggacaugucaaaccuaccacaagaguuucgugagcggauagaaaggcuagaaagaaauuuugaaguaucuacuguaauuuuuaaaaaauuugagcccauuuuuuuagauaucuuucaaaauccauaugaagagccaccaaaguugccccggagccgaaaacagagguaagaagacccuugauucuccuagaucugugaugcagggucauuaggagacuuuaauuuuaaaaguccguauuuaccuucggcagagacuuaaauuucuuacaaucacuuauauuucaaaauaagggugauacuuuaguuauguuuuucuaaucugauuguugcgugcaucuugcaacacuccguggagugugcugagccguccguauggcgucccgaguggaauuguacaugcgauuugacccuuucguuuauguuugcucuccaugcuuagcagguuagccuggccaaauaaaacaauaaacaaaaccaaagcaucucucccuucaggaggauccccugcaguguuaaggaccucuuuaacuucugcuggacacucuuuguuuacaccaaggguaaguuacacucuccccgcuuucuacccugggauuuggugaugguugacaugagcggguucuggaucuuaacuuuuuuuccuuaugaagggaauuuccguaugauuggugaugauuuaguaaacuccuaucauuuacuucugugcugcuuggaccugaucuuugccaaugcuauaaugugcccaaauagacgagacuuguuaaauccaucauuuaaagguaagauguuuauuuuugaaaaguaauuauuaacuuuuagaaaaaguauaaaaauugacuguucugucccuccuguucccuucaugcuuugucuaacuaggcuuaccaucugauuuccaugcuccggacuucaaagccgcagaagagccuccgugcaucauugcuguacuuugugaucugcaugacggacuucuaguagaagcaaaagggauaaaggagcauuacuuuaagccauauauuucaaagcucuuugauaagaagguacuaauaauuaaauguuuaagggccaggagcagccugaaaguaaagaaccgucucagcauucuaggacccauggucagauaccccaggucuggggcuagagagauggcucugaagguaggagcacuuacugcucgugcagaagacccagguucaauucccagcacccacauggaagcucacagcuucaggggagggagagucuauguuuuuaaagguaugguucaugguagguuaaccacacuccggugggugacccugcugguaugcccaaguaucugagcagcacaauuggggucaaguggagggagguggguagguuugggagaaauuaggaggggauaaauaaagucaaaauaacguugaugcaguucuuaaagaaguaauaaaaauauuuuuuaacuuuugaaaaauauugccauagacuaacuuugaaguauuuugaaaauuugucuuuagggcuguguagcauaauggugaugugcucacuuagccugaguaaauccccaauucaguaucuaggaccauuaaaaccaaaaauaccuagauauugguaugguccuagauauugaauuggggauuuacucaggcugagugagcacaccaccauuauguccuuagugcccaaacguuacuuucuguucucggaguagugucacuguuuuaaaauuaaguguguguguguguguguguguguguaugguguguauauauauauauauauauauacauguuagcuaggcaguggugaugcacgccuuuaaucccaguacuugagagguagaggcaggcagauuuuugaguucgaggccagccuggucuacagagugaguuccaggacagccagggcuacacaaagaaacccugacuagaaaaacaaaaaacaacaacaacaaaauauauauauauauauacacaugugugccugaguguauauguauguguaccacaugugugcaagaucacuccaaggucagaagaggcauugggucuagaacuggaguuacagauggucaugaaccacaaugugggcgcugggaacaggacccaggugcuuugcaagagcagccagugcuguuaacuccugagccaugucuugagcccuuggucugaaauuuuuaauaauuuuucacgcguguuucauauauaugugaaaauauuuuuaauaucucauuuuugugcuuguuaauauucccuaaauuauuuuuuuguuggcagauuuuaaaaggugaaugccucuuggaucuuuccagcuuuacugauaauagguagguauuuacagaugggcgugguggugcacaccuguauguaaugucagcacagggacaugguggcaggacauucagagguucaaggccagccuugcuacauagugaguuugagaccagccugagcuacauuacaugagaucauauaaauaauagguaaauauccaauccaaauaguguauggccuguccuagucuggcaaugaugauuuguugaaauguguugacugaaacauuaaauauaaagguaacuccuucauaucaaaaucuugcucuaaggccauugaauggaauugucauuaaaccguguuggcuaaauacauuuaagaaacauuugcauuugaaacaauuauacuccuaugaggacucagaaauacacacaauacaucuauguuugauuuuauauucuucuaauuaguuaauguuagcaacugacaauguccuucuuucaaagccacucuuauguccuuagugcccaaauguuacuuucuguucucggauuagugucgcuguuuuaaaauuaaguguauagucugcuuugacuugcacuucaagguaaguuacugcugugacugucgugaauguucauacuuggguaggaaccucugagauucuuagauaaauaaagguaaugaaaauacggagucaucauuuuccccaagcuguugucugugucuugucuuuuugcugagauaagugugcggucuagcucagacuucuucuggcagcugaaagcaguucucuuugcagcaaagccgugaacaaggaauaugaagaguauguccuaacuguuggggacuucgaugagaggaucuuuuugggagcagaugcagaggaggagauuggaacaccucgaaaguucacugcugacaccccauuugggaaacugacaucacaggccaguguggaaugcaaccuucaacaacacuuugaaaaaguaauauagccuagccuggccucaguugugaacgaugccugucuuuucucucucucguucuacuaacagcagaggcaucuuucaaauuagauauugcauuucuucuacuaauucauauugccaugaaagcccugacagguaacuuguagacuaugcuacuuacucuugccguuggucaugccuuauguacauuuuccaagcacaccguuuugucaugcccugugucuuuugacauaacacacaguuucuuacaggucccuuugcuucagguagccuguguuauguugcuucagaguugucgucucugucccugcacuugacacacacuguuuuuggcugacuuuugcuauggagcuguagacgggaguaucgagggccgaggcuggauucuguguuuaccugggagauuugguagaggagaaaggcuaauaauggggagucaccuugcagagaguggggccuccuucccggcucucuacugaccucauuagcacaggcaaaucuuauacuuaccugugcccauuuccucauguauaaaauuaaaguaggucguacguaaacauuauuucucggauauguuguaugagauaaaugagacuauagauaugaagucugauucaguuguacaauugucauuagcauaauauugcuagacaucugguugguagccuguaaaggaaggacaguaauaaguaguguaccuguaaaugugaauacagaagauggggcacacgcugcaguaagcauuuagccagaggaaauaacucguuaaucuuacacauuuuuguugggcauggcuaacaugccuuuaaacccucaggaggcagaagcaggugggucuccagguggguuucugaguucaaggccagccuggucuauaaaacagaccaggacagccagggcuguugcacagagaaacccuguuuugaaaaaugaaaaauaaauaaauaaauaaauaaauaaauaaauaauaaaaaccaacagaguuuccuuuucugacagaaacggucauuugcaccuucuaccccacuuacuggacggcgguauuuacaagaaaaagaggcagucaccacgccuguagcuucagccacucaaaguguaagccgguuacagagcaucgucgcuggauuaaaaagcgcaccaagugagcagcuucugaauauuuuugaguaagugugucauuuuuauguuuugucaaaaucagauuuuuuuuguucaguuauauuuuuaauauauuuggcauuuuugagacugggagugcauggggcaaguuuuacugcaucgauuugaucauaaaauguguugcagucuaggcagaaguaucuacugaaaaauaaaguuauuucgcagaauaauaggcuuucaaguguauuugaaaauuuauugagugcagacacugcacucuuguaagaucuugaguuauuugugguuuuucuuuuuaguugacuuucuuuuuuauggggaaacuuuagcgugccauggcauguuuauagaggcaagaccacgugaugaaggcauugcuguccuuccaccaagcagaucguggacauugaauguagguuguuaggcucagaggcaaaugcccuuacccacuaagcugucucgcuggccccuaaguuuacuuuaaaugaguucaacaggaguaguuauucaaggugagacugguuaccuucuggggacaguauauagugggauuucauggaguugauuuuuaaagagccauguuuccugguaaagauggugggaugaugugauagcagagacccuucuuuucugacuccuaaugaaauaaaagaauaaugagaaucaggaaaauaauguucagcagcuccuuugaggagagagagagagagagagagagagagagaggacuucguguuauaaucuucuaaauuagugguaaggaaagguaauggaaggucuguuccaacagccuguucccuaacaggcggugcuggaaggguguguuugauaggauugugcuccuacccaucacuguuccacacugggcucuuccuccauccuucuggugaggguaauaaucaggaguucaagaccagccuugagacaugacaccucgucucaaaaacaagcaaagagagcgaggugacaacauuuccagguccaggccacuguuguuguccucagagaauuaguccugucaaauaacuuaggcuacaccugacucuguggcucaccuuguggcuuuaccuugaugacugagcaggaaggagcacuuccugguuacaugagcccagagcaguuuuugugguuuuuggguuuuuuuuucuuaagauuuauuuauuuauuguauguaaguauacuguagcuauauucagacccuccagaagagggcaucagaucucauuacgaaugguugugagccaccauguggucgcugggaauugaacugaggaccuuuggaagagcagaagucagugcuuuuaccugcugagccaucucuccagcccccagagcaguuuuaaagauaacucauuugguaaagcgcugagacccugagugugauucuccagauccacuaaggaagcugaguguguggugccaugccuuuguaaaguacagcaccaaggcagcagaaacaagaagaugcuuggggcucaucugagaauccaggcuaaugagagaaccuauuugaaaacaaacuggucaguuucugaggauuggcacccaagggugaccucuggcauccacagauauacauaaacaccaauaaagaaacagacaaaaaguuauucucuaagucgccaggcucugacuaacccugaggcauggcgggaucucauagucaugagcaguuuuggcaagacuguaguaagucucacaggaagagcaaguacagagucacugccugagauggggcuuaugagcguggugaaccuugaaaaagcagaguauuaagacauagaaaugaaaguccugagauuaaucuuuuaggaaugugaaauauacauguaaauaaaauaucucaauggaaacgagggaggaggagcgggggcggagcucuucuccuguaaucccagcacuugccagguagagacaggagaagggauccaagucauacuccaacacugucucagcacagagagagagagacagagagagaacgcguagguuaugucaucuacucaaucuacuuucauuucuacgucuuaauacucuuccaaagaaagaaugucccaugucuucccaccaggguuuaaucaggauuaugggaaacuacuuaaaagccuuccauuuuccagaguucauuauaacucuggggagauccucauaaagguaaagauauccccaggcaacucuggaaugaagauacuuaccuaaaucucagaagaggagggaagucuggcucuccagcaaaggcugcggagcagcgacacucauuccuucuuuccuguaggccacaagaagguugccaaaguuguccauagucucaaaaauaucuaugaagagacguuguagggaaggcuggaagacugcccugaagaucuggucauagcuccuaccugaguagauuggccuguacugaacugucagcaugaguaaauugaaaagaaguggcaaggccacugugcaagcauguuaccgcaauaggagaagggacggaaugagaagcacaaaaagacagacacgggagccaggugugggcagacaugcucgcaguccuagcucgugcaggugaaagcaggcagagcagacuucaaggcaucuuuggcuauaugaauaguucaggagcaaccugggcuacaugcgaccaugucucaaaaagcaaacaaacccaaaacuauaacaaaccaaaauaggaaaacaaacaaacaaacaaacaaacaaacaaaaccaccaaacuuuaaaacucauguggaacuuuaguaccccaaaaagccaagacaaacuugaaaaagaucagcgcuggaggcuuuacauuuuauuucaauauaguagaauaguacacagcuucaauaaucaaaaaagcaugguauugacccagacauguauaaacuggggaaacaaaauggagagaaauaagcuauauuuuuuuucaagugaucauugauaguguaccaagaccauauaguggguaaagaguagaaagaaaugauguugggaaaacaaaauauccuuaugcagaagaaugaagauauuacacaauauuaaaaaauuaauucagggccagugagguggcucaggacugcaucuuuuaucuuuggcugccaagucugguaacuugaguuugaugcuuaggaagaagagagauggauucuagauauccucugaccgcuaccaaaauaaauaaucauaaaugcuccuggaccagagagaugggcagcaguuaauguacuuguugcuuuugcagagauccaagguuugauucugagcacccacauuagacuggcaccuuguuuggccucugucgcacugcaugcauuucaugucuaagcaggcaucaaauguaugcuaccauaccuggcaaaauagcaugauuaaaaaugcuuauagcugacugguaaggcaacucagcaaaugccugcuaaguucagucccuaauacuuacaguguaugugcgcgcgugcaaguuuguaucuguauuccauggccuuggguaucuacgcaagcugucugucacugagcuggauccgagccccugggugauucuugaagaaucuugaggaauguugauaaucuggguuuuccugauaagcaaguuucucuuguauuuuauagaucuuguaugcggaauccuaugggaaacauuauaaaaauugugaaaggaauaggagagacuuucugccaacacuauacccaguccacagauaaacagccaggaucucacauagguaagaagagaagaauaaaagcggcacagcauuaaguauggagacuguccccacagauagcauuaaguguggagaaagaauguccccacagucagguucccaucucuugcaguuaauguacccgcuuacuguugaguuugccaucaccauuucaauagcauaugcucuccuguguuuucuauagacuuugcuguaaacagacuaaaacuggcagaaauuuuguauuacaaaauacuggagacuauaaugguccaggaaacacgacggcuucauggaauggacaugucgguaaguaacucuauccuccuagccagcuuucaguccuaccagggaaguaagagguuucuuuuuguuaguuuguuuucacuuucuaaaaaaguaauaauuuuuauucuauacaauguaagcaauaaaaauuuacauaauuucuuaguuuuuaguugaagaaaaagauuauaagggagaauaugaaaaugagauuucuacucuacuagaaaauuuacacucacuuguauuuacaaccaucaacucuacacucauuuuaccuagagagucuaaaagcuucuuugagaacacaguuauaccauaguucugcaacaguugugaaagcaguuguggucccagaacauaggagcacacacuugcacguagcugucagcguguaaaaaccucaucucugccuccaucagaggagaaugagucacugccaccucugcguggacagucuccucuccaguucuuacacagaggcugaacuuggcaggaauagaaauggauucaagcagcagcuguccaugagcuccgaaagaggaacugaaugucaacuguuaaccagcuuuguccuuucuaguuugacaacuucuugagaccuugagaccuaguugguuucuucucccuuaguucucagugaugucaccugauuguuucacaccuugacugaugaggucacuuuguccaacuucagccaccugcucuuccuaagacuucauuucauuauuacaaagaagucaucaucuuuaacaagcugaacacaugucugcuuaugugcaccggacagguucuuccaagccuguguucaguccucagcuuucucugcacagauugaucuuucgccucuuggaagcuuucagauaauaaaugugcugauggaggucuuuccaagcaaaauuaauucucuucuuuuuaauaacucaucuuuaaaaguucuugccugauuucuuucucagaagacaucaucugacuuggaguugacuguucuugaaacugcucacggcuucuuuguaugcuuuucguucugccuaagauuagcuucauaacuuucucuucugaaucugguaguucccuccacagggcuacacuucuggacgcuugacaucuggugcuuagcauuuagucuggguugcuguucuguagaaaaucaaagguauucucauaggguuuguuuuucuuugggggugggguggggcggggauuguuaauuacccagaguugaaugaagaacauuugcaauacaaagcucaguggcagugcaugacccugacacacacacacacacacacacacacacagugccuucagugcccccuacgugcggccagcaacaccggcacagcucccuguaagugagcuuucuauggucucuggucuuccucucaaauuauuaagcuaacaguuguuuauuuguuuauaacucaaggauucuuaacuuauaaaauaguauuuguuuuucuuuaaaaaaaaaaaacacaauaguucucuuugaauauuuguccaagucugaucaccucaaggacugcuauaaauauguuucuuuuguuuuguacauuuacuguguauuuauguauuugguggagggacggauuguaccuuacacuauggaccuuacacuguggaggucagaagucaacuugcaggagucaguuucucuccuacugugcaaguccuggagcucaaacucaggucgucaggcuuggccucaggugcccuuaccugagccaucuccucagucauauuuucagaaaauucagaaauguucuccaaaguuaagccuagcauaagcugcuuccauuucgccccuucccucugugcacucugcagucaguccuggagccaucccaucuucuguuccaccauaaacagguggaucuguaagaaugcuguggacugucacaaaagcauuucucuguugcacccugaaaugaaauguucaucucauuucuuuaguauugguucuuuuucuuggauuucauacaguugucuuuugugguuuaugcuaacaucuuaauggaauaccuaagagagaaguaaaauuuuuacuuuuauuuuuaaauaguuauacauccauacaaaguugcaaacguaacagagagaucaucuuccuacagggauuacaacuuaaacaguauaguaucaaaacaaagaaauugacaguaaaauagugucuggccuuguauagguguaugauguguggguguguaaccuuguauaggugugucauguguggguguguaaccuuguauaggugugucauguguggguguguaaccuuguauagguaugucauguguggguguguaaccuuguauaggugugucauguguggguguguaaccagaacaaaguuaagacccaguagcccccccuuuuugggagggagauaauuuccaguuagcucuuauuccuguguuuguuuguucguauguauaugcauaucugugagaacacugguuugcuucuggguuuuggagcaacuguuaagcaugcacuuguccucaugcacgugugcuggagauguguggggcgccaggacagcgcuagguucuuuuucuuucccucugguggacugaacucauauccucaggcuugguggagcgaaccccuacccgccaagccaucuuagcagcccgauuuuguuuuguaagcuaaggacucgcuauguagccagagguggcagcaaccuuccuguucugcuucccacgugcugagguggccgaugugccaucaugccuggcugauaacacuuaucucuucaggcacagugagagcauagcacuaauaguugcuacuaauaauaguaacaacgagaaguuauaaugaaagcuaugugaauauuuuccaucucucucaaaguaccuuauuguccuuucauccucaucccuguacaaagcgcgcugugguuacugucugucuguccuaaauugccacugccucuacucuugcacaucagggucauuguuaaguaaaagguggggccuuaagcauaagcccugacacaccacaucacagucacugcuacuaaauggcuaacgagcagguagcauguacaguauggaucuccagacaaagggaugauucccauccacagcagggcagacugagacaagcugcugucuuacacugcucagaggagcacacaauuuaaaacuuaagaauuagugucugugauuguucauuaagauuuuugaauuaagacugaccaugggcaaaugaaagaauccucagaaaauaaagccacacauaaauggugucuacugcacugacugcccagaacucuguuaccagaaaggaggaaggccucuggcugcccuuuaucucacgcuccacuuagccacuaguauaauguaguaguuauaguuuuauaacacaucgugugaauccaccucuuuuaauuuauugauacuauguuuuguagccuaagauggaguuuaucuugguaauguucuauaaaaccuugaagaaauguauguucuucuguuguauggaauguucuuuaacuguccagguguauuuuaucacauugugauuuguguuauauccgauauuguuguuuaugauguugcugagacuauucucuugcuaauuuucugcuugcuucuaucuguuacugagagggauacugaaaugucuggauauaauugugaauuugucucauucauaucuaucagaguuuuuucuuuucauauuuugaagcuuugcuauuuagcaaauuuaagauugcuuccuugacuucucuguaaguugaaccuuuugucaccauauagugucccuucucugaccuagguaauuuuguuugcuaugaagucuuucucccgauuuuuuuugguuaauguuugcaugauacaccuuuuuccauuguucugcuuccaagcaaccucaauuauuauaugaguuucuugcagaaagcaaauauuugagucaugggguuuuuguucuuuguuuguuuguuuguuuguuuguuuuugaggggugggccugauagagagagccucuuguagccaagauggccuugaauuuaccauguagcuuugauggacucacagugaucaucccccugucucagccuucucagugcugaaauuacaggcaugcacugcuauucccaguguaggucaugguuuuucauauuugcucugucaucucugucuuuuagcuggcaguuuuagccacuuucaugucauuaugaaugugguaaagucuaagucggccauuuuauuucucuuuccuguuuguccuuuuucccccucaccguuucuacuuuccucccuuccagcucagaaaaauacagccugugcaaagacacaccucuccucuucugcuugcuuguuuuaucuguguuuuggccauuuuuuuaaaggcucuagcuucuuuucguauguauuuucuuucuuuuuugucaguguaugugaguguguguguaugacucucauucuacugguauagauaucucacuauuucaguaaaauguagaaaccauaucuaauuuuuaaaaaagauuuauuuaugauauguaacuacaguguagcugucuucagacacuuugacuucucucuggcccaaagauuuauuauacauaaguacacuguagcucucuccagaagagggcaucagaucucauuacagaugguugugagccaccaugugguugcugggauuugaacucaggaccuucggaagagcagucaaugcucuuacccgcugagcacugacucagcccccauauuucauuuuaaaggcuuuucccuuuacuuuuauucuguguauguaugccugcugugcaccuugugcaugaagugcccagggaggcuaggaaaggccauuggauucuccaaguuacugcugguugugagcugccaugcugauacuugaguccucuggaagagcuaccauuccucuuagccacuguauuagucaggguucucuagagucacagaacuuauggguagucucuauauaguaaaggaauuuauugaugacuuacagucugcaguccaauucccaacaaugguucaauaguagcugugaauggaaggccaaggaucuagcaguuacucagucccacacggcaagcaggcgaaggagcgagagcaagacucccuucuuucaauguccuuauauggucuccagcagaagguguaguccagauuaaagguguguuccauaugaccuugaacucggagaucucccugucuuaaucuucuggaauccauagccacuaugccucaagaucuccauaccaagauccagaucagaaacuuguaucucccagccuucagauuagggucacuggugagccuuccaauucuggauuguaguucauuccagauauagucaaguugacaaccaggaagagccacuacagccacuaagcacaucucucacccuauguccuuuaacgucuacuuaacuguuuguugacugacacuuuacuguagcugucuguaugcagaaucuaaauugacauuuuucuuuaugacuuugaagacuuuacuccauuaucgucuacuuccuaaugaugcuaauuagugguguguucuuucuuuguguaggacuggucuuuauuucagaaaucuuuuguuuuguuuuguuuuuggcuuuggauacaagguuucucucuggcuggccuggaacucugaaacccaggcuggccucgaauucuaagagauccuccugccucugccucccaaaugcugggguuaaaggcgugcgccaccgccacacucuaccaacuaaauugcaccccuagucuccuaauguacccuuuuguggguuuuacagucauccauugggcauuccuacagagcagccuuuuaguuuaaacuuguaucuguccugugauucauuauguuuguuugguuucauuauuuugcagugcucuguuuugugaauucaggguccuguacauacauacaagacaaguacccuaccauugagcauauaccccaauuuuuugcauuuauuuuuuauuccuuaagguuaauuuuauaguguuuuaauguuuucuucuauugccuaacaugucuccuaaauguuucuguauguuaugcucuguacuucaaggagagguuuuucugcaaauguuggauuaucugugauugucuacuuauauuuaauaaggcacugaaaguugauaaccuguggggauagcguccagugguuucaggugauaagaguuguagcuacugguguccuagucuugcuugguuguuguaggaagggaaaaugucugacagccuaguuacagacaucugccucuucuuaaguacccguuaagucucauucaguuucucuagagaacaguucagacuccuaagggauuaucauugacccuuagaucccugguuguguccccucccuccgucccucccacagucuaacuccugcagauuuccagaucaccccugcccccgggucuguucuugucucauuucuacuuugcauucuggcugugccaucaaugcaguguuuccuccagguuucauacgucaaguuccuuuaagugucugucugucugucagcucucaaauauauuugagugucuuuugucugugagucucuugucauccuaucuuccuuuggucuuugugacuugcuucgugguuauggauggcuuuuggcuuuaaccuaaguggaguuucugagauuuuauucucuugagauuucuggugauucuuaauaaaagaagggucauacauagcuuuuaaaaauuaaguuugcacagucagcuauuggauggaacacagggcucccaauggaggagcuagagaaaguacccaaggagcuaaagggaucugcaacccuauagguggaacaacauuaugaacuaaccaguaccccggagcucgugucucuagcugcauacguaucaaaagauggccuagucggccaucacugcaaagagaggcccauuggacuugcaaacuuuauaugccccaguacaggggaacgccagggccaaaaagugggagcggguggguaggggagugagagggaggguaugggggacuuuugggauagcauuggaaauguaaaugaggaaaauaccuaauaaaaaauauuuuaaaaaaaaauuaaguuuggaguccagcaaggugauucaguggcuaaaaagcacuuaaugugcaaaccugacaacuuuaguuugauccucacaguacacguaugggcaccauggaacauacacuuauguguucacacacaaccacauacacaaacaaaagugccgauaaauuuuaaagauauugugucuaugaugugugucuggccgugugcacagaauggcgcagguuuggaggucagaagacuuguggagucaguucuuuccucccaaguucaugugcuuucagggaccaaacucggguugccaggcaaggcaagucccuuuacccacucagagggcucacuggcucaaauagcuuauuuuuuaaauguuuauugucuuagucaggguuucuauuccugcacaaacaucaugaccaagaaucaaguuggagaggaaaggguuuauucagccuacacuuucacacugcuguucaucaccaaaggaagucaggacuggaacucaagcaggucaggaagcaggagcugaugcagaggccauggagggauguuacuuacuggcuugcuuccccuggcuugcucagccaagacaggaaccuggagucaagagcugagacagacauggggaggagcacuguauacuggcuuccacccugccucacaguuggcaauuuuucucacuggcccagcgauggcacuucuuacagugggcugggcccuccugcaucaauuauugauuaagaaaaagcuucauaucgaugcucgcagucaaccauuggacugagccugggguccccaauggggucaccaguggagaaguuagagaaaggacugaaggacuagggguuugcaaccccauaggaagaacaacaauauuaaccaaccagaccccacagagcucacagggacuaaaccaccaaaaaaaaaaaaaaaaaaguacacauggcuccagcugcauauguagcagaggauggccuugucaggcaucaaggggaggagaggcccuugguccugugaaugcucaaugccccaguguaggggaauucgagggcagggaggcaagaaugggugggugggggaacacccucauagaagcaguggggagggggaaugggaaaggggauaacauuugaaaugugaauaaagaaaauauccauuaaaaaauuaaaaacaaacaaacaaacaaaaaacaaagcaaaggccucagaggcagggagggagggcccuaggccaaucugauggaggcaacuccucagcugaggcuccugcuucccacuugucucaagcugacaaccaagacuagguaucaugcacgauauuaaaguucucacaaaaggaugccacccccacauaguuuucaaaaguuaauauguaggggauuuuaagauuugcacuuauucauuuaguguuggagaagucagugacaguguuggagcagacuugucacagugcaugugugaaaggcagagguaacuugugggagcugacucucuccuucuucuaugugggucccaagcaucagacucaggucaccaucuuuaguagcaugugcccuuacacaccgagccuucuucucagccauuuuaaucagcucuagcagucuaugaccuugaaugggaaaccagggugcaugugggaggugcuugggggugucaccugaggucagugauggugacaaagaucuccuggcgcaccaugcugguuagagagugcagaggcuccuccuguaccagcaccugcagcgagaggaaaagaaguucagcuaucugaaaauguuccagcucacaggggcagucauaggaaaugugaauggccuauagaaguaaccaggaggcuggccaggaggcccuacucucagcuccauagaaugacagaacugugugccaagcugucccuuguccucuuacuagcuguuugugcuggcucaaccuagugagucucccugugugucuuagucaggguuucuauuccugcacaagcaucaugaccaagaagcaaguuggggaggaaaggguuuauucagcuuauaccuccaaacugcuguucaccauuaaaggaagucaggacuggaacucaaguaggucaggaagcaggagcugaugcagaggucacgaagggaugguacuuacuggccugcuucugcuggauugcucagccugcucucuuauagaacucaagacuaucagaccaggaauggcaccacccacaaugggcccuccccccccuugaucacuaaucaagaaaaugccccacagcuggaucucauggaggcauuucuucaacuaaagcuccuuccucugugauaacuccagccugugucaaguugacauaaaacuaaccaguacauuuauauaugucggggagaucgggacguggugugccuguggaagugagggguugguuucacuccugguguuugguuccagggaucaaacuccugcugucacgcuuuuugccagacagcuuuacccacugaaucaucuccccugugguccccaaauaaccauuuauuaaaacugaaagcauguuaguuuuuuuuuuuuuuuuuuuuuuuugcagagggugggguuugagacagaauuucucuguguaaucuuggcuguccugaacuucgaucuauagacuggaacucagacuccaccugccucugccucucugccucccugccucccugccucccugccucucugccucucugccuccgaacugcuggguuaaaggcauucaccaccaacguguuggaucuuacacucauugaugagagaggcuuuuguuuucucaaugaaguauuuuuuucucugaacuuuuagcuucuguauuauuuuaucuuuuauuucgguguuaacauuuauacugacaaauuacuuaaaagaaaagaaucaaucauaagauuuuuuucucucaauggaaauaucaccuauuuuauauuaacauuuuuaggcucauuucucaugucccucauuaaaauucaaaaucuacagcaaaugagaguaaguaugauuggaaaacuuuaucagcuugagagugagguauauauguacaugauacauaugcauauaugauauauacauuuauguauacacacauauauaauauauguuuuauuauauuuauauaaaacagagcuggaccuauauccuaauuaucuaauugucucugauaauuuaggauaauauuuuugcagauuauuuugacuauuuuucucccccaucacucccauucccaccuccagaaaccucuucuguuuccccuucccaggggacccaggcguccccuccagcuguccuccuuaccugaccucucugggcgguggacaaagcuugccuguucuuugcaggcugcucuuccccguuaccugcuuuucucuguaugcugccuagcuuggccucugucuugcucuacagcuacagcuagaauauaaaucuuucugccucacuucccaaccacaugggaagguuauaguguuguuucuggaaggaccaagggugaaauuacugagaaauacuaaagucugaucuuuucuuccccaagguucuuuuagagcaagauauauuucauaaauccuugauggcuuguuguuuggaaauugugcucuuugcauauagcucaccccguacuuucccguggauuauugaaguucucgauuugcagccauuuuauuuuuauaagguaaggugauugcaaaguucuguucugguauguauucacauaagcauuuaucuuaauguugaagaaacacuguuguaauguuuagaaaauauuucuggaaguauucucguaguaauuauuccucuugagguauagacaaagacaaaaggaggaggaaauugagccaguuucacguuugaguucuuuucaaguuacugacuugcaaaugugagcuagcgcucaguacugagccucgcaugcuccucucccuaggccucgcuuccuuuagcacagacccagauagcacuggguuucaaaguuacucgcuccagaggcucuaggcccucucccugugcuagagucauuaacuaaccagaauuuuacuuuauuauuauuauuuuuuuuuagagaaaacacauacagucacuuuuaaauaguuuguucuauucuuuugugauauuggaaaggggagguggauuaaaaagaaaguagacuggaagauaagacuaggccacaaccacucuuggacuuuuccccuguuuauacccauuggaucacuggccugaggcaggaggaucacagccaugucuguaauccugcacucagggguggaggcagggggaucagagguucaucuucccuaugcagaaggucacagccagccuuggcuaccugagguccugccucaaaaaacaaaacaagaagacgugaaagauguguauaguuuuauuuuaccuuauucuuuuacuaguuaauuaucuuggucuaggaauagaacacaggaccuugcacaucguagauaaggacuuuucugcugauauauagcucaaguaugugguaauauuuucccccuuuuuuuguuuucaugugucugugugauauguaugaauacauguagacucacauguguguaggugcacauguauguuugggcaugaauguguggaaacccaaaguugaugcugggaaucuugcuuaacuguucucaccguauccuuugaggcagggucucuuaaugaaacccagaccugccaauauagccagucuuguggccagccuucuccaaggauugcuggccucugccuuccgaggcuggaguuagaggcaggucuuggaaguuacugccucugauagucucuggaagugacaugcacucuggggaucugaacucuugcuuguguagaaaacauuuuuaacuguuggccagcccuguaugugguaauauuuuuaguguucacuugauauuacucagaggccugcucuuuucucgagggagaaagaggggcaguggauuugggggggggagaagaggcaggaacuggaaggaggggaggcugcaguugggauauauugcauuagagaagaauaaagagacuuaaaagcaucuuguauuuaaauuuauaacacacagauucuagucguccacagaauuauggcuccagugugauucuuuguggcaguaaagugagccauucaugucuguaugcccagagcagugauugcuuguuagucugaacucacugcuguuucuacguucuucucuucagguuauugagguggugauccgcucagaggagggccuuuccagagacauggugaaacaucugaacagcauugaagaacagauuuuggagaguuuggcuuggacuaauaauucugcacugugggaggcucugcaugcuucugcaaacagagucccuuccugugaagaaguaagccagggcuagacgaagagaauaaguuuuguuuuucgagagaggguuucuuuguguagccuuggauguuaugaacgaugcucuacacaaguucaagccagauguguccuagcacugagagggggaaauggaaggagucccacccaccccaaauuaucagauuaucugcagaugaugacuauugccaaagaaaaaucaguuuuccccaccggagucucauuuguauaucaaguacauuucagggcagaccccaugcccagcaguaguugguuaacacaaaacucauugguauuuuuauagacuguuucauuuugcuuuguuuuacuggucuuuuacauguucauuuuuguuuuugagcgugcgugcgcuugugugucugugugucucuuguuugauuuaaggaaagaaagaucuugagugaguaggaagauggauaggguccgagaggaauuggaggaggggaaaacuugaucagaauauauuguauggaaaaauuuuuuucaauaaaaaaggaaugauguugcuaugaccauucaugcacaaggacuuguauacauguuuuuguuuuucuuggguaucugucugugguauuuuaucugugcuauuguuuucuguagguuauauucccuaauaacuuugaaauagguaauggaggaaaugugcaaggccaucuccccaugaugccaaugucuccaauaauacauccaagagucaaggaaguucgcacugacagugggagccuucgacaggguaggugugacguugauggagcacuggggacagaugcagaccaccuuguuuguuuuaagauuuauuuauuuauuuauuccauauacaacauucugccucccauguaugccugggaaccagaagagggcaccaccaccaccguaucuuauuacagauggcugugagccaccaugugguugcugggaauugaccucaggaccucuggaagagcagucagugcucuuaaccgcugagccaucucuccaguacccacagaucaguuucuuaagaaaacagcuucuaacuccuuagaagcauaaaacauuuaauuucuucaucaagauuugacaagcucagugcuuucacccauauucaaugugaccuauuauacacuuucuuucuuuuuuuuuuauauuauuauuuuuuuuuauuauacacuuucuuuguauuaaaagcaguucugugcugagcuugguggcacaugccuuuaaucucaccauuauaaaggcagaggcauacagauuucugaguuugaggccagccuggucuacauacugaguuccaggccagacagagcuacagagaaagaccguuucugagaugggggguuguggagaggaagaaaaaaagaggaaagaaaagaaagaaaaaggcuuguggcuuagugaauuuuucaccaauccugccagccugagugugacuccccaggacccacaugcugggguacagaaccaacucugguuaauucucugaccuccaccagugcaccauggcuugccauucuccucugaacuaaauaaguuaaaaucuaauuuaaaaaauuaaccuccacaacugagcuauaucuccuaaaagacuuauuuacacucuuaaaauuguaccuuuugagccuuaauaaugggaagauuuuagugcagucuuguuuuuuuauugugauguaccaucugacacacucaucucuuggauuacgaaucccuuggaauuuguucuguuuguuuugcuuuugagagagcuucucuauguaugccaggcuggccucagacuuuugacccuccauccuccgccuccugagugcuuggguuccaggugugugcuuugcguucuuaaauuccaagaauggucaaaaccuucgcuguuccacuguugcuuugcaaauacugggaaaacuaugguaaacgcucaguuuacugaguguacaaauaaauggcugcuccguccaccaucugccagggcaaagaagaugcccuguuauaaauaacauaaggcagcaagcaccaucuaaguuacucugugugacuuuuuaacuuguaucagugggcuggggaucaaacccaaagcuucauaccaugcuaagcaagugcucucauaagagaaggcauuucagggcgucugcagauaacgucauggcugggacccaguucucucccagaaccaccaccuuugagcauuccuguucacuccaagggcuuucuugguuuucuuagauucaaggcacucaaguagacucugggagcuacaagaaucuacuuguuuacugaggacuaaaguuagggcugcucuuguaacauccagaaucauucaaagaguuuuauuuagccacagcugcuuccccaucucacauuacacaucauagccagaguaacuuuuauuaccuauacuuuaaaaguagacugaccgaucaccuacuuaaaguaaaacuagguacugaggccgggcagugguggcgcacgccuauaaucccagcacucgagaggcagaggcagguggauuucugaguucgaggacagccuggucuacagagugaguuccaggacagccagggcuacgcagagaaacccugucucagaaaaccaaacaaacaacuuaaguauugagaugccuucacuuuaaugugguggguacugucguucagugguagacugcuugccuaacaugcacagaacacaaaagagcagcagcagagcacauggugugcuugugagauuggcucaggacagugauaaaacauugugaacaacgaugcagaauugaaugucucuagaaauaugugacgagcugggcgugcugcugcaugacuucaucccagcacuugggaggaagaggaaggugggucccuaugaguuuaaagucagucuguucuguuccacauaaugaguuccaggccagccaugacuacauaaugauacccugucucaaaaacuaaagcaaaacaaagccagacauauguaacuuacauuacaguuuuuguagaagcucacaacuaauaguucuccuugagucaaaggaaacauuggacuugaacuuuugaacaaugcuggaacuggugagagcuugcugacccuuggaagacaaaaguccauuuuuguuguuguauaacagacagaaguuacuaauggcucucuuagguuucuauugcugugauaaagcaacuuggggaagaaacgguuuguuucaacuuguaauccacaucacuguacaccucuaagagaagucagagcaggaccucaaauagggcaggaaccuagaggcaggggugauuuagagguaauggaggagcgcugucuugcucacucuacuuucuuauagugcccaggacugccaggcaacgggcaacaugggccacagugaaguaagcccaucucagucauuagucaagaaaauucacuaaaggcuugcccacaggccaggcuggugggaacauuuucucaguugaaguucugucuucccagaugucucaaauuugugucgaauugacauaaaaccagcccaaagcauuuaauuaccauucauugcucaucucugcauaugaccuaguaucuaugugacuauccuggaaagcuuuuugaauguuuuaacagcucucuuauaccaacuggaaaguuaaaaauguugucagagagccagcaugguaguauaugccuuugaucccaacauucaggaggccaaggcaugaggaucucugaguucaaggccacucuggucuacagagagaguucauuccaggacagccagggcuacacagaaacaaaaacaaaaaacagagagagagagagaagaaaauaugaaugugagagugagaauguuauuggauggagcacagggcccccaauggaggagauagagaaaauacccaaagagcuaaaggggucugcaacccuauaggaggaacaacgguaugaacuaaccaguaccccccagaacugugucucuaguugcauauguagcagaggauggccuaggcggccaucaaugggagaagaagcccuuggucuugugaagaucauaugccccaguacaggggaaugccagggccaggaaaugggaguggguggacuggggagcaggggccgggggaagguauaggggacuuucaggauagcauuuaaaauguaaaugaagaaaauaucuaauaaaaaaaaauuuagaagcugaaaacauuuuaaaaaauauaaggggaaaaaaaagaagagaaugagaauguggggcacaccuuuaaucccagcacccgggaggcagaggccagccuggucuacagagugaguuccaggacagccagggcuacacagagaaacccugccucgaaaaacaaaaacaaacaaacaaaaaagaaaguacaugagcucuauugcagagaucuguuguuucuguugauguaccuaaaaaaaacuccugugacuaucuguuauauuaacauaaaaacuugauuaagcugcuaucauauugaaaugcugaauuuggauaaaugaaaccucuauuuaaaucuguuugauucuagaauaaaauaucucuucuuccuuaaagaagaacauauaguaucaaaacugucuugagauccuguguucacuguagugaauugcauugggagaggcccugucccuaacugugucugugugacagagguuaauaccccaugucuuccgauguugcacuucgccuuaccacaugaggcaggcuggcuagugaguucuggggucugccugucucugcccauccucccccgcuuuauuuacucugucaggauaacagaccugugccaucacaccgugaggcuggggcuccaaauccccagcuucuuauauuugcaugaugggcauuuuaacgacugauccaucucaccaauccaauaucuucucuuugguuuugaucggaagagaagacccuccaacuaaggcagggccagcaguggcaugugucacguuugcuccuguuuccuggugacccuacuaaagauggcucuguguuuacugauucauaaaccacagccacugccuuaaacugcuaggaauguggggguggcaaaacugugacuccacaaaccgaguuuugcuugugccuccucuuaaucaugggugcuauuuauuuaguagguaauacuaagagcuagaauccaucucuucaguuagugcuuaugucauucgacugcucagccucucccuuguucuuaauggguugcucuguugcuauggacagagcugcaggaaugcggaaagcugagcugccacacugcucacucugcucucucucccucuaggcucagcaguccgugagugugggaaccaugcucccuucuacagcucaagugcuuagugugugaauaaggaaaccugaauuuuuuuauuuuggaauacguuuuaaauuuaaaccuuuucuuuuucucuuuauuagauaugcaaccauugucuccgauuucuguccaugagcgcuacagcuccccugcugcaggaagugcuaagaggagacuguuuggagaugacccaccaaaggacacacugauggauaagauuauggcagaaggaacaaagcugaaaauugcuccuucgagugucacugcugaaagcuuaucaauuuccccugggcaagcucuucugacaauggccacaaccacagucacagggacgacgggacggaaaguuacagucccuuugcaugguagcaucuucaucucugccuuauauuguucaguuacauaaaaauuuaagaaaugucuuaugacauugcaucacaugauauaacucuguauuuuuuaaaaacuugacuuuauguauauaagaguucugccugcaugcaugucuaugcaccauguacaugccugaugccuguauaggccagaagaggaugucaguuucccuggaacuggaguauaggugguugugaaccacugugaguggugagaacugaacuuuggguccccagcauuagcagcaaaugcucugagccauugagccgucucuccagccccaguaguuuauucuuaaaccuaaguucuucucuuucccuuuuuuuuuuuuuuaaagaggaugaguuuuagaucucaucccaaaagaacuuuaucgaaaugccaauucaucucaacuuuauuucaucucaaaagagguccaaauaauggacucaaagaaaucaaacccauguucaguacacauguauuucaugcguccaacucccugaacugaacauacuaugugaauauaauagauacucacuacaacuuuaauuugacaaucaauagacaacucugucccuacacuuauguuuauuaaaaacugacaaacaaacaaaaccuguacaaaagauauccccaaauuccuuaucaaauugaaacaguaaucuugagagacauuaucgccuaggacccccucuuccucuggcgcgaccauguccucuuccucuaccccggccucggccucuuccugcaacagcuucucuuuuccuagauuucaccuuagguucaacauccacaaguaguguaucuagagguaagcugucugguagaauaaaauaccgaauguuagugccuugaauacucaauguuuccaacuguacagguucucuguucuucagggucauuuucacagcuuuaagguguguauucaugcugacaucuacaccugugauuguuccauggacuugugucccauucuucaauucaaugguuacaguuucaugacucaauuucaucaaaaaucucacgagcuucauccuagcgaugcaguucucccuucugguccgacuguucauggaauucaggccuucucuuucccuuuaacugacccuguauuguagggcaauuugaaguucacaggaauuuuaaaguagaagagcuugucauauacuuccugucauccucccugugcacucucacagccugugaaaacaucgacauuguacacacgagccgguggguucuuagaucagugaggccucacugacucauucauacguacaacccauggcuuacuuucagcaucacucucuggguagcggacauucugugcacauuacaguauugacacuguauaaugacaucuaucaucauagucucacugcccugaaguguucaguccuacaccuccuguuuuauuuugaacauauacuaucuuaaauuuccacauuuuauaaauuuacaacccuuuuuguuaggauuuaguuuuuuuuuuuuuuuuuuuuuuuuaaagauuuauuuauuuauuauauguaaguacacuguagcugucuucagacacaccagaagagggagucagaucuuguuacggaugguugugagccaccaugugguugcugggauuugaacucuggaccuucggaagagcagucgggugcucuuacccacugagccaucucaccagcccaggauuuaguuuuuuuuuuuuuuuuuguuguuaucugaacuuuauaaguugguguauuaagggagaaauagugcuuaaaagaguaaaauuugcuuuuuaaaguauuaaaguugggccagugacauggcucgucagcuaaaggaucuugccugcaaaccggacagcccagguucaguccccagaagccacaugguaggagagaacugguccuguggguuguccucugaccucuaugcucacauuguggcucauacacacauuccucccauaagauaaauagaugauguuuguaaaaguuuuaagugucauauaaaaacaugacaggcucauacaaaaacagaagacaagauuuuuuguugucguuguugucuguuuuuaagacagggccucuaugucgugcuggcuuuaacucaccauguaaccuuggcaggccucacauuuacagccguccuccugccuuagcuucccaaggauuguagacaugaggcgucacacccugcuacucaaaauuugucuccuuaaauaaaaugaaacauaagacuaucgaaaggaaaccugcucuugcuucaaaaaguaaaagcagaacuguguuauagauagcuccuguguaauagcugcaucccuuucucuaacgucccugcacuaacucauacauguacacugacaacuugcugugaacauucagcuuguaucuccaccugagagucuugcuugugcaugcagguaucgccaaugaugcuggagaaaucacacugguuccuaucuccaugaauccaacucaggaguccacagcugagagcccugugucacugacugcccagucacuaauugguacuucuccgaaacagacccaucugacuaaagcacaagaugcucaucugaccggaguaagcaaacccaagaggacuggguccuuagcacuguucuauaggaagguacgugucuccacagcauccaaacacagcucauucagccaagacugcauacuaagcaguguuggccucuuuugauuucucuuuaaauauacauauuauaaaauuugcuucuuuaauuuuuaggcguacaguucggugcuagauacccucaccuuguugugugaccuuugccacugugcaccccugggaccuuuucgucuucucacccugaaacccuuuacucauuaaagcggaagccaccauuucucccugcucccaucaggcgaucuccaugcuauuuuugugugcaugaauuugaguguuugaaaaggugccauguuccagugaaaugacacacuagcgcgucuguugacuggcucauuuucccacauucaucugugcaauagcacgcgugggcauuucuuugcauuuuaaagcugaguaacguauaugccacacuugguguaucuauucaucugugagggauguuuggguuguuacacuuucugguuuuaugaauugugccgcugugaguauuggcucucucuggcucugcguucagcuuaaguguauuccuagaagugaggucaauaucuaguguguuagggguggggccagaggacagcuauggcugucauucuguuugugccauccacuuuguuuuuaagagaacucaccagguaaacuaggcuggcuagcaagcaagucccagggacuccuaucugucuccuccuccgcagcacggaacuacauugcauaccaccauacccuguguuugugagugaguucugggcacugaaccccaguucucaugcuaguacagcaaguggccuaaugacuaaacuauggugucucccaggcccuugguauuuguuuaggcaacugccguucuggacugugugacugcacugcuguuuguccuuacugcuccuucucaacagugacaguguccuucucuacccacagugacaguguccuucccuacccacagugacaguguccuucccuacccacagugacaguguccuucccuacccacagugacaguguccuucccuacccacagugacaguguccuucucuacccacagugacaguguccuucccuacccacagugacaguguccuucccuacccacagugacaguguccuucccuacccacagugacaguguccuucucuacccacagugacagugucuucucuacucacagugacagugucuucucuacccacagugacaguguccuucccuacccacagugacaguguccuucccuacccacagugacagugaccuucccuacccacagugacaguguccuucccuacccacagugacaguguccuucccuacccacagugacaguguccuucccuacccacagugacaguguccuucccuacccacagugacaguguccuucccuacccacagugacaguguccuucucuacccacagugacagugucuucucuacucacagugacagugucuucucuacccacagugacaguguccuucccuacccacagugacaguguccuucccuacccacagugacaguguccuucucuacccacagugacaguguccuucccuacccacagugacaguguccuucccuacccacagugacagugucuucucuacccacagugacaguguccuuuccuacccacagugacaguguccaccuucuuuaucaacagugacuuucugagauuuugggggguuggguguggaggaguggaagaacuuuauucaaagugcagugagaugugguaaaaggggacacuaaggaucuuaccucaagcucaagaucaggaccaaacagggcuccuucuauauauuguaaugaaaaggcugacuuccugcucuuagacuuccucacugguguugcugggcucaaucuccaauuacaguucucacagagaucugcauugucagugguggggacagcaggcuucauagaagagccgcacuggaacucaccucuuucuuucuuucuuucuuucuuucuuucuuucuuucuuucuuucuuucuuucuuucuuucuuucuuucuuucuuucuuucuuucuggcuuggucuagaggauugaagcagggcauugugugugugugugcuuuucuuuauguguauggguauuuuauuuguacaccauauuuguacacugcccucagaggccaaaaagagucugacacucuuguuaauggaguuguagcccugacuguuacuagcuaccauguggugcugggauuugaacuccuauccucuggaaguacucuuacccacugagccaucacuccugcuuacauuuuaguuucucguuguuuaauaaguguggcuuauuguuaguuuagauaucuuugcauaaauguccuuuagauuuugugaucgucacaggaguccuuuauuucuucuggauauccucaacggauucaugguuuucagagauuuucucccauugcagcaguugucuuuucacucuaguaauuauagucuuugaugcauaaagauuccuaauuuugacaaaaguuuuuuucucuggaauaugugcauaugcauguguggacgcauggaagcuagaggcuaauguugaaugucuuccuccagcacucccuaccuuauuuucagauuuuuuguuuagggcauggagaaauggcucaguaguuaagagcacuggcugcuucuucagaaggcccauguucaauucccaguccccagguaguggcucacacagucuguagcucccgucccagggacccugacacuuuuuucugccuccucagacucccggcaugcucuaaaccauagagccacuccagucucaggagacuggguuuuuggguuuuggguuuuugguuuguuguuguuauuuuuaaaaauguuuugcuuucugagucauuuucaggcucagaaaaguuaagagcuuuguuacuuggcauauuugacauuccaggaauuuuacuccaacccaaaaagaacacacaggggcuucugaacacuugaaaauguuugaacucaugacaguuauuaugcaggugaacccuauuuuuacuuuuucuuacuuuucaugguggcauuauagaguauuaggcaugaucacuuuaaauagggggcuggagagauggcucagugguuaagagcacugacugcucuuccagaggaccugaguucaauucccagccagaugguggcucacaaccauauguaaugggauccgaugcccucuucuggugugucugaagagagcaacaguguauuugugcauaaaguaaauuaauaaaucuuuaaauaaaaaagaauaaaaaacacuguaaaguaguuuccaucuauagcuuuuauuuauacucucuaaucacagcauuuaaacuaaugcuauaaaacagaaaaauuagaugauuugguaauaauuaacagccuaccuguuuuguuuuguuuuuuaagcuuggucuauaagcccauguucaugguaagacuuagacacuugacaaguaacuugcuguacaauaauguguucucuucucucuuaggucuaucauuuggcaagugugcgccuacgugacuuaugucuaaaacuugauguuucaaaugaauuacgaaggaagaucuggacauguuuugaauucacuuuaguucacugcccugauuuaaugaaagauaggcauuuggaucagcuccuucugugugcauuuuacaucauggcaaaaguauguauaggaugggaggggguuucugcccuuguuaccuuaauuugaagcaucaguaaacacuguugaauuugguccuuaguuuuccuuaugugcuacaagcugauacugcuuaucuuuauuaaguaauaacuucaagccacuacaaugucuggacuuuuccuaugaguuucauaauaauaaacuuuuucacuuguuaagacuacauuugagggaggcaggcagauuucugaguucgaggucagccuggucuacaaagugaguuccaggucagccaggacuacacagagaaacccugucucgaaaaaccaaaaaaaaaaaaaaaaaaaaaggcuacauguaaaauggguaagggugcuggccacacaagccugaauuugaucugaacccauagugaaagggaaaaaggggaaaccgaaucgugaacguugucuucuguucugugucagaugugcuccugaguucacacacacacacaucauuaucaccacacaugaaauuuuuauguuuuuaaaaagaagaguacauugguuauaaaggaauuuagaaauguggauaacacauuugcaccucucccugugaugucucuggugugagacuuaaaaauaaaaugagcaugacauuccgaugaguaaggugcagaacugaagucgcuuggccgcagucacccauaaguagcaacacuucguggcccucccucuuccuuccuagucuggcguaggaugccugugcucaugccuuucuuuguuguaucaugcugcuuagcaaguacucuuugcuuuuuguugcuacaccauguuuaggucacaaggaacccaucuugcuuauuuuuuaaaaguuugacauauauuggaaaagucauuuauaacuucugucuucacaauauauuggcuaaacucgcaaucuuagccaauguauauaauuuuuuuuuuuuugguuuuucgaaucaggguuucucuguguagcuagcucuggcuguccuggaacucacuuuguagaccaggcuggccuugaacucagaaaucugccugccucugccucccaagauuaaaggcaugcgccaccacgcccggcucacuuuuuuuuuuuuuuugguauauaauuuuaagaccugauuuuuaagcauucgaggcaaaagguauguuuccaaacucucuugugcccuuccuguucaguaccucuuuaaaaucucuauauauaggagcuggagagaugacucagugguuaaaaacacuagcuucuugcccuuccagaggaccugaguucaauuuuuagcgcccacauaacugcucacagccccuauaacucuaguagcaggggaucugauggucucuucuagcucccuuggcccccaaacaugcauuuaguacaugggcauucaugcagacaaagcacucauacauguaaaagaagaauaaguuuuuaaaugucuauauaaaguauuaauacauauuuuuacuaaucauuuguguuuuuccagaaaucugucagaauuuaggcuuuucuacuucuaagucauagugcaucagggaaggauuaguugaaaccaguguuaugauagcagauaacaggaaggauuccuuuuuggaucacuaaucucuuuccuuuccuacugugacuucuaaguauuagacucccuaccaacugucuuaaaacacucaaaaccuaauccuauaauaacuacccaguucuuugaugaaucacugcaagauauuuuucugucuuuuaguaggugguuaauuuacuuuuaaauaaguacucaaaaguaauaagccagacccugccaggggcucagcgugucuucguuuuuuuuccaucaguuuuccaacacucauuuucaguagugcucuauccuaccgggucuacugcuuguugauuaaugagacugguaacuguguccccaugggccacaaagccugaacuuuaaaaguagcaaaaaucauaacuguaugugguuuuuagucauagaucagccuggguuaauggcuuucugcaaggcugcucuuaauaccaaccuauaauugacaucuuugcucagagccguguuucuuucaaaagcaguugauaaauguauuuuuuuuuuuaagguaacaaaagaagaaagaacuuuucaagaaauaaugaaaaguuauaggaaucagccccaagcuaauagucacgugaguuacauuauuuuuccucuguccaaaaauauauuuuuaugccauuucuuugcuaucaggauauauaaaaaguaguuacuugauaguuuuacuguaguuuggauuucuugguuuaaaggaugccaggaaacucaagaaauaguuucauuaaaggaaagcuuaaguagaaggcuggaaaccugacuccuccugacuuauccaugucugcuucuacccucacacauucuggaguggcuucuguucauuuuaggaggagagacauuucucacuagaaaaccuaacaaaagauagguguacaacauuucauuguuagguuugguuuguuugagacagggucucauuauguaacccuugcuguccagggacuaacuauauagaucagguuggcuucaaaaucacaaagaucugccugccucugccuccugagugcugggauuaaaggugagccgcaacacuuggcuacugauacuauuucuuaacuguaugaagcucgcuugauacucuaaugguuaaagccaaugaaauuugaugaauuguugacccuggcuucuuugcugucugcaguugguugaguuuuaguuugacuggguaucauguacccacuccuucacucccagcccggguagguuguacucagacuuacuaacacaccugaggaugacccuggcucauagcucuuucccucccaaugcugggcuuauaggcauggaucaccaguaugacugccugaagucauaauguuuacaucuuugauaacuuauuagugacauggugacaauccuguuuugaucauggaaauauuaauugaugguagauguccuggcacaagggaaauauuuaaugaauaacuuacuugccuugccuuuuaauuauuugaauuaaagagcacagaaaguuaccuuaaggcuuuggccauuuaaucuaguucguagacaaauagugagaguuagagcggguaaucauaccuccucugagcccaaaugacucuguuuuccuaagccccacguacaccaauagugagcaauagaaagacauuucaaaguauaaauauugguuaaacacuguggcagauuuucugggccucuuuaggaaaauccucuggaacacagucuagaagaggcccuaccuuagggugguguggauccaaacugagccccgccacuccuuguggaguaaucucucagcaccuuguagaugacuuagaaaaaagauggagcccugcgaugguggcacacgccuuuaaucccagcacucgggaggcagaggcagguggauuucugaguuugaggccagccuggucuacaaagugaguuccaggccagccagggcuauacagagaaacccugucucgaaaaaaaaaaggaaaaaaaaaguggacuguguuuuuguagccaucuguaggaaagacguuagggacagggaaggaacuuuuuuuugguuuuugguguuuuuucugccucaauuuuucuucucugugauguuucccauaaucuguacuuaugagaguuaauaugauuuaccugguuuggugauaacccacaugagagguauuccuuagcugacuugauuuugcucuuguuuuggcuuuguuuaauuuguaucucuuaugacuaaguggucccccccucuggccuguagguauacaggaguguucucuugaagaguauuccaggaggagucgugguguacaauggugacugugaaaugaccgauggugguaagcuuauccaacucucaugcuguacacaauacaccuuugacauggacucacauuguagguggaauuagcaauauagucacuguuuuuaaagacuuacuauuugugugugugaaaguggcuguguaaggagagagagagagagagagagagagagagagaaagagagagagagagagagagagaaauaugagaaugacugacuauagguaccuguggaggccagaagaggguguugggaucccugagcgagacuuacaggcauuugucaucuggcugaugugaaccagacugacuguguccucugcaagagcaggacaugcuuuucuucaguucauuucuccaacccuccacuuuuuccccuuguaguucuagagauuaggccuaaagcaggcuaggcaagcacucuaccacugcacucacuacacuuucagaccaaaaggcaauuuuuagauugcagagcucugauucacuguaguguuggguugguuagaauugauugucaacuugacaagaucuagaaucaccuaguaagccuccaggugauuaugagggauugucauaacaaggguuaucggugugggcaaagaaaagcagccccguccccagguugguccuagaguucauaacaaggaauccagcugcuuucugaccgugaugcaucguaaccagcuggugaugggcuguguccucgaaccaugcaccaaacaaacccauucuccuuaagugcuuucagaguacugaaucccagcaguaggaaaaguaacaaaggcaagccuacugggauauaagcugagauuaucucaagucaacaaagucccacuguguucaauuuugggggcagcaacacauaccugagacaagcauuuaaaagaaggaacaaaaaaccaaagaagacgagauuuauuuuaccacauggauucagaguucucauuccauggucaacugacugacgucaucacuucugggcuaucagcaugcagacaucacaguggaugacagcuggaaggagaggggagagacuugacccugaauagaacuuuuuuuuucuuuaaagauuuauuuauuuaguuuauguaugugaguacacuguaacugucucagacacaccagaagagaacaucggaucccauuacagaugguugugagccaccauguggugccugggaauugaacucaggaccucuggaagagcagucagugcucuuaacugcugagccaccacuccagcaccucccccccccuccaauaaagcuuuuaaaagcccaccucuagguacuuuuucuuuauccuagaauuuccauuuucucccaaaacaaugccagcugggaaccaaggcuucgacugugagccucuaggggacauuucagguauaaacuguaacaccaguuaaucugucagagugugacuucggaauauguaggcagcaguuacuuccuuuuacuuacguguauuauuccugagacaguaggaaaucacaaaagaauaaaccaggugaaguugcagaaaccucuggauuccuugccuauucugguguuugauuuuuuuuuuuuuuuuuucuuuuuugagacaagauuuguagcccaggcuaaucucauccuuguauaucagauagugaccuugcaauuccaguucuuccaccuccugagcacuggguugaacgcuuguggcaccacacaguuugugagaugcugaaaauagaauccagaacuugguguacacuagacaagcacuccaccaacugagugcacaaaaaugacuuugaagaugcauacacaagcuggagagauggcucaguggucaagagugcuaacugcucucgcagagcacccaugugguggcuccuugcccagcagccaucucucugaccacaccuucuccauguuuaguggcaaggaugcgucuucucaaucugaauacuaaugacagucugcguagaggaaccaacgcagucauugaguugucccuuaggaagcuggacguggauuuccccagcaugugucucagccaguccccuaagccauagaaaugcuuccauuauguucuuugcucaaacauucgucuaucuccugggauguagaacucuggucuaaucacaaccauggauggauuuccuuuuucuuuucuacuugacuuuaaauccuuggaaaaaauucaaaccaaagagccaagcuaaaguaucuaguauguuuuucuguaacacugaaguuuauaaucuaaagaaaacauuaaauaauugguguugacucauguaaugagauugaccuacaucagcuauuacuaaauuucagacuuuauuuucuauugcuuugacaagauaccugaggcugcagaguuaagaaaacucagaacucuaugccuuacacuucuaaagguggggacgcucaagacugaggggccauuucuagcaaaggccuucuuggggggggggggcugugcaggguaccacacgcauaagcaguaucucccacaggcagagccaaguaccuagguuguuuauuuuauuuuuaaggacuggaauuguggguuguuuuuuuuuuuuaauuuuuuuguauguguagaugcugcaugucugugcaccacaugcaugcaguauucuuggaaggugucagauccccuggaacuggauagaaugggagccaccuuguggaugcugggggcuaauuccagguccuuuguaagagcaauaagugcgcuuaaccacuggaauaucucuccaggcuauuugauuuuaaauauauuuguuagaauguguguguuaccugugugugugugugugugugugugugugugugugguguguguguguauacgcauguguacagguguccauggaggucagaaaaucaugugcaggcccugacuuuaaucccuagcacuuggcuaugggagaugacauccaaaguaugucugacccuuuuagagguucccuggaaugucauggcccggagcuguuuuaguuuucugguuuuccuaagacgaagggauacuucaaaucuguugaauauaagaacucaucuuugauauguuaaauuccuuauaguuggcaguagauucuuuacuacuauaaagaaauaggcugggcaugguggugcacacuuuuguucccagcauucaggagguagaagcgguggagcucugugaguucaaagaaagccuggucuacagagcuaguucuaggacagccagggcuguuacacagagaaaccaugucucuggggggaaauuuaaaauuaaaagaagaaggaggaggaggaggaggaggaggcagaagcagaagcagaagcagaagcagaagcagaagcagaagcagaagcagaagcagaagcaggaggugauucuguccaaguagcuggaguuuacacacuuucccuagacagugagugcugggagccugccugcccuggaguaggcuuuaggaggacagagcuucagauguugcuuugaagacugauggucucuggccuucuagcucucuaacuauacugaaugcuugcugguaacuucuaaaagauucuaaaaucuuucuugcuuauucugugguuuaaaaacgcuggcuuugcuuggugagauggcucaacuaguuaagagcacuggcugcucuuccagaaguccugagaucaauucccagcaaccacaugguggcccaugaccaucuauaaggggaucugaugcccucuucugacauuugcguguucaugcagcagagcacucauacauuuaguuaauuaauuaauuaauuaacuaauuaauuaaaaaacccauuggcuucuuuucucuuuaacucugugcuuuauuaagcauuagaauucucugugcuuuauuuaauucuuuauacuuaaauaagcacuagggaaacuuaaccccuuuuuauuguucugugcuaagaacuuaacucuuuauugcuugugcauuaacagugcugauaucuggcaaugaaugugcugcucagcagcaggggauugagugaaaggauuugcugcuggugcuccuuucucuggugaaucagccaggagccucucuggcuacgcugguuaacucuuucugaaccagacaggaaggaaaagaagagaauuaagaugugccuggcggugguggcgcacgccuuuaaucccagcacuugggaggcagaggcaggcagauuucugaguuugaggccagccuggucuacagagugaguuacaggacagccagggcuacacagagaaacccugucucaaaaaaccaaaaaaaaaaaaaaaaaaaaaagaauuaggaugcucuguacagguaaauacacacagucacauauacauucaaacauucauacacccacucucugaccgggcccuacugucugauacaaucaacucuacaaguauucaugcaugcuuacauauauuuuuuucuacaugcuaacauguagacucauagacauauguauuuggauagauggauggauggauggaauggguggauggauggauggaucgaucgauggaucgauggauggauggauggauggauggguggguggguggguggguggguggguagauggauggauggguggauggauggauggauagggcagaacuccccaagccaaaccauucaaccaacaacuuuauuucuuuucucuggucuuuuuauaccuucuuagacaaaaaauucuuuaggaaauuaccucagagauaaaauguuacauaaaaugggaguuauagaaggauguugauacuaagaucacagcaguguuucauuauaauauacucauuaaaaguucaaagcaaaaguuuuuacauggccuugccuuaucauagugcacaccugugacuuuauacuuggaccuaaauguuuuuccuugaacacaaaauugucccaagucuaguucucucuuuagugugauugggaaaacucauuguacuucuuaguaugcagcccuuacuacuuugaggagugggcgcguuccauucuugauucuaaguuuauuacaucuuucuagcaacuaugaccaucucuaaaaacugucuuccuaaaauuauuugaaucaagucaggaauucuauagaaucauuaucuauuuuucuauauagcaucacuacaacguaguacaucuuuguaggucuguagaaaucugcucagaaggguggguaaguaucuagugauuguuauauauuuaauaauaacaggaaaagaauauuaauaucaggaaucagauuaaauauccuuggccuugccuagaaaagcagauuugucauugucuuaguuagguuuuuacugcugugaacagacacaugaccaaggcagcucuuauaaggacaacauuuaauuggggcuggcuuacagguucagagggucagucaauuaucagcaagacaggaacauggcagcauccaggcaggcauggugcaggaggagcugagaguucuacaucuucaucugaaggcagcuagaagaagacuggcuuccaggcagcuaggaugagggucuuaaaaguccacaccuacagugacacccuuacuccaauaaggccacaccuucaaauagugcuacugcgugggucaagcauauucaaaccaugacagucauacaaugacagucuauggcagaaccaucucaggaagaucaccuccuaguuuuuagcuucuccuagauagcuccuggcaaaugagcagacugcagcucugcuugaagucaauuuaaguggugccaacagauaagacagcacauuagagugaacuuuguuuucuguuuuaacagcugaggggauaacaguugaaaacuagaauuccuguuuugcaggagaaacaagaguccuagaaugugcgggccaguucuggcucaggccuaaaucccaacacucuggaggcugaggcaggaagagggcuacaagccuacuacagaauaaaacuuaccaaaacuaacaacaagcccuacaacuuccucuccuuguauuugcaagaagauaaacacagcaauccucuuguuguuguuugagccagguucuuacuguguagacccagggguccuagaacucuaugugccagcaucaaagaagugcaucaccacaccugguucacuuugugucuuuccuaaccuguaaacauaugcuuugccuucuauaauccuuccacuacuucagacaaacaggcugagucucugugggccuucuuggccucugaacucaggguguuucccugcugcccauuuugaaguugcuuaagaccuaaccagagcugguucccuuuaauaaaggccauaggugacagugagcucagaacugcccuugugaaauguguugugagcugucacuagagacacccgccucacauucaguccacacaauuacauuucucgacauucugguuggauuauuucuuuaacagucuccugguguagcccaggcuagcuuggacucuugauucucccccuccccucaguccuccaagugcugugaucacaggcuugugccacugcacucccagugugcuuugugaaguaugcagauagauuucucugagaauauaacugcuuuuuuauacggauuuucuuuuuaauuuuguuaaaagaaauauaauccaaguuauuaauuuaauauuacagaauaccuaucacaaugcugaauucuucuuaacagacauagaagaugccacaaagacucccaacuguuccagugaaccagugaaagaggaaagaggugaucuuaucaaauuuuacaauacaguauauguaggaagagugaagucauuugcauugaaguaugauuuauccaaucaggaccauauaguaaguuuuaagucuugcuauuucaaaauucuuuuaauuuuaauuaaacuauauuuauauaauuucucccuucuacuuucagucccucccauguuccucacaacccccucucaaauugauggccucuuuuucuuuauuauuauaacgugugugugaguguguguauguguauauaugcauacauauauaaaugcauacauauauaaauguaaccugcugaguccauuuaauuuggcauuuauauauaugguuucaggacugaccacuuuguauuggauaaccaguagacaauagaaauagaauuucucccucccugugugcuuagaugucagaccccaccaccaccaugagaggcccagccccuccccaccaacccuacccagaccagucagggaagaaacaagggagugcucuggcuuaagacaaaugaaggguuuuucaacuuuuuggggcagccuggcagagccaaaaggauucugguccccagcaagaggaggcagaucuuaagucagggucagggugggagugguucucacaccagaaacagccacuggucaauacauggaaacagaacugacaaauacauagacaggcagacagacagacagacaagacaaccagguguggccacgacacauuuauacaccuucccccagugaggucacauguggaugcagacacugggucagcaguucugaccucuccugggauggcuacagaaggcuccuuaaccaaguuuaccuugagaggugacagagcaggcaaccuuuuaacuugucuccuucugggguggaagugucaaauucuuacccaacuuuaggcagcaaaugaccagagggagucuuggggauguggcacuuagguugucccaggagcuccuuaaacacugccaggccucuuccacacugugagggccucagagacagacugguagacccuccagaaauggcggguauuccagaggagacugcuuagacaugaauuuaagccaauagaaaguuuguauuagccagccagaaaccacacucagucuugggaucccaguguagccugagccuugcucagggcgagcucuuaagcauaaaaaccauguccugggcugacacacuucagcuagugagaacagugagccagaugcagagcuacagaagccaaaaaacaaggcuaaugcauucagagccauucccagaaguguauggacuuugguggauuaguucucuguuuuaguuuuggcauguggugcugugugcugauauauacagccugaaugguacuuccaucauggggucaguugcgcuaaggucuggagccugucacacccguccuguuuuugaaaaugguuuuauacucuuuccuuguauggccuagcucuuuuccuuuguuuuugagaccugggucugucuucuacucgccaggcuauacugaguucucucaauuccaucuucauuucagcuugagucugcuucaguguucucuuuauugaauccaguuuccaguccuggacugcagcugucauuucauucagccugcuugcgcuuccuugggcagcgcucaggaauguacuucuguucgucuuuaucaaccagggagccuggcuuguggggguuuguuugcugugguccagagucugguguggcugguuuaugauacuuggaauugagugagcccaaccucuauugucacccccacggugugaacccggaucccacgugugccugugauuugucccagucguuuguguuccuguccuuguuuuggagagacagagcccaggcuagccuauacuccugccucugccgaguaugggaugacaaaugugccaguguggccaccuuguccagaaucuucaggacuaggugcaggguuucucgggugaccaaggaagauaagcuuuagcuugcuuaguagugguugaugaaaacaaugaguaauaacaaguuuuugcuuuuucggccauaaauaagcccuuaaaauggaacaucuucuagcaaaaauuugcuacaaagagcaauaugguuuuuuauucuuuugucuuacaaauaugauuucugggucacucuagauggaugcucccccgcucucuccuuucccacacauuaagcagcagccggguuccccacgccgcaucucccagcagcauucccucuaugugucuccacacaagaacggagcgggccucacccccaggagcgcacugcuguacaaguucaacggcagcccuucuaagguacagugcauacagauggccugaagagcagcucccauacauacuuggucagggcugggguuccgguuagaauuuucaaguaacuaugaaaaaguuggauuucaaguagcuuuaccucuuaaaccucgagucaguuugucagccaguagcuguucaucuucuucuuauaaagucaccacuaagaaaauagaaacuacuaacugcaccaugcuuguguguucagaaacacugcuguuaccauacauggugguacauaaccuguaaugccagcgcugagcuguugaguuguuugaacagucacagaaguggggcuaauggaggaugcuaagcccuauuguugggguaggaaguauuuuagaaacaugguuagcaacauucaacaaaguguaggagcucugcagagagugcagacccccaggcccccauggcagggguguggaagcucugaaguggacucaggcccuucaggcaggaggggguaccacuaaaccauuucucuggccccuguuuguuugguguuuuguuuuguuuuuugcuuauuuugagaagugucucaacagauguccgagcuacccuccagcuagugaaaaguuagaaagcagggccuacucuucugucuguguuuaugaagagacuggcuucagcauuaccuaguauacuguuggagaugugucagagaugggcuuuuucaguauugcuaggacugcacagcagugucuuaaguuucugaaagccacaaguauuauuuagacaaauaugugagugucagugcaauaacagcuccuuaaugccucagguuccuguuuggucccaugcuuacagaggucucacucuacuuacccaggaaaacugaccaagaugagacuugucccauaaagguguuuagaagauauuagaccaucgagauccagggcacugaucccugaaucagcguuagaaucaccaagggagcuugcugaacacuagcccuguucugcagaccuguggaaucacagagagcuagcaggcagggccagguagagcguucacucuagacaacugggaguuucaggaaccaccucuccugagccuauaaaugucagcauuaccugcggugacucacagaccccacagcagcuaaaucggagucauuuccaggcagucagugagcacaucagauguguaacagcaucacuguguuaaaccaggauaggaaugugucagucugaggcagacagacuuccaguaguucaagaccagccugacccugucugcgagaaaagaaagggaccaguaaguuggcuuaucaaucaggguaaugccccucccaccaagccugaugaccugacuuaaccucccugagccuuugagaugucuacaugucgacaugugugcuaugcucgcacagcagaaacaaacacagaaaaaguaaaaagaaaaauguguacauguguguguguuuauuuacauuuuuuuguuguuguuguuuuuucgagacaggguuucucuguauagcccuggcuguccuggaacucacuuuguagaccaggcuggccucaaacucaagagauccaccugccucugccucccaagugcugggauuaaaggugugagccaccacgcccggcuuacauuuuugguuacgcacacacacacuacucugcuguuuccgaggacauacauucaauucccagcagccagucaguggcucauaaccaucucuacugccagucucagaggauugauacucucuuauggccuuuguggguaucaggcaugcacacagcauacacacaaauaugcaaacaagacauucauacauauuaaguaaggaguaaaugaagagauucaacagacagacaaacuugggucgcacgcagcuggccgugagugaaagcacuggcuggcuguccugaugcuuuaugugucaacuugacccaagcuagagucaucagagagaaaggagccucaggugaggaaaugccucccggaaaaccagcuguaaggcauuuucucaacuagugaucaguuguggagagccccgcccauuguggguguggugccaccaucccugguucuguguaauccuuuucuauaaggaaacaggcugagcaggccacuaagcaguaccagucuaugaccuaugcaucagcugcugccuccaggauuccgcccuguuuguaauccugucuugacuucaaugauggacagugaucuggaaguguaagcugaauaaauccucuccucccuaacuugcuuuuuggucaugguguuuuguuuaggcaagaaauccuaagacagccgggcaugguggcccacgccuuuaaucccagcacuugggaggcagaggcaggcgaauuucuaaguucgaggccagccuggucuacagagugaguuccaggacagccagggcuacacagagaaaccccgucucggaaaaaaaaaaaagaaaaaagaaaagaaaguaagaaaaggaaagaaaagaaaaggaaaggaaagaaaagaaaagaaaagaaaagaaaagaaaagagaagaccuaagacacugcacuguccuggugaccugaauucugucucaggaacccacacugcaaaagggagaaaccaacucccaaaaguuguuaguuguucccugaccucuguacacaugccacagcuguaaugcacccuacacacacacacacacacacacacacauacacacacacacacacacuaaauaaacacaacauggauugguaggccuuaccacaaaaugucugacucagagagugggugguaaaacuugugaauuucacauuuguaacauugguuccucggugccucugcuccuucuggucugauuaaaaccacucaaaaagccaccgcuguaaguugguuuagauucaaaagauaaucucuauaccagugcuuagauugggguagaagaugggaggaagaaaagagaguuagcuuaguuuuuuacauaaaguuucuuuuuccugccuuuuacacaugcccucuuguuuuuguagaguuugaaagauaucaacaacaugauaaggcaaggcgagcagaaaaccaagaagcgcgugauagccaucaguggagaugcagacucaccugccaaacgucucugccaagagaacgaugauguuuuacuuaagcgacuacaagauguugucagugagagagcaaaucauuaacgucacccuuugccugaucaaagcacuuuuggauuguucuggagaaagcuggggcuccauccuucacauuuuuaucacuggguuauacaaaaccuugcaccacaaguacgcuccuuuuuaaaagcauuuauucacccuuuauagcuaacagacauauauuuuaagguagauuagaaaagaauguuuuaagugccuucauaaacaguaauaagauuuucuuuuuuuaguguuuguuccuaggauuucuuuuuagggugaauuaagaagaaacuauucuuuaaccgucuuuucaaaaugaucaaaugucuccugugcuuuuuaauauucggucagugagucugugagauacuugucugcuuguguugagguuagcucccacaguaggagagcucacugauggaccagccugccuugggccugcuggagcaacugccccucaggugccaccagugugugggacuguccgugccccgucuucuuccgcucguugaguacaagcagcucuguaccugggcucuguaccuuuuagcuugauguuaucacccuauaaaagggauacucauuuuuaaaacuacgauuuucaugauauugccuuaauuauuuuaugugauuguauucaguauuguaguucucaaaauaagaaacuguuucuucaucuaggagaauaaaauguagauaaaugagaaauuaaauuucccaaguaaaguagcauuaugauaagaucauucauucauuuguguugggcacaguuggacaugccuauaauuccaguacacagaauugcugggaaugucaggccaguguagcuacauagcaagacccugacucaaaaagcuaaauuauucauucucauuguuuauuuaauuuccugaaaauauuugaaguuuucacauuaaaaucacuucaugucuuguaaguggaguguuucaguuuaagagcugcuuuuccuuucuauuuuguaucacccuuuguuccaguaauuacgguuucuccugaguuuccccuggguguaacuccuggauccccugaggaucuucccacacuggagguuuagccuucugaagaaucaggucgcuaguguucaccuuuucuucugugugccuagcaucgggaaggaugugaauaagccauuuaaauuaauaguuagaugauguaucaguauacauauuuuuagcagcaaaccuuauuuuuuaaaauauaaaguauuggcuuggcagucuagcucagcaugucuaacauauccagugcuggcuaauuugaacgauagucuaagauuuggcugccaauuaaugaugaaugguaaccaaaguuuuauuuuuaaauuuuaaaaagagguuuggguuauguuuugcuugucugaaauuguauucuuguguuuuguguaguaucuacacauguuguaauaagccaaauaauagucugucuugaguccuuguacauauuucuguguagcuauaacuacuguaucacuuucauuauuaauguacaaaauauaaauguagauuuauccaguggcuauguuaaaaaacuuaaguaaugaauuugccaauuuucaggacuuuguauuaauguauauaaaauaguuaauaaaaauuagaauuuua

SEQ ID NO: 12300 - RNA, 10001 nt, Mus musculus
guaaaguuuauaaagcuuuauuaaacauuucaaacagcuguggaacgaacacaccagaaauaaaagcuuuacaacagcaguccgaguguuucacaaguguggccucuaagucccacuccccagaagccugcuuccagcucuguccuaugccugccccccccccccacuugcacacaagagggggaaaggagggggguacauuuccgacuggaagaacaaccaugcugauccccaguggguaggggccaggagaaagucucauuugcaaacacuuguuucugaagcgcagagaaaagcaaacaaguaccaagucaccaaaucuuucuuccuguguuuucuucauaguguacagucuacgugcgcagcaaugaggaagcuccuggugggaggaugauggcgacugcuccccugggucuugucugaaccaccuuggaguccacugugcuggucgcucugcaauccccaugcuaaauaaaaacugcagcaggaccuacuacagcuagcuacuacuacuaaaccucaaaaucagaacauauucaauaaagcuucuucaaaaggaauauacacauguauugguauguaaacacacacacaacacacauucacacauacguguguacauacacgcugacacuagugcacacauacauacagggcacaucaaaaauauccaaacaccuaccaagggaaucauggcugcuaugaaaaauguaauacuuucucauucacucagccagggaccacugggucuacgagaauacugcacaucucccuccugaagagcaugcacuggagacaugagguggccccuuuaggucagcugagagagacaggaggaagagcaaagggagagaggcugggcuggaaggcaggagcccagauacccaggccaaagagcaaugucuccccaucgcuucuuucuuaaaaaugaggcagaggaaauacuggaggucugcagacaacgagcaguugagacaugauuccgucucaccuucucaaaagggaacgaaggaugaaaaagcgaggcucucgggcaucagcaaucucuucaaauuugagauaagugcaaaaacaagcccugucuuggacaggugcuccccaaaaaaggaaagggguuggaagugaaccaaggggaaaacggggaaaggggacgaggagggaacgaggaaggucuugacgaggaaggguuauggaggugacauugagacuacacuguauccacacaggucauaucaaggguauagauuccccaaaucaaugagcaagggggugggccaauccgucagccgggacccagauggugacagaacacacaaccauaagaccacccacgacuacaggacucuacaacagaagcaccgaucagugccauuauucacauuguaaggauaaaacaucacaggccaaaaggcuccauuaggaaugugguacccgcaggacugcgggauuugaaacuccaaugcuuuaugaccuaugucaaugccuccccucccgucuucugcuuccuuggcaagcuaucucggcagacguuaggugcccacaacaccggggucaugggcugauuccggaaguggggaaucggagcagugguacaggaaacaauuuccccagcagcuauagcagaugagaaagagggcugccaggaaaaccaaggcacauauugugcaagguuuccguuccaggaggaagcugagcagguagaagcccaugaacauggaguggcugaaccacagagcgggguugaggggcuuggggaugaggaggacgggcagcagccacuggaggcaauacaugaucucugccgggcagggccuucaccaaggcugccaggcaccgcugcaggaaccgaccuaaugggagccagcaggcacagguggcugcccuucgcuuucuucgacucucucuccaggagcugagccgcugugcucucuggcugucagcccgggaucaccaaggcagcagggauccugaagagaaaagucaacacaacaaacagacaaaggacagacagacacacacaaaaaacaaaaaacaacaaacaaaacaaacaaaaaaacaggaacaaauuguauacuuauuugggaaaauggaucaugguuaacaacagcaaaugugaaugcccuuuccuccccacccacccaugaaugucuacuccuauccaaauuauuacuuaaagauagccugcuagggugugucuucccuaggcuucuacugggggaucccaggaggacacgguccccacagugggcuggcuuugccugggcccugcccagcagagaucauguaucgccuccuggggcugcagcccguccucaaaggucccagaccucacaauaccgcccuguggcugccacaggacaccaugggcuugguguugugccaccgugugguaaggaaaggcucuguaucuagucucacaucuugcugcuacugagugugguggaguaugccaauuuuacaacaguuaucugugcacugccgaccuggagaggcuaggcaauggaaccucagauccuggcaagcuaugggaagauacaguagaaagcagccugaaccauuguuugccuuuugcaaauaguucagcaucauuuaccccaaaccagccaacuucuuugaaaaauaaauuuuuaaaaaaagaaaaccaaaaccacaauacccaaacucaguuggaccauuaaaccuccaucuuuuacugacauugaacagaaaugggucuaugaaaguauuuaaucaaaauuaauguccuauccaaauaggggcaaauacuauuuggccucugugccaaggaggcuugcuggagagguacuuucuccagccacugggaccgugggaaccuucuacuugcagauggcaauuuggucuugcuaccauuaucgcaauucacuaaagaucuauaagacaacgcuaacagaggacacaagcuuuacuuugaaacuagaagacaguagccacaacccuacguggauguagcaaaauccuauuuuguguuccagcugcauagcgaacucauacaaagaaccacccuggcucaggcagaccuacuaaggauuaagagaagggagcacaaaaaacagagguccguaucugucccgcagaaaauuuggucuacuucuccauaaagcucgcuccuuuggcacacacaaagcacgccaauccuuccuacaucccucccagaguagauacaauugcuuuagcuacgaagagcaagagugccgguccagcucgggaucgcagccacuaccgccugccggacagagcgggaaccaacagucagaaaagaucaaagauucucacaaaacagcuggcauggguuuaaaauucacggacuaguaggaaugcagaaaaaagguauacauuuugcuuucagagagacuucuguaacuucggcuuuccauccguauggaagguauauuuuggcgcggcacugguuacgcggcauguagaauuuguaggcuugggugugucgaaccaagaggcuugcaccccuacccucauucuacacuguagagccacgacuucccuccauuuuacaccgaauuucaaaagcgggcagagcagaaucuucuggaacgguguuagagcgggcucaggaggugggggucgguguggaaagaacagacgggauuuuuuuuucucucuuggcgaaugaggagcgccccccaucaccccuccuucucaacaucccccaagcgcgcaugcgcacuuagguggcaagaggguacuuaaggcacggccaccggggcugcggcauugcgcccagcagcggacuccgagaccaguagaccucggcgaacccuugcucucgaccacccacccacuuucggaaccauggccgcaguggcagcagccucggcagaacugcucaucaucggcugguacaucuuccgcgugcugcugcaggugaguauguacccgggcuuugggugggagagggcacccgaaacgcgccccgggaccccuuaauccauaucgcgauugccgccccuacccaacccauccuaucccaauugccgcaaucccuguguaccaaagugccgcggugguacuauuuguccccgcccguucccgugcccacauccucgcgcagacccuguccccagugcgcccgcgcccagccgggaacaaagacucaggggugcggcggucgcccgcugcggacgaucgcgaccaacgcgguaagaaauacccgcuauauucaggcucgaucccaggagggaggcggggcacuugugugcugugaaacuuuacaguucgcacaacagaaaauuuucaccuuaaaaaauugcgcaaugcaggaaauuuucuuuuaaauacacuauguacacacauauaacacuugggugggugaaaaagaaguuagaaaauggcacuccucaggaaaaauaacaaaaagaaucucaauaagggggaaagggaggaaauagagaaaacgcgcauugcaggaaaaauaagccagacaaaggcacuuacuaggagaaaaauggauuagauaaaagugcauuggaaaagaaacaaagaaacgaaaaaaaaaaaaaaaaaaaccgaauuggaaacacacuagagaaaaaaaugccccuugcaggacaaaaacggaaggggaaagaacauuuucaaaaaaaaaaaaaaaagaaagaaagaaagaaaaagaaaaaagaaagaaagaaagaaagaaaggggcaaaucauuuuauggaaaaagagagugcgcgauaucgcgcgcaaaagugcuucucuuaaagccaaacuggaagaaagcgcuuugugcaaaaaaaaacuaucuaccccaagagcucccuuugcaggaauccugcuaaaggaauccuuugccaaaggaaucgcauauuuccuucaagguguuccuggaaugcugcauuuacuggguaggauucgcuuuucgaaauccuccagggacacagcccauugcgagaagugagguauacuuaaguuguggguccaaucagcuugcagccaugcagcucucagcacaguuggaaaagcuccagcugcccugacugguggacaagcugugccucggccgccacuccaggcuaugcuggacaggcgggcggggcagggggcggggccgggcgggcaaagcagcagcagcaagcagcaguagcagcaguagcacacaggaucauggguacuucucuaaggguggguccugggucucucaccgcagguguucagguacucccugcagaagcuggcgcacacggugucccggaccgggcggcaggugcugggggagcgcaggcagcgagcccccaacugaggccccagcucccagcccugggcggccgugucaucaggugcuccugugcuucucgaccagcaugggagccagugccgcgcaggaaugggggguccccuguguucccucgucagaggagcacuugccaaggucagugaggggccgguaggcccccagaaaagcagcaccgacaaugaugaagauaucaguucccuucccagccccuuugccccugucccacuaccggcgggugggagaggaggggggaagaggggagcaacccucgagauaugggcguaggcaccacauucugaucuggaccaagucggaacaguaccaucucagccgcacaagauccuaccaugaagaucgaacagcccaucaaccagcagaauggacauucugacaucaccagcugaagcccuacaucucggugcagaagagaaagugucaacugugugcagcauggggggaguggagggcgugggugguggaggaagaggguuaagaaaacuaguggggcccccuugcugccccuugccuauggcacacauauuccugccuugcucccucauuuccccuuuuccccccgccuucgaaagcccuccccaaaaugugucacuugauuuggauauauucaaccaguaauugaaucccaccuuuaccaaaacacguucucuaacccccggcccuucacugaucuugcuuaucccuggucucacgcagcaguuguggucaauauugugguagucgcuaauuguacugguuuaagugugcauuaguagugucuccccagcuagauuguaagcuccuggagacagggaccaccuccaccaaaaauaaaaaaauggaccucuccugucuuguaguguccuaggacccugcagggcagugggggugcaccaaaaaguucuuuuguggcuucuuuugcgacugcgucacauuauccauaaagcugggcaauguacucauuguggaggggcacaccacuuggaauggggagggggaccacaagaagacaagaauaaacugagaugcccauaucugccucauuuaaaucuguccugagauaaaggacuauuucucauccgcaaugagaagaguggaauucaucugucccagaauaagggacauuuucccuuccccacgaugaugggugaauuuauuugguggugccgagauaagguaccauggcagguuuucuaucugggaaagauggagagaaaauaacugggacuggcccucuaaauggaauacuaagggucauacggguuaauuuaagaauauaaagcuauaccacagaucucucuacccaggagccccaggaaaugaaugcugggcaagaagagggggugguggcugggacaaugagcaugagguguggcuuggccccuccuccaccaagcuuaaugcuccagaccccaggaucacccuaaggcuggccauccugucuugauuuuccaacccuccagcuggacacucccucucuuaguuuucucaguucaucccuaagggccuuaucagaucgauagcuugccuuuuccccucccauugcagcagggagggugggcuggccccuuaguucccuuucuugguuagccagagcuguucacaagugucagcugacugccucaccaaaugguccugccaccuguuaagccucauuucuggcuuuacccgucccugucucugcacaccugcuccuaugccaaugaguuagaaggucaccagucucucuugcuauuuccucaaacuuccuaguccuggucaucacauuacacacucaggugcacaaagcaccucaaaguucuugaacccugaccugcagaucccccaagaaacccugauuuucaaaucaaucacuggcaccucccucuucugcagggacuuuauagucucauucagcacuagggaauuacgggggaaaguagcacagauuuugguguggccuuggcuuuuccacccagccagguugcuuuuaguucccuacuaagguccagaugagccccauacacaucagagaggcgggauuccacaggacuuggaugugaaacccauuccaaggcgcggucuuccuuagcaggguagauacagcugcugcuaaggccugaagucaggucagguccugugccugccccguaguuacucaucugcagucaguggcuaccuccuuuaugguuagaaacuucugugguuugccauacuaaacucauugaaccuugaguacauauacaacacagguuccaaaggaagguugacucuccccuuggagaucuggaguggggggccugaugucacucuauuguuccauguucuaacgucagcccaaauuagaugccagcugaguacacaaaagccaaaccagggagaaaggagucuggcuacucuggucauagcauauccugugcccaucccuaagccaggaggcuacuacugguaacuccagggcuuuccagaugaucuugguaaaaccuuuuucuuccaucuauuauccagcagugaugaguguagguggagucuucaaggcgcccuggugacccugagaaugugaaugucuacuacccacuuucuucucccacuccacacccuuuuguccugacagcaaacuaaacccuccagaggaggcaggaauguguucgugcccuuucuuugugucaaaccugcaagccugauacaaaaccaccuuguuuauacaaugcuuccacaagcuaugcauuaaaacauuuuauucucacauaaagcaaugggaugugucuuuauugcaaaguccuuaguacacagaacuaaauaucccuuuuucuuaaagagguugcuaccuccaaagaggagcaaagguggagaaggugaaguggaacagcuuuaugggaaucuagcaacacacgagauuccaggcacuaaugccagagaaggccugaccagcucaagcucaguaggguggagguuacuaaguaccaaaacuuuuagagauguggguucuaggagacuuuuaagucuaucuguaaaguaacugaauugugacugaaauguaucugagggacaggacaggaauuaagauuuuuggcuuugacucuggggcuggccaaagacagcuuaauuacacagagguuuugaaggaagcaggcucgcugcugacuccuuacuagauaucuacuuucaaacuuggaucgcuucaggagccaacaucccaaagggcgagccucugagcuggcagcuaaucuuccccaggagauuuaaauguguauacacaaacauaagacuaauuuaccaaagucucuuuuuucaggugaccacugacuucuuccauaugccugagagacaauguuugccacaaucuucucuggaaauaauccugucccccucccuccacagggcucauaccacaccaggauacagauuccugaacauucccagggcagagccagaagacagagaggaaggcaauacagggcucuugguaaaucacacagucacaagcuugaauggaaugcguguauuucaaagagaacaaguaaaaagggcagccuaacucucaucccccuagaaauaacagguaagaaguuaaaguguucugucaacaacuuuaagaugaccauuuucagaucgagaauugaucugguuccuggaaacugaccaagguuccagaaauccaaucuuuaaacaggaacucuggccauuaaugaaucuugacuuaaaagaaacaagccagcucaaucuaaugcuugccaggggcacauaaaauggaacuuuuuuuggguccuggcuuugguguugcaguucagauggcugacaggauggcuggaccaugucagacagggcagagcuguccccaauauaucaguucccugaaagggacaaagaagauccgaaccuauaaacagaaauaaccuauaaacuagaacgggccccaguuucccaaguaaaaagagacaagagacuuagaagaaaccuaaaggugguuuggcagagaaaggaaaaaaaaaaaaaaaucgacuguccccaucccccauucuuccuuuccagccaggcacuccguuccuucugcugcccuugagugccacuccccacaaacuggagagggaaccgguguccagacucgacgaaaaguugguggaagugagaagcacacgggacccguagcagauggucacccuaucacuccggacacaaaagagagcguucggggcccacuucuacuuucuccccacacuccuucggauaagggugggggaagaaaaagaaaaaaaaaggggggggggagagaaacugaaguggcgaggaaagaguguccagccucccagaagcugagccccucgccaagguccggaacagaggaggugguggucgcgcccgccccucccagccccgucccgggagcgcgcugaccuuggaggccagagugacagcuaaggaaccccggaacccacccaagggacgggaagggaccacccccaaggcccagguugggacgaaaaggggaggucaucugacgccagacaagggugcgcccgaccccggccgcgcggaaagccccggcgagaggccaagcgacgccuaaggugaccccggagggcuaacauggcggcgcggccgcaccgagcgcucucacccugcccaggcgggcgacgccacgauaccugcgagccccaccauggcacugccgccacugucgccgucgccgccgcugcuugccuccaccuuagcucgccaccaacgccgcaggagcuggggagacgcccccuucgucuucu

SEQ ID NO: 12301 - RNA, 14312 nt, Mus musculus
cuuggaggcuucggucgggagcagguuccugccugugaguuggaaagggacauggcuguugagggcgagccuggaugcugcaaacggauagggaaggcuguguggcgucgggguaauggacugucucaguggguuugcauucuguuuaagaaagguccagacguuuaagauuucccggcuugguuuuagguucuugugggaauggggauccagaccaucagcuaaccgaguaauuugcaaaccgaugguggaugcgggaacugcggcuuauuggggacugcuucggguggagaaucagagucuaagucgacucgacgagucuguggaugaacgggaguucccucguagagugcccaggacuggugcugcucuucccgcagccuucugagcaguuuaugucgggacuacuugagggucuguuucaaagcgcagacccgcuaaagcucaguuuguagaauauuccagaaguuuuaggauugaacacugccuucgugguggccgccgcuguuuauuccaacaguaaggugguggaggcaggaucaagucaaaggucauccucagcuacacaguagguccgaaaaaccagccuaaauuacauccacauacgucccuaccucaacaccuccauccccaccacacacacacacacacacacacacacacacacacacacaccuaaaugugugguugcuuacaucagcagucugaggcaggagguuagccuucgauuuaaggccagccacagcuaauaagugagagccugucuggggauguaguucaguuaguagggugcuugccuagccagcccuggauuccauucccagcacuuggaaccccgaggauggugaugaccucugugguccuagcacugcggaacugcaggcgggaggaucaggaguucagaguaauccuccaccguauagcaugcucaaggccagccugggauccauggaacucuugucucuaccacaaacauaaagguuagguguggucuugcauucuuuuaaucccagccuuuuggaggcagagggaggaacucggugaguucaaggccagcuuggucuaccuacauaaugaguuccagaacagccaggacuacccagggagacccugucucaaaaaaaaaauccaaaccuaacaaacaaauccuggcuccacugcaaauacaggaaauagaaaccucuuagggauaagacccugguguagcuauuaugggaaagcuaaacugcagggcugguuauuaaccuuggucuggggcccaggagugugagguagcugcaacugcaguccuuugcucagggcuucugccuccugccuagcuucccugaucugaaaaggggaacccuguggcaugugcaacuuucuuguaguaaaucuuugagcugagugagaaccaucaaggucauuugguguagauccgaaggugaaggacuuggacuccuccuaaaagaaaggcucuuguuuccuuuuucaggugacauggacagauguaaagaaaacugugucuccaggccuguuaagguacagaauuaccuguauuuacaauuucggcuuuuaaaagauuuauuucugccgggcgugguggcgcaugccuuuaaucccaacacuggggaugcaaggaggcagaggcaggcggauuucugaguuugaggccagucuggucuacagagugaguuccaggacagccagggcuacacagagaaacucugucuugaaaaaaacuaaaaacaaaacaaaacaaaaagcaaacccaaaacgaaaacaaacaaaagauuucuuugcuuauuuuaugacuaugaaugugucuucaugcacacuagaagagggcauuacagaugguuauaagccaccaugugguugcugggaauugaacucaggaccucuggaagaguagccaguacucuucaucgcugagccaucucuccagcccccacaaucgguauuuuuuaaaugaugugcauuuuguuugugugcaccuaugcauaugccacuguguaggucagagagcaacuugucagaguggguccagagacccuaacccagguccuuaggcuuggcuguaaaagaccuuagucccugagcaaaucuguacagugcucguggaaucgaauccuuuccuccguggcuuuggguagaaacuuuagguugacccugccuggaggcuaccugagccucuguuucuucaggaaauggcucugcuguggaaaccucagacccucugagcucaugguggauccugagcgccucauuuaaggaggagggagugccagcgucucugagugugauuaguuuagucuuaagaucucguuaagacugacacaacacagaucaucccgugcaguagugauuguuuucaaggccuccguggucuucuuuguccuuuuuuuccuauugaaaaacauaauuucuaugcauuuuaguuuuggagauaacauucuuaaaaaauauuucuguuggguggggcuuggugggcacaccucuaaucccaguauuuaggagucaguagugggcagacugagauagaggccaggcuguucuauauugugagucugggacuggccaggauuacacagugagacguggucaaauaagugcugugauagaaagacccaggggauggaugaucugagagaacggcaauacgcccuggaagcccagcauaaccuuagauuuagacuguuuuuuuuuuuucaaaauugcuugaggaugauucuaucgucuuuucuccuaaacguaaaauugcugcaaggauuugauauaaacuuucaguaacaauaaaguuugccucaggcgcagaggcuggccuagaacucagucagugccccuccugccucagccucaguacuggaucacagguguggagugccagcguccgggccgcuggguuucacaggugcucaggguuuccaucccuggauggcggcuuauucgcgagugguuaaggaagcgggguuugagucggucgaguccucccuuagggcgcgugcacaauaaggcagcuucagccgccuccccuuuacuuuacuuauuaaagaguuguuuauauauuuauaucuuuuguggaugaauguuugccugcauguagccagaagagagggucagaucuggcucuggaguuauaggugguugugagucaccgcguggaugcugggaaugggagccagagccucugagagggcaggcagugcucuugacugcucaguccucucucugccccccauucccauuugucauacaagauauuagggguuuuguuagacugcaaaggacacuugguucuugggguagcagcagccuuuccugaagccauaacgccugucuucucuccaucucagaccacuguucccuucgguccgaaacgcgucuuggugacugagcagauuccgucucagaaccuaggaucugcuagcaguggccaggcccagcggguccuguguccuucuaacucccagcgugucccuucacaagcccagaaacuuggagcaggucagaagccggcaccaaagcaguugccagcugccaguguuccuaggccugugucccggcucaauaacccccagaagaaugagcagccugcagccuccgguaaguggucuugggugcucaaaugcauagcuuggcguuuauccuugauguccuagccucuguaccaugucuguugaggaggagagaaagaaugagaucuccaugcucagguguaugucacacaugucagugugucuggguuugggcuccaccagugcugggaugcagauaccauugcuggccaagcucgcagauguccucugcccggagcagaaggaaauguuggauguaauggagagacuucuggguucccagggccugggagggaggaguuccccagcauggagaggggaguuggaggguccuuccugacaggcuagcuggcagaggagaugaguuggcuagaggagggagggagccaggugaggugguaagggggauguuggacuuuucauuacauuacauguccaggcucacaaguucagucauaauuagaaaauacaaacagagcaccaccuccucccccauccccccuccuccuccuucuucccccuccuuuuccuccucuucuuccucuccucuuccuccucuccuccuccuccuccuccuucuccuucuucuucuuuuugguuuuucgagauaggauuucucugugcagcccuggcuguucuggaacucacucuguagaccaggcuggcuucgaacucagaaauccgccugccucugccucccaagugcugggauuaaaggugugcgccaccacugcccagcagauucuucuuauuaaccuauaacuucaauuuaaagacucuaaagaaugucaccuccaaaacaaacacauuuguuauaugacauccuacuuuuaagauggcaguguuugcuguuugaaagcacuccagacagacagagaauaucugaacccaucuuuucaugagcaaauacuaaugcccaacuucuuuuacuguuucaccaucuacacuauaaaguaggacaagccccuuucagucagucuauuuacugaguuuuauuccuuuaggaguguacccugcaugacucccuauuuuuaaacuucauuuuuagagaccucuaagccuauacuaaaaagagauguugaauccguagccuguucuccuacccagucagaguuugucaguugucucuguuugcccugcaucaauuauacuguuugaguuugcucaggggcagauagcccaggaagguuccuggagugauggccucaucuagcuauguacuuaucugugcuuaaugaucuccagggcauuaggaagacuuccaaauagugaccagauaaaguuaauuuuaggauuccucaaaagacucagacauaguuuuuuucaggaagacacaaaaggaauccuaaugcagaaagucccugcuaacauggcaaccauaaccccacacaaucacacagagaccaaaucucaaagguuagagagaggacagcgauugcagccauuggcucagcauuacugggccugggugggucaagcagcguugcaggcuccaggacuuucacuguguaguggguuuggcugugucagaaccgggcugauguugggauuguuuggcagcuggugggugcuuacagcgccucugggauugccuugaccugcauccucccagcccuggcaggcacucacguagacagcauguuacacagaagagacuaaaacgcagcaguuaacuuagcccaggacaacuccagaaaggagaggcacgggcaaaccugccacuucguuuaggaagcagaugcaagaccagugcgugauaagaccugaaagaugggaugggaggagauagcuguagcaguguaaggagggagagaacucaggcugggccucaugaagaaaaacagucuguacaaaugagucaaggcagacagcuaagucuggagaaaacccaugugaaucgagugcauauguacuagucacaaagcaggaaaccggaaggggcagauggcugaagcuuauguaguaucauucagcaagggagagaugcuccagcaagcucugagggcagaggagcagauggaggcaaaggaagccagugcugcccucagacccaccucucagcugggccacugucacuccaccauccgaaacacacucggcuggaguggauuuuggguggcuucuucugguuucaaguccuguuuggggucauugugaaaguaaguuuuauucaccugaaguaauugucgucugggaagcuuacuccgucugcuaaccugggccugggccuggaaacucccagccucuguguaaucuagucuaggccuaggacugucuggccucucagaucuccugcagaacacgcuuaccguucuagcucuuucugaacucuauugguugguguaacucagcuguccuggcucaaacuccuguccaagcugacggauucaaucuggcuucucuuaguuucuuacugaauugcuuaaaagaacuuuauuuaacuuauuuccuaggaaaugauucugaaaaggagcaggcauccuugcagaagaccgaagacacaaaaaaguaagcuugcugucucugcuacgagagcacccgucgggcugugcgacacuugucuucaugccauccccacuaaacucaaacuuagcaggggcucaaaaguaguucuuuuuauuuccuuaauuacuuuuucauagaagauuuuuguuaaaacuuuauuuuaaaaaguaguaaaaacaaaccaaaaaaaaaaacccaaacaaaaaaccaaaaaccugccaaagaugcuacaaucccaugaacuuguacacaauuuggauaguaauuuggaguggccuguuggcccuucccugcuccuaccagugacaguggcucuguguuucccaccagagugacucucgaacccacagccuguuagcuucucuggggaugcagggaggagguccucacaugguccugaaaggguguccuguccagugcuguugcuguccuaugguggugaggguugccagucagucuguccuggagcagagugcugcuguggacagggaacgcugggcucuaaagcuuguggcucguucuggugccuugggguugaugcucguugaggguguguacggaaugucucugagcacgaccaggcugacugcucaguggcauggcugugagcuguggcuagugauuucauauuuuaacuguucacauuacucuguagaaggcaguggacuuuggaagauuuugacauuggccgcccacuaggaaaagggaaguuuggaaaugucuacuuggcgcgggagagacaaagcaaguucauccuggcucugaaggugcuguuuaaaacacagcuggagaaggcgaacguggagcaccagcuucggagagagguggagauccagucgcaccugcggugagugguccuccugccggaggagcugggggacccggacagugccccuccuggcuugcuucagggaaugguuaaagcugacauuucccguagacugggugacguggcccucgggaaacauugcccaaggcuuaaagccagcaguguacuugggcuuuucucaucaggaggagauuggaggagacacugggugaguugguaguguugguuucccuuuuggcucucaguguuucugaguuugacacagaugccagugcugaggcucugguguccucugcugucuggcuugccguccgucaccuggcaggguggggacuggggcaccugcccacugccccccugccugccuugguugugacuccuguuugcacggccugcuccugcacagaagugcuucccuccucagagagagagagagauugcugucagcugacacuguuucccacuaaggauaaagaugucugaaaggagcagugagaacuaaacucgaucugcuucuauuuugaaaucugugcguggacauguuuaaggugucuuuuggcugggcucagaucugugcucagaucuggguucagaccucgugcgagcgcugugacacccacugucuuuauuuuuugaggggucagcaguccauguggagcuggcucugaagccacaugucacagucuuuguucuuuguugcaggcaccccaacauccucaggcuguauggcuauuuccaugacgccacccgaguuuaucugauucuagaauaugcgccccuuggaacagucuauagagagcuccaaaaacucuccaaguuugacgagcagagaacagcuacuguaagugcgcuccuuccuuuaugcuggcgucggcucuguccucauagaaagggcacguaguuaugaucaaauauuugaaacagaagaaaggcaaagcagcuuaguuaguugccucuauacugaguccguguguguguguguguguguguguguguguguguguguguguguguguguauguguaugugugcguguguguuuaccugaacauugcuucucuuauacuuuauaacuaagcaaugcuggugcaugacuggcgugcugaagcccacccuuuucuugcgagugcgucuguguucuuugugacuacaaagggcagagguacugagaagaucuugguuuaaagugagguuuugucaugucagcacugggcaucacugugugaccgcuugugaggugguaagcuaguguccuguuccuugggugaucuuuguccuauugaaagucagugucccccuucccaugcugaacucucagagccaguaagcacgcucucccugaggaggggauggaaugggacuuauuuggugccaugugcuaggagauggcucccucuuccuguugucuuuuagguuuauuuacccauguuauccauguggguauuuggcuugcauuuuucucugugcacaggguccagagcauuuuucucugugcacaggggccagggcuagaguuucagaugcuugugaacacccagguaggagcugggagcugaaccuggggccucuggaagaauaaccaguugcucuugucuuuuaacuuuguuguuguuguuguuguuguuguuuggccagcgcuaauguauuuuguuguuccaguguugucuccuggcgcucugccagguuucuccauaagccaccacugugggguuuuggcugugugagcuuucuuucugguacugaguacuuggccucaucuucacuuccaggcaggccugguccuagaagcagccauuucuucccuaaggaucuuggcuccuuuguuggagaauguuacugggaacugaggucuccugggaacucuugcugcugggcuguuguugcuuguagcucucagcuggggagauugcauggggcucgugcauguuuguuuagugaucaguauucaucucuccugagcucauccauuguaugugggacauuguggauacccccucuucuugggcuucacuguacccgugcaucacccauggccuccuuguuaguuaugcauuccugugugugugugugugugugugucucugugugugugcgcgcgcgccugcaucugccugccugggucucagugugccugcaucagcugguggaguuagucauuccacaccagcacaccuugggcauuugcuaccaugguuuugggcaucaguaguucuggcaggguagucaucuuucuguuggucaugguuuccaguggcaugugacauuggcuauuugcuauuuaugucugccauuagaugccuguguaguguaguucccucagcuccuguccugugucguuccugcagacgucuccucucagucucuccucccuucucaaagccguuuguggccucuuguccuuaaagcacagcaguucuuuuuucuuuuucuuuuucuuuuccuuuuuuucuuuuucuuuuuuugcuuuuucgagacaggguuucucuguauagcccuagcuguccuggagcucacuuuguagaccaggcuggccucgaacucagaaauccaccugccucugccucccaagugcugggauuaaaggugugugccaccacgcccggcgucuuuuuucuuuuucaaaccuugucugcuuccuacaugcugaaauucaagguugccaucaugcccaccuggcuuacagccaccuacacuaaucguuuucuauaauuggccauuaauaagaaaucauaucacuggacuguccugacuaggcagccgcccagguaaugccauggagacuuuuauuaaugugacagcuuggccuucgcuuaagcuuguuccuaacuagcuuguauaacuuccgugagcccauuuauacuaaucugccuucugccacauggcucccucccucuuuuuuuauacaaccagucuguuucuuccucugcuucuagcucucgaauccucacacuugguacuuuucuuguuccuaucucugcccggaagucccgccuauccuuucuagcuuggcccuaggcuguucaguucuuuauuaaaccaaucacaaggaugauggggggaaaaauguuuauaaaacauugagaugggugaugcuucauacaaauaacaguaccaaagccuggucgucuuuuccuuuugggaaagcaaaguuuguuugccuauugagcucuugacacacgagagcugagguggcucaugugugcugaguaagcggccaccacaacaagaagcaaauagaaagacagguuugcugggaaaugcccaccgccuuccgucuuugcuugcuuacuucucauguagauuaaaacuuaacagaguuauccugaguauccuguuaaugggaugcagagcagacugugggacuggcaauagauucuucagauguggaggccaugggugcucaaggucugccccuggucagggcauuaauuguuccuaucacuagcugugcaguucuguaaguccagcuuacagccagugccaucccugccucucaagauuaucuuacuccugugaguauccuguuagcagaguccugauugaguuugucaaucugcagcugguguucacagacucaccccuuuuuucuaugguguuugcuucaauacaugaaaagaaacacguuaguccuuguugggucaacuugcaguuuugccugauggccuuacauauaaaccuaagcccugggucuccuguguucuucucccaacaguacaucacugaguuggcaaacgcucugucuuacugucauucaaagagagugauccacagagacauuaagccagagaacuuacugcuuggcucaaacggagaguugaagauugcagacuucggguggucggugcaugcuccaucuuccagguaugggauuccagguuagcagaaaccuuaggaacacccgauaaaguucuuucugggaccugggcucugucacccuggcuuauggauacugagugucccuagagguuaauggagagugaugcacuuagagauauggcugaugguugguaaacaaagguguguccuggagagacuuguaccuuguuggguggggguagaguagggagugaagcuggacaccaguugauuggaacuucaaaaccacaguggugugggugcagcucugggggugccugucuccugcugcuggucaguagcuguaaagguucccuuacaacugcagcggagacaucaucuuaugcaacaguuuagaaguugguacuuucaaacuugaaaacugaguuggguuugaauaacuuugauuuucucauuugaauggggugucuuuaaagugugcaucuguugucaaaaguguugccaacuuugggggcuguguguguguguaugcaugcaugcauguauguauguauguguagcacuggcuguccugaacuugcucugaggccagaugagaaagcuaaacagguacagauaaaggugcuuguucaagaccugggacccauuugguggaggaaaagacugaccugccaagcuguccuucagccuugcucuauguagugagcgcucucucucgcucucucucucuccacacacauacacacacacacacacacacacacacucucaaacacacaaagaaaugcagauuuaaaaaguguacagccuguuuucuuaagcacuggugcaguuuaaggucaccuguuugucuccagcagcucuggggcaggcuguuguaacugaugucggugguagcuccuguuacccagugacacaaaccccagaguugcaggugucaugggacuguaugauuaagcaggacuguaaccugacuagugguggcaucaagagagagacccagcuugcagguuuuaggagagaucauaguugagaaucuugucaguuacuccaauaacuucaaauucaguccccauccuagcugccugguuacuggggaccauccuuugggaaucucacaaaagccucuguugucuguuccugguugauuccagcuuuuguuuucaaaacccaaacggauagaaaaugcugaguuggugaugguggcacagagguccacagcucuauucuagagcccuggguacagcuccauucuggaacccuggacacagcuccacccuggagcccuggacacagcuccacucuagagcccugaauauagcuccacucuagagcccuggguacagcuccauucuggaacccuggacacagcgccauccuagagcccuggacauuggugauaggggacauuuaaagucaguugugacaucacaaugugauguuucagugugcauccccuaagauaggggacugcuugcacugucaccaccauugugaccaccaaaguuagcauaauucuuaguaacuaauauuuaguuuacacucugauucaaagccgaccugggcuacagcgugcgacuaauuuugggggguaggaaaggaaagcccuagaaagggagagucuauaaaugaaggcggcagccguguaccucaggggacguccuggguucuguaguccuguuuggcuguuugguuuaggggucuaaagauuuuauuuuuauuuuacaacguauggguauuuugccugcaugccugucugugcacauggaugcuuaguguccaaggaggcuagaaaaagaauugucagcugugggcuugaguuacagaugguugugagccaccauggggugccgagaacugaauccaggcccucugcuaaagccucccaugcucuccacagcagagccaucccuccaguaucuugcuaugcagcccagacuccacuccaagcaggcauucucuggccccagcccucuggcugcugcugggaucacaggcgugagccaucacacccgacuaagaucuguuuuuaagacagucuuaccagacugaucuggaacucaauauccuucccucuccaccucucaggugcugggauuaaaagauaaaccagcacacagggcuugguuauguuucccucuuaccguccacacaggugugugugcuugcucauagcugcuuuuacuuaaaguaccgacuuuaaagcagcuauaagauuucaugaacagagccgggcaguagugguacaugccuuuauucccagcacucaggaggcagaggcaggccuggucuacaaagugaguuccaggacagccagggcuauacagagaaacccugucucaaaaaaaccuaaaaaaaaaaaaagauuucaugaacagccguagacgugaguuggaugggucugggggaaguuugguggcuccaugcuucccccugaccauuuaggugggcaccugucugagcgcgcuggccugccauagugagcgcucaucacaucaccacaugguaugucugugugucaaccccagucuccguuugguuuaggagaaccacaauguguggcacccuggacuaccugcccccagagaugauugaaggccggaugcaugacgagaagguggaccucuggagccucggcguucucugcuaugaguuccuaguggggaugccuccuuucgaggcacacacguaccaggagacuuacagaaggauaucucgggugagcugcugcugucaggcuucugccgagggcugguguuuuguuuauucauguucaccucugacccaugcuuguguugguuuaucauuuauucugcagguugaauucacuuucccugacuuugugacagagggagccagggaccucauuucaagacuguuaaaacacaacgcaagccaaaggcuaacacuagcggaaguccuugagcacccuuggaucaaagcuaauucuuccaaaccuccaacuggccacacuagcaaagagccaaccagcaaaucaucuuagggaauccugaaccacggccaccgugcaacugugagaaacacccuauugaagccacccuccuggacccucauggcugcccucagggugccuugcugagcaacuaguccuuggccaugcauccaggaaaccccaagaaccaugcugcuuuuccugauuuaguaaucuggagggaagguuccacugcagcuguccccuacccucacccugggccugugccccaagguguccuugugggggggggggucucacugugggaaacuuaccagagaucaccugugucguagccuucaagugccagaguguguguauaacuuauugggucaccaggccuagggaaacuguuggaauggguauguaaucuuuuaaaugucaaaauaaagauuugcauagacuuugacuuuuaagugacacccauucagggucuuguuuccagucgucugaagcccgugcgggauuuggauccucagccacugcuacggagccugugccuugucuugagaccugacucggggguuucuuuuucugcauguuaaaggcuauuuuuuauguuggaguucugucauguaugcaaacuuguuaaauauauauguauaccaucuac

SEQ ID NO: 12302 - RNA, 60567 nt, Mus musculus
  misc_feature (18165)..(18165): n is a, c, g, or u
  misc_feature (18170)..(18170): n is a, c, g, or u
cgguuucucagacuguugcaggaaggagugguguggacacgucucaccgggcggacgcggccuggcgguucugauuuggauuccggcgccugggccacgacgccuugaggagcuuuaucaggcugucugggaagaucuggggagcccagggcaucccgaagucaccccgccccgcgccauguccuauacguucacgaggugaagggcugaggggggcugggcgugaggccaauugcucugcgcucuauucuagugaaggugcgcgcccgggcgcuuuauaggugcaguuugcaucccuucugcgggucgcuugccgguguugcuccuggaggcaccaaugcauugucgcggcugaccagaguggcugcgaccucggagaaucugcgucaagggcuuggcgggggggggggggggggguggcgggggggguggaagcggggggugauuuauucaccaauguuaucccacuguucgcuaggcauuguuaugguaacagcuuccaacuuguauuucccggcacuaugcaaaagcgcacuaaagcauauuugcagaggagcugagagggaaacucgcgacuugauagccccguguguuuuuaggagaacuacaucuucuaggaggcuuccagcaaacaccucuuuucaucaucuacugugguuuucaugcccauuuuugcaacaauuaucccuauccuuuaaaauaauggggcuucaaggucaguucucuauagugucacaauuuagaugcucgauuuaaaauguguucuguuccaaaggaguuaaagcagaggaugcuguggaugcauuuauguuaaaauuuaaaguuauuuucauagcgggcagugguagccaaguaccugggagggagaggcagguggaucucugaguuugaggccagccuggucuacugagcgaguaggacagccaaggcuacacagagaaacccaguuucagaaaaggaaagagaagaggggaagggguuaggggaccaggacagccagggcuauacagagaaacucugucucgaaaaaccaaaaaaagaaaaacaaguccuguuuuguuuuugguuuuuuguuuuguuuuaaaacagggguccuguuuggaaguauucgcagucuguccaguauggaucacacgaaaauauuccaagacuuucauacucaacuuucuugccacauuuugaauuccaagacauuauuccuccagaugacuuccuaacgagugaugaagagcaagauuugguuuuauuuggaacuaugagaggacaaguuguuggacuacgcuauuacacaggaguuguaaguaaaagauuagauaauaaaauuaugguauguuuaugguuuuaacaguaaguuauaguaaaaggugauguauacaaugaauguuuuacuuugaaugaaaggcuagucauaaauaccuugacuaacugauuaacuucuuacuuuucuccuaugcuuauaguuuauaaagcacuuuugcccacacauuugguccuugugauuacugaggaacgugguaaauuuaagaaaugacuucaaauccaucauguuuugcauuagguuauucauuuuuguaguaaaaacaguccuuguucuuucuuauguauuccuguucucugaaaugaauguaugugaaaaugugugugagagaaagaaaauggacagauugagaauauauauauauauauauauaauuuucuuugaacaauaaucuuuauuaagggcaucuuuguuauuuaguaauauaauucuaaugauauuuaauuuauuaugagaaaguuucuaacaaaaugagaauaagauucaaugguuagcaaguauuuucuauuuuugcuugcuuucucuucucuucuuuucuuuucuuuucuuuucuuuucuuuucuuuucuuuucuuuucuuuucuuuucuuuucuuuuuguccuguaaaaacaaauaccaguuguaucacuuuacauuaguauaguucagucuguauuucuuuaaacugcaguuugggagcugaagagacgacucagcagguaagagcccuugcuguuccugcagaggauuagaguacuauucucaguacucuuggcuggcacaacagcaacugcagcugcaggugucccaaugcccucuucuggcauacaugacuacuguccccccccauacacacauaugcaugauuaaaaauaaaauacaucuuuaaaaaaacucucaguuuuuacauuucauuuuuauuaauggaaucaauauauauauauauauauauauguguguguguguguguguguguguguguguauacacaugcaaucaauaauuggauuuuguugauuauuuaaacuguauuucuuccaguuaugaucaaaauuauuauauuaguuuuggcuguuaugggcuauaagguccguucucauuuccugcuauagauguguaucauuuaaaaguaaggucucuuuuguggaaucuuguuaauuucuuacuuucccccuucucucauuguuuucauauauauauuuuuuaaagauuuauuuauuuauuauauguaaguacacuguagcuaucuucagacacuccagaagagggcgucagaucuuguuacagaugguugugagccaccaugugguugcugggauuugaguuccggaccuucggaagagcagucgggugcucuuacccacugagccaucucaccagcccccuguuuucauauuuuuauauuaagguuuauuaaaaguuuuuuuuuccauguguguggggggaaugguuuggaaccauucuggucuggaacucacuaaguaauccaagguugacccugaacucauagugguccacuugucccagccuucugaguacuugaugaucucagaacucuauuuguaauugaaauuugaggagguuccuuggaggaauucuguguuuccuguuugucauguuuuuauucucuguauuuuuuacguuggcauaacucaguuguuuaguaguuguaugagagguaguauauaggagauuacuuagggaagaacaauuguuuuuugaauuuuugugaauucauaauuuucauuuucuacuugagaauuuguccaaauauaaauaaagugcuugguccacauuuuuucuggguauccuaacauugcacaauauagugauacugaaaauuuaggauuuucuaucuuaaguaaauuggaauuuuuuuuuuuugccugaugauuaaaugauauguggguuuuuucaaaaaagucuaauaguuuuauuaaagaauucuauaaauuuguugucucuuauuucagaaaaaauucuaagacuauacuuuuaaguguuuguuuauucuaaagccauuuccguuuuagaaacuccuuacguucucauugacucccucgauguuucccuguugucuacccaugucuacuauagccucuggauccuuugugcugucauuuuccauuuucuguuuuucccacauccuuucuuuuucuuaccaugcuuuucagacguucucuuuacccuugugcugacuguaguacuuaguauucgcucgugauuucuuucucuucuaggcauuuuaagaaucuauccauucuuuuuuuuuguuuuguuuuguuuuuucgagacucuguauagcccuggcugugcuggaacuuugauagaccaggcuggccucaaacucagaaaucugccuaccucugccucccaagugcugggauuaaaggcgugcaccaccacugcccagccaaaucuauccauucuuaguuggcaucuaucuauucucugguucucucauccuuuuaugaguuguauuucauauuugugcuacuucaaaacuuacaguuuucuaaauuacauuuauauggaguguuagguuauaguuauuaauccuggaacaaucaguuauauugaucugagaauaauuucuaugauacuaguuaacuaauaagaauguauauagauggggcuggagagauggcucaucgguuaagagcacugauugcucuucccaagguccugaguucaaaucccagcaaccacaugguggcucacaaccauccauaaugagaucuggugcccucuucuggagugucugaggacagcuacaguguacuuauaugcaauaauaauaauaaaaaagaauguacauagaucacauguuuaguucauuuuccuacuguauaguauuugcagguaauaucauuuuaaaacauugaauuucauaaagguuuuuuuuuuuuguuuuuugguuuuucaggacaagguuucccuguguagcccuggcuguccuggaacucacucuguagaccaggcuggccucgaacucagaaauccaccugccucugccucucgagugcugggauuaaaggugugcgccacuaugccgguuuuuucauaaaauuuuuaauacuauaacugacuuuauauauucuguaauuuuucaauaaauguacauauauaaauugaaaucauguuaauaaaaaacccaaacagaaaaugguuaguuacucccauaacauucaugccuguuauacccauggacaguucuugucacaccagucacugcaggucacaugguucacagcugaguaagauuguugaugaccccccuuacccgccaccagaggacuccauaguacuccauagaggacuuccaguucuaugaaagcuacucaguggggacugagucaguaccuccuucauuccuccagguccuguggccaauguaugaugugucuaugcuugccuuaccaucauguucuuuugggaagccaagagccaagacaauauccuauauuguuuugggaaucuuuuggacuacugguagugucccauaccuggcacugaacuuuuuguuuggaaaccuguggauucugggauuagcauagucucccauguaggguaacucuaaauaaacucuguuauauggaaagauacuacacagacacacacacacacacacacacauacauauaugcaugcacacaagcauacacacuguauauacauacacacaugcaugugcacaaacacacacacacacacacacacacacacacacaugauuucuacauugccuuuuucauacaaucuucguggaaauucucucuccccaaacguuccucugcucuaccuucucaguucucucccacuuaaaccuccacauuauuuuucuuuucauaccaccugacuucuuucuccuacccuuaagcccuccccucauuguccguuucugguuuccuggauuguaaggcauuccaaaucaaacaaaccuaaugauuugacacucagagccacaugauuaagaacauguggucuuuguaucuaugggucuggguuacuuaaguguaauguuuaccagcuguauugaccugcacauuuuauuuuucuuuguauaaauuccauuguagauggcccugcauuuucacuucuugucagaugauggauguauaggcuguguccauguccuagccaugaguagaguaaaugugaacauggauaagcaggugucucugacccaaccugggcauguauagccaaaaauuaccucuugaacaauauagggcgaaugaaucuuacaguagauuugacuguacuuuucagauuuuaaugguuuauuacccuuccuaaugaauauaaauuagaaaaguagagaagaagagccauuguaaaacauauuccuuaauauuucuaguuugggcugggacuguggcucaauugauagaugcuuuguaguccuuaccaagcccugggguucagucccucacacaauaaagugcugagaauggcggugcauaccuguaaucucagcacuuaggaacaaguggaagaagguucaauuuuuuuaguucaagaucaucuuugacugcauaucuaacuugaggccagcccuagauacgugagacucuguuccaagcaagcaaacaaaaaacaaagaaaaacuaacaauaauguaugaauggaaacucuagaaaccaaacaacuaauucaagcuauuacucuucauauuuauauauuuacaucuguuccuuauuuuuacuagguaaauaauaaugaaaugguugcuuuacaacgagagccuaauaaucccuaugauaagaaugcuauuaaaguaaauaaugugaauggaaaucagguuggccauauaaagagagagauugcagcugccguggccuauaucauggacaacaaauuggcacaaguggaaggguaaugugcuuuuagaguuuaauccuugugguuuuaguuaucuuugaauauguuaucacuuuuggagccccuggaagugucauggcuccuaauauuacuguacuuuauauauguucaauuuucuucucugccuuuucuauccagcaaauggcuguccucucuaauucucuuuacauuauaaccauggagaaaaaaaaaggguuuuguuuucccuuggguuuacauauuaggaaguauauccugucucuugcuauuguaccuaguuuaacucacagugacccuccagccucaaacuccuccugagugcugacaugacaggcaugcauuauaacaggcauuucaugauggagggcuccugguaguacaaccuggccucgaacucugaaaccuuccuuagccuccuauguccugugauuagaggugugccccaucgugaguguugguuuuauuuccuuuucgguuuuucaaauuugcuuaaauaauuccuucuuuuauaugucuguguuugguggaauauuuaacauucagaauuaguauaaaaauaacuuucaauuucucauuuuucucucuuccuguaauaguguaguuccuuuuggugcaaguaauacuuuuaccaugccucuuuauaugacuuucuggggaaaagaagaaaauagaaacgugguuuuagagcaguugaagaaacauggauuuaaguugggucccacaccaaagaguaaguuugauguuguaagaugcggggauuauuaaguaaucagucucuaugaguuugauuggcuaaaguaguaauguacaaaaugcuccaaguuauaacuuuuuuugguaaucuuugcuggcuuuuccuuuuauauuucuguugaauaucguaguaauucaucauuguaacagcagggcacguucugaggaaggcaucauguugacugucauuguguaacuguuguagacuacuuauacaaaauaguuaacuuuuagacaagaaaaacugauuaauaaggaaugaaaaagaauuuaauguuugguuagaacuuauucaaauaguaugugauuauuucaguaauauaaguuguuuuuacauuuaguauauagcuuuaaaaauuuuuuuuuaggucuaggaauaugauucagugguagaacacuucaauaauguauuauauuuuguuucauuuuuaauauucauuguaguacugggaacugucugcuaggcaaguguucugccacugaggugaggcacacagccaggucugggaaguuuuaauacuguuugguauuuuaguuaguuccuacugcuuaauuuccuuuuacuugguuauuuuauuccuaauguuuggaaaugauagcuuuagggucgaguuuggagaacgcauggggcucuggaagagcuggaccaagcuauaguaggccggcucauguggcaguacagaugacaacugaccagguaagcuuuuugugguugguugcuuugguuuugagucaaggucucaugcaggcuuaaccucaggagucacuaucuaacugagcauggccuugaacucugguccuccugccucggccucaaauacugagauuacaaaagcuuaucaccucugcugccacugauacacucuuauuuuguacuguaauguaaauuuuuagugcuaaagguugcuguuuaaaagaauagguugaauaucuaugugcugguauuaguaaucuuuagguauauuguuuaagguauaaugaaaacuuguauaacaaauagaauguagauauucauuugcagacauagucuaaaaaggcagugauaagggauauauucaucccuuuuaauucuggaaccauccagccucuuauauaaaaagcauugucuuugcacaugcuauguauuuuaaacaauuucuaaauuaauuuucugccauaauuuacauuauaaaucugcuauaaguauaaaagauauauaguaguuauaccauauugguuaugaaauaauggcaagagaaauguauguauacagacucaguauaaacauauccugugugacuauuguugcuuagcuagaucuaugaaaaggaagguagauucacauauauacaacuauacauucauaaaauggauaugauuauauauauaauuuuuguuugaaacuuuuagaauguccaaaguagugauaaaaaacacuagaaugugacaacuauuuucuuuacaaaaagguugcaaauacaaucuuaaaaaaacuuaacuuaaaaauuuugguauauucuacuuuuuugccugauuuauucaauguguuguuacaccaaguuacuccaaaagaauauauacaguuuuuguuaauguuaauauagauuauuuagacaauaacauuaaaacauuuucaugacuguguauccacuaaugguuuuugacaguagcacuaaaccauuuuauaucugucuauccauuagugagauucuuuuucucucccaguugguuuuuccucaauguucaaagggcaugggccugugcuuugugggcaagcugucuucuagguggcugcuauguauucauaugcuaauuuuaagaaaugauaagacauaccguguaaguuacauuaaaacugaacuagauugggcuggagagauggcucagugguuaagagcacugacugcucuuccagagguccugagcucaauucccagcaaccacaugguggcucacaaccaucuguaaugggaucugaugcccucuucuggugugucugaagagagcaacaguguacucacacauauaaaaacaaacaaacaacccccccccaaaaaaaaacaacugagcuagaucaguuuuaauggucagcuaaauuaguguaauaaugaaguuguccuauuagccugacguuuuauagaacauagcaaguuagauguaucuaguaggucucccaaaaauagacucaaugcuaaaaagaauaacagaauuuuaaucgcagaaagaaccuuggcuguuuaguuuauuucauauucuugauuuuaugaagguaagacaggccauaucuaugccuaaacaugcagagucacuugugacaggacugugauuggcaccuuagagcgucaucacuguccuuucaguagcauuaggacugggccugguaaaugcugggaccagugcucucucugcaggcuguauccuugcuccuuuauaacuuuuguguauguucauauaaaaugagugcauuuacuucuauagaaaaauuaccuuauauguuuguuagugaguggugggauaucucagauacuuauuuuauguaccucugagcauuugacuuguucaaugagaugauuuuaaaucuauacguuacauaguauuuauacuuuaauagguuuguucagcauuuauuauuuuuuaacuguagcucaaaacggaauuugacaaauuauuugaagauuuaaaagaagaugauagaacuguugaaauggaaccagcugagguacugaacuuguauauuuaaaaaaauuauuucuguauauguuguauaaaguuuuuuuuuaaaagauuuauuuauuuuauguauaugaguacacuuucuguauauguuauauaaaguuuuuuuuaaaagauuuauuuauuuuauguauaugaguacacuuucuguauauguuguauaaaguuuuuuuuuuuaaagauuuauuuauuuuauguauaugaguacacguagcuaucuucagacaugccagaagagggcaucggaucccauuacugauaguugugagccaccaugugguugcugggaauugaauuuaaaaccucuggaagaacagucacacacacacacacacacacacacacacacacacacacacacagacagaguuuuuuuuuuuuuuuucuuucuuucuuuuuuuuuuccugagacaggauuucucuguguagccuuggcuguccuggaacucacucuguggaccaggcuggccucgaacucagaaauucgccugccucugccucccaagugcugggauuaagggcgugccccaccauggcuacacacacaguucuuaauaugagagaaaauauguaauguaggucugguuuucuuucuaggccuggccuuuuccacaaaauaaugaccaaauuccaucuauuuuucuauaagacaugauuuuggcugaauaaauaauauggcugaauaaaacucuacucuguaaauauacugccuuuuauuucuauuaauuuauugauggcaccuaggcugauuauaaaauuuauuuuauuaauuuauauguguacacuguagcugucuucagacauaucagaagagggcaucagaucccauuacagaugguugugagccaccaugugguugcugggaauugaacucaggaccucuagaagaauaguguuguuuuuuuguuuguuuguuuuguuuuguuuuucuguuuuuucgauuuuuugagacaggguuucucuguauagcccuggcuguccuggaauuuacucuguagaccaggcuggccuugaacucagaaauccgacugccucugccuccugagugcugggauuaaaggcgugcaccaccacacccggcaagaaugguguucuuaaccauugacccauuucucuaguccuggcuaucuguguuuugguuuuuuuuuuuaagaaaugucuguuuucuucauuuacucauuugcugauagacaaguacuuucagaaaaugauuccagaaacucaaaaaaucauuccuggaacugaccaguggugugcauacaaagcuucugcauagacaaggaaggaguugaugggcugcagagauagaacaccggggcaaucucugccagcuccauguccgggucggggucuguugcucuguagggaauuuaaagaacucaaagauauagcaaugauuacaauguaaagcuucagcauugucaacugccuugguaauuuauacauuuaccacugcaagaagauagcuuuuccagguucuccuuaugaaaaaggacugauuaucuuucucuuuaugauguuauauuuguaggcuauugaaacaccguugcuuccacaccaaaaacaagcucuagcuuggaugaucgcacgagagaacaguaaagaacuaccaccauucugggaacagcgcaaugacuuauauuauaauacaauaacaaauuuuucugugaaggaacgaccggaaaauguucauggaggaauuuuagcggaugauauggguuugguaaucuuuuuuucuauaguuagaaaaaucuuacaauuacgauuuuguagaaagaaaauuuuaagcugaaagaaggguaucagcuugggcuugcuuucaguguagauagaaaauacauuuuguuuguuuguuuguuugggguuuuuuuuuuuucccuuuuuaucuuguuuuucuuuaaaaauagguucuacuagggaaccaacagaugggucaaauaacaaagaaugguuaaaaaugaguaacagaauacaccaacauuaaugaguguaaaaacucauuuccaauuuucuuuucuuguggaaauucaugacaaccugccuuucauaggguuuuuaaaaaguaaaguuuggugauagcaaaaucugucaccaucccauaguuguaagaaacaguaguaaguagaguaaggcugagucacuucaaacugaggagccugcaccuaauuuucuguuuuaaaaaagaaguccuuugguagugguagcaauacugacaagagagaaagaauagucuaacagccucuuguaacccaaauaacuguaccgaucuauguauuucuugcugugacugcugcacgucugcuuggccaagagaggcauccucagauaucgaacaaaacaagaaaauaaaaucuuucuuaaggauuaugcuugaugaucgcacagacugagguuaucaagugggaggaccuaggcuaggacaaggugucucuguuccuuccuccagguccccuuacuacuagaguauggacacuggccucauggcuuggcuuuccguauaaccccaauuucaguguuacuagguguggcaaaaaguuuagaaacaguaauacauauacugagaaguuugacccgagucaugaaaagucaagcaagagccaugagaagucagaugguagccagaugaaacaagauagauuggcgacaagucagacuggagccauaacaagaucagaacauggcuguaaucaaguguacagugggagugggaaugggaucaggauggauaggccugauaagacagacagaggaagaggacaagauacugcugccaucuccucgagcagucuuaaguucagaccaagaaagagguaagcugaagagagggaguuagagcccaugggccagcucaugcucaggugcaguguggcuugaugggcaguaacauuggcaugacuauagaccacucuuccagcaguguccaaccccauucccaggggcuauccuccugguaacgcuacgguucccuaaccagaaucaaacaguaggacaaaccccugacucuuugcaccccuggcgguuuucuuuuucuuuuuuuuuuuuuuaaagauuuauuuauuuauuauauguaaguacacuguagcugucuucagauacuccagaagaaggagucagaucucguuacagaugguugugagccaccaugugguugcugggauuugaacuccggaccuucggaagagcagucgggugcucuuacccacugagccaucucaccagcccccuggcgguuuucuuacagcccccuuuccaucuuuucuucuuuugcucuacccuggagauuacauagauguuagccauacuaggcaugcauccuuccuacuggccuacuccucaaacuccuuggugucuuuaauaacacuguugcuaugggagaaaacaggacgguguuugaaaccguauuuuagcacagauccuaggugugcagcauaggagauauuugugacugguuaccauagccauuccuguuggucuggucauagagcugucucuuggagcucuauaacauuuacaguauuagacaugaaaccaaauaguuuugaaauacuugaacaauagacaaaaacuuauauaaguagcacaauuuaauuuaacucuaaacaauaacauauaugagaaugcugucuccuuuguuuugcaaguuguuuugaugcuuaggagaaaaaauugggagcugaacugucuuuuauuacuguacuuuauauguuuacauuuugaguuucaguucugggagauacaguccauuauggggaagauacgggggagauuuaagugacggucauccuggaacuguagucaagaggcagagaaauggaugcugaugauuauggcagccuuuggaacggugccacacacugaguagcuuauccuaccucauuaaccuaguaugagaaagggggcuacauuuuuggcaguugcuuuagucauaacuugcaagcuuuguaacauuuuaacuuuugauuacaaauugauauuaacucuaacaacauauucuguaguuuccuuugaagacaaugccuuagaccuuacauugcuuacuuucaagaaaauuugucuuagaacucaaucauuaacaaugacaguugcucauuuauuauuuccacuaaaaccaguauaugaguguauauguguguguguguguguguguguguguguauauauauauauauauauauauauauauauguguguguguguguguguguguguguauguauauauauauacauacauauauacauauacauauacacacauauauauguauauaaauauauauauauaugcauguagcaaaaauuacugaaaaaggaggccaugaguuagaagagcgaggagggauuucugagaggguuuggagggaggcuaaccgugccugagaacuguuauugagagucuucucuggcccccauacauauguaugcucacacaucuaccuuccuacacacacacauacacauacacacacacacaaauacacacucacacacacacauaauuuugauauuauagucuccugaaaggguuuauaaaaggaccagacuuuggggacugcuuuaaaauugcuagauuuauuucuguauuacugugaauccuacuauugaaaauaauggaagugucuucaucuauauguuagaauuucuaauuauuuuaaauuagcugugagguucauaguguguuaguccuuccauaaaaugacaauuuuccaugauguuuguaguuuccaugauguuguugaagucauuuaguauaagaaaguuuuuucuuaauuaagugaacugcuuacuuuucauuaauaacuauauuauuuaacaaccaugcaugcuguggauuugacugauacucaguauuuuaugauuuuuagaauagguuuugaaauguuuuauauauggguuuuagaaucugaccaucugucuuuuaaaaauauuuuaaagggcaaaacucuuacugcuauugcugucauucuuaccaacuuugaugauggcaggccucuucucaguaagagaggcaagaagaaucauccaggaaagguaagaaagagugaaggccgcuuuucuuucuuucuuucuuucuuucuuuuucuuuuucucuuucucuuucucuuucucuuucucuuucucuuucucuuucucuuucucuuucucuuucucuuucucuuucuuucuuucuuuuucuuuuucuuuuucuuaagauuuauuuauuuuaugugugugaguacacuguagcuuuacagaugguugugagccuucaugugguuguugggaauugaauuuuuaggaccucugcuugcucugaucaaccccacuugcucuggucggcccugcucacuugggucaacucuguucgcucagucacugcuugcuccagcccaaagauuuauuuauuauuauacauaaguacacuguagcugacuucagaugugccagaagagggcauuagagcucauuacagguggcugugagccaccaugugguuccugggauuugaacucaggaccuucggaagagcagucagugcucuuacccauugagccaucucauuuuacuuucuguagaacuuuguaucucacuaaaagugguuacaaguaccugguaauagcugaucuuuuugagacacgaucaguguuuuuaaccagaauuuauauggugcuuauauaauuauaaguaccaauuucuaugguggugcauaucuuuaucucaguacucaagaggcugaaguggguggauugcugaauucagaggucagucugcucuacauagugaguuccaggacagucagggcuauauaguaagaaccuauuucagaagggcaacaacaggaagaacaaacaaauuuuaaaaauccagaagauacauacgcucacacacacacacacacacacacacacacacaguguaagugccauaucugucuuaguuacuguucuauugcugugaagagcaccaugaccauuaucaugguggggaacacgguaaucggcaggcaggcauggcuguagagcagcagcugagagaugacagagaggguggagggagggagggagggagggagggagggagggagggagggagggagggaggagagaaaggaacaacgggggaggagaaaaaugaguccuucgaccugcuuauugagauguuuuaaaaaauauuuuacuuuuauugagacuuuacuagaaucucagauuuagugggucuuuuggcuuuuguuuuguuauaaauacuguugcuguaucuugccagcuuugggaauuccagaaaagagaguaauaguaauaguggccuaaugauagauauauuauuuacugaauagggaaucuuuuuuugaaaauuuggugugaaugguuuuuucacaguuauaucauugagagguuuccuuugugugcauucauuuggaaagauaaagagcaauuaauuuuuauuuuuuuuuagagauuauauuauugcuguuuaagcaaaugucuauguauaauuagaaagcuaaguagguccuccauuguuggugggauugcaagcugguacaaccacucuggaagucaguuuggcggauccucagaaaauugcacauaguacuaacugaggacacagcuaaaccauucaugggcauauauccagaagaugcuccaacaugcaauaaggacgcguccuccacuauguucacagcagccuuauuuauaauagccugaagccggaaagaacccagaugucccucaacagaggaauagauacagaaauugugguacauuuacacaauggaguacuacucagcuauuaaaaagaaugaauuuaugaaauucuuaggcaaauggauggaucuggaggauaucauccugagugagguaacccagucacaaaagaacacacaugguaugcacucacugauagguggauauuagcccagaagcuuggaauauacaagauacaauucacagaccacaugaaguucaagaagaaggaauaccaaaguguggauacuucaauccuuagaaggaggaccaaaauacccaugggaggaguuauagagacaaaguguggagcagagacugccccaccuggggauccaucccauauacagucaccaaacccagucacuauuaugaaugccaaaaagagcuugcugucaggagcuugauauagcugucuucugagaggcucugccagugccuuacaaauacagggguggacuuaagugcgauuuucauuuuugagauaccauugaaaacauuuaaaucaguuuguguauauauauuuuuaaccuccuaucuaucuuuccauuacuuuaaaaucugguagcauuuuuaaguaguuuuuauuauguaaaguaaagcaauauaaaacaagauccuaacuucacuuaaaacugauacaucacuguagaaaaugucuuuuacauaggaauacaaggaugagaccauuaaacgcagaggaaguaauauggacaagaaggaagauggacacucaggugaguuuuaauuaugaacauguucugaccacuuuauggaugauuuucuuacuucauaauucugucuuggguuuggugauaugcagaaauuuaggauugcuuuaaaaaaaaaccaaaaacaaaaaacacuuccuggagauugguaaucaggaaagguuacgucaaaauaguuggguugguuauuagcuuaucagaaauuuugggggaaaauguuucuuguugggagaaaaaaauucuguaaagaacaguuuaaagaaaaauuaauguucugcuuuagaacucuauuuuaauuauaaugcagugugcuucguuaaaaggaaggaaagccagaaagauaaauuagaaccaauucugaagucaaagagaccuuugauuuuaggagucaugagguuuauacuugcauuucugauccagguugaagcacagaaaggcugugcuucaagagaugaguguguaaagagcugguaguaacugcccugugucagucagccuggggagcagagaagugcagaagacauucucagaggguagaacugagugcaacuguuugcuuuuucuaaugguaggaagacauuuggauauagggguaagaaucguugguaagcuuaugggagaaaaugagaacucaagaaaaacuauuaacgggcuggagagauggcucagagguuaagagcacugacugcucuuccaaaggucccgaguucaauuccuagcaaccacaugguggcucacaaccaucuguaauaagaucugacgcccucuucuggugugucugaagacagcuacaguguacuuacauauaauaaauaaauaaauaaaucuuuaaaaaaaaaagaaaaacuauuaacauucuuaagguggaaggacuacauaaacaaguggguggagggggagagguaggaaaguuggcuuuuguugauaaugcauccaauugugauugcaaguucucugcaaauuaaaauuaguuugauuuuaggccaauaguacuguauuguagaaugugggagggcuaagcagugguaaggaaauugacaguuaauauuuggaaauacagauuuaucaacuaccuauuagagagnauaunaaaauauaaagucuccuccccucuccccuccccuuccuuucucugugugugucuguguuugaucagaaguaaauucagccucuagguuggccaaugcauauuagaaaaagauguuuuuguugggucauaaaaaacugaaaguacuuuuuuuuuaauauuuauuuauuuauuuauuauauguaaguacacuguagcugucuucagauacucuagaagagggagucagaucucauuacggaugguugugagccaccaugugguugcugggauuugaacuccagaccuucggaagagcagucggguacucuuacccacugagccaucucaccagccucugaaaguacuuucuaauggaaaacuacuagguuaggagaaauguggaaacaauucucuggggcuugagaggagugaaguuaguaaagcucacggcugguuauggagaaucuaaccuuucacucagauguugcuauuuuaagacaccuugauaaugcucugugcuucuuugaaauagagucauccacguguggugaagaacccaguauuucaggaacuccggagaagaguagcuguacucugucgcagcugucuagcgucugcccuaagagguaaagugcugcaguuuaacugcaugacaugcuugcucacacucuuccucugcuuucaguuacuguaaauacauuccuaacugcaguugcuaaaucacaaugacaguucucguuuguaaagaugauagguaacagugcucuauaaaaaaggcauuuauuccuaagucaugcugccagucuuccccuguuuuucauuucaaaauugaaaguagggcuggagagaugggucagcaguuaagaacgcugacugaucuucucagcaaccacaugguggcucaaagccaucuguaauggaaucugaugcccucuucuggugcgucugaacacagcuacaguguacucauauaaaugaaauaaaucuuuaaaaaaaagugaaaguaguaauaaucuauaaaauacaugacuuacuaauuuuuaauaacuacugcuaauuucuccuuauuuuuuugaccuauuuuuuuaaauuguugagacaguaagaguucauuaccuucuucuuuuuucuuuauuuuuuuagaaagcaaauucuuuuuuucuuuuuuuuuuaagauuuauuuauuuauuauauguaaguacacuguagcugucuucagacacuccagaagagggagucagaucucauuacggaugguugugagccaccaugugguugcugggacuugaacucaggaacuucggaagagcaguuggaugcucuuaaccacugagccauuucuccagcccuuuucauuuuauuguuuuauauguauguuugcuuguaugcaugucuucugugugccacaugugugccuggugcucaggaagccagaagagggcauugggucucuuggaacugaaguuacagaucauugugagcugcuauguggguauggggaauugaacucagguccucuggaagaggacccaugcugguaaucccugagccaucucuagcccaguuuccuuuguuuuuguuuuuguuuguuuguuuguuuguuuaauguugguuuuguuuuguuuuauugagacagguuuuuucuaaguagcucuagcuguucuggaacucacuauguagaccaggcuggccuugaacucagagaucugcugccugccucugcuucccaaguguugaaauuaaagguguaugccauuacuggccccagcuuccuucuuguguaaaugcugaaucuuaaaacugaacuaauuauacgccuaugcaauauagcacuauuagauagaauagaucagauaaaaggaaauggguuauguaacaaggaaaauuuagacacagcagccaguugcaucuauuauagccaauacagcuaugcuuacucuucaaauaguaauaguuuuaggacuuuugaauacugucacauuugugcuauacaguggguuauauuuuuauuccuauuuuccaagugaggaaacagacauaguuuggugauuugccuaaagucauaucaaguuccuaguagaaugacgauuugaaucuuaguagucuaauuccaaaguccauuguucuuaaacacuuacuaccuagauuuuaugaaauaaucauauucucccuuuuuugacaagauucuuuuuuuuuuccuauuacccaauuuucaaagguucuguuaaguuuuuucuuuaauuucuuuuauugaaaucauugguaggcuuuauaaauacaguuuuugucagaccaucuucauccugcauacccuguccaucuuccucuccuuccucucucugcucuccucaccaccuuacucuaaucucuuuucuuucaguaucccuuugcugugacauuauauguguggagaauuuuugaguauauauggcaauauguaucuuugugcaaucuuaagguccacaaaguaagagaacauuuauuuagucuggcuuaauauggucuucuuacuguuuguggucugucgcacuuuccuguucgucccucggucuucugguguaguuuuuguuuuccuacaaccuuacguggccuaaucuuuugcguguguacaggccuuucacauuaucuucgguagguuggcuuaguagucauuaauugccuugcuuuauguucaucaugagaaggucuucaauuaggaagaauagcuuuccuggauauaauaaucugagcucgaaguuauuggcucucagaacuugaaaguacccuguuuccugccuucuuggcuuuuagaggauuugcucaugaguuugucauucugacggaucuccuuuuaucugugacucguaguucucucuugcagcuuuuauuauuccuggcucucugugcucaguaauuuaacugcagcaugccauggagguguuccuuucucuugugugguauucuaaaugucuucucuguaugggguuggcauuucuguuaggauuuuauuuucugugccuucaaaaugaauuucuuuugucuuuuuucauacuguguagauaauggucuuuucaugguguaucauagacgauguguguucauucuuacuauuuuuuccauucauuuucugacuguucugauuugucuauuuuguucuaaagcccuuguacucugucuucacaagaucuguuggaggggcuuuccagcaagcuuuugguuggauuuauugacguuuuuauuuggguugaguuuuuuucaguauuuuuaugcauugaaucguucuuucaugcucuguauugacuugauuucagucuacucuuuauauucucuuugagcuuauuuggaagcuuuuucacauugucuuuuaacuucauugaauguuuuuguuucacugauuuuguuuuguuuuguuuuuuauuuauuauuuuauuuacaguccagccauuguccccccuucuuuuuccccccucccacaguuccucaucccauucuuccuucccccugccuccuucccugccaggccucuucucucccuggggccucucagaacggggcgugggggggguguuagugggguagaggguggggggagcuuagaccaggccaugguaugcuuccugguuaguggcuaguggcucagugucuaggagcucccagggguccugguuaguugagauugcuggucuuccuauggggaugccauccucuucagcuucucccguccuuccccuaaucaacccugacuucagacccauggcuagguguaaguaucuauugguuggguguguauacaauguacaccauagcaucaguaauagugugccuccaugagauggaucccuaguuggcccgucauuggacugccuuucccucagucucuucuccauuuuugucccaguaguucuuuuagacaggaacacuucugggucagaaauguugacugugggacggcaaccccaccauuccacuugagguacugucuaucuacuggagguggacucuuugaguucccucuccccacuguugggcauuucaucuaaggacccugauacuuucuagaggguccccccacuucacugaaugcuuuugauagucauucuuuugcaucuuuugucuuagaguucauucuaacucccuugcauugggacccauugcuauggaguugauaguuuugaagauaucuuucuuugauuguuugcauuucggcauaggauuuaugcaaggucauuggcuugaucauacuguuucaguugaaguauuugcaguggucaaguaggucaaguggacaguuggauuaagcuguggucuuuguuuguuuguuuguuuguuugugccauuccuucccaccaagcuuuugcugagggagcagcuacugucuccagcauuacucuuaggcuagaauaugaacuauagaugcacucucaacugauggauaggcuuacagugaaaaauacaguaauaucaauaaaaaauaaccccuuuuaacuccaauaauuuugcagaauaggaugcauuguauacuaagauauuagucacuuagaguuggaaugaaaaguaaucuucugagugagacuggugauuaacacagaagagugaacaaugaaggaauuggagaugggguagcuucaauuaaagcaggaaugaaaacagaaagggcugaagaaacacacauaguucaagcaaucccagugucaggcugacaggacguuucaccagccuugggcugacugugccccugggagccuuucucuucaucguggcugcuccugcugcucuggacacuacuucucuuucuccuuccucuuuccuuucuuguguguguguauuuguucaccuuucuauguaucuacuuguguauguuacagauuugugcacaugugugugugugugugugugugugugugugagugagugagugagagaggggggagagagagagagagagagagggagagagagagagagagaaugagaauagaggccagaaaucaaugcugucauucuuagcuacuauucaccuuauuaguuuuuaacaauugaaauuggucauugacaauuucauaauacauacauauauauauguacauauauguaugaaaauuacauucucauugcuuuuuuuuuuuugccucacuuucucucccauuccugcuaacaucccaguugcccaagaaucuuuuuccuacauucaugauuuuuuguuuuauuuugugauccauuaaguuuaagcagggccaucuuuguacccuguaccaucuuugaguuugaagcacugguuggaacuugguagguguauaaguagguacacaaucaaacucucucucccacuaauucagcggggaggaauuggaccccacgaguuaugacugcguguugacaaggccggggcaggcccagugaaucugcuuauuccucuaaagccauuuguguauguucucuugaugacucuuugcagucacgugcugcaugccaugacgucacuuuaguauauacagguauuuucucuaugugcucacaucccugagugcacgaugguauaugucugaacuaacacuuccauguguguaaguaauuauccgaucucuacacuggcccaugcuugcuucucuauuugggcuggggcuuucuggggauagaaguggcuuugugauucuguuuccuggguuagcugauccuucuguuguuugccuugcaucuggaggcugcuuugugggcauuguuuaaaguucuugauacuauacauccuacuacuugggaacuaguaagacuuacucuaguccaugauccagacccugugucuaccacuuagaauacugugugcuccucaucaaaguuuccccaacagccacccccuguuaggaguguucugcguucuaggacugaugauaguucccuuacaccuguucugggugaugcagagaagauguuuaccugucgaucugcccaagcugcuaucucagcauaggucuuuuuaaaugacuuguaugugcuacagccaaauacugagaaauaugaauguggaauaugggucuucacaucucugucucguugaacuguaaacuucucaaugauaagucugguauugccuguacuuucaguguuugccuuauuuuuuguuuugucuuuggacuuggccccugacucugucugaggauuugcacagaugcucuucacauuggcuuuacagaugccugccugccuucccuuccuuuucugccuuauaaauuaauaaccuugaacugagaguagggcuaccugaaacucuucuuuguccuaagcugagcuucucauucucucugguuuuucucagucuuccuuuagcaguagaguaugccccaguugggccuugaguauuuuuagaaucaguuguagacauuccugggcugacuauucaguguuucuuucuucucugcggaagcuagugcuugccugucaucacuccccucacacgacagaggcucucacagucccugcuuuauguccugugaacuuaacagucugcauggacuugucaccuacugucuuccauauugcuagguuuuguugguuuuaauguuacaucaguguuuuaguugaacaaaugagcacugaacucuaggcauaccuucucaaacguaggcauggugguacuagauuauaaguguagcugucugcucauaaaaccaaaagcuuuuagcagauuugucauuugcuuggcaaaaaaagacuuuuugaaaaauguuuuuaaaaagcaaauuguacuuaaacaacuucuguauugcauuuaauaagcaucuugcuuuauuauauuuuauuuugaaauuuucaauuucagaagaaaaauuucuguacaguacauugaaaguagugauucagaggaaaucgagacaagcgaacugccccagaaaaugaaagguaauaugauuugauuugacacucugucguguauucuaauauucugaugugcccauuugauauuuuuguuuuauuuuaggcaagcugaaaaauguacaguuaaauacuaaaaguagaguaaaagguaaguacauauuaccccuucucagacuuuuauaaucugcauguaaagauuauuaaaauaaaaccucaucaauugacaucuuaaucggucgacuuuagcaauaauuaucaaaugcagcugcuuuugaacucuuuccugcauuugaccuucucaugaacuuaccauauguuuuagauaaauuaaauaaugcaaacucaaugaauaauuucaauuaaaaaaucuaggauagaaaauuuaaguaaacuuuaagcaaaagucauuuucuguuacuuauaaaauaacuugaaucaaacuuuguauuuuuacauacauauacacccccuccagcccagcccacccccacccaccaacacacacaguagugaacagauuuggaguaucuucuuggcagcauucacauuaugcacauauuaaagaaugaauacuguugauuuccuucaucuuugaaacacgcuuuauaucccuguuucaaaucguccugucuuucuguuagcugagaauguggauuauguuuagacaauagcuccucacuuaccuaugauaccaacagcuucacacugggggagacgcacuccaucuucugcuuucacuucguuuaagugaagucauaguugguucaugagugcaucauuucucugagcuauagagguauacuuaaugucauaagugccaauguuguuuaccaaacacuauuuuuauuuaauaauauaacgucucaaguuacagaauauagaaaguuccuaaggaggcacagugaagaauuuuaaugauuuauuagugauuuuucuuaucaggaucaucuaagguuaaggaagauucaaaauuugcacuuacuuuuuuugccucugcaacacaaaggaaaauguugaaaaaaggucaguacgucuaguuuucuacucccccuccuauuuguaaugaaaagaauuuaaauaacaauaucaaauauacuguacuggcuaguuuugugucaacuugacacagcuggaguuaucacagagaaaggagcuuccguugaggaaauaccuccaugagauccaacuguaaggcauuuucucgguuagugaucaagggggaauggccccuugugggugggaccaucucugggcugcuaaucuugguucuauaagagagcaggcugagcaagccaguggaagcaagccaguaaagaacaucccuccauggccucugcaucagcuccugcuuucugaccugcuugaguuccaguccugacuuccuuuggugaugaacagcaguauggaaguguaagccaaauaaacccuuuccuccccaacuugcuucuuggucaugauguuugugcaggaauagaaacccugauuaauagaaacccugauauacuaugaaaaauuuggaaaauauugaaaaggaagaaagcugguguagcuuucuccaugccuuucucacaguauuuguuuuagaaagggucaagguguaaugggaagagugcucucucaaauccaagagcuauuuauucuuguaaaucaacaaagucauuuaugauugguucaaagcuugacuuggauaaauuuaaauaaagauauaguuuuuacugggauuaagauuaacuuuucuuaaugucauaguugcuucugaguaugauggaaagagauugaauuaaggauucaaucugagagaauuguauuucugugcuauggucuccauuuguagcacaagaucuuauuucgauggcuaauugaguagucacaagggaugcaaugaauaauuaagagacuuuagauguuaaaugauacaaagacaauaaagcaguaugaugugcauaaaaguagaauugaauguagccuguuuaaaaaugauauauuuuggaacuggguggcuuaggggcuaagagcacacaccacucuucuagaggcuccagauucauuuccccgcagcugacuuggauagcucacaugcuuguaaucccaacucuagggcauccaacuacuucuagccucuguaggcacucacacagacacagacacauaucaucugcacacagauaauuaaaaaauaaauuaaauauauuuaacuggagagguaaaauccaccuugaguauacacagucccauuccauggacugucagcacuugaagaaguuagcugagcaccaacaugaauuucuguguacuucuuuuuuuuuaauuagguauuuuccucguuuacauuuucaaugcuaucccaaagguuccccauacccacccccccccauguggauguggauauugugugugaccagcugcuuaaugcucuuggugcugugauuuuuccauccacuacaggcuauguucucaguuugugagccaaagucaauccuugccuuuacuuuuuaaacuugcucuugucagguauuuugacacaaagacuaacaggaaauugguauugagcaauggcacuguugcugugauaagccuaacagugguuuguaagcauuuagcauugguuugcagguagaaugugaaagauuuuagagcuguaggcuguagucuguagaugcccuauagacaagagacuauugggcuguucuggugggaauuuggaagaucagaaugcugagagaaauguggauaguagggacuuagcuugucagguuucaggaaacuuucuugggcuaggagccuauuauguuuuaaucuggcaaaaaaccugcugaauucuguguaugucuugaucauuugagugguccugaauuaaaaagcguugguugacuaguuguuuagcacaggaauuucaacacaggauagcacuuagucuauguuaugguuacuucuuacugcucuuagccauggugacagagaaaccugcaaguagggcaggaagcuaaggcaaacacacagcuugggaaguaugagaguuuacagcugagucaaguagaccuggcuaucuuggaacucaggucuguagaccaggauagucuugaacucacaaaaaucugccugccucugcuuucugugugcugggauuaaaggcaaauaccagcauucgcauccccaccuucagcccauaaaauucuucuggauuucuuucuguguagaugaugauugcugagaccuuauugagauguauaguucaggauuuuaaaaagcaggucuacgaacaagucugucaaugucuuguucuuuuaggcaugucuaugauggagugcucagaggcaugugacacuggagagaggacaagagcaacacugaucaucuguccacucucugugcucagcaacuggauuguaagucuaaagccuuucagcuuaaagugggauguuaacauguuugucuguaagaacauggugcuauacguauauguggcauucauuuucauauauguuaaacgaauuauauuuguugaaguaauuaccuuuuuuuugaaggcuuauuugauuaacuuaauugcugacauaggguuuaauuuguacuucugcuucugccauuuuuguuucccccaagaggaccauauuucuaauuuaacacucccauucuacugaguuugggaauuaugagaauuccacugauagcaacuucuauaacuguuuauaacaucacaugugcuugcuugguuuguccuucauuucuucucauagauuuuucucacuuaauuguuaccauucucaguuucuaagugaccaaauugaaacagagagguuaauuuacuugauuagggccauccagccaagagagagcuugaauguggucaccaaccuuugacccuguaguucuuguuguaagguaaccaacuagaaaagcgugucucccccccccccccccccccccccccccgcgaauuguuuuuccuuuuugaagaacauugcauucuuguauguucuguguaaggaacagccugcuucuaugucccuucuaauuugaaccucaagcuuuguuuuauaaugaaauauuauuuuggaagcauuuaaacauaaagaccacuggauguguccuuucauucuugcugccuucaaggauagcuguccccuccugaucugcccucucucaggaagaggaaguccugcucuuuguaaaacuguugccuuaauuuuuaugucuuauuccauuuuucccauuuccuuuuucgauuuucuccuuucucuuaguuauucagucugaucccacuggguuucuucaugaaaaauauucaguugcucauuuuaaauacgucauuuaauuagguuucccacugaaauuguugcucuuauguauuccgucccugguguagcccuucgcugauaauuucucuuaagcucuuacuccccgaauuggcuucuguuuucagcugucagaauugcauugggagagacaccuaguaacuuguuauacccacuguccucuuguugacucuauauucaucuuuuuuuuuuucuugauuuuuuuuuuuuuacuguuuuuaggcauuggcuuaaugcguuucuucuucauguuauuuuuuuuuccucucuaucaaggggcauagaucuuuaguagacugcuugcccaguguggccagcaccauaaauaaaaaauaaaugaagaaagaauaaauaaauaaauacaugaugaauaaauauguuuagauaaauauaaaaaaaugaauaaucaguauuuuacuauagcuuuauauuuaaaaacuuugaguaauauaaacuuagaaaaggaaaccuuggcaaauaaaauuaugcgaaacuguaaaggcauagugggcauuugagcacacagagcacugguucucagcuuccuaaugcuaugaccacagcaguaccuuauguuguagugaccccaaccauaaaguuauuuuuguuccuacguuauagcuauaauuuugcuacuguuaugaaucguaauguaaauaucugugcuucucauuggucgugggcaaccccucugaaaggguccuucaguccccaaaggggucaagauccauuaguucagaaccguuguugcagaggcucaugguaaacagugcuucauucucccaacaacauacaguuucugccuuccuuguuaaucaccuaccauuccuaggagaagauuagaaaguuaaaaauaacaaagaucucucacuuuaaaaaaaaaaucuauauuuuuacugaguguguguguguguguguguguguucauggacuugaggguguucauaaagaccaugaaaggguauuuuauccucuggaacuggaguuacagacuaauguuaacuauuguguguauguugggaaccaaacucagguccacagcaagaacagcaaguugcucuuaacuugugagccauugcuccagcaucccuuuuuuguuugcaaguaagaaaaaaaaucaaauuaaaggaaaagauuuuaaauaccaguuacacaaacaccauuaauuaguuuuagauauuuagacaaaugauuuaagugcauuccaaagcacuucuuuuguccucuguugauagacuacauggcacacacaguguagagaccuguuguuccuuagccagaaacguugacuuucuuucauucuaugccuuauccuucaggaaauagccauuguuccauuucauugccacccauuugauucagauuuuuuaauuaaaaauuucuccuuaacuggauuucuucucuaccagacuacuuaaaaauucuguuauuuuuacuucagauuuugcucuaccuuugcauuuuuugucuuuucuauuuuaugcgcguuuccuuuucagucuacuguaaucuagugcuuauucucauuugcuauggaaacuccaugcccuccagguguccccuccucuggggaguauuuauuuucauccuuggggucacuguauggagagugugugugagcuacaggugagcacucaccgcuuuacuacccuagcucuuucuacuccuugucuucuguggguguucaugugacuuuucaucuucucucugugucuugggacucuggcuaccacugcauugcuuuugcuuugcuucuuguucauagaaaauuacucucaggagcuugagaguuuugaggccaucuugguuacauagugaucuuaaaagaaaaacccaguuaauuaugaaaagacccaggauuaguaaagugcaacacccuguggaauaaccuaacuuuaucccagcucugccauucauuccuccauuaauugcauagagugauucaguguuggcaggcuggaucccuaaccacuguguugucucacuguacauguucucguuaaaacaaauaucuuuaaagacuuauuccgagcaguauauauugucuauuuauaacaaauauguauauauauuccucuuccuugcaccugaaugccagugcuuauguuagaccuaguggggaaacccucacccaauuccugauucagcgugcacccaaaaaaucaggaaggaccaucucuugauguaauuacaugaggacguuuaaugauggagcuccggaccaacaugcaucccacacaggagauaacgggaugucggccccgaggcucgaaagcuagggguuuuuaaugggauaaggggcuuagggcuguggaauucagcauagugacacacuauuggcuuauuuaaacauuaacagaaagauuacauguuagcaaaagggcaucaggacuuuguuccugugggcugggggcuuaucuuguucacauagcaaccaguugauguaugacuuuacccggcgucaaggggcaguagacagaggggagguuccggccaggugguguugacccagacaagauagcccugcuuguacaaucaagcuguucuuaggaaugucuuaacaacagcccugucuguucugcuuuguucucggccccaggccucggcucauagacaacucuuuuacaugaaucacaauauuuuuacaaaaucucauuuucuuucacuuacacucugugguguauucuaaauagccuguaguaguggcucucaaccuauggauuguguuggagaccauacuguuagaagggcaagcccuucacagccucccacccuauaaaagccaauuggccuuguacuauggagccagucguaaccuccuccucccuguuccccgccugucagccaagaauauccuuguacucuccuucaguguuauucauaauaaagugccuuucaauuccaaggcccuguagcugacuacuuaaaauucaacuaagaaguuaccuauucaguacuaauuagcaguauaaagucagagccuacagcucagggcuauucugcuaguuguuuacugcgacagaaaggacagucuuauccagauaugguuuaccauaagaaaaguuaggaaaucccacggagauggguuucuucuuuaacccuaagaauucaggcagaacuauugagcauaaauaaauuuuaugccucaggccagccuuuucuuuuuuauuaacaacagagaggagauguaaccuccccuccccagccugaaaccuguuugcucagggguggagcuugccgcucaaucauucugccacgcccacugcuggagccugccgcuuugcaucacccugcuacuggaccccaagaugauuuggugggaaucgggccccuuccccuccuucauaacugugugucggaauaguaaaauugagcuuugaucagaaugacugucuuagcugcaucuuucucucgcccgccuagcuccuucuucucuuccagguuuccaagaugccuuuccagacuagaacccagacaugugagcugcuggccggacacaacacucuaucuccaaagauacuuauauuacaauccauaacaguagcaacauuucaguuaugaaguagcaacaaaaauaauuuuaugguugggguccucauaacaggaagagcuacauuaaaagguuauagcauuaggaagguugagagccacugguuuauagugaccaaagaggacaaauauccucuuucuuacuucuuucuuccucuuuagguaaauuuuucuauaccuuuaucacucaguucuuccacacagccaucugaaauauaaggacaucacugucuuaucucuuuuccucaugucccauaguuaacaucccaagcccugggcuucccguuugcuaccauaguuuucucauaguuguuuaucccauuccgucccaucuucugcucgucugguuguacaguugcaguucucaccuaagaaucuaccagcuuuucuucauagcaucuucuccuuagucugaucuuuuucucccuugcucaaaaucaucuaagucuguuguuuacaaagaaacuugauuuuuuuuuucuuaaaaaugaagacaugcuagauauacuuguaaucccagugcuugagagccagaggcaggaagaugacgaguuugagacuguauugggauaaauggggaugaugaguuugagccucagagugguaacucaauagaaaaaacaagaaauggccgcuuauugguaggauaggccaaauauauauaaugugcuuuguauguuuguuaguuuuaugaugugacacaaaucaguaauuauaguuauuauacuuuaguuuuaguaaaguuaacaugguaaacuugauacucaucugcuuccuauuaaaauauuuguuacuuucuuuuaggaccaguuuggacaacauguaaaaucagaagugcacuugaauuuuuauguuuauuaugguccugaucguauuagagauucagccuggcuuucaaaacaggauauuauuuugacuacuuacaauauuuuaacucaugauuauggaguaaguaugcauauaccuagaccuuuaaauuauuuauuauuuuucaauugucugccugucuugucugucugucugucugucugucuguguggugagcacuagugccuuuggaggucccuauaguugggauuacagguauuugugcgucacaugggguggguacugagaacagaauuucagucuucugcaagagcaauaagcucuccuagccacuuaauuauucuccagcccuacggagagauuguuuaagguugaauuuaauugcuauuuuucauguuucuaaauuacucuaaaauucaccuguuuacuuuuugacuuugaaaauacuaaagaaugucuauaaaauagcauguugcaaaaaagagcuuuguaccuucuugagauaauaauucggaaacaguuuucauuuagaacguuuucaauuaaaauuuuaaauuuggauuuucucuaggguucaucaucaucuguacacaaacuucuucuugauguucuggaaaauuuuuuuuuuuugcuuuuuguuuuuuaaugacuugauuaguuuuacagcuugaaaauaaacuuucugcuuauaguaguuauuaauuaggcucucaguucuuucaugagccuguuauuuuccuuaagaauucaaguuauuuuguaaauacuauaguuaaaaaucucaauguucuagaaagaauguuacuauuuguaaaagaaagcaagguuguaaugacaauuucuucauaagggauggcuuuucugucacguuucaaucugaugcaaaaugguucacuguauuauguaugacuuagucaacuucuuagcuugguaaagcagcuagugcuucuuaguggcacuuuguguaucauauuuaguauuuuguguuuuuagcucuaaaauagaaguaauauuaaaggcuuguaaguguucacuaauuuaaucuuuggaauacauaacagugccaggaaccuuguaagaguugguaauaauaaucaaaacuauuauuauguaccaaacacuuauuacuguguuauuuuacugugcuuugugaauucauaugaaaucucuauugcagacuaaagaugauaguccauugcauagcaucaagugguuaagggugauccuggaugaaggccaugccauucgaaauccaaacgcucagcagacaaaagcuguacuugaguuagaggcagaaagaagauggguauugacagguaauuauagcauucaacuuuauuuuuucuuauuuuaaauuugucuguucacauguauguggguauguaugugugagugugugugcagguacacauccaagugugcgugcauucacggaggaacuugaugucaguaucagcaucuuuuuggauucuucuuuaccuuuucacugaggugggaucucagcugaacccacaguucacagucuugcuagguuagcuauccagcuggcuucuauauuccaagcacuggcauugcaggcaggcugccauacacacucagaauuuauguggauuuuguggauccaacuucagucccucauuguggcaagcacuuuaucuacugaacuaacucccagauaucauuuuuugguuaguuuuuaaauuagugucuaaacauuauacauauuaauggacuucagugagcuauggaagcucguuguaucguucucaaacuaggguaauuguaucuguuuccucauuuauuuuguagcaaaagcauucaaaauauuuucaucuagcuucuagaauauagauaguacauuguuuuuuuuuuuaguugccuuacugugcaguagaaacaacagagcuuacuuuccuccgugcuguaucuuaguaacauuugaacaaucuuaucccucuuuuuuccuccaccacucuucagucuccagcgaccuccagucuucuuuugauuucuaaguagccaauucagaaauuacgugugugugugugugugugugugugugugugugugugugaaaguguacacaugugcuccauacuauauauauguggauguaagaggacaacuuacaguuguauuuuuccuacuauguguaaucugaguuuggucuucaggcuucacagcaagguucuugcuuugagccaucuugucagccauauaauuccauaugaauuuuaauauaauuuuucuaguucuuuuuuauguuuuuuuaauuggguauuuauuucauuuacauuuccaaugcuaucccaaaagucccacacaugcucccccaccaacucccccacccacccacucccacuucuuggcccagccauuucccuguacugaggcauauaaaguuugcacaaccaaugggccucucuuuccacugauggccgacaaggccaccuucugauucauaugcagcuagagacacgagcuggggggggggggguuacugguuaguucauauuguugauccaccuauaggguugcagaucccuuuagcuccuuggguacuuuaucuagcuccuccauugggggcccugugauccauccaauagcugacugugagcauccacugcuguguuugcuaggccccggcauagucucacaagagacagccauauguggguccuuucagcaaaaucuugcuaguguauacaauggugucagcauuuggaaacugauuaugggauggauccccggauauggcagucucuagaugguccauccuuucaucucagcuccaaacuuugucucuguaacuccuuccauggguguuuuguucccaauucuaagaaggggcacagugaccacacuuuggucuuuguucuucuugaguuucauacguuuagcaaauuguaucuuauaucuuggguaucuuaaguuucugggcuaauaucuacuuaucagugaguacauauugugugaguuccuuugugauuggguuaccucacucagaaugaugcccuccagguccauccauuugccuagggauuucauaaauucauucuuuuuaauagcugaguaguacuccauuguguaaauguaccacauuuucuguauccauuccucuguugaggggcaucuggguucuuuccagcuucuggcuauuauaaauaaggcugcuaugaacauaguggagcauguguccuucuuaccgguugggccaucuucuggauauaugcccaggggagguauugugggauccuccgguaguacuauguccaauuuucugagaaaccgccagacugauuuccagagugguuguacaagccugcaaucccaccaacaauggaggaguguuccucuuucuccacauccucgccagcaucugcuguuaccugaauuuuugaucuuagccauucugacuggugugagguggaaucucaggauuguuuugauuugcauuucccugaugauuaaggauguugaacauuuuuucaggugcuucucagccauucgguauuccucagaugagaauucuuuguucagcucugagccccauuuuuuaaugggguuauuugauuuucuggaguccaccuucuugaguucuuuauauauauuggauauuaguccccuaugugauuuaggauagguaaagauccuuucccaaucuguugguggccuuuuugucuuauugauggugucuuuugccuugcagaagcuuugcaauuuuaugaggucccauuugucgauucucgaucuuacagcacaaaccauugcuguucuauucaggaauuuuuccccuguacccauaucuucgaggcuuuucccuacuuucuccucuauaaguuucagugucucugguuuuauguggaguuccuuaauccacuuagauuugaccuuaguacaaagagauaguucuuuaagaaugccauuggcaucuugauaaggauugauuuugauuuguagaucauuuugcacaguaugaacaugucuuacggugguuuuacugcugugaacagacaccgugaccaaagaaacucuuauaaggacaacacuuaauugggucuggcuuacagguuuagaguuucaguccauuauuaucaaagcaggagcauagcagugucuaggcaggcaugaugcaggaagaacugagaguucuacaucuucaccagaagacacauuagaaaagacugacucccaggcaguuaggacgaggguguuaaagcccaugcccacagugucacaccuacuccaacaaggccacaccuccaaauagggccacucucugagccaagcguauauaaaccaccacaggauauuuuacaguauuuuaucucuuuggcaugagucuuuaauuauaucuauuucuuuaaguuaaacaaauggccaucuuuuuccuauaaauugaaacauauuuuuguauuccuucauuguauauaacuucagguuaucuaauccuuaacaauuauuugacuuagaacuguguaucuauuuguuacuaaaucauuuuacaggccauuaaggaguuauauuccauuaucuaauauaagaaccuuccuaagaugucuuggucauaucuuggaaugguuucuccccaaggccagaugggugcaugaccuagacaggcauggagagcagccuguccaggugauggugcugcuugcaggauggcaucauuuuggcaugacguaccacugagcuagugcaggcagguuucuuguuguuuuuguuuguuugguuuuucuuuuucuuuucuuuuuuuuuuuuggugguuguucuuugguuugguuuuuuacacacuugcuaaauuuaccaaguagcauuuccaagcauucuacagcacaaaccugggggugcuuuuuguuuuuuuuccccccauuggagaaaaagguuguuguuuuguuuuguuuuuucacaauauuucuggucaugcuuucaccuucuccggccccuuccagcuccuuuccaccuccccacaguacugauucuuccaauccaugaacaagugaugccuuuuuuuuuuuuuauguugucaguuucuuucauugaugucuuaauaguuuucacuguaauuaucuuuuaccuuguuacauuccugagauuacugaugcuggcugcugugucugucuuuaugcagucucugggcuugcauggagucaaauucaaaguugccagauacaaaaucaacauccaaaagucuguaccauuuuuauguaccaguggugaucacaauuuugcaaaauagagcuauuguugacuauuugcuguucaagaauaaucuuggugucaacaguuuccuggcuuguguugcuguacugugucagacuuuucugauacuauuaauggucaaauuaaugauuugcauaaagugauaugcaaaaucucucaggugaccuuugaaugacuaucauugauaugaugguuuucccauuucuuugguccucuauuagcuauucuuuuaaccaucuuauugcuugccuaaccauagaggcaauacauucuauuaugaccuuuauacagacacucuuuugucuuuacaaacugagaaaugggaagauguaggggcuaugagugaucaucgauaaguguuggagaaagcagaauuguuuuuuuuuguuuguuuguuuguuuuugcuguuguuguuuugguuuuguuuuuguuuuuucgagacaggguuucucuguauagucccagcuguccuggaacucacucuggagaccaggcuggccucgaacucagaaauucgccugccucugccucccaagugcugggaucaaaggcgugcgccaccacacccggcaaaagcagaauuguuaaucagcggaguugucuucucaggaggacaugcauacagaaggcugggagaggacauaguuagugacuugguggggacaagccuuacccaaauccccagaauauuuuuccuuagcuuuguuucucagugaguaagaauccauccuuauugucacauguaguuuauauccugcugagcugucucugucagugaucacaccagauccuaucccuuuaaagccagagggucaauuuuuauggucacauguacuuuucaaaagaguuucaguguagucaugccuugagguuuauugugcacauggaauugggauggcuguuaccuagaaaauguuuuccccaaaauuauacuguauuuaaauaugucuaaaauaaacuggcuagugccagacgcuagaaauuuugacuuaacacugccuaugucaugcugaccagaauuucauucuuaccucccccauauuggauggcuuuuuugcuggccaugacauuuguagcacagccuccugcaauauuguccaauagcaaauuaucugcucagugugucaaacauuugccauguuaaguguaugagaaccuuaguuagccugggccuaguacaguguccaguuucagcugucgcuugucucauugcaccagguuacagaaccgucacucaguggaagaguucuugccuagcauguaugaggcauagauuugauucccuagcaccacaacacacaucuauuuuuaagaguuacaaugguuuccuguuuuaaauauuuguuuuguuuuagguacuccuauccagaauucuuuaaaggacuuguggucucuucuguccuucuuaaaacuuaagccauuuauugauagagaguggugguauaggaucauacagcguccugucacuacaggagaugagggaggacuuagguaaguaaguuuaugaggugauccauuagugacgauuaauggaaccuaauuucacggucuuuacuguuuucacuuagcguuagucuccaaagcauaagcuuccgugucacugacucugaaaaccuagugacuuguguucggggauccaagcuuuuuguuugugcaucuuuucuguauuuugcaaaaauuaaaggaaaggcagagcuuuauggucacuguguguagcuguuaccccuaaaguaacagguuccacaaugauaugaaaagcuauauccuuugaugauucacuaugcacuauauuuugauaacguauauaacuuuuauagaggcauuugauaugguguagaguacacaguggacagugaucucaaaagguuuaaugaacauuucacgugguugauuuuggugggcacagauaaauggugacaaaaggauugaaaacauugauuuugccacacacuugggugcuguaguuuuagagcagugauugucuaaauagguuugggacccuaagugggccauacggucauuauagaaguaucagcauggaaaaggaaacagaaacguaauggagauggaaaaaaaguaccagcguauguucuccugugaggaugcauauguauauauacugagauacuuacuucucuuauggcuagauacaguaaaugagcuucccauugugaguucaaguggacaugauuuaaaguauaagccauuauucuuaguagucaaaacuggucacaugauuccuaagaaauauuuuugcccuauuuugucuauguuaaaaauuguuuaguuuauuauuauuggcaauaauaacugauaagcaucauuuaaaaaaaauugacauugagggaaaaaaguggaaagauuacagaaccaagaaaggcauuuuuuuccucuucugaguuugcaugauuuacuuuucaguuauucauuaacuuauuugauuuucauauuauaccuuuacuuuucacauuacauuacaugggacuuuaaaaaauuuauuuauguauuuacaucucaaaugcugccuccuuccugacucccccuccccccuccccccaggauuccucuccccaucccucauccccuuugccuuggguugaaggccccaaaggugauagcaaccccaugggauuucuuuaacucaagagaagaggauuauguuagaguacagaagauaagcuuuuacucauaucuguacucuuuuuaaauaaaguaccuuaaacucacuaagcuucuuaguaagaacucagauauuguguauggacugauaaguugauaagaaggcauuugagaaaaaaguaccaauguugacaacacagccagaaaagcugugaaaaagcaucauugguauuguauuuagguguaauuucguuacuuuuaguaauaguuuuuuauuuacagaauauuuuugugacuauaaaaaccuaaauaaaagauuuuuuuaaaaacuuucaauuuaguaagauuauaaaucaacaaacuuguuuuuuguuccuuauuguucaguauauuuaaaaauaguuauauaguuacuuguuuuacuuugucuaggcguuuacaguccuuaauaaaaaauaucacgcuuagaagaacaaagacaagcaaaauuaaagggaaaccuguuuuggaguugccagaaaggaaaguauuuauucagcacauuacucugucagaagaagagagaaagauuuaucagucuguuaaaaaugaaggcaaagcugccauuggaagguauggaaaccgaaugccacuuaacauuguauggcucugucuacuuuagcugacuuacagauuuucaacauuuuagcuaaaagucugaaauauauugaaaacuguuuugugaccuauacuuuaauauuuucuccuucuuccuuccuuucuuuuuuuuuuuccuuuucucuuuguuucuuuguuucuuuccuuccuucuucuuucuuucuuucuuucuuucuuucuuucuuucuuucuuucuuccuuccuuccuuccuuccuuccuuccuuccuuccuuccuuucuuucuuucuuucuuucuuucuuucuuucuuucuuucuuucucuuuuuaaaaguuaguugaaaugaaugaaacaagaguacaauucaucagcuaaguaauuucuuggcccugcaaaaaauaaaagcuuauuuaaaacauugauuucagaggucagcgggccuugcuugcuuccauucugagugucaugugaggaugcacacagggcaggaggcaugcauccaacuugggcuuuuauauucauuuucucuuuugacauauuccugaaucacaaucuccuuugguuuuucucucuacaaaucaacuuuucagugagguauucccucacugucuuauaaaacagcguuagaacuuccugaauccuuccuucugcuucucccucccccauaaagcuuaauguuuuaaaauuuccugcuucauuuuauugaaaauauaaaacucauuuuagucauauaucccaguauauauguauguuagguucuuaguagucuugauuuuaauaguuugggaagaaauuucacuuagcacugcaacgauuuggaacuuggaagucuguuuuuuuguuuguuuguuugcuuguuuuuuaauuucucuuaugaaaucuguuuugugccaaccucauuaaaguuuguauugcuaugaagagucuccaauuuacaguccucuuuugucuuugccucauucuggucccuguagacauucauagccuaacuauucgccuucugguuccuaagucuuuaauugucuucauuuucuguucuuagauuucuacauuuuguuguaagacaggcugacguauuucuuccauguuuguaauacuaccuagaauaccaucauacuguaaagauguuuuucaaagaugguugcgcguuuacuuuguuuuccauaacuucucaccaucuuacucuguagaugcccuggccucacggcucacugacuggugaaaaagaacaacaaaugagucagaaagauauuuagaauuguguaauguggugagguuaagagcccugagcaaguuuaguuuuagacaaggcacaugcugaguaaaagcaugucuaauuguuaaagaaauuuaaccccaguaaagagaaaccucuugaucuauauugaaacaacuggaaagauacucuaaagggcaggaccccaccuauccaauguucugucuuaauuaaagucaaauugauuuaaaaacagagauucugagccaggcgaugguggcgcacaccuuuaaucccagaacuugggaggcagaggcaggcggauuucugaguucaaggucagccuagucuacaaagagaguuccaggacagucagggcuauacagacaaacccugucucaaaaaaaacaaacaaacaacaacaacaacaacaacaaaaacaaaaacagagauucugaauucagagugccacucagguauucccugcaugggaacaccaccuagggaaguguuucucuguuauccuggaaggcacccagaagccaauguaauggggcuaagcuacuucuuaugauggcagcagaauuuggcacguaguauuguagaggcaucaauuuuuuuaaagaguuauuuuauuuauuuauuuuuguuuuuguuuuuuguuguuguuguuguuguuuuuuuuuuuuuuuuuuuuuuuuuuuugagacaagguuucucuguguagcccuggcuguccuggaccucacucuguaaaccaggcuggccuugaacucagaaauccaccugccucugccucccaagugcugggauuaaaggcaugcaccacgacugcccagcccacuaauuuuuauuuuuuaaagauuuauuuauuuauuuuauguaugugaguacacuguagcucauuuggguuaacucugcucgcucaguuccugcuugcuuuggcccaaagauuuauucauuauuauaaauaaguacacucuaguugucuucagaugugccagaagagggcaucagaucucacuacaggugguugugagccaccaugugguugcugggauuuugcccagaggcacugauuuuuagcaaagaaagacacaagagugagagccucaagaagucuugucaaagguaccagaaagucacugaggucaaaacauguagcagaauuagauucucgacaaggaugucagagagacuauugugaagguccaaguuagaauaauguuggagaugccaggacagugggaugucucuggaggaaagcaugguauacagaccccugaagcuccgugaguuacaagaggaaagaaccuggaggggcagggcugccugggcccuuugaagcuuagaacauuucaucauguuuaugugacugacuuggagccacaggauuuguuguuugcucggcuggguuuuggucuuuggucaaguuuuucuuugcuaugcuacuauuccucccuugguaaugggaaucuuuagucuaugcuauuauauguuugaauuaacucuauuuuuucauauuauaggggcuccugguuauuauauugcuuggguuucagaagaggcucuguacguuugaaauguuagaacuguugagacuacugggauuuuugaaguuggauugaaugcauuuugcauuaugagauggccacgagccuguggagauaagggaaagaucguggcuuaaaacuggaguauuugugcaucaggcugauaugagguggacuuuugaugauugauucugccaacuugacagaaucuaguguuaccgagcagacaagucuggaggguuucuagauuaggcuaauugaagacagaggacccacccugacuauggcaacacuacuuuauggguugggguccccacugagauaaaaagaaggaagcaaguugccuaucaguucucgucucacugccugcugacuggaugcagucucacugguggcucccguccuguagcccaccuacaccagaaagccuaguguuuguucucaacugggaagaaagugauagaacagagggaacguccgcuugcagaggugggcguaaaggaagaacaguuucuaacgugggaucaaaagcucugcauuagaccugucaugugaacauacgggauugacuuuacccgcuggagaggcagguauggaguucagugcucccaguuugacucuuaaguuucuguuauuugugagugaugagccugaguaaagucaccuaagagagugauuaaguuaaaaguaggucuauccgaaaagguacuagcguggcugguaaaacagugggaagccucuugccagcaugccauguggugggucccacaagcaguuuccuaaaccaacaagcugaaugccagucagauguagccaugcccgggagggaaugcagagugcugaggaagcugucuguuugaauuguguucucagggauguuauuguuaaaguaaccucuuucauagguaguagacuuauuaauacuuuauaagcauugauugaguauaauugaucuaaguauuuaaaugugcacauuaauggugucuuauuaaguaaguacaaugaacacuuuuuuuuuuuuuuaauuauuuuuuggauuaggaggcuaaggcacaggagacagaguuguuauuugaauuuuagcagguugguuucagaacguggaaguuuaucguguguauuauguugccuacuuuuuuacuuucuucacuauccaaaacacugccacugucacuacuaguauauauaagguuuauaaaguaauccaggucguguuguaauugcuuuguacacacuaacuucaugaguaguccucccagaugugguguguaacuguuauagcugaggacacaggcaggauuaggcugcuggccaagucugcauagcuaaauugacagaauguaccagucugacuuuaaaauuucugcuuuuccccaggagacuugauugcaucaucaacuugacguuucagauuggauauguaauuuuuggauuaauuauucuucucuuccacacugaguauuucuuugaaaaaaaaauaauagucaguuuugccuuucuauagccaauucuugucuucagacuuaaagagaaagcuuuuauuuuggcuuucugcuccagaggugucaacccaugguaguggaaacuacagaguggaacggagcaauaucaugauaaacaagaggcggacaagagagcaccggaaacaagugcucaagucagggcaagauccgucuauuccccaaaggcuuagaguuucuagaaccucaggcgucagucagugcuguagcuggagaccuggaguucagcgcaugaagcauuggagaguguuucauaaguaaaaaauagcaaggagccugaugugcacauccacgcccccacggaaguacagcaguuugaucagggccuuccuguugacuuucuggaagauauagauagcaccauuuaaaucuuucaauucuauguaucugcauccucccccucccccugacacccacacccuuuaaaaagaaaauguacuguuuuuguccuauuuuucuugucuuuuguuguuguuguucuauuuucuuucuguguuuuuaaaugucuucccacugcucuuuauugguauugauuuauuuaucauccuuuauaacuauuuuuuguuuucuuaguccuauguccuuucauaugguuuugucagugguuuuagugugugguggucugaaugaaaaugguccucauaggcucauaggaaguggcacuguggggagguuuggccuuauuggaauuggugugacauuguuggaggaagugugucagggggguugggcuuugagguuucagagguguguccaguguggcacucucuuacuguuuuccgguccggauguagaacucugagcuaccuggaggugcucacagucauaaauuuuaugcuuucugugguaacuuucuggugaguuuaauuucacugccuucuuugcucuuugcugguuauucaauguuugacuauuuugaguucuuuuuggacgagcuguuuguccagagucauguauagguccaggccaucaagaaauacuuaauuuucuuauuauucaugggagucaguauaauguaaauucuucuagguuuuauugguuuuuauauaacagagaucagaaacauaauuacuuacaaaauugauuauuauacaauaacacucccccuacuguguguguguuuugugaauauguguguauguguguguguguguauaaauuggauugaaaauugaagucaucaugcauacacccuauuucuguuuuuacagaagagauaugaauuuuccuuucaguauguauguaccacuuacuuugaagggccagcugaggucuguaggucaugcauauugacauuuuccuaggugacuuuuuuucuugguuucauuaaagaugagcuugcuuuuguuuuuguucuuguuuagagauguucauaaugucugacauuuuaucccuagguauuuuacugaagggacuguccuugcacacuaugcagaugucuugggucuucugcuuagauugcggcagauuuguugccauacccaucuucuuacaaacggaaugucuucaaguggccccuccaguaaggaaaugggauuaguucauaccauuguguuugcuaaauauuucaguuagaagacagguuuuuaugcaacuugaauuugaucuauuacuuugauauaccuuugcuguaagauuuuuuuaaaauuauauuuuuauucuguguguuuguauaugaauaucaugggugcauggauacaugugugggagaucagagcauaacuugcaagagucaguucuuucuguaccauguuaauucauguugucaagugugguggcagauguccuuagcugagccaucuugcuggcuccaagaauuuuuuaugaaugaaauggaaguaugauaccaauguagaagaauauucaaacugguuuuuucuuguaugcugcuaguguggcagauguuauuuuaugaggugcuuaagugagauggcuauuguaccuucauagguuuccuuagaauuccaaauuuauggcaugauuucugcaaauaccagaauaaagaugaaagacaauuaagcaaaauuuucuuauauaagauaaauuguucuagucacauuaccaaguuuguucugaaacuaauucugaagugucuuuuuuuccuaggaagugacacgccugaagagcugagaaagauguuaauagagaagaugaagauaauucugagcucugguucagaugaggaaugugcaaucugccuggauuccuuaacauuuccugugauaacccacugugcacacguguucuguaaaccuuguaucugucaggucauucacagugagcaggugaguuuguuguucaguauggacucaguguuugacggagugauuuaccuuucuuugguauaauaaaaacccagccacguuccagagaugauaagguguuccuuacuugaauuuaauaaugcaccuuuuaugguuaauaaucucaucauuguaguaagugguguauuuauuauaaauuaaauggcacgacuuuugggggacauuauuauuuagucaguaauucuaguucuaaauuucagauccuuguguucaaguaaauauauuaauagagagacaaugaauuuaaauuuuauuaauuuuauuuuuuuaauuuuuaaaaaguaaaaacgcaacauguuuaauuuagucuaguauauuuaaagcacuuauuaauauauuacuuucuuuucuuaaacuaaguuuaacaucggauggcauugcgcuuuuaccauccuaaugugacucaguugugucucagcgaucugcuugacacguacaacucauuacuguguugagugguguaggguaaacuagggcuagagucuucugugaaaaaagucugaaguugaaugauauguuaaacagucugucggcuaaugcaaauucaaagucuuuuuaaauguucuacacucuacaugugggaaaugcacacauugcacuuacaggcuugauucugaagucaagagcuuugugaaccacuauccuaaucuccuccucccagucauuuaccuuucccugcugagaggugcuccuucauagacauuuuucauguaguuugaauuuuagaaucuuucucuugcagugauacugaguauguaguuaagauacaaucucacuuuauuagguccugcuuugaaugaacuuggaguauuugagagagauggacgucucacgcuguuaaaagcuuuauaaacuacaaguuuuguaaaacccugcacugguucuuaaccuuccuaacgcugcaacccuuuaauucaguuccucauguuguggugaccccaaccauaaaauuauuuugcagcuacuucauaacugcaguuuugcuauuaugaauguuaauguacauaucugaugugcaggauaacugauauguagcucccaagggauuguuauccacaaggugggaaccgcuacacuagggacuuuguuuuuuucuuuugaaauguucuauguauuuuuacuguacuguagcuaagggcaagaaaugucacguuuucuuuaguagcggacgauucucagugcucugagcuucugcauuuagucagguuuauacucuucugcucuguccuucacaacagguuguaaacaggucucuuacaacaugaggacguguuuguauguuuggaguucagguacagguugaucucaaguaaaugaauaugacaaaaauccugaauaaaauaagugcagaacuuucuauacaugacaaaaaauguaggcaaauuuauauuucuaugagugugguucauucuuuguucuuuuguguauagccacaugcaaaguguccuuugugcagaaaugagauacauggagauaaucuauuagaauguccucccgaagaauuggcaugugacagugacaaagaguccaguauggaauggaaguccagcucaaagguaaaguccacaugcguaaauauucuaauguuucauacuuaaugaggaaaugucaugauaaaauaguaauuccauuucugcuuuuagucuuucauguucuuuuaguuguaccagcuucuguuuauauuuaguguugaauuucaguuggaaaagaaagguauuugaauuauuaugguguucuuuucagucuuuuucucuuacuuuugccuuuuaguuaaauuauaugaaaaucuucucaauaaaaaaauuguuagaagcuggccgugguggcgcacgccuuuaaucccagcacucaggaggcagaggcaggcggauuuuugaguucgaggccagccuggucuacaaagugaguuccaggacagccagggcuauacagagaaacccugucucuaaauaccaaaaaaaaaaaaaaaaaaaaaaaaaaaaaagaaagaaagaaagaaagaaaaaaaaaaaagaaagaaaggauagauugauuguuggagauuuguucaaugaguccugcauuaugucauuaugcgaacccuacuaaaauuagugagugcaaauaaauuguuaaaaacuagagugucuggacuuaucacacuaauugagauggaaucuaauggauacaauauuuucgcuuuuucagauuaaugcucuaaugcaugcuuugauugaauuacggacaaaggaccccaacauaaaaaguuuaguuguuucucaguuuaccacauucuugucuuuaauagaaacaccucuuaaguaaguuuaacaugcgcuuuuacuucauauagaagaauuuuguacauguguguugugugauagccacgcccccaaaaugucuuaauguaauguuuuaucagguuuagucauuucauuuauuuaaaaugauauucaguguaacaacagaacuucuccugaacauaagauuuuaaaauuaagucuaaauuagucaggaaauaauuaguaccuggcagauggccagaugcucaguaggcauuugcuuuaucgagaaaugaauuauugagugaaugugucauucacuuggaagccguuuacuuagcuuguacagggccuugaguuugacugaucuuuaguaccacaggaauaaauuaugagugaauuugguuuaacgaauauuuguuaaccuuuuaauauuucucacaguauauuuauugucuguuuucuuuuuccauuagagccucaggauuuguguuuacucguuuagaugguuccauggcucaaaagaaaagaguugaaucaauucagcguuuucaaaacacagaagcaggaucuccuacgauaaugcuacuguccuuaaaagcagguggaguuggcuugaaucucugcgcagcuucucgaguguucuuaauggaucccguaaguacuuauauagauuuuucaaaauguuacuacaacaaaacaaaacaaaacaacaggaaaagaaacaaaaccuguuugagaggugccuuuuaguuacaauuaauugugaggagguaacauuauccuuauuugcagaugaggaaacugguagacagaaaaguguacaguguucccacggucacacagugauguguaaaacuagucagcuucuguguuuuuaaguacgguucugugauuccaacuguuuugaauacauaaaggaugccuauuaaugcuuuuaagauucaguaagcagcaaaucaaugagauaucacugugcauuauaugaucaaggcauugggaaucugacuauaaaucagauauuggcucuugucauggucauucuucuaauuugccuaaauauuagaucgaaugcaaauuuaagccucucucuuuugagacauagaaguuccugaggagaccuaaagagaacauuuuagacaugcauccgccuugauucagguucagauguccaugaacauauucucaguaaguuucccuggcugacaacaugcacuuaauguggcuguguaacacaggcccuagggauguuuuggauuucuguuagaaaucuaaauuagauauauauugucagcuuaccauucuucuuggauaaaguacaggcaagagaaaaaaaugauuucaucuauugcuaucauaauuuuaaaaugucugugaacuacaaguaauucauagaauuuuuaaaaaacugucagcugauacagccuaaagucagucuccuauacacaauuuaaguuauggcaaauuaacagcaaaaguuuccuuuucuuagaccucggaggcauuuagaagagaguaacacuuaagcauuacuacuguuauaaaucucaucugcauaugagguauaauuucuauuuucagcuagcacuuucucuguuaauguuuuuuuuacccccaaauacuguuuucaaguuuguggguuguguguguuuugggguguguguauguguauguacacgcucacauguauaugugaauguguguaccuguacaagugaguguguaagaaaggacacaagcugucuuuuucuguugcucuccaugucacucugucaagacaggcucuguuaguugaaccuggaacaugcccuuuuguccaggcuugcuggccaacugucuucuagaauccacuugucucugccccccaacaccaauagaaguacaugggaccaugcccagguucugugugggugguggggauuucaaacccaggucuucauguuuccacagcaaauucucauuccacuuagccaccucuagcuuuugcuuucauuuuuaagaauuuucaauuuuaacuuuuaugauuuauuuauguuuauguguguguaugugcagugugcaaguugaugacugaggaaucuaggcagaaagcuucagguacccugaagcugguguucccuggcgguugugaaaugccugauggggugcugagaacugaauucuaacccuccacuuuagccacugggccaucucuacagccugcaaauuuagucuucuuuauuuugagacaguguagagcuugcuguaugagacuugaacucagagaucuaccugccucugccuguaggguccugggauuaaagguguaugccaucaugaggaacagugcacuugauaguuuuuuacaauuuaaacuuuuuaguuuuuugagaucauaauauugcaucuuucccuuuccucgcucuaaacccucaugugcccugcuuucuuuuaaaaucaugaacuuuuuuuuuuuuuacaauaacuguuguuauuguaaguguuucugcucagaaggaaggguaaccugggacuaggaugcccgggagcacacagcuccgaggugggacagugucccaguggaaggccauccugagaagacaggaaccacacagcucugagaggaagccgccucagcagaggcauugcagcuggcagggaggcaaucccagcugagcugaggagcucagggccucagcccagcuccuucguuucacuucccuccauugcuuuguuucuucuuggcuucuucugauaagagaaucacaccaggcaggaaaucucaugacacagauuuauuggaggguccgggguguugagggacgaaucaagggauaugcuguccacuuuuccugggagcagacagcagggaacuggacgaagggacagcgcuuauuuaggauuucugagggugcagggcuucucaggacagagcuuuccagagggaguauuggugggauuucaaguccugagcuugaaccucagugauggaugugauuuccuggucagagauugguggcuauuuuuccuccucuuuucucuucauugggcccauagugugggaaguucuuccccacugcagccagccagcuuuugcugaggcaccaucucuguggggcugcuggguugggguggcuggagaggaggcagugccaguggacagcuccuaugggguagcucuugcagggaugccuaacuucauuuuacaccagaaagcucuaggcugaggcagaaagguguugccaccuuggacugcuccguaguucccacggacacuggaaaggcaaugcaccaccauggacagcuccugugagggcuggaggcugagaagauguuggggugccaccauuucugacaggagcccccauuuugaacugcagcaaccagaggcuggggcagaaggagggacuggcuuuugugguacacugcucagggacuaugguuauaagcauguauguauauguguauguguauauuccuaaaugcauaaauacaaccuguaugaagucauuuguguguauguuuucagggcugaccauuugguauuggauaaccaguugggguacucuuugaggaagacuauuucuuccacucucagcauuccuuaguggacuguaguucacugugucugcuugggggcaccuugggcuuuccucauacacauuagcaugucagaagcugcacguauaaagucuuuacuaacgugacuguguaaacauugaagugaacaaggaugacaacaauagaagccauuuggcugcuacugaagaccucuguagcuggguguucucuugcuguauuacaucauguucuugagcuuaagucagaacguacguacuuuuaaaguacauuuuuucaaguccagcugauugcaaacaaauuguugguuguaucaacaagucugaaacagccuuaagacuuaugaauacuauugaaacuguuuuauauuucaucaauauggaaaagcaaaaaauauauaaagaaaaccgaugcucgccaaaagaggagaaacuuuuucauaugcgggcccaagaaugauauguuuuguuuggucauuuagagagaacgcacaguuucguuuugugaccagaaagccacaagguuucugaucaccuggcaggucuuauguugcuccugccacaccgaucaggcuuuaguugggcccagguugcacaugccugucugcgacgcccuaaaacuuggaucuauuugaguacugucacaaacuucagaaaguuuuggauguuugauuuuggacuguggaucuaugcaaacauuucacaaucuaaaaaaauugagcuuugaaacacacaggucuuagacauuuuagaaaagauucucagccacgauuguaguggguaaagugcaguauauggggaaaaggcuggcugccuuaauaguacuggagaaagagccuucucuggguauauauguaauaucaguguuugaguuucauuagagaaggaggcauacagacacugggaugaagggcuggugcagaggacaugccucaguagagcaguaguaaugcaguccugucuccguuaggccuggaauccugcugcagaagaucagugcuuugaccggugccaucgacuuggccagaagcaagaggugaucaucacaaaagugaguuuuuaaaguuacuuaagauuguuugcuuuuuaaaaguaacacacgauugaaguagaauauggagaagauguaaaacucacuuuauaagauuuguuuuuuccucuguaguuaacauauguucuuuuucaugcauauaucucaauauaaaauaauugaaagaaaaugggauaaugcuuuauuauuucauaauauauuucuuucccuuaaacauauuacuguccauauccauuuagaucaacacuuucuuacugugguaagaccauuucaaccauuauuuugaacacauaguccauuuacauuaggaauauucacaguguaccgucaccaucaccauccaucacagaaugucugugccauacccaacagaacucuucuggacuuacacuucauucuccuuuguacuccccauugcucucuacccccaagccacuuauaaccacuguuugcuuuguuugugagucuuaguccucauuagcaccuccacacagauccaccaugacuuagucuuaagcuuuguaauaaagaguguugucaugaaaggaguacaucuuugugcacguauuccaguaauuccucuggguagauuuacaaaacuauacuuggagacuuggaauugauauuaaguaacuucaaguugauuucaguguaggccauguaguucugcugggagugucuagccuauagaaggccucgaguuugaucacuagcauuauaaaacaaaaggcaggcagucuuuauggcauauggagugguguaaauuuaugugaccauaagggaaugaaaaugcacuaauuugcauuuacccuaaacauaggccuuaaauauauuucaugugucugcugcucaugguuguauuuccugcugugaccugcuuguucauuucuucuuugcuuuugcuuguaguuaagcacaguuuuauaguaucaaggacucuucauuuugauuuuaguuguauauauguugaaaaugguuuauccccagcucuugucuguaaccuuucugagagaagauuuuaaaguucuauguuuucaaauguguucuaucuuuauuuaaauauguuuuuccaaggccuuuuuuucuguaguuacauagcagugagccuuaugagaacccuuuaccuuauaagauaucaaagcagucuuuguuuauauuaguuuuaauguccuaguacuuauggccuuauuugcauuuuuaaaaggggcagucuguauaauucuucuggaagaugcuguguuuugugaaauguuucuacauuuuuuucuuuuccaaaugaagagguuauuguucugucaccuuccuuuuaugcuuuuggaguuuguuuugcuuuuaaaaaguccauaaucuaucuacuaguagauauguagaaauguguaugugggucuauuucuaguccguucccuuguucucuuuccuugaugucuuccuguucuuagaauaauauuuuauaauuaugauuuuucacaucacccaggucaggcagcucacaaucaccuguaacuuccacuccagaggaucaucaaacacccucuucuggaccuuccccccccccucucccccucucucucuccucucucucuccucucucuucucucucucauacacacacacacacacacacaaacaaaaguaacuucaguaaaaaguauguguaugugugugcaagcaugugcacauggaggcuggaggacagccugugugcugcuacccaagcacugguaccuuugguuuuauuuuuuaaccauguaccuucucuugaguugggguuucgcuggccuggagcuuaccacauagcgaggcuggcuggccagugaauccuagagauucgccugcccccaccuccccagcccuguuguuagaagcauauugaacaaugcuuggcuuuuuaaauaugaguucugcagguugacuuagguucuacugacggagacuacaaaguauguuuagauaucugauaaaguguucuaauuaauguucauuuugaaacuuuuauuaguuaucacuauugcuauuggaaauuugaaucuaugccauuauaucucauuuguggaauauugcucaggauuuauuaaauuuauaauuccuuugauaacuaucauguuuaggaauaagaaguguuuuuguacagaaacauauuaaauaguauaucuaguuuuuuuaaauguauuucaguaauguucuguaauacagcucuuguuguuauuacaguaacaaggauauuuuagcauuugcuagaaauacuucauuauuuccuaagaaguuucuaguagagaucaugaauaaaauuuggaugugccuuuuauuucuaggugaggacuuuguuauuccuuuuuaagauucuuaccagaaaugaugaauuuuaucaagaguuucuuacuuaucuguugccucauugauauguaccuuuguauguauauagacugucauuugugggaacuucauuugacucuugauaauacugaauucauuugcuaauauucuagcuccagggacaccuauauaauuuguguuugugauguucucaugugaugauugugaagaguguguaaguucugugcuuccagccauauucuuuguaugagaaaaugacauugggcuagaaagggaagccaugcuuagcuguaaauagccucacucugcauauugagaaaaggauauguauguauauauauauauauauauauguguguguguguguguguguguguguguguguguguauguauguauguguaagugaucauuucacuuuuaaaauguggguacacuuuugaaauguggguacuccugaaauacaaguucuuauaaagguauguauauuacuguuucacugugucuccauguuuucauucugacuuuagugugcaguauuguuaguucacccuuagugcaguuuaggaaaaggcuaauuuucuuaguaaagguuucuuaagagcauuaaaaaacuucauuuuguuagcugaacaguucuuaacuauuacuuuaacuugacuuuuauuuuuuucuguuugcaguucauugugaaggacucuguggaagaaaauauguugaaaauacagaacacgaagcgagaccuugcagcuggagccuuuggcacuaagaaaacagacgccaaugacaugaaacaagcuaaaaucaacgaaaucagaacuuuaauugacuuguaacuugugggguguuucuaaggucaguuugaacagacacuuaagucuuacagaugaaaaauacauauuuaaggauggcaucuagagaauacuuuauggggggcauauuuuauguuaauacaguaguguuacugacacaucuucuauaccugaaucucuuuuuaugauacuucacacagcagugaguuccauuguaaaccggccugagacacaugugcauagagggcccuuugcucuccagguuggcauucccuugcugaggguauuuuccuacauuucccauguuucccacaucuucacugaagugugguugaagcuucuacuuguaaccacuuacucaccaaagccuuuugguaaugauucagugaaucuacaguccuuguaaauuaugaacaaguauauacagacuauaagaaagauuuuacuggauguucaaaaauuauacuugcauucauaacuaaaccuugacuaaaacaccaaaguucagagggcaaguuaauuuuucuuuguugagauauaacaaauaugugacuuuccauauguguuuagagaaaauuuagagaaaaaaaaaagcauuguguguucauuuuagugaaguggugcauucauuauuuaaaugugaugauagaggcacaagguguaaaugguauguaggggugaaggaaccaguucuaccugguuugucuugaaugcuuauauuauguaauuuaaauagauauuuuuguaagugcucucuauuuauguagguguuuuggaaauccaacuuuauaaauguaauacagagacuacugcugaaccugagaagugugauaaucaggauggaaauuggguuggauaaccuucaaaguucaacucuuaaagacauuuuaaucccgaaucuaaaaaugccuuugugaguuuagaauccgaauuuaacuuuggaauuuuauuaauugaucucuucauuuuuuuaaacccuuuuuugggaaguuaaugacuaugacucauaguuaaaacaaagacgcagucaggguauauaacaauagcuuucuuuucuguuguuguuuuugaauccagagacaagaugacuaagaagaagcuuuauggcuuaugauauaaacugaagaacaacugagacuguauuuaugcucugagagucuuaccugacuaagagagaugauagauacccuucuaaauccucacagaauccuccccagccuguuaguccuccgaggggacaggacuagccggcaagcaucuucucagcucccuugcucgggcagccaggcgaggcagaguagcauucaggucagguuuucuguagcggugaaaguggaauaacugggaguggccugcuugggugaguagcccauaggauuuguaggacuaguaucacauacaaaucaagucucauuauguauggcauuggaguucuuuaguuccuauacacagugaaauuaaguguaaacuaguuauggcccaaauaaacaagaaagaaacucaguuuacucauuuuaauuacaaauaaacugagguuccaaagugaaggccaugugcgucuuguccagaaaacuacagagcuaucuaugcuuuaaaacaugagaacaaucaaauuugguguuaauaaaaaaagugaauucuaagauauaugaaccccugggaugagggaugcugcgcucugcuguuuuacuacuuagaaauguacugaaaauauuauauuucaaauuguguuuccaacuggauucuucuuuaaauuaaaaaaaucaauaaaaaucuaaaaauuuaccuuc

SEQ ID NO: 12303 - RNA, 5233 nt, Mus musculus
uagaggagagcuuuauuucuugaaaacacugauuaacauagaguucacaggaauaacugagaaguuauuuuagcgcuuacuuugugcuguccuaaaaaugacagacaucugagcuuauuuauauuugaaucaucuaaauacuuuuauuaaugagucuaccuacacaugauauuuaacaauucaauauaauaaauaauuucagauaaauaguuuaaaacauuuuugagcccuuggggcuuacaaaaagaaucuuuaaagauccauauuuaucaucugaagacuaguaguuacaaaagauaguaaacaauacauccaaaaauaaauuaaaguuaaauauuuaaauaaauagagagccuuauguguuguaagcaggagguacauaguuauugagggcuuguugagaugaugcuuugacagaaggcuauccaucuccucagaaaguccaccacaguugcugacucaucaucgaauuggcacucaaauguguugucagagcccuaaaaaagaauauaaaauuguaggcuaagguagcuuacuuugcauauaauuauucuucacggaagcuuuuaggcauuuauuuuaacacugguuaaauauauugaacauucacauuucugaaaugaucacaauuauuggguuauguuuuauuaugauaucaaaugguaaagcauaaaaaauaaagcucuccagaguugauuaccaacgagcauuugaugggaacacugaacacuucuguagaauucaguugcuugaccacuuuuucucugguaaguguacacagcuaugcaucaauuuaggcuucaggaauggagaaaugauacuuguuauauguucuuugcuaaaucuuaagagucuauuauucaauucuuucccccccaagucagaaugggaacaacccagaguagguuaggacaagcaucuauugggggaaauuuggagaauuuuguuauagauauaccuacccugauaccaguguagaugaaucacaaaguuuguacauguauaaauauuauaaauuuguucuguggauuagcuuuuugaaagcuaacccucuuugcuaaaggagauauuuuaauucuguuuuuaggugacaagcugagaaggaaauauuuugacaaauuuaugggauggcuuuuccaaaucugacuaauuccuuguaagucaaaugaggcagauuauuccuuuuaaauaaauacuccuuuucaaauaagcugcuguggucuuauauacccucuuuacauagcuacuucaauauucuaaugucuugaauuuuucauuuuuaaaaauauguggcccuugaaacauuuuucuaguucucauguagcucuaaaguuuguaccauucauuaggggugaacuuucugauguuggccauagauuuuagagcauccaucuuugcauacguaaguacucgauuuuagagcauccaucuuagcauacguaaguacucacaccuuucaacgucuagaugauguguauuucagccugcuuuaaaaaccucaaauggaagcugggcagugguggugcaggccuuuaaucccagcacuugggaggcagaggcaggcggauuucugaguucgaggccagccuggucuacagagugaguuccaggacagccagggcuacacagagaaauccugucucaaaaaaacaaacaaacaaacaaacaagaaacaaacaaacaaaaaaaacaaaaacaaacaaaacaaaaccucaaauggaaacagugcacugaaaugugacuuugguuuggaaaggacuagcccacacccucuuggaggcuugcugcuacugucucaccagaguccaugauucuugugcauuuaaaaacaaagcucugcagugggcucuccccguccugcucuguccauuuuaauggcugccauuuuuggagagaaaugucuguuuuucuaccaauaccagcacaacuucucuggaaaaacuuuucagauaauuuuuucugaucugaugaauguaacaccagcaagaguugcuuguuucuuguggaauucuacuccgugcuuucucucacauccaguucuaugcugguguggagggagcagaguguucauguucccaguuuccuugcaggugaugguagguggaaauucuagcaucauccuacaguggaaggauucacuugcacagugacuuuaaacuuuggcugacuaaaugcacagaacccaucaaagaccagaaauggcaagccacuuaaaaaugcauuucuucucuauuuuauuuccagauuagcaaauaaagcaacaccuuaccuuuaguuuuacaacaguuacucugauauugcugaugaaauucucagcaucuuccaauugaaagcuuuugcuuugagucaaauccagaacaugccgcagagguccaaguucaucuucuaggcacugaagaucuuucaauucuguggccuagaggaguaauaagcuuaaccaucagcucagcucaccacauacugaagagccagaaaguuagucugcagucucucuaaucaagagaaggcagcacauagcuuuuaccacucccuguccucuguaaagggggacugagguaaucgaugccauaaaucuagaagagcaagagcucacaaccauaagggucaccuugacuguuaggccacucuagugagcucuucuggcuucauuagacuuuguaaaaagucuguguuucucuaccaaugcauagcacaaguucagacuauuguuccaaucuacaaagaaaucugcaagguucacauucuaauaucuaaucgcagaguugagaaucacagaaggguaagggacaggaauccuuggaugccaacugucauaggccuaaaucuuacagauuagguuaucauggcccugacugaggggugucaagauagccaggaagacacauguaauauuuuuuaaauuuauacuucucugcaauuacuaaagaugaguuuuuuaaaaacccauaugucaagcuaggaagauggcuuuuaagguaaagguaccugccaccaaacuugaugauuugaguucaauugcagugacccacccacauuguggaaagaauggcccaacuuucauauuucgucuucugaccuccacaguuacacugugauacacaugcaccuccacacauacauacauacauacauacauacauacauacauacauacauacauacauacauaaaauguaaaaucuauuugucccaaugaaaaaagucauaacauuuuggcagaacacuugggagaauuuuucugauccauguaugaaauaauguuuaaauacaucaugcauacuuacauacauauacagggaaaaaggauauugucuagcucuauaguacacuaugauuuccauaaagucagcugcuuuaagucuacagugaacuguguuaucuccauuuuaccaagucucacaaucagugucuuucccacaaccacaugaacggggagcaaggguggcccggucggucggucgcuccuuucauuaaccacagccuuugaauuacaugcuucuauuguuuuuaaaaucuuacauaccgaaugcagguuaaaugaaaacaucagcagaauuuaccacauuacucuuguuuucaauaauuauuuuaaaacuuagauuucuaggaauuucaccacucucuaaauuaacaugaucucuguuguuucucuaacaauccuuagaggaagagguuugacaagauaacacguaguuccugauuggucugcuauugaccuuccaacuuguuauggugugucuuggguauucaguguggagcuccuucccucacagaacucuccaguuuguuacugugggagcugaacauuaugugacuguaauuaagcuggaagagcaacuggggccuuucuuuuucaucuccuguagaacagcuagaggcaaaguuccccugacucaauaggaaugggucaacagcugccucuuuguccccuuagaucccauuuugcucuaggcuuggauuuacuugggacaagcucuuucuaggaccaaaguuauccauucucuuuugacuuucgggacuagagcaaauuucuacccuugcuggaguucuaagagcuuguguaagcuguuuuguaucacacaacauucugccuccaaaggagaccaaaaaaccuuucaauauugagagauaguaucauguaguaauauuacagcucucuaguuccacuaguuaaaagagacuguauaaauccaaaauuguuuuauacaucucggacuucuucucuagcacuaauaguguguuuaugugcuguuggccagacacuguucugaaaccugacaagugauaagcauagcaaugaucauuuauguaagugggugaaugagcauagacaacuuccugaggccaugagagcuaggcccuagcagggcuggacuccacugcagaucauuggcccuagaaucuuaacauugguuaugcugcuccucaaaaaugcagucauaggaaucauucuuaaaacaguaaaguguguguaaaaugagacccucucaagucaauuuuuacauuuaagaagcugaaauaaugcaccucucucaaauaucuguaggacaagcauaaaacagaaaucaacagucuuuaaauuaucccagcaucaaaaugcaaucaucuugcauuuucuucucauucccuuucccaacacauaaauacacaggaaaaauguaaagaaaaccauuuaaaagaaguaccauugucaagauuuuuuuacagagagauaucagagaaacuuauuuucuucagaugagguacuauucaucuggucacauguuauuuacacguuauacacauguauguuacuuugaauucauuagagcaccaguuaaacacagaaacucacucaccugcuugggcaaguaaaauuugaaggugagcauccuggggaguuucagguuccuguaauucugagaaagcguaacacauuauuauuaaagguuauuaaacacagccuuuggcaagaaagcuaaagguauugccuauagaugggauggcugugcacuuaccuccauccugcucaggagcuccuguagguccaucaacagcugcuccaggugcugcugcugcugcugcugcugcugcugcugcugcugugcuuccgcuguagagcuugaaguggagcuugaagugggugcgcuguugacaaggagcacaagugucaaugugacacaggaugcgagcugcaugcuguacaugccugcaggacuugaggucacugugaggagugauuagcaagggugau

SEQ ID NO: 12304 - RNA, 125045 nt, Mus musculus
agguuccuggaaacuaggaccaugaacuuggccgcaaaccgggcuccuggccgcaggcggcucccgcuaccuucuccaucucugugccagcuccugagagucugggggcugcuaucacugcuccccggcuccgcccgaguccaagcggccgaacagcgccagguguuccaggugauggaagagcagcccccagggacucuggugggcaccaucccaacgcguccuggcuuuaccuaucgucucagugaaagccacgcccuguucgcgauuaacagcagcaccggagcgcuguacaccaccgcuaccaucgaccgcgagagccugcccagcgauguggucaaccuggugguccuuuccagcucccccacauacccuaccgaggugcgagugcuggugcgugaccucaaugacaacgccccagucuucccagacccuucgaucguggucaccuucaaggaggacagugguagcgggcgucaggucauucuggacaccgccacggacucugacaucggcuccaacgguguggaccaccacuccuaccgcaucgucagcggcaacgaggcgggccgcuuucggcuggacaucaccuugaaccccaguggcgagggagcguuccugcaccugguauccaagggcgggcuggaccgcgaagucacaccucaguaccagcuccugguggagguggaggacaagggugagccaaagcggcgggguuaccuucaggucaacguaacuguacaggacauuaacgacaaucccccgguguuuggcaguucccauuaccaggcgggggugccugaagacgcaguugugggcuccaguguccugcagguggcggcggcggacgcagacgagggcaccaaugcagacauccguuaccggcugcaagaugagggaacccccuuccagauggacccagagacggggcucaucaccgugagagagccgcuagauuucgaggcccggcgacaguauucgcuaacaguucaggccacggaccggggcgugcccucucucaccgggcgcgccgaagcguuuauccaguuguuagaugucaaugacaacgacccgguagugaaguuucgcuacuucccugccaccucgcgcuaugcuucgguggaugagaacgcgcagguggguacagugguggcucugcucaccgugacugacgcugacuccccagcagccaacggaaacauuucagugcagauucucgggggcaaugagcagcgccacuuugaggugcagaggagcaaggugcccaaccugagccucaucaagguggccagcgcccuggaccgggagcgcaucccuucauacaaccucacagucucggucucggauaacuccggggcgcccccuaccgccgagguccaggcucguucgucuguggccagcuuggugauuuuugucaaugacaucaaugaucacccuccggucuuugagcagcaaguauacagagugaaccugagcgaggaggugccuccggggagcuacgugaguggggugucggccaccgauggcgacucuggucugaaugcuaaccugcguuacagcauugucuccggaaauggguugggcugguuucacauuagugagcacaguggacuggugacuaccagugcugccgggggccuugaccgugaacuugcuucccagauuguacuaaauauuagugcccgagaccaggggguccaccccaagguauccuaugcccagcuugugguaacuguccuggaugucaaugaugaaaagccgguguuuagccagccugaagguuaugaggugucugugguugaaaaugcuccaacugggacagaguugcugguucucggggcaacagacagggaucugggugacaaugggacagugcgcuucucccugcaagaggcagagaaugaccaaaggcucuuccgccuggauccgguaucugggaggcugagcacugccuccucccuggacagagaggaacaagccuucuacugucuaucgauucuagccacagaccuggguuccccuccccagucguccacagcucagguaaaugucagucuucuggauauaaacgauaacagcccuguguucuacccaguccaauacuuugcucauauccaggaaaaugagccuggagguagcuaugucaccacagugucugcuaccgacccagacaugggucccaacggaacuguuaaguacaguauaucagcuggggacaggucucgguuucagauucaugcgaagaguggggucauuucuacaaaaauggcccuagauagagaagagaaaacagcauaccagcugcaaguaguggccacagaugggggcaaucuacagucucccaaccaggccaucguaacugucacaguguuagacacacaagacaacccaccuguguucagccaggcugccuacagcuuuguggucuuugagaacguggcucugggguaucaugugggcaguguuucugcaacuacaauggaccucaaugccaacaucaguuaucucaucacuaccggggaccagcgagggauguuugcuaugaauccugucacagggcagcugaccacagcaagugucauugacagggaagaacaguccuuuuaucagcugaaaauaguggccagugggggagccgucacgggagacacugugguuaacaucacagugaaagauuugaacgacaacgccccccacuuccuccaggcaguggaaagcauaaaugcuguggagaacuggcaggcgggacacagcaucuuccaggccaaagccguggacccggaugagggugucaacgguagggugcucuauagucugaagcagaaccccaagaaccuguuuacuauuaaugagcagaaugguaacauuagucugcugggggcccuagauguccacgcuggcucauaccagguagaaaucguggccucugauaugggugucccucagcuguccuccaguauccuucugacaguuuacgugcaugauguaaaugacaacccaccaguguuugaucagauuuccuacgaggucacacucuccgagucagagccugugaauucucgauucuucaagguacaagcuucagacaaagauucuggagcaaauggggaaauagcauacacgaucacagaugggaacaacggggaugccuuuggcauauucccagauggccagcuguauauaaaaagugaacuggaucgugaacuucaggacagauauguguuacugguuguugccucugaccgggcaguggagccucuaagugcuacugugaaugucacugugcuuuuagaagaugugaaugacaacaggccuuuguuuaauagcaccaauuacacauuuuacuucgaagaggagcagagagcuggguccuucguaggcaaagucagugcuguggacaaagacuucgggccaaauggggaagucagguaugcuuuugaggugacacagccaaauuucgaguugcacgcugucacuggggagaucaccagcacucacaaguuugauagggagucccucaugaggagaagggggacagcaguauucagcuucacagugacagccauggaucggggccucccucagccccucaaggaccaggccacugugcaugucuacaugaaggacaucaacgacaaugccccuaaguuucuaaaagacuuuuaccaagcuacaguauccgagacggcgaccaaucugacccaggucuuacgagugucugccuccgacguggacgagggaagcaacggucucauucauuacucuauccucaaaggaaacgaagaaagacaguuugccauagacagcuucucuggacaggugacucuuguaggcaagcuagacuaugaagcaaccucagccuacucucuccucauccaggcaguggauucaggggccauuccccucaacucaaccugcacccugaguaucgauauuuuggaugagaaugauaacacccccucuuucccaaagucaacacuauucguggauguuuuggaaaacaugaggauuggcgaacuuguauccuccgucacugccacugacucugacucgggugucaaugcugaccuacacuacacuauuacagggucaaacaaccaugggacuuuuaguauuagccccaacacugggaguaucuuucuggccaaaaaguuggacuuugagacacagucuuuauauaaauuaaacauaacagcgaaagaccaggggcggccuccucgaucguccacgaugucaguggugauccagguacgggacuucaaugacaacccccccagcuuuccuccgggagacauuuuuaagucaauaguggagaacaucccccuugguacgucuguuauuuccgugacagcgcaugacccagaugcagauaucaacgggcagcugucuuacgccaucauccaacagaugccccgaggcaaccacuucagcauagacgaagucaaaggaaccaucuacaccagugcugagaucgaccgggaauuugccaaccucuucgaguuaacggugaaagccaaugaccaagcagugccgauagaaaccaggagguacgcucugaaaaaugugaccauuuuggugaccgaccucaaugacaaugucccaauguuuauaucucaaaaugcacuggcugcagacccgucagccaugauugguucuguccugacuaccaucauggcugcagacccggaugaaggugccaauggcgaggucgaguaugagauacucaauggggacacagacaccuuuacuguggaucguuacaguggggaucuucgaguggcuucugccuuggugccuucacagcucaucuacaaccuuaucguaucagccacagaccugggcccagagcggaggaagucaaccacagagcuaacugucauucuccagggccuagaugggccuguuuucacacagaccaaguacauaaccaucuugaaggaaggggaacccauuggcaccaaugucaucuccauagaagcagccagccccagagggucagaagcuccaguggaauauuacaucguuucuguucguugugaagagaagacugucggacgucucuuuaccauuggacggcagacgggugucauucaaacugcagccauuuuggaccgggagcagggugcgugucucuaccugguggauguuuaugccauagagaaguccucugccuuucccaggacacagagagcagagguaagagcuuguauucuuuuauuuguucucaauaggcuuaaaaauucuuuucuucauauuuacucuaugauucaacuauguuuuuauggcuacuuuaauaaauagggacaauugaagcagguugucacacacugacaguuucagaaaaugcagcugcaauccagguugucaucaauaaugaauuuuuaaaaauauacuuuaaugucccuuaucagcaaucaugaguguaaggcugcugccaccucuuuagccacuugcagaauugaaugaagcccauuuguaugagcagcgccacuguacuaaccuagaucucucuauuaaaaaaaaaaaaacaaaccuggcuuguggguggaaagucucagaguuaagaaaucccuguucuaaggggaagagcuuugcuagaacucugaauggauuagauuucugaguugagugaagcaggagccugcguggcaguuuacaucggaacaauacugacuuuuccauccucagaaagcuugguggauucuuuauagacagcgaauaauuucagugugcagagcuaagucuguggagguucccgacuccugccuguagggcuuacaaacuggcauggauuaaauacuuccuuuuccccuguacacgcaggugucugugaacaguuaggucagaugugccagccacucugguucuugcgauaaaagaaugcuguuagaugugguggugcaggcacuugugcugucuccagguggggaacaaaccuuuuucaagcccaucccccagaagguacagacugcuuccacccauccucauccucguaucgucugccuuccuuucuauuaagugccuuuguuccaggguugugggaaagucgccaagaauugauacagcuaccuucuggaaagcuccauugacgcuuucugaguucuuccucccacuucccacuccccucagagauguuuuagcaucugucacucauccaagaauucaaaauaucaagugugguuucugaugcuuggcagagguccaacuacaacacgcugguggaauggaggcugcuauguuuguuugccugcuuucuccuugugggagaugaaggaugcucugcuuuggagugcuggcuuuuauuguuagcuuuugaaauucccugugauuauuuauuuuugagaucgcuagcuggaugcauccuauggauggcacucagagggcauuagcauucauuagaaauauaauucccaacagggcuguaauuguaaguggaucucaauuuuuccuugcacauccugaccccgagaggcuuccaagucaaguugucuccuuacacccacuauaaagaucuugacaucagaggucucuguucagcucaggucaugauuuacguguaauuuuugauuugaguuuauugccugucucccguuuucuucucuguaguuauuucugagaugagcagcuuugauuaguuugaaaagcaaaauauuuacugaggguuggcaauuaagacucuggauaaugacugcguuuguugaacagggggcauggguagguguuuaugucagucaacugcuuuuaucagaggguugcagaacaagggaaggaauauuccuggcugccauuagaucuaucaugauugugauauguauccauucuaaaggggaagguugguuugccauaaauguauuagacagugauaucuccgaaacauucauaaaggcuaaaaauaaucauuacaaauaauuuuucuuaggaauggggacaguaugcuacagugucucuuuaacuucaauuaacaucagugugacaggcauucuuuugggcuuccugugacuucugcauugagaaaccaaaggagaaucaaccuuuguugauugugugucuaucugugugaauguaucucugugcaugaauauguguuuguuguguacuuguuucucuuauucucuugugugugugugugccuauuuguguguaugugugccuguuuguguguguguuccugauugaguguguguuugugugaauguaucuguauaugaauguguauuucugcaucucucucccucucccucucccuccccuuucugccucccccucucccuccccuuucccccuccccucccccucccccucccccucccccucccccucucccucucccucucccugucugucugucucugucucugucucugucucucucugugugugcuugugacacacccauauaucaggauacccucuauacacugaagugcucaaauuauaaaccaacuuugaguuccucugguacagcucugcugaaauuuaaagcaaaugcuuuguuuacuucucaugcccaacgaacacugaaagcagugguuuauauuauauuauuaacuuucacauuauuauugaucauauuuuucccacauauaaauuaaacuagcuaguuuuucauuauguucaauugauuuauuaugauucuggaaagaggauccucggugucaaggaaggguuacuugugcaccguuugcagguucagacuuucugcugaauuugaaaacagggauuugucugaccugauagagguccaggcugaugcacauggcucaggccaaugucacagcagaucacauucuauguaauaagaaggacaggagagaagauggacaauuggccugcuuucucugucgaaggcuugguuugggcacagauuacauuugauauugcuuacacuggacauuugcccaagggacacauucucucacucugccuguaagagcuaaaggcuggcaggggcaggaaugccuccaaaguaauucugucuucuguaauaugucaauuaauuaauuauuuugaucgaaaauuaaaauauauuucauccacaaacuuccaacuuagggucucagacaucaugaugaccaggggcuuuguuucaucagucguuguuauuucagacucuuauucuuuuacccagcaugcaguaggggcugcaaacguguuacuacugaguaagaugguagacgaaccaagacuagaguacagcuuccucgcggaggagcgaguccaagaaaagcugcgggaagggaggauguuggcgaauuugacugaucaguugaguaugggcagagaauaguaacuaccucugcucuauaaaugacaugagaauugucagaaagucgagacaacagagggaagugaacggguggucugacaugaaaggggcugcacccacugggaucgcagacgcugcauugcaggccguggaucucucggcccucuuauguucccuugaaacucuccaagggcuuccugaugaagagcgucucucaacuauuuuucuuuacuuguugugguggcuugaaugagaaauguccugcauaggcuucuguauuuuguaauuuuuaggagguggagcuuuguuagaggaaucacugggggaggcgcgaagaucuuauagccccgcccuauuucuugcuuggcucucagcuucccguuugcaguugauaugcgacuuucugccaugcuugcccuucacuacggacuuuuaucucucgacaccauaagccaaaauaaaugguuuugucuguaaauugcuuuugauuguaguauuucaucucaucaccagaaaaguaacuaaugugguaguuuaaacuaagcaacagaaaaauauagcauacugauuuauuaacauuauaaggaauacaacauucuuuuuuguuuaaagauguuacauguucaaguuugaaaauggaaauaucucacauuuaaauuuuuucuuuggcucaugacuuacagaauauaguaggagucucaaacuuuguuuuucuaguugaauacaaugaguuguuuuuguuuacuuuuucuucuauugaaauauugagauuaauccauccucagaaagggagguugaaugggguaaaggaaaaguguuuugauuuggugcccuauucagguaauuauugauuuuaccaucccuguagggacaaugccuugggacuuaacuggcaccccaccagaaaaccagucagccgcuuucccuguguaguuaugcaaauaucauggucuaugccauguugcaguuggaucguucccuguuuaagcuauauccaucagccaucuguaacucagaaaauacugguguaaaugacagagacuuugugagacagggaagauuuuaguaguuuauuuugugaauuccaaauauuauuguuuuaacugauggaaaaccuaacauuuugauguuuuugugugugugugaauguguuuauguguguguguacauguauauguauagauguguuuauagguguuauauguauauauuugucuuagucaggguuucuauuccugcacaaaacaucaugaccaagaagcaaguuggggaggaaaggguuuauucagcuuacacuuccacauugcuguucaucacuuaaggaagucaggacucaagcaggucaggaagcaggagcugaugcagaggccauggagggauguuacuuacuggcuugcucagccugcucucuuauagaaccaagacuaccagcccagagauggucccacccacaaggggaccuccccgcuugaucacuaauugagaaaaugccuuacagcuaguuggaucuuguggaggcauuuccccaacugaagcuccuuucucugugauaacuccagacuaugucaaauugacacagaacuagccaguacaauaugcaaaugcuuaugugugauuuuguuugaguguauauauauguauguauauauaaagauauacacacauauauagauauauauguguguguauauauacauguauguaugcauguaugcauauguuuguauggauguguauguauauguguauauacguguguguguauuuauugugauauaguuaagcauugcuagucugacagauuauuacauaacaugcuuauuuuugugaugacaguccauagcauacacucccuuuauauguuucacaaauacaguguauaaauacuuaugguugcuuugcucuauauuaagucuccuguaaugcauuccucuuaauagcagugguauaugcuugaucacaucugaccaucuccuguccaaauacuccagacucuaggaacuccacugaccucuccuccugugccaucagcuuucagguaugagcgagucacagagaucauguggcauccguaugugcuuggugauaucacucagcaucauaccuccagucuccuccauggagcugcagaugcgagccucagugcucugacaaaccuggagugccaugcacaugcauccuguguucuucagauggucauauagguuagguugguuuuauaguccggcuccuucacagugcucaguuagcauggaaggaaguuggcucuccaaggucugcauuucgauccuucuggguauugcauccuguggcauuucuuucguguuuguacagaacuucucuagucuuuucugugacagaacuaccaguucgcauuucacugcuacaguucagauguugugggcucugucccugucaugucacuacugagauguguuggaucccugcauaggugcagcugggggcgggcauuuaggauauuuaugacauccuuaaaggagaccagugucaugacccauuucucauccucuugguucucuggcucaugauguagcuaguuccugccaccauagaacaugguucuucugacucaaucuucuucuagcucaccacuggcccaaaucaaggaugccaaugggucaugaaccacagccuucaaagcuguaauccacacuaacccuuuauccucauaaucuggucaucccagagauuuuguuauagucacaguaaacugaccagcacaccaagcauugguauaugugaguaaauucuucaccacaucugcggcacuaaucuuguguuuagauguugaucuuucuaacuggaguggaacaugacauccuaguuuugguucauguuuaccugaagcucuuugauguugaacaaucaucuacagaccugcaggccaccugugcaacuucuauuacaucguaugcccaugauuuaacucuggugcuuacuccgaugccauugaaauguuuaaacuucuccuauauuaucaacacuaagccccugugggaugcauccuuuaggcuguuuucuuaucuauaggauuuucucuuacucuguugguuguuucuaucacucuaaaagcuuuucagucuugauuuuuauuugccuucuuuuuuauuuuccagucuguacuuugaguuuuuaauaauaauagugauaauaauaauuaauaauaauaauaaagcaagaucacuauuuuggaucaaaguacacugugggcaguguuuuauucuaacaguucagcuugaggucuggccuuucauacaaaggucuagcuucauccacauugccuaugagcagggcuuuucccagcacuaucuagugaggacccugucuuccucccgauguguucuugcagccacuugucagugcaggccaguccacuggcagugugugacuuugccucugcugucuuuccccuagugaucugagcaccuguuuucaugaggacauauagcguagcauuugucuugcagaaaacacuucccauguacugauagcaagccuccuaggaaugguuaggaauuauucacaauccaaauuuuuacuugucagcucagauuuuuaccacuaacgacuuaccuugucagguauuuugcuugaagugucagguccccuucauucauuauaaaagugaacaguuucuguuaguggcucuuugcaguggaaaugggccuccccagacaguugcuuuucaagcuaacagcacagucaguuggagauuucuuuuacaccaccucagcccucagcugggugcagaacacugauucucugugcagaacucauccugaguaacauagaacacugauaagacauuaagacuagagacuucaucuagcauaauugauucuaaaaagcauuuacuuuuuuauuuugagugcaacugccauucauguuuacuaugaauacuggcggugaaacugauguugaucuguggcucacacaggcacaaauauccugaugaacgccuauagaugccagcccaguaccuauguaugugguuagccauuuuugggggguuaggagaaaaguuguuacucuguagacagaaggauauaucaauugcuuuaaaaauuacauugucuuuacuccuguauuugcuauuaaaucuucaagaagugauauaaugcauggguguggcagaguggaucuguaaucacauuaaugaagaggcagaggcagaaagagcucauguuugaggcuauccucggccacagagaaggauuauucuucuaaggcuucucaccugcugcagucaagguggucagcagaucaguuagcgaugcugacccagaccccaagcugaggacugggggagagucuggaaaaggggagguguggaaucagaggaggacaugacuucugaugaggagcacuguguggagugucugagcggcuuggccucagcagucuacagaagugucgcaugagcagcaggccacugcaccuggaaguggagaaucuagcuccauauuagaguuccugcguguauguucuaaaagcaaccagaagucucacacagcugcacacaucuguaauccuauugguaggggguggaggcagagguaucgggaacggaagacuagcugaaauucgugagacacuugucucgaagaaugagacaaacugcuaguacuggucagaugaaacagugaacacucuagccuucaggaguuugaugcaggaggaucaccaugagugcaagaccagccuaggcuacacaguggaguucugucucaaaguauaauuccaaaucaaaaguauccgcagguuauuauuacugacuacuguauuguaaaacgauugaaacccugugucauagcuaggauuuuuuagagcuaguuauauccauggugcacacuuuaaaugcaccuucagcuguuuuagugacaaacuuucagagaucaaauucaucuucagaguccauuuacucuguuccuuucaccuuuacuaaaacuucagucccuuuaguguccuaccaauggguuaggcuuuuggguacccaagggaagaaaaaacuuuuucaaagauuucugcuugugagccuuauucagaguggagguuuccucucuguggcuuguccuccgccaugauuagaaggacacacaguccggggacuccucagcugagaggcuggguggugacugcuaagggggucuccuggugcccaugauggacacaguguucaucacauugucauuaucuaauucuccucaaaggcuacugacauagacuuucuuuugcuucuguuaaaugcucccuucgcugggcuucuaagucacugacaucuguaacuuugucucucucuguuucuuagacuaauuacuucccccacccccaccagcuucucuccaucaucucacaccaugaacaugguaaauugcagaagugaaauucuggcagcugguuugugacugggaagagguucucccaggugaauucucucaaguaccuggagaagguuccugacgguggcucuccagugccucacaggggaaccugacaaugaaggccuuuacaaaaccuagcuuaaucuaccaggggaacuuuuuuuuuuuuuccuuuuucugucuuaaagcauuagggagugguuaaauacuugauauuaucucuagccaucagugguuuagauugucucuuuucauuaagaauagaaaccacuaaagcugcaagcuaacagaucuauugaagaacuucugcuguuuuaaagaugugacaggguuucaaauguuaaaaaggacuugaauggcaguuacauccccucauccccaggggaacaucugaccugcaggagcagaaugacaggaugggggaggggcugaggaugggggagagacucaggcugugagugcuaggaagacuuugccucagagagaaugauaacgggaagugauuggcagucugucuacuaacaugacagaccugaguggcagaggugucacagagugggaaauuguucacaucucagucugcaauuaggguugacuccaugcuuuggccugagacuccagcaggccuaugagucccacaaagacuucucagaugaacacugaucugaacuggaagcaaaguuugacugugaaaauguggcucaugguuggugcugcuagccaacuuccugcucaccucucgccugucacggucccaaccagauugcugauccucauggacacgagaaaaggaaaauagcuuugcuugugcaugaccauggcucugaaauuuuccauagaaucaugagaaauuuacuucauuucauguucuggagaagcugugugucuuuaaauuugaaaguauauuaaauauuguugugaucauuucaaauuuauagcaauuuucagauuugugacacuuuuacuacaaguaguauguaaaauaaggcccauauauuauucauugcuuuaaugcuaguuuuaaaugugauuaugucaaacuguguaauaauggagcuuugaaccguaauugccccuaaauguuacugaacugcuucugccucugacaucguguucuugcucaguaggagccucucagagugugcuagugcuacauaacauugagucacagucuauuuuuuuuuaaagauaguguauuaaaucacccaguaaaaccauuaaaauagccauccauguuuguguuuugugggccagggcagccucuguugcaaggucagcuucuuacuguuuuauuacucugaauaauaauaaaacacagaaaguaucuuucuguugagguuguaauuaauuggaugucaguacagaaucuugaguguccugagcucagggccagguagacuagaaacaccacuugaccccugaaauauugaggaauaauggaagugggagcguagguuguuuuguuuuguuuuguuuuguuuuguuuuguuuugucaaucuugcuuuucaagaacauggucuucuuauugggcaaacauggcuggaugugauagaggcagccaaucccauauuugcucuuuuguguaucuguaaaagucagucaaugccuuuauucccuugugaaguguuugucacucagcaucuaagagcagauacguaugcuaaaggaaucacuucuguuuaaaaaugcugggaugguaguggcacuggggugagcuucaggagcauagaagagugagcgugugaaacaggacuuuggcaugcuugcucacuguuagcuucaccacaucccacaauuagaugugggaugccucuuacccucccuaucuuagagacugucugaaggacccuggggucacugaucagccugccaagacuccuuccugaacuccagccuaaggaugagacucugucucaaaacccagagaggaccacaccugagaaacaaagcuaccauugaccucugaccuccauaccuccuaaacauucaucagcacccauaaccauauaaacaucccccuauacccaugaaaaauaugcuuuuuaaagugcccuaaacacauuuuacuuguugauaaaacacgagacaagguauaaauaaacaaagaaauacaacuauaauuuaaauuuuaucuuuacuaauucugguauuuccuaaccaacuuuucaauccucuguuagagaauuugacacacauuucauuuuuugggaggaccucucuauuguuguuaauacuagguacauaggcauacugcacauugaaauuuugugaacaggacuugaguuuuacuucauauuuuguauauauuaguauucucucacauaccugcacaucccaagagaacacuguaucccauuauagaugguucugauccacuauguggguucugggauuugaacucaggaccucugaaggaggaaaccaguauucuuaaccucugagccaucucucuaguuccauggucuguggaauuuaaaggggagaggagcuuguuccaaacccuaccuguggugggagcuucagguagauggucagccucuucggucuuugugccuugucuauaaagagaacacaacggaagccuucaauaagccuuaggaggaaaaugcgccucacggucggguggauuguucuucaguguugcuuggcuuacuguugagacuccuucauuagacugcuuacuccuugugugguccagaaggcaaugguuucacaaaaauguaaacaacugcuucucaagguaauagcuccuguucacacagggauggugcugccgauacauuaaggacaccguguggaugugaguaaaccaagcauuuacauuuaagggaauuauuaaggaugugcauuaaaaugucucauggucauuugcuucauuaccugaaauccaggacuaaaauagauuuuaaaagacagugaguggccagugagcuggagggaaaagcucagaacugaagggauuuuagcuaagugagagaagugaaucuuguuuuuaaaauacuguuuuuuuucacagacacuuacuuuauuuuagguaacucauaaaauaaacccagaugagcccucuuuaguucauagacuguuuacauaccuguucgguucagacgucauuucuaagcuacauuccauccaggggaugcuauaaaagauuaaaagggacauugaguauucagcaaauaugucgaaaagggaacuucaggccuuauucaggcuguaaaaaccuuuguuuaauuuaaucacuugugugggauauuuccucacaguagaucuuugaacauccucaccugucuccuaaacacugcaguuucuguuacuauuuagcauuaugguggaaaguggccauucugcuuccaguucucucauucuguugucuuuuguuugugaguguuguaauggaagaaaugaagcaauuucguuagaaauaaaauguuaaauaugcuuugaccccgaaggcaggucuggcaccuacuguacugaucagccuuuauuguuaacuugucacaaccuugaauuuccuggcaugagggaacgucuaaagaauugauuggauuuauuggccaaucuuuggggcaccgauuuaguugaugacucauguuggagggcccagcccauaguggguggcuccaucccuaggcagaagguguguaagaaagguguguaugaucaaccaugaucacuggaacacacuguauuggucucaguuuuauuuguuacuaaugcuuuuguucuuucuaauacacuucucugcuccuaauuauuacacauaaucauaaauuucacaugacaauaugaugaaaagaugaugcuucaaggcaugaauugacagccuugggggcuaaucuaugucaucaacagagcuuacaguuucauuugcagcuuagugaagacucauuggcuuuugagucagaaaauagguuuaauuaauauuucuguaaaagaguuaauaaugcccaauuucagagaacaugaacauaucagauuaaaugaagcauuaauuaguagcuagcagaaguauaaaucaacacagugagggaggauggaaaacucaaagcuugccugggcuucaaagggagaccuuggggcaaacaaaacaaaucaaggagaggagaggaaggacaugcuuagaaaacagaaaaucuucauuugccuuggaucacauuuauaguuagcuaaauuaaauuuggauguuaagcugacuuugaaggggugucucuaccauagauauaacuaagcgugccuccuaauuaaauguucggacaugaaugaguugggguuugcuuucuaguaguguuugugggagaaggaaaauucaguaaguuaacuguuaacgaacacagacguuuuagugggcaaggagagggaauaagggaauagguguaaaugggauuuguaucacacgaacagguugcagaaggcacauguccauggcaccagcgaaggcccauuagugaacucaaacauugugaagauauugcuggaugugccguuguagagauuccagccuuuggaugauuggacaguagcuucugggcauguguggaagauagcucaugauagcaagaaacacuuaguguaguaagcugcuuaccucauagugaccaggaaaugaaaagcaggaagagaacucauuuccccucauagagaccagggaacagagagaaaaaaagaggagaccgcauuucccuguauucucccaggacacuccaucaauaucugagaccuccuccugggucucaguucuuauguuccuguauuuucccacauccccaaguuaaggaccaagaagacugcuggcuucagaccuaggaaagagucagaaacgacgucuaccugaggcuauguaggauaaugagagaaggaaggauuuguaucuaguugugucugggcaggcaugacuuuguacucucuguacaaucuggaaguugagucuauauugcugcuuuuagauacuagguguacacagccaugagagucaucaucucagccuuuagacagagccaguuugaagcauuuacuuggguuguuucagcagagagugaaaaccacuuaggaauuccaguuuuguagagagacagcugauagaggcaggaaaaugcuggccucacugcuggccauggccuuagguuggcgucuacuugucuguaagcaguuaccagagacaucacaaucagaggaguuaguucuagagucuuguaaauaguuugcuaugacuuuccaguccucagucuuaccccaguguucauucccuggaauacuguugagugcucugggguccaguagccccacuucagacccacccugcagcacacaggaagucuauuguaaagacuuguguuaguagaacugaaagacagcuacacggagaggugccaccaguugauaucccugacucaguauugucccaccaagcuuuaguguucgugguuuauaaucuugguugucagugggaaccgagugggaccagggaucuugacuggagauugccuccagcagacuggcccaugggcaugucuguggggagguauuuccuugauugcuaaagagcaaagaagggugagcccgcugugggcagugcuacccacucccuccuccagccagugauuuuggcuuguacaagaaaagcaucugaguaagcuggacagagcaaaccugugagcaucguuccuacguggccucugcuucagcugcugccuaagcuccuguacugacuccucucagggaugaacuguuaccugcaaguguaaaccaaauaaauucucuccugaauguuuucucacggcaacaagaaagcaaucuagggcagcaguguuagauuuagauagggauuuucucaaauuuugugaucccggggggaaauugcucccuauaaugugaugccuguuagaaauugccuaucuuuguucuuccugauuuuaaauaauuuaauaugaaacaucacuauguaaugaaguggaccccagcuccagucaagaggcucuuuccugcacucaggucuagggucagcauuucuaacgacugccuuuccuucugguguaagaccagaccgacucuaugcuaauauaaucucugccgucuuccuuuccuuccuuuugaaaacaggcccacccgugcuacuauaaucucugcuuuccagaaacccuucuuuccccagaagcccuggucauuugaguauuuaaaugacuuauuuauagaucucccucaggaaguacaauuauucagugauuuaaaaaaaaaaaaaacaaaaacgucuuucuaguuauauuagcaguaagcauguacuaugcacuuauugguuaugaucauugagcaauaauaauugagcuccuauuccugagacaauaaaaagcagcauucagcaacaacagauggcuacuuaggagcuuucaugcaagcuaaaaauggugcucagaaaugaguucuguugcuggcaccaucuuacagauggugaaguggaggcucagaggagauggauuagcacacauucugacuguagucuucgagaacgcugucaggacaauguuuagcugguauuuucauuuuguuuggaauacauugguauggucuuuuucuuuguguguguaaguagcauagauaacaauuuucacuuuggguucuuuuagaaugagcuaugaaugaaaaugauuuaaacacagaaguauaaucucagucaaaugaauguggaaagcaaucacuaaaauccugauuuauaaaaaguacuggaaccuaacaaaauacuguucuccaauauccuuucuuaucaaggucuuuuauucuccauauauucuuucucauauauguguguguguguguguguguguguaugugugucucucucucucuguguguguguguguaauuuaaauaaagcagaauuuaaauaaguuuagaaaaauauuugauuuuuauauguaaauguuuuagcuugauucauuuccaauuacuauccaugaguugugugggcauuauuuaugaugcaaaguauuuucaaaaguuuaaguaaaaucccuggggugaccugaaguggcggugaugaaauugcacacaggacaucuuagcaaagauccucuuaguuggcuccugcuucuuauauagaaggggaaccccacauuugcaccaucaggagagcagcuuugaggguggccagccugguuccauuucucuaaaguugcugcaucagcacagaugugaguguaggagaggaagcuaggguccuauagggauggcaguaccagcugcaacagugguaagggggcagcaguaacaguuaccagcgaugguggggaggaauuacaauggugggugagcaggaucagucauaacacuuggaaccacagcgaaaggggacaugauaauggcaauggagucacagcagcaggagcagcagggacugcagcaggugcgcuagccucgcagaaacaaacacgggagcagcaggacauugguggccgaagcuuccggaggggggccaggcaaggcgcuuagcagucagaggagcacagacagcacgagcaaggggauagcaacggagaguugcuuuucuuacuguaaaugccuuuugaaacuccugcaguauuugggcauuaguugaccagccauuacaaaugucugucaucacgguuguuuuugauguauaaggcgagcuuaguugaugaaaggagaggagcggagaugagaaaaaugcuuuguuguaaguacaggaaacaaggaaggcccugagagccgccugagacuagcauguaagauggacugaaaucagaucuuucucauagcauucauuaaaaaugccucuuuaauuccuuuuaggaugagcuaauguauucaaaugguuucacugugugggcuauaugaguuguuguaaacagcacaugagaugcccggagaaagucgcuaucuggaauguuucuaacauuauacuuugaaauagacaugacagauggaugacuguaaugucugugaccgugaaaugagacuugcugugaggucccaaacucucagcguucugaacucagauagaagcaaaaccacgagaagaggagaagagaguacgguccauucagaugaaaguuaaucggugguggacuagaacuucucagaaucgaccauacccgcugaugugauuuauaguccauaccaagguguuguuaagacauugggauucccuuauguucuuccccaacuagagaaaaaucuacauuuacauauaagaaaauaguugcccgcacccaucaacacacagccuagcuuuuaauguaaagucugcaugcgcauaggaaaagaacccuugagaaaaagcagaauuuagcauaauugaaacgugguuagccaucuggagcagucgcugcaauacaaagacauuugguauuuuaaauagaggauuuggaauucuuuugugucuuuuaagaacauugauuuauugagacuaugcauggcuuuccaucauauccaaaagaguaauggcuuccuaaauaccucuuucauucauuuuacaaaauguuuaauacauuuacacagaaaggaaacuuugagggcauaugaacugaaguuacaggaaauauacaaaauauuuuguaccaagaauucaccaaaugguauaaaauauaaguuuuuuuuccuagggaaaaaaagcccuggauauuuuugaauguuggacaaauaaugaauaaacaauuuuaaggauuguaucaguauuacacuaaguaauucuacgaaauacauuuuaagagcguguaaagugacucuagugauuagucuaugaacuucuaaaauuccauaguaauaauuggaguugauaaacuuaaggcauagaguugagaucauuuuaugcaaaugaauucauauaaauauuucaugaguaaaaguuuuauuaggcucaaacaauuauaaauaacauuucaagugauuuauauuauaaaauaugauuaucuggagguuucauuauacuagccucugacauuuaaauuuugagcauuauuuuaauuuauaucuguuuuauuacugaaauuauaaacauuauuuguauguuuuguuuaagucaaaguggaaaccuggccacuuuuucagugaucuacuuuuauccaaauuuuucaugcagucacuaaugagaaauaagaguuuguuauuucuuguccaaaacauaugaaccuuaucuauauacaucuauauucaucuauauuuauauauauauauagauauauuuuuuauauguauauauaauauggcuuucuaugcuaucuaaccagguaggauaagaucaucacaagaaaaagagaaagaauaauauaaagacuagcaauucccacaaaacucacuuuagggugacugaauuuacuuaaccugcccuuuaaaaauuaaaaaaaaaauucaucaucacucucaauuaacaacuuaaagucugaaucaaugauuacaucuacauuagaauuugcaguuaauugcuuuauuugcuuauuuagaacuaaaacaaaauucuaggauaauuuucaaucucuuucuuuauguuuuuugaucagcauauggaucugauggaguaguaaaauuauuuuuugaaaauaacugaauugcauuuuuuauuuuauauaaaauuguguuuuauuauucucacuaguacaagugaauuaacuuugaggguaugguuuggaaguuguagucauuuaauugaguacacuagcacaugacguauuuuucuuuaguuuuauaccauauuaggaacuguaauaggacuguaucuaacuguaaguauuaauuuaaauagagagucuaaagugugcugccugucuucacagcaguauccugaaguguuccaggacacucuauucucgcuguaugagauguuuucuuugugguuuucuccauacuggagucaagugucugagucuguguuuucuaaguguccucccguuuuggcuaaaggucaccauucucuuagaaucugaaauguccucauugaaguggaagggugagcauauuaccuggcuugauuuucuacauacucuauuagacaacacauccuauucagugugauaaaucaccucauuauacuugcaaaaucuuucuuuuccuaagacauaggauguaggccaccucuccaacuagcaagagcagucacaucuguuauuaagcuguuuccuugcagauauacgacacauagagauugcauacauaaauacagacacaaugguuuaaaaucuuguggauggacacaccacacacacacacacacacacacacacacacacacacacacacacacacacacacacuuucuauaaacauaaaguuagagauguccccugaagauuuucaaccaguuaguguugcuauuuuggaagagugcagaaccuuuuugaggugcgccucuggugggguagaccugaaggauuaagaucugaguuugucaggguugucugcuagaugaacuguccuauaaugacaguaacuuaaaaacaucacauguguggagaguaccuguggaaggcugcacuauagaaagauguaacaacacauaugauguagaccagugagggaacacauaagaaacaaguuagauagacucuuaaguauguuaauuugaaagucuccuacagagaagauuucucucaugauaauaucaaugucaugaaaguauaaagguaucuuuaaaggugagcccacccugaaauaaugcaaaauaaagaauaagcaaacaaagcaaaaacaaccaacagaaauugcacugaucuuguggucauaccauguaacagaauugguaaaaguuuagcuuguuauaugauuuagaaguccagaagagggcauuugggugcauuuccuugcaaaacugaucaauuuaaaauuuuacagcucuggaaacuucuguuucaacugcuauaauguagauuuuucuagugucuauugagcagugcuauaaguugggcagaacaugcccaaaggaugugacauauggcccuggaguuggaucuaccuuggaaguuuaucacuuuacuauagcguaugcaucuuugauucuguuuccuaugcugaauggauuucucaauuaguuagaaaaaauguagauggaaacuaguuagguaaaugacuuugacaguguacucaccccauuaccaauaguuuagaaagagaaggagccucuugcugauuaaucccuucuucgguaagcucauugagguagacuggccaguagagcccacauuuuuauuuacuaaaaauccuacagcaggacccuugaauccccuuggcuucaugauggcaaaucuuauuaagcucccucucaggaagauucccuccuacugcuuuuucuguaggucaugcacacuacuuuggaagguauccuugguuacuauccagauagaaucaguuugucccucaaugaucucaauuuaaauaauuuuguuaucaccacaagugcugugucuacugcauagaauugcagaauccaucucuaccaccuccccuccaaaauuaccgucuccuugaccuggugucauucuucaucccugggcucuucaugucugcaguguugacugcuaaguagauacaaagacacaaacauacagaggucaacugugaacauguucaugggccuugcuguacuuuuguagccuguagaagacccguguugcauccauguauagauaggcagcuauacaucuucuuaaagugagcagucugcaugcacuuuggucacagugcagacuauucaugguaacaaacaccuuacuguaguccaguuauagcaggcugaagcauugugagugaccaacaaguauguguuuacaguugcugagcugagaaaacauccuggugggaacacugggugugcagaucaucuucugccuugaugaacugggcauuucaggugcugaguuugcaauuugggccaguccauguuucuuccacugaugacuacaaauuuaggccauagugaaacauacaaggaaaacuucuuguaaaugacugagaaggaaggagaaaaaaugguggugauauguauuacuuucauugaaguaacuugcuuuccuauaauuuuuuuuuucugguguccagaacuuuccccauaacuagcacuuaaauaaggguaauguuucugauuauuuuuaguggcaccuuacagcuuuucucugccuauguaccuccucucuuccaugcauuauuuaugagcuuggcuucacaucugcaugcuggaauuuauuccacccaugauucagcaggaaugggguguauaaaccugacuauauuugccucuggugcagcuguggaucucucuaaaucugacuugcaugcacugagcaaaucuauguagagcaggccucugauguuaaccagguggacuuucucagcuugggggugcgggggcagagagcaacacucucugcuauaucacacagucagugggcuguccucccucagugagaucagucuuugggagaaggcaaaggagguuuucuuauuuaauuugcuuccagcaaguuccccucacccccuuuucuuauaguuuaaguaaugcuuucuuaguuggucauuagacuuugggaguuacucacuuuguuggcgcagacacuaaaaccuucugucuuuuaacucugauuaguggcacuuuaauaaagucauuugaaguucaguggacugaauuuucuaacuuuucugauguuucuauggucacagcgaagcgaccugcauugaagccucugugcaaucuuuuacaugcaaauucugcaaaaccaugcauaauuuuguauaucugacuuccacaccaacugcagagugugagggauuugaauaaaaguggcugcagcacucccugucuuuguuguuucuccaguuggggugcagcggucugggaaauagagaggcugucaauuuacugucaguugacugaauuugggucuuucaggaucagcaguuugcugauaaagacuuuuauggucauacuuuaggcuuucuuaacaaaccaauguugacaccaccucauuuucuuccccuugauuggauaaucccgguaaugcacgcuauugaaggaaauauuucucggagucaggucaaugaauuuuugcuuggagagguggagagaguuuguccaauggcuguaauuaaaucaugcauggugaacuggcuuugggggaauugacgcguuguguauugcauuacaaccugagugagcacugacaacgccugagaacgaaggggaugaaaaauuaugguuguuuuuuugguucccaagaagccaacgaggcaggucauugacuugauuuucaugggaagcccagcuuugcccugcucgcauauucagagacccagcaaccuguauugaguuugggaaggagcaggcaacaguauugugccaggguuuguugaggagaaacaaggcaagauuuaaaacaaaacccugaauaggaacaguagcccugugucuugcagaugaccgacuuuuccucaguggaauuucauacgagugcccccucuuuucuuaaauaaggcuacacugugguaagaagaauauuuaagauauaauccagugaccugccggagcuggagcagucacaacaaaaggaagaaauaaguugggagcugugaacuacaaauguagucagagugugauccacagaagguggcccugagccaggcgaguacagaagaaggcagauccaaccaagugaaugggggaccuugaauauguuuucccccuaacccuuaguaaacuugugcaucuaaucgcauaggaaaaacaagucaguuauugccuucuucaaguuuagaaagcucuguuccuuucuauagguuuuguuaaucucuggauuuuuuuuuguaaagacuaauuuaauagaaacaaaaccaauguuaucauaggcaggaucuuggcagcagcaggagugggcucacuggggaccuguugcuuccugaguggcggugacaaugaauuaugaugaggcuguguggggacggugacucucaggagcuguaugcuguauggauucucaguaaguaauaggagauacugggcagugaugaaaaugagcauuuguaauuuugacuucccggaaggugauaagaacauuuuuuuuaaguuuuaaauuuuuucuuuuugcaucaaguacuauuuguguauauucaugaaacacaaucaggaacuguagaucauugcugugauccaggcagggaaauuaguaaaccuuuacaauuuucuucuaaucaguacuaaauucuuccuuuauuuuauuuuauuuuacauuuuauuuuauauuuugagaaagggucucauguuauagaugagucuggucucaaauucagugcaauccuccugccucagcuuccugaacacuguaauuauaggugauagucaacauucuagccuuguaccauucauuuuuaagauuuaauaugagaaguagcugaauaagaaauuccucacauuuuguuuuccauagcuuuaauuaaucaaccaaugcuauauauuaccaacaauaucauauaaacucuuuauugucauaauauauaguugucuuaguuaggguuucuauuacaugucaccacaagucuuauagaggaaaacauuuaauuggggcugguuuauagguuuauagguuuaguucauuaucacauugggaagccugguagcaugcaggcaggcauagugcuagacaggguuuuagaucuggcucagcagguagcaggaagagagagcuacugguccuggauugagcacuugaaacaauaaagccuaccccuagugacauauuucauuuaacaaagccacaccugcuccacccaacaugucuauuugucuuaauaguaccauggccuuugagucuaugggggccauuuucauuuaaaccaccagaaugguacuguauauauuuuauuucuauauaucuuucaauauugagacaaacuaauuucauaaaauuuacagagagacaugagaggugcaauggacgucaaugaaagacagcuagaugacaaguagaggaagaaaagacaaaauaggaacauucauaguguucuuucaaagucauugccaaggggucagaaagauggcuucgcaagaaaggcaccugcuaccaaucugaguuugauccccagacccacaauauuagaaggagagaacugacuacugcaaauugcccucuaaccuccccauaaacacuauaguauaaguaccaucuccaaauaaaggaaauagauaaaaauuuaaaaaauaagcaaacaccaaaagauucucuggguggaaaaauagucuugugaaaucuaucuguguauguguguauguauguauguauguauguaugucgguaauucuauuguuggcauuucagagaauaguuuucaauacuagcaaaaacaaccacuuuagaaaaguaauaauuuguguguuuagauguauuucugaaacauaauuuggauuuuauauauaacaugcauagacuaaauaaaauccaugggugcauacauuaaugcagcacccaguguucaucaggaagacauauaagaaccaaucuuuugaaaucacggugguucugaguacacaauuuugaccuuuuuuuuuuuuuuuuuuuuuuuuuuuugguuuuucaagacagaguuucucuguauagcccuggcuguccuggaagucacuuuguagaccaggcuggccucgaacucagaaaucccccugccucugccucccaaguguugggaauaaaggcaugugccaccacugccuggccuaaaauuuggaccuuuaaaacaccagagcuucauaauguuguuucaaggucacaugacugaaaauuauuugacguuuggugaugggugcaugacuaacucauucauuguucacuguggagcuacagaguucucagcagacucacucugaggcuuagcaacuuaucuauucaucgucuggauuguucaagcaguaaaaaaaaaaaaauuccacugugacuccgacaagguaggaaaaggccagucugggaaucaggggacauauauucaagcuucagaucacaaacucucugaacuaagucaauuauauuuggaagucaccaaaaauuuuuuaaucuugguuucuuugucauugacacugaacaaaaauguugcucucugguuuaguuaguucugguccucauuaguuaaucaccccaaacgcccaaccugggacuuucuuagaaccaucacucucaagggaagagcuauuggcuguguacuauauccuuggucauacuucaaggacaugaucuuauguccuuguuguauaaauaguauguccagaucucaauaucccagucuagaggucaucacaggcaugccucucagauguggaaugaggcuccgugugugauaucaucuccauggagguggauuucugguuucuccugcugguuauugcaaucccagggccaagcauacaucuaauagagcaaucuagaaugguuuaguaugacaacaaaguaauucuuggaauuacagugcaguggaaggaaguuaauaagaaaauuguguuuauaauuaaguuuguaguugaaaguuaccuccaccccgugugugcauguguguguguguguguguguguguguauuagguacagcaaaccuaggcaacaguucaguuuguacuauaacauccuguuuguguagauaucuccucauaauauuacugauaauagugauugagguggguuucuuauagaauaaagcuugaggaaauugauguauauuuuaucacaucucaaagaaagcugaagggauaauuuuugauaccaagaagggucaaggaauguaggaauugaguauaggcaauucucugaagagaacaguuauuucuccaauguuuuaacuuuuuccaaccaaagcaaaaagauuaaaaaccaaauagaucaaauagcuguaaggauucuacgcaaugggaacagaaagcucaaggcacugagcucgaugaccugagcggaguuagaucucuggcuucccaaguaaaaggagggaagcaacuccugaaaucguccuaugaccuccacaugugugugacauggcaugugugugaucacacucacagaaguacauaaacaucacaguacauaggaaaaguuaaauaaaaauuugcauucugaauaaagcaaauacaaaugacaaagucgcugaaguuuuaaaaggaugcuuccugucacugaagugacaagcagauuacacauaauggccacaccuuauagcuugagacggauggaguugaaauguagcacauuugugucuuugucccagagaugaaauguguugaaaaaucuaaguuuacaggagguuuaacuucgucgugaauggcuuugacagcugucaacaaauggcaacaggcuuccacccucagaggaagaauacugaagcaaaugcuuaugacgucugaaguuccucugucucauugcuacaguuugugcuucaagagauuuacagugacuuauacaggaaaauagcagaguggaauuauauauugcauaucuagcauguaccagauauuucauuuauguguauuuguaugugugcaugcaugguauauaucuucagggcauauaccguguuugcuuucuagaguucaacaaugaauucauuuaaauuaugguuuugcuugccauucauauccaaucagcuagauuugaacauuauaaagaugcccagaguuaccucacaaacacaacauuuauuaaaucuuacaagauggagagaaaucccuauugacuugagucugaccucacacaauuccagccaugaacucaaugugaaacagaagacacaucugacaucuaaacuugcugacaccauuaaaacgguugucagugugugugugugugugugugugucuguguguguguguguguguguguguguguguauagacugguuaauuucacuuaaaugugaacauagagauuucuauccagugaagcuugguuacuugguguuuuagaaaaauguacauuucauucaaugagugaaaauuuucuuuaugcuucuuuggagaaggagagaaggucagcuucuugcagaaacacaaaggaucauaaauuuggauucuagcagcucugggcacuucacaacccauuaaaugcacguguggcuuggcuauguuucucuuuggucagccaguguuuucuuucuuucagcagaguaugaugagacauuuggaguuuuaucucugcauguaucaggccaauuaguaaaacacgagaaagucauagaguuggacugaacuucacugaugucauuuuaucuuuguuucccaaaaauaaaaaaccuaagcuccauuguccauuguuuggaugaccauuuuagaguccuguccuuuagcaucgauucaugaaaagugugucucuccucucucugacuugguuucuuguguucagcaggaagucuuuccucucucuuacuugguuucuuguauugagcaggaagacugcacuuggagcuuuguaagcaugaaagccuaggaaggaagugugccuugugcagccagcauuuccaggcaggagccugcgcuuuguuuacugugguucucauucaggccgcauguuccuaucucuaaugagcuuuggaggagcaccuuuguccagcacuggccuccaggaaggcuuggacccucacaagcugggagaauggauccuggcugccauccacaggaaaacagagcuuuacagaccuccugcugcuuuccuugaaaguccccagccaugcagagccauuuaguguuacuauggagggacacugagcagaaagguuguugagcuguccccuuagccuugccaguuaaauugaccauuacauuugcugaaugcccaaccuccaagguugcuggaugucuuauuacauucccucuggacauucugggaggaaaggauuucuuuaucauugcuguuguguuagaggugauaggauguccuuagaggacccuggagugguccuacaucaugcaguagcauauagauccacugaagaggucaggcugugugguuggucagguugccgaaaaccucaucucugguuuucuaaauuuuuuuuauuucaucuuuacacaaaaaccuuacauuuaaaggcucuggaucuuaugacugucugaguuggauuaaaaucuguaaauuucaugccacugauuuagaaauaggcacauauuaaauccugaacuaugucccuuaccuggccaucagggcuuacuuugaagacugucauaaauuuccuuugaauguagaguuuggucagugugcuuuugugcuuuuaguggaacggcagcuaguuccagaagugucuacuguacauauguuagcagacaaagccccauguccuuggaaaccacaaaugucacagccuguuuuccuuggcuguccucugcuggugaccaagacuucacuguggcugucuuguuagcauugaguuugcuuucauauaucugcuacacaguggaucugucuucucuuuuccuuuauuaaacauaaauuuauccuaaauguguguucaagaguguuguucugagugcaacagauagugcaaucuguccagauaguucagauugccuggcugggucuauccaacuggagugcauaugaacuugggggauggaggcauauugaggaagcaggauucugcuguaacuuugcaaucuuugucaaugaaagucagaaauggcuucagacaucuuugaguaugacuccaguaacuacauucucauauucugaauuuuuuacaaucauuacauguucuuuguuauaagauucuucagaauuucccaauuugcuacaaguguuuggaucuugccaacuugagaugaacuuugcuuuaagaaauccuaaacuuuauggaccagauuuaauacccaauuuucaucauuucagcaaaggagacaauucccauagaacauuuuacaguggcauucccauagacaacaggggugucggcuuuaagacgugcuacaauguaacucuucuuccuucuaaugaauugggggcuugcaacuccagguggauaggguaaaucaccaacgugguggagagcaagcaacaagaaggcaggcauggagcuggagcagcaguugagaguucauucuccuuagacaggaagcagagaaaguuaacucaaaauguuagaaauggcgucuuuugaaaauucaaagcucacccccagugacacaccgucucuaacaaggccacacccccaauccuucccaaacaaacaaccacaagccauuuucugaaaugaaauugggguugccugccucugacacccucaaucuuggcccccaaguauauaaaaugucagcuucaaggucuaggcaauaugaccacaggaaaguuucugcugauguggcagaauuagaagagaguuuuauuuccacauugcucuaccaccaacggagugccaugcacacagcugaagaauguguuuuuaauuccaauucaccaucuucaguacuacauuguuaaaaugugaguccacuuuagcuuggagaugcuuucaaauucuucugggauuuuagaaggacucaagggugaauucuuaaugaccaauaaagauuuccaaccagauuuuauuugucaagaaaugucuaguucuauagaaaacuuggcauucagucagaaugacauuuuucuccaagcaguuuuacaacaaguggaaaaugaaacccagcagugucuggugacaaucggcuacagaagccccgcccacacagucagcuuuaacauggagauguucuuucucucccuuuggcaucaccauacauacaucugcccccuguugauuucccuggucuuauguuguuuaagaauauguuauaaauuaacauguuucuuuauuucccuuccaguuuacaacuaugucucagauugacucagaagugagauaauuaugcuuuaaaguaaauccuuuaaaauauauaguuacaauccuuugucagucuuacuuaauguaaggcuugacaccagguguaaaacugaaauugguguauuauaauagaacagugcccugucagaugucagaauuacagaaaaucucuaauuaccaucaugaagagaacuguugauuuuauagcguggcuuagcccagaaagacuguauuaaaaacaaacguuuguuuuacuauuuagaguagucuguauggucucuaaaaauucaaaaugcagaauauucauugguuggaccaugguguuugaaauuuuacaaagucaccaauagagagugugucuccccaaagggcucagaaauauuccauauucucacaacgcuucucaagacagagugauacuuaauauucauaucugugaucuuacuaaacuuuccccaaaugaguaaaaaucauaaggugaacaagaaaguucucaaaauaggguuauaauagugagaaaugagauaguagcuuagguuaaaaacaggucucagaacauuauuacuaaguggucuuagaaguguuuuaacaaaugggcaaauagcgauuuuucuccaucaucugaugucaaaauuaacugaguuuuguuuuaagguauuuguuaauaauggaaauuuuuauuugugauacugaguucauauuuuggguuuuuuuuuuuuaucuaugaggaaagcaguauuuagaauucuccaggcugucuuuuaagaugaagucaacuuucaugauuuucaugacuuuuaacacgugguuggcugaaaauacacuggaucaccgccuugauggucggacuugagagaauuaucuuccuuucuuguguaguguacaauagucaauaacuacauaacuaaugaggcuccuggaccauuacaucuauccaggaaaagaaacuaaaccauuaucccuucaaagccaaguucugugcccgggaaauuacaccaagcuucaaaccugacagggaaaaucaguggaagcugaaaacaggggaccacugaagagagguuaucagaucauccacgcccaggucacugaaaguggcuaugugacagucauagaaacuaaaggaugaaucuacaagcucaguuuucccucuuuuucuugugugcguaguguacauauauguuuaugcacauguguguaugcaugugugugagccaguaugugcauaugucuucaagugcaugucaaaguucagcuucuacucucuuccuacauugcuggucaccuuauguucuaaggcaggaucucucacuugaauccagcacucauugauucaauuaguauacguagccagcuugcuuugggggucccaugucucugcccccugcacaccuguguucaggguuugacacagcccacguacugcauauacaucuuucaugauacagguaaaauaucuuauacuuuuuccauuguucuaugaugaggagauaguguuucaaauugguuuucucuucucuaagccaaucaaugaacucaacagacauaguaugaggagugccuuguggaagagaaaaacauuugacaacgaugguaaggauaggaaaaagcauuucuagugauuuuucaaagcauuguuuuccugcagggucaccuaacauuagcccagccugaacauaacccauagacacacagcauuuaccugccauuaggcugauugcaccagggccuucugcuggggcagcugugcucuuugauuggcauuauuaugucucugaggagcaccccucugcuaggacccuguuuugcuuucugacagcagaauuuuuuauucaguagucagaucugcucccgagugggagucugagcaaagcacuaucacccgagaaacuucaaagaacaaaggagcaacccugaucuugcucacaggagccacucgggugguccuaccauauaauagugucuccuggcuugcauucccaagcucacagagcaaagucacccaacagccauacggccucaaaaucucggcauguccucaagcuggaucuguaauagagggaaagaaauaucugcuucccucgggacuuugucuucaaaggcugacuagacuccuacucuacagauuuaugacaugucugagccaauauuuauuuuacucaguugcuugagcuaauaauauauagcagauugguauuuacagaagcagccugaaguuucuuuguuugguuugacuuuaccgagaggccccacucaaacagaugguccugacagggaugcucuuuagcuuagagaucuaagucugcuuauuuuucugugcugccauuuaugaguugugaaguaaacuuaaugcauuucaacagauccuauacaagucagaugaaaaggggcuugggggcuagagagauagcucaguggaugagaguacuuaaugcucuugaagaggacccauguuugguucccagcaucacacagaggcuccugacuaccuguaacuccaguucuagagggucaaguugccucuucuggucccugcagguagcugaauacauguagugacauucauauaugcagauguacauauaauuuuuuaguauaggugauuagaauugauacuauacuaaaguaaaauauaauugagucauggacuauucuaauaauucaaucaaauaucaaauaguuuggauuaauauuauuugguaaguaggaauacacaugcaucauuuaccucuauagacaccaaggauauaaagcaaauauaauaauuauauaucacaaugaucugaaagauacugugauagcuacagugcagauaccaaucaacagacagcacaaucggauaagugaugaauuaccuuauguuacaggaauucuauaauaggcauucaugaauccaacaccauggaauuagauuuucuguggaugucauugcaucuauguguuucaucuauuuuauuuuaucauagaggucuuauaacuaaugaauaaaauaaaaggcagauauaucccaugauauuuauaaaacaccagugcacauuuucaugagcaaaacugaaccuacugauucucaacuauaaauaacugugucucugggccuggguaaccaaaaauaauuauuaagaccaucucaucagucacaagaucauaaacuagagugccauaauuguuuccagagaaucaaaaugucugaauaagcuauuuuuguuuuauguugaguuuaggcaaacauucagucuuuugauccagagucaaacugucaucuguucccuuacauugauaagguuccuaugagcaaagcuuagagcagaugucucucaacacagaaaauauguagauccuuuggccuuaacagcaccaauagcaaaaacaaaagaauuaagcagaaucuugaugauaguuguuuuauuaagguauucacaguguuagcuaaaugaaacuuccuuggcugagguccccaccucagcugucuugacagcauuguccucuccagccuagauauuaaagaugccauuuggacaguucuccaguaaaaauuuuauucccuuuccuaaagggagagaaaauaauuucuuucucuacugugcugcucagauuuaaagccauugugcuauguuugauuuaaggguuuggggggugucagucccuucuggugggguggguagugacuguggagggucuuguucacuguucugagaggcuucauguagacucugcucuguucauuguaugguaaugacguaauggcuguuuccaagagaaaugccucucaacuucacagaguucuagaagauucccuugcccccugguguuaguuucuucuguaauugcuuaacauuuacauaaaucugagcagucuuucuucugaguuaagggagacaggugugggggaucccuaucauuacagcgcguguuuaagaaaaggcaugacacuucccacugccccuguuuccccuuuauaaagagaaaaacugacugcaugguuugaacucugucuuuaucaauaaccgaggcaugcugccuuuucuguuacucagugagcccugagccugcccaaucguuuucuuuugcucauggguuccagcauggagcucugagaagcagguucaaaauuagacucauuacucucacucucagagcaccaaguuccccuuggguagagaacugacucuucacaggagugcuuuccccccaacauccucuugaagaauugcucucucucucuauuggagaacugucuuccaucaccuuaguacauacaagugugcuguuuuccuuucaucuuggccuucucuugguucuggugucuucaggguguucaccuuauaucuugccucuucuucaaguaggacauucucaaacuucaugcaucucccuccucaguacaaagcaccuugaagucaugaucucucauauaaguauugaauugacaaacaacuuaaucagacuuuucaaguccaagacccaagaaacaacaucuauccucagggagcuuacagucuuauaugggaagaugaccaaguaggggucaucauaguucuuuugguuuguuugcaugguacagggggguguaggcacuuuaguuuguccuugucuguugguguaggggaggauucaagcauggugaaugugucucugugcuuuaggauuucucuccauuuguaaccaagcuucuaagggaggucuacacgugaagcuguucaggguggugggacuauaaaagcaugaagcacagagaaaggaaaugaguggggcuggacaccuuccucugaggaauggaaugggcaggaaaauacuggaaaacucacaagacugcuuuuucaauaguugggggagacuggugaaauacaaagucaucauauaguuagggaagaugguaggcaguuaaaaaccugggaagcuacugacagacucauuuacuacugcuaaguaagguaaagagaaaugcuucugaugacagagaacucuaagaucuucuucccuucccuucccuucccuucccuucccuucccuucccuucccuucccuucccuucccuucccuucccuucccuucccuucccuucccuucccuucccuucccuucccuucccuucccuucccuucccuucccuucccuccccuccccuccccuccccuccccuccccuccccuccccuccccuccccuccccuccccuccccuccccuccccuccccuccccuccccuccccuccccuccccuccccuccccuccccuccccuccucuccuuccuuucuccccuuucucucuucuccccucccccacuucccccuccucuccccucuccuuucuugucuucuuuucucuuuaugccaaauuugaguuauuguuagcuacagaagcuacccaaagaaagagcaagucgcucuguucauaggaagcacaggcucugacaugcucaguucuuccaacuuuaccaucauagaugauguauauaaacacagauuuacuucagggaagaagagucggaauguggggagagaagguguucuauauagaaaagugacuuuuuuccugcucuuugguucuuuuguguuuucuagucucuuuagucauguguagucauaucauuucaaggaugagugauuccaucuugggcagacuuuagaagagaaauuguucuuuauuugauaauauggagcauguggguaauguuucaauauacaaauacagaccuggucagugguuuucuuucauuaggaagguagccuacagagacagaauuucagcuuggccaauucaauggaugaguacuggauggcuuuauuagcaaaauagccaguuacuauugguacaggauuuauuagauucaucgaauuaaacaauuucuagugaaagaauaaauauaagaugacauccuaaacauguaaccuucucuggaaacuccuagcugugacaauguacucaccagggagaagaaucauuuucuaguuugacauauuugacuagcuuuuguggaagaugugcaucccucauagaucaguagaaaaauauaauuguccaauuaggaaaagugaauuucuauuuuaguucaaaauauaagaaaaucacucugaaucaucagagcagaggaggcacagaauguucuucaugcacagguauguucuuugaugggaauaagcacgcucucauagaggcauguacagcuagagagacagcucagugccuaacagcacacaguguucuugcagagguccaggguguggacccuaacacccugccugggugacuuucaaucaccugcaacuccaguccuaguuuauuugacacccucuucuggcuuccagggguaccuucacucaaaugcacaugcacaugcacacacacacacacacacacacacacacacacacacacagaauuauaacuagaaagauguuuuugaaagugugauuuguauauuggccauagucuuagauauaaugaagagauagacugaugaucagagaagagauaucagagggaugugcuugugugugugugucugugugugucuguguaucuaccuaccuuagguagacagauacuauaaacaagaauggaaagucaaguuuacucuguugguauagaauuaugaaaacccugcuugaccuguguuuugccugcuucugcuuuguaggacuuuucugcugguucauuuaguauuuguuacuagcuuagaaauaagcuuuuuagaagcaggaugaagugcaaagcauuuggcaagaaaugagacagauucugauguagcauucuuguggaggaccuuggccugucucugaugcaggauugugugggguugggaaggugggcauggguugaugucuguuuagggaggugaggcugggccagugcaggucuguagugggcuguacaacuuccuggguaccauggaugugauucugaaaguuuuucacuccagugccauuuuugauuauuuaucuugguauuuaaugucagugguuuagagcgaggcuccacaacauugccaauaaccauccaugccguuaaaauaugagaaagacaaaagaaaugcaaacuggagagauauuuuagaacagaacuggaacaaagccaaugagacugacuucguggaguguuuggaggaaauccagguagucugugauauuucccuagugugcacacuugcacacacacacacacacacacacacacacacaaacauauccuuggaugaaaauuaacucuuucuauugagguugaauuugagacuuucuugauuucgaaagucaaaacugagugcaaauuaagaauguugaaaguaugauaaaaauauaccguacgcucacuugacuuuuggcaagaccucacaucugucgagaaugucaagauaggaagauauccaaagcauuuucuuuucuuuuuuuuaaggaaagguuggauccuagccaaaugccugcugaggaauucuuaggagaauuucuggaaacuauaguuuuuaagguaaucauauccuccaugcuuuccuggccccagauauuacuggagugguuuuaaagucucauuuauuugugucuuguucauccuuuagacugagguggucagauuucauuuuggcaagaugacagagggaaauauugugcuuggcacuguucggccuucaauuucuuugcaaaugucugcgccaaggaagagguauuuugugcagcuuuagcuagauauuuuuuucucucucuuuuuuuaauguuugaugaguaugucucuuuguguuagacaaaccuagaccacacguugcuuuuccacuaaacuugagcacauaucagacacuugguacacauuggugcaccacuugguauugugguggggaggcacaagagagaugagauuuuagguuaaccagcagugucuaaucgcaacuuaacugucaaaucuuuucuuuggguugcaccugugucucaugugcccuggacuggccucaaaguugcuguguagcucaggaugaucugaaaccuucuggccuccaauacccagcugggguugcugggaagggucacuacaguguuuacuguuuagaauuguuugaagacaguugucuaagugugauggaacaacuucagccagccaugaccaagagugaacaaaaacucccaacuuuucugcagccauuuucaugucaaucucauucauucauuccuuccuuccuucauucauucauucguucauucauugauucguugauuuacucuucaacauacaugguagauaguugcaugauacuuucuaaaauuuuugauaaaauacauacaaccuacacuuccuauuuuaaccaauuuuaaauguauuguuuaguggcauucaggaccuuccguagcugucauuauuaugcacugucugugugauuuuggcuucugacaccaaggccuuacacucacuggacagucacccccucugaugagcuguguuuccagaguuggacuauucuggugacaggcacaaggagcacuguguuauaggugcuuagucccugggccaugccgcuugguuaguguguuuugugcauaucacugcaaggucuauuuggcuucucuuuaaaguugagugauauguguuauauuaaccucauauauacaacacaccuuguuagccagaagagacacucaggguccuaucuuuugcuguugagggacucuugauuugagauaugugacgcuaaaacaaugcagguucaaggugacaggcccacacuagguuuagagucaugacagugaguguucugugaucaguggaccaaaccuugugugauguggaucucuauucuguauggcugagaugaaauuguccuucaucucaccauugccuauacuuacuauuaaacacuuaucuauacuaccccauucuagaugcucccaugccuccuauuauauauaaauaauauaaggagacugggggacuucaaagcaauauggucacauaaaucaaguguccuuuaaaccuucacauugggccugguaggaaggucauucucauuaaauucauucugaguauucagagcacagacagucuuuccuucuccaacuuaugguuuaaguacacuaaaaucuucauuguugagucucccuuuagccaaauccaaacauuuaacauuuuugaaguuaagaaugggauauucuuaauuucuugcucuagggauacacaguugguauaagugaaggcauacacacacacacacacacacacacacacauauaugcauauauauauugauuugcauucugcugugcuauuaagugcuuacuauaguaaaaucuguagguacagguccuuuuaauuauagaaucagggcauguguagauagggauagguugguucuuccuuucccaaguuuauuauuugugucuuucacuugucuaucugauauagcugagacucugagcccuuuauugaauaagagaggagagaguaggcauccuuauuagguuccugaucuuggaggaaauagauaauaguguaacugacagugacaguguaaaaccccaauugaagcccuacugauccagaauugcuguucuaacugcaguuguuugccugcauuacaacaaagugauucuuuguuaauuggucaaaauaacaaaacgaaacgaaacaaaacagaacaaaacaaaaaauaccccacuguccagcacugaaaccaugcaggauuauucucacugguuacauggugcugcugggugcuggaaaugaagagcaguccguaagcugggagguguuacauagccuagugggcuguguaagaaagaguaccccagauguggcccagagucagaugaacaagugcagagcaaaaaggaaaacaaagccaaaagcaguuugggcucguaacaggcugcuguucacaggaugcuuuuaguuuuuaauguagguacaggauguuggacuuccuagcagcacugaagucucagugguggacaggguaccaaggacuuaagaaauuaccaccagugccuuaucaaugucaguuuauauacugcagauaagcaucugaucuaccuuacagagucaagccaugugcagccaucuagcgcucagggcauucagauggacccucauuuuucucucugugccuuuguaagagcaucaagccuuaggaugugugcauugguagacagcacaccuccuuacagcugaauacaauuccauuguguguauguaacauauuuuuauuauccaucaauugauggacauauaggcuauuuccauuucuggucucuuauuaauagagccacugugaacaggaaaguguaaggaggauaucuauaguccuuuggauauaugucuaagaguggaauagcugacucacauggaagaucuaccucuggauuugugggggaccuccacacugaccuccauccuggcugcaucaauuuacaguccuaccaguguuggauaagcaggccacuuuacucacauccugcaccacauuuacuguccuuugucuccuugaugcucaccauucugcggggguuagaaggacucuuggggaaauuucaauuagcauuuccucuagccacuagaauuucuuucuuugauaacuuugauaacuaucuguucgguauuauggcccaguauucaaaauuguguuguuugucuccuuauucuguaggcugugucuacacuugguuuacacuuucauuuguuguacaaaacuauuuacuugugugauguccccuuguugaucauuacuugcaugcuugaguugcuggaauccuauucacaauauccuuacauaugccuguacuuuuaauucacuccccacuuuuccuucaggcaauuucagcuucucaggacuuauucagaggauuugaucuguuuggacuuggcuuucaagcagagugagagaaaaagauuuaguuuaauucuacgaguagcuagucaggauuccaagcauuugucaaagauucugucuuuuuccauuguguauuuuuuggucauagauuaaaaguacuaggcaaauguagauguguggacuugcauccuaccccucuauucuuuuccauuguuagugagucuuuugugccagcagcaugcuguguuucuuaugaugucucuacaguguaacucaugaucaggugugacugaaccagaccagcacugucccucuugcucaugacugcuuuccuuaucuggugucucuuguguuuccauauaaguuuuaagagauauuuucuuuuccuauuuuugugaagaaugucacuagaaauuuggucgggauugcauggaaucuguagacucuuuuuggugugaucgaaccuuucaggauguugauuuuuuucuaacccuugagcaugagaaaucucucagucuucuucgauuuucuuguucaguguuuuauaguuuuuugguuuuuuuuuuucacuauagaggccuuucacucccuugguuagguuuauuccaugguauuuuauuauuuuucuuugaggcauuaugggugggaugcuguagcugaacuaaagguuuaggucuuacaucagggcuuuugaucuacugggaguuaguuucugucuaaggugggagguggagaauuuauuuucauuucucuacauguggaugcucaguuucccaccagaauuuguugaguggcuuucauuuccagcauacacuuucauaccuuugacucaccacucgucucuguagaaauugacauuuauuuguuauuacggugaacaucaauaaggcuugcucugcuaucccagaaccucuggcugccuuuccauccucugcagccaccccgagucuccauaacagauagguucaugggggagugaaccggcaaguuacaugcagcaguauggcuuauucauaagcucggggcaauacagcauaucucaaguaccaggcacacuucaggacagcagacacugguuuuuuccuuuuauuugugucuaaacaaccauuacuuagaacauuaaauuucuggagaaaauuaaggaauugaagccugcccguucccaaugcaccugcucccuucccugucaguauuguuucuuauugaagagccccuguaccucagaagcugacuggaaugcacuuccuccugccucucugaguagcugcagguggggcuguucuaggcaaagauucaggcagggaacucugguuuggacuacagauuucucaucucugacaccuccacuagaaaugcaccauccuuuuccuaguacuagagguugacagagccaugugguucuaggacauuucaacuuucuccauuuaugacuauccuaccacuccaaucaagcaucauaaaugaacuagucaugaggcaaugggagaacuaacaaugucaguggaagggacacacagauauuuaugaggagggaugaagaacuaggcucaaucaaucaaucaaucaaucaaucaauacuccucacaaauucugcuuuaacacaugucugacauuuucaguuuucaagagugugcacauguguguagcuguguacaaguguaugugugcaugugugugcauauggguguauagcugugugcauguauacauguguguauauaguugugugccugcauauguguguauguguguauauguaugugugcauauguauguaacugugugcauguguguguuuauguauauauauauauauauauauauauauauauauauauauauauauacauacuuggguguguagcucugugcauguguuugugugcaugcaagaguauguguacaugugugugugugugugugugugugugcacacauguugaggcuagaguucagucuuggguguuuuuccucagaagccauccaccuuuuaccuuuuggcuggguagucacucucuggcugguuuaaccaugaaggcuagccuagccggccagcaagcuggaacguuccuucugucucugcuucaaagcucuagcauaaccagcaaacacuaggaugccuggcuuucuuuuauacugcuuuuggggcuggacaugcaguucucaugcuugcaaagcaagcucuucacuuuauggucugccuuccagcuuuuccacuggucugaggagaugcugacucugcaucacgauaucuaaagcccacuaagcaagggaaaaaguggguucccuaaucuccacaguacuuuuucauuuguuuaguuuuuauaaaauuucccuuugcaaugugucucccuuauucagaucaacaucuaccgaaaagagcacucugggaugcuuuugcagggugcuugguuuguaggaacauaaaaauguccucaaguuccacaugaaagccacacaucuuuuaauuccaucuucuagucugcacauccuuuagggcaugugcagcaaucggggcaaauguagaauucggcagugucgguuuccggcaaaguugacguggguacauauggcagcuuuagaagaauuccauauuugguucugacuugagcaacccugagaguaccagggcuccagcuucuaguuugucaccacacacacuuagugagccauggcaagcgcgcugccuccagaauggacuuaacugcuuugugccugcacccccggccacccucaucaccgcuggcuccccuccaagccugccugcuacucacaaguauuucuugccuaugagaaaugcaucaaaauuccaagaacagaugcugcugacugcugggagaguuuaguggcgagagauuaacauaauggcuuugguuuaagaaauuuaauugggcauggucacauccguguagaguauauggguaacaagcugugccuugaagauuuuuaugugauuuuucaauuuguuuuaaaagcaaaacuaaagaacugaaaaugcacaugcuuccuucuucccuaauguucaguagucacuggacuagagcaacccaucuuuguauggaauaaugcacagguaccuacauaugccugugauuucauuuaaauugcacaaaguuucaaaugcugaaaugcuuaguaacuuaguauaccccaaaauaacuuaugacuaaauuaauuuuuaucaagccuuaucccuuucaaauuuuacuuuuucuaaauuauuucuuguaaaauaauguauaccugauauaacgguuagcuauucauuuucuaauaaaagucuuaugcuauuuuaauucauaugugcauauaugugugcugugcuaugugcaaauguguaugcaggugugcaugcauguacagguaguacacgugugugugugugugugugugugugugugugugugugugugcaaguguaccugcuaauauauguggaugucagagaacaaucuuggguguugugucucagaagugguccacuauuuuaaaauuuuaaaaaauuucuugagacagggucuuuugcugggucuagggggacuagccagggagucccaggcagccagcugucucuaccuuuucacaggugaaguuacaagugccaccuccaaguccacgguauucacauagguccugggaauugaauuccuugugagaagaccuuuucaucuuuaugagaaggccuuuagcgacugagccacuuacccaaucacccaggcuuuucuuuuagcuagucaguuaaagaugagucuugcucucucgcuuaggcuaagauugacuuucuggacagccacuugccuaggccucccaaauguaggacuuaugguucugaacagccacaccuggcuuucuuuucauucuaaaguggggaaagagauggccucuagcuagauagggagcucagcauuuaugagcacucauugcucuuacagaggaccuggauuaaguuucuaacagccacauaacagcuucuaacuguuuguaacuccuguaccaggggauccaacacccuuuucuggcuuccuugagcaccaggcaugcacagaaugcacauacagauuucaguuuucacuagugugauguuagcugaggcagaacauaauuuucagcccccccuggcuuuccugacaccucacacacagcuccugccagacucuaaugguaugugaugugaagucuuuccuccaaagucuaauuuccaugacaaggauucccaguucuuaguucuagaccaucuucaagaugagacauacacucuuagaaccacaggcuguggaauugggucgguucuaugugauaaauaaauaaaugccugagcauauugcucauaggcugaucaugacccugugugccuccauaguccaaacgcugugguccugacauuugggcauuuaaauguaagcuguuccuuguuaagaccuucucauaacuaaaaugugagucacucccaaacuguaauggaaguuggcccugcagcaugauaaaccaacugcucagaacacaggguaagcuuugcccagacucaugacaacagaauucccaguggucgccccaaauagggaaaggcccgaggaacaaacugaaagcagucggguggauccuggcaccauccuuuacagcagcaucguuuuuccuuuuaagaaaugaaaauucgcagaggccagagccuaacaguacagcguggaacagggguuggguguuuguuacacuuaugauaaguuuuaaguuucuauuugagauguuaaccuggagucagucauguguucuacugacaaagcucuccuguuaguucaucuacaaucaaaagccaaagcaaaaccaaagcagaguaccaguguucuggcugauacugaacuagcacuugggggguuauuacagccgguguaggcuuucauauaaguuuaauaaacaaagauuugcucccagagguucacagggcauaaucaaugagccgaucccguggaaugaaauaaaucacguagugucugguucuagucaggguagacauuaacacauuuaaaucuaaauucgauuguguagccagaguggugauucuaaugagucacccugcugucuguguaauaacuacugcucucugguuuccuggguagacugucagcuuccacgucccaucaaucgugggcuuucuguacagcuccguccaggcauuuuaggaaauguaaaauccacaugacaccucaggucaagcaggaaagguggcgcuuuccucuuuucagggccagaggaagugagugauuagacaugaggauugaacagcuccugaggcagguuucaauuggacuuccauaaggaagaggggguggucucuccauaaugaagaaggggugggaccuccauacagaagaggaggugagcguuuuucagcauccacuucagugugaugaaauuguucuuaguaagacuagaauguuuuccucggugauuuucagugguguguacccagucuacaugccuaugacugagguaccauuuagcaaagugucacuggagggucagcgugauggccugcucugggccaugcucacuggaauagcccuguacuguucagcuuggcaggcucugccauggugcugggcccuacugagggucccacaugcucucugagauggaacccauucuggacaagucauguuuaucucaagcccugcuacuguuugagucaugauuaugagcauggugucaauaucuuaucacagcaucuuuaguagcaccaagaaguagcacugaccugauggucagugggaugcaaaggggcuaggagagcgacaggaugggggcugguucuuucuggcuaccucuguaggagaacagcuucaaucaguauguuccucauguuucaguagcaggucauugaaaacauauaaaaacaggguugcuuuaaaugaccugucccuaaaagaaagauucuguuaggcacaggaggguuguaaauaugaacaagacagauuuguacuuuccaaaucucugaaucuagaagucacugcuuugaguguugcuaacggucuggggaacuggagagucucagugacaggcugagcgucucgacucugaugaucuaaaguacuuugaaauacacaguguuuuaagcaugggcauauugccacaaguggaaaauucugcaaucgccccugggaagcagucaugacauaggcaaacagaaaauaugucgucaaauuaccuucagcuguguguagaagguacauaugaaacaaaagugaaugugguauuuagacuugaguuucuuaccucaaauaugucaauauagucuuucuuacaaauguucccaaaucuagaagcagcagacugccaggaaaucccugaccccaggcuucuagaguaagcauugcucagucuaugacaacuucagcagccuggggauauauggagagaauucugaccuauaaccuucuauuauugaaagagauuuuagaaaaaacaauucauuagaaguugcaccuuucgggcuggggagauagcucagaggucaaaggcauauacuacuaauucagaagggccugaguucaacucccagaaccugugcugaguagcccauaccugucuauaacuacauuccuagcucaauugauaugauaccuaugugagugagcacacacaaacacacauacacacacacacacacacacacacaaacaugcauauacaaacacauacaaauacacacacuuauauaaacauacacauauacacauacacaauuaaaacaauccuuaagaaauguacuuuugcauaaucuugauguaauccuucaauauccacagaggcaaugcaugugaacucuuaauguucauuuuugaugcaaugcuuuucauaauuuauauaaauccaguuaucuaauaacucauaugggaucugacuauagugccaguuccacaaagauaaaaugggauguuauaucuuguuuuccccucagucacacauggugugacauggugugacaugguguggguugcucuuuuauaguuugugcuuuuucugucucuccaacuauuucccuguuaguaguuucugaagugcuuaaaagaaacuuaccaguuaggaagaaaacauaucugauuuuuaaaguaaucaauuauacuuguaucuacaccaugguaucauuuguaauauacaccccaagcuucccacugaaugagcaauugagcuugguguagugcaaagacagaccuaucaauaucuucccacaacucacaggugaaauucuuaaaaauggaaaaacuguagauaaaaucucucucucucucucuccccccucuuccuucuuucuuucauuuucguuuucuuucuuuucuuuuucauuucuucuuucuuuucccuuaacacaauagcuuuccauauaacuuguauaugcuaacuuccucaaacauaacuuucacgcugcuuugaauuaggacauguuucucacagcagguuucugcuuuaacaccaagggcagaggccaguggcuucaggcgcaugguugagccugcucagcauuccagacucugcauuuggcugaagaaaauucaaugggcccugggccuguggccuagcauuguuuuucuuagauaaagcacuuggcauuucaaugccuuggcucacacugccugugaaauaaaggaaccgaacaugaugcucuuucagauuucuuaaauauucauacaucuugcaaaugaacagaacucugaacuuucagugugcuaagcaaccuacagucuuacaaacaauacaaaccaucuuucccacauauugagaauuucuuuucaggggcugauaggaggcaaagacuuucaacaggcugcauguucuuccuccgcucugacuggugccuucucuauuuucauagcuacaguaaaugaacuaacauaacgcaaugccacacaugguuucaggauaacugugugugcacauguguuugcauguguguugcaugccaguaugcacgcuugugugugugugcuugcaugcauguguauguguuugugugugugcaugccuguguaugugugugugugugcgugugugugugugugugugugugugugugaacagccuucacagaagccaggugugaaguugugaaguucccaagcuuaguaucaacccagagugcaguucaugucagcugcaagccauacagagcaguguuacuaugaaaaccuguguguaaccaacaaacacagugagugauauuugaaaaauauauccaagcuauaaauacauugucacacauacacaaauuauccucuucuggaaucuggucuguguugccugugguaugcucacucaugccaacauuugucauccagcuuuuggagucuacgagugcugagccuguguuagccacaacaacacagaagaaaagaggacugaacacucuuccuuuaagggaaagggugaaaugugcuuauggacauacaugcaaauugaagcacugauaucccccuugucuauuggaaaccaacuguugacaucuuggggcagagaaaucugucuccucacccugaggaauuccuuaagcugucuuuucacauuggggcagucauuuuucucagcacagaaaagacugugccuggcucaguggcaaguuuucuaugucaacaguuucuauccugucuggaugaagaugugggaugauuuggaaccaaacauugaaaguucagcaaagacaacaugaaagcauaauuaauacuauaauuuuaaagaccuccuucaguauaaaccuggucauuuuuuaaagaugaagucauaguuaucauuagauuucugaaugaagagagugcauguugaaagauacuuucuuguauuccauguucauuuaaaagacaaaccucgagccagcuguggaggugaguucugcugcuggccacuaccugugcuguaauucuucugggaguuugcggagaugccucaguggguacagcucuaguuuaaaaaguuuuuaaaguucuaguguggggagccaaguucgaauccuagaaagucauauaaauugggauacuguagcacauuuguaaucccagauucccuaccccaagaugggagguggaggaaggauacugucugggugaguuagcagaucuggagaauacggugaugaacacgagacugugucucaaacaaggggccaaguauggaucaacaccaugaggauguucaugaauguguguauaugucucucaaaguuuccuacacagacccaugauuuugagaugggggacugaggcuaaaagaauaaaaguauccagguucagucaggagaagggcagagucuaauuuguuuguaaacccaccacauuuggaaaucugcucugauccuggguugggcugucucuuccaaguucaguuacagcugccauggaucucugcucagagggaggaugaagagagccauugcuauuggacagacaaguugugggcuucucuugccuuugcacagaugggguugggucauuuguuggugagcaaaucucuuccauuaagauggagagaggcuugaagcaauuauuauguauucauuuuauauauuuucuuuauuuaucgauuguucaucuacuuauuaaucuaauuugccuguauuuucccaacauauuugaucagagagugacauuguauccacccaagucucucuuccucuuuccugcaucccuugaggagcuccguacccucuggcuggcccccucucuucccauuccucaucuuaaucccuggaucucauagggucuucacaguagagguaugaacacuggcaucucacggaacaccaguuuugugagaaaaaugccauugcuggcuggcugggcuguccuucucaacucaagcugugaccuucucucgggaagcuuuuguuacauuaguagaugucugccauugucucagaaccucugccucucuuacccaacucagaacagagacacagggugaagcugcuguuuaaauuucauacaucuuuucuucugaaaacuuuacuuauguagggaaacuaauuccagcuaagaccucucaaacaaagcaguugauacuugugauccaaggaccauggggucugaaaggaagguugcucuaugccugcuacuguaaaugggagucaagauggauaaguguguaguuuuugugcccugucccggcauuagagaguugguguuacauggagaaauuucaaguauuucuuaaacuaaugcauggaugucuucauuucccagauauuagcugcuaccguacaagcauuuuagacaaaauccauggugucagauggcaccaugguugaaagacagcugacuucuagucuugggagaccuucaccagggguugcaaugacaacucucauggggccguuuucagucugaaauugacugugaccauuuaauaccauuugccaucaacaaaucagaugcuacuugcuuggucuuaaguguuccuaugaauauuuuauacccuucuuucaagaaacauugcuuuggggauacuuuuuuauuccuuuagcgaaggacaguuccauggacuccuggucuccauuuccgauugagggcuuauguauuguuuuauuuucuuuugcuuuauagguagaaauaacacuucaagauaucaaugacaacccaccgguguuuccaacagacacccuggaucucaccguggaagagaacauuggagauggcucaaagauuaugcagcugacugccauggaugcugaugagguaguuuaugucuuuuuucagauucaugggagcucuagugaucagugagguuacagauccuguguucuuucucugagagcaucuauuaguauguuugaagugugaugcaagaaugugauauacuuagucuguaaacugcaugucucacaaacauagagacccaaguuuaacugucuuuacccuuguaaaaaggcugugugaagcagugcuagccuguaacuccacuccuggagaaacagagacagguggaucucuggggcuggcugugcagaccaucuauccuauuuggugagccccgggucucagugagaaaccuugccucaaaaaacaagaucuugcugcagagacgaucucaucagucuaaagcgcugacugcucuuguagaggaccuggauuuggcucccagcacccaccuugcagugcucacaacugccugugacuucagcuccaguggauccaacauacucuuugaccugcauggacauggcacucaugaaugaaaaauuaauaaagguuauuuuuaaaguuggacaauuccuaagaaacaucuaaguugaccuccaccuacauuccuacaaccuguaccucuauaggcccauacauaccccaaacacaaguaaaauaaaagaaugggagcagagaaggucagucagaggcugguuucugaucagucauucaggugucugucuuuugcauuuuagaucucaugaccaaauaauuuuuuagagauaaaggcaccaaaacugugucuuuuucuuacauuuuccuuauuuguuuucgcugucauagcagccaaguaucuauuuuuuauuuuauuugugauuggaaauaaauaauuuaaauguaacaauauuuaaggugaccuuaaaaucuuuauauuuuuaauaauuauauacuuuuauguaaauuaacauuuuguaauauuuauuucagguugucaugcagguaacuagugagcuuuucaauuuauugccaugaacaaauuucauuccuauugggaaugugaaauuuggacauaguauagauuaucacacucuauauuuuauuguaagugaagauuuacaauaguuauucuacaaaucacauggaagguuauauaauuaauuuacauuucuccacaugaaaucucuuugcuuguuuucuccuuagugaagggucuaauuaaugcccugccauugaggggaaacccuucucaaacacuaggaaacucucccauuuccccuuagcuaaacuccacacagagcugacuuucucuacuuaacuccaggauuuauuuuuuuuuaaacuaugguuaaaugguucauagauucacuuauuuaacacugaauuaguagguauuggcuuuuuccucucaacuccaggagugucugaacauguaauuuuuuuaaaauuaugauugaaugguucauagauucacuuauuaaacacuuuuugaacuaugauuaaaugguucauagauucauuugcuaagcacugaaguagguagaacaggcuggauggggugaugcucgccuuuaauguaguggcagaggcagguggaucucugugaguuggaggucagucagcuauacucagugaaugccaggcaucaggaauacauaguuagacccugcuucaaaaaaaaaacaaaauuaaaaauguaaaggaauaauaaauaaauaaauaaauaaauaaauaaauaacagacuaguccuaauagccaauuuagaaauauaauagccuagucuguuaauuuuugcaaacauuaguaaaagggaauugaagagaauguaaauuuuuagauaauuauaguucucuucuagaaaacacuugguauuuuuuguuagugccugccaucucauuuuguuuagagaaauauuaauacugauucccagaucagugauuacuaacagcugugagagugaacaccuguccugugcaacauauauaacagcugaugaaguuuagcaacuaucucacuuuauuaaagcugauacaacauauuuagcuguauccauuuaugaaaucuuaugaaguccaauuucaauauaacagcaacaugaauaucauacaauugaguaggauaaucagagcugaauggucuuaauugcauuuuaggaagagagaaauaaaacucauguguucggaauguuuuguucuaaucacuuuagaagaacgaggcaauagcuauguucauuuuaauaaauauuuuauugguauggauguugacucuguggaauuacaugauuaaugugggauuucucaacccaaauuauaguggauuacaaauaaauuguauauggaaauuugauuguuuuaaucagcauacaacucuccuaagaacuguccucuugggacuguuagauccauuguuaauuauuugcuuccuuuuaagagcacaugcugcugacaugaguucugugcugugugcaugcucugcuucucuuugaggcuguaccgugucugagaaugcacugugugcagggcucaugcccagccaccuucaugcuagucucugagguacacuuggagucacauugacauuuauagucucugagguacacuuggagucacaaugacauuuaaggaagagugcaaaguuccuuaucuuucuaggcauuuacacccaaauugguuuucaugcaucuuguugcuuuauuauuguugagagucaguuucuagaauuaauacuuaaguaaggcauguaggcaugaucauguagacaucccaguguacaaagacaaaaagaugcccaguguguacgcauucuauucaggaucaggcaggguggagggcaaggguaaagcagaaauggggggggggcuuuuguuggcaggucaagauggggaaaggaaaaauauuagagagaagacuggggugccugcacacacacacacacacacacacacacacacacacacaaaggugcgcacguucaugagugugagagcacauuagaaaagcaggguggaucagagaguuuaaauuaguaaauccaccagaagucugaagccugcucuaagauuguucuuuauuuuguuaaaugaugaaucccaaagagauucuauccuauuuccacaacccuuuucuuaauaaugggagguucccacgguacagagaauuucagcucuugcugugagguacuggcauuucuuugacccuguaugaagcagagcgggcacacaagcucccuacagugauucacagaugugucuuuuuccccuguguuguugugauggguucauguuaauuauuuuuugauaaccccuuggucuccuggcuuugcuugcucagcuccacaccucuuaguuggaguggaaacagcucauuugacuguuuccuguucucugagguccuugcuguguuuuucuuucuuccucugcuuugucagaacaggguugagaugcgagguaccccuuuuacucugcagugacacaggacguugcuguuacugacuauggagaaaugaguggcuucaaagugcagagggugcagauguugcugggaaauucuaucaacuuauuguuuuacagccucuacccuuuuucuuuaauuaguguaacugagaaauauucaugugcuagggaaccugcagggcacugagaaaaggggugagugucagaagguccaauucuccagucaucgagucuguguguuaaggacagcccugaacauucaaagauuccauuguugaaaaggacaucucagguugaaaaacuuaguugcaugcuacuguuauuugcucuggaaugccccauggggcucugccucugcagcucagggauggugcuuuaauggccuguccucauuugacaagacuaggguguuaaacaaacccccauuauagccaggcuucuugacgggacguuucggcuguucaugaguaaauaguaccagcugauccugaaggggaacagauugcgguguaagcucaaucgaucgaccuucacuugcaggagaaaggcucccaugugaaagauauugauuuuuauggugagucauuuuguugauggggcuuuacucuaagcauggaaucauuuguauaaugguuucaagaauauucccguaucuucgaauucucuuagcuuccuagucuguaucauuuugauaauccagaauagaguguagcccuuggguaagaugccauuaaaggaguagaguucuuuaugaaauagaauacuccagaaugugggcagugcagcagugaaaaaaugcuuuuccgauguuuuuguucaaccguaagauuacagugagugcguuagauacaaguggauaaagaaggagaaugugucaaacuccagucaucuuguauuaaguuaugggggguuuucaaggcaaccucuuuauuaaauuuuaagacuggcauugggaauacagaauaaagagcucauaaaggcagcugaacauaaauuuagaaugaagguguucuuuucucaggcugcugaaacugaucucuacccaagcaggaaaacagaaacacacacaauaaaaaucgucaaaacaucucauagaaaagacauacaggugcuucggaucuguaacccagucagucagcuuuucauucccacacaacacuuuauuuucugcccgcuagcuaauguuagugagaguucuuugaauauuuuaacgaaucaauuccuggauagucacaaugagaaaagggaaauuuguuuccaggagcuguguuuaaaucaaaacagguuugucaauucaagaacuccagcaauccuuauaccuuguagucaagggcagcgacugggauaagacauuugaugccauagauaaggcuaacucuucugucuagauugaacuuacuuguggaccaccacaucaccaaguccuuaccuucaacaaugaaggauaagaccaacuagcauuuuccuacauccuuuaguccugaaggaccacucuaguuuuuaacaugggcaugagccaauuuaguguuggacacagcccuguuuggcaggucaucuaaccuugaccguggugaacagugccgggcugcacaggaaacuaucaaucucuuuuugaaacgcuuucggucccuuugcacacaccaggagugggacugauggauggguucucaggcuuuuugacuguuugccuucugagaucuuccugucguuuccacucaauagggggcaggguucugaguuucacugauguuugacguucuugacgguugugguuguugcuuuuuguggaguguaacugcucuguuaggucugauguaggacaugugugugauuuuacuugaaccuccauggcaauuggugauguuguacccguuuugacacaacugcugcauuuccuagccucuuuggagagauggcugcauggguccuuaguuuuuauuagggcaggaaauauuuuucgcucucuugauaucuugggaauuaaccuaucacguguagaguuugcccucacaacugccggucccuuuauagccuagaaguccuucaguuugguggcaccucacuuaccacuuugugguggucuucucaccugcagaguguguguguguguguuucaugaccgugaauugaucagcaagaccaacacuaucaggaagagagacaucugagucucgaugaagacuuagaauuuugggucucaaguuuagaguucaccuauguuugagcacauaugagaugccuucuccuuuuuuuguuuuuguuuuguuuuuuuguuuguuuguuuuuguuuuugacacaugaauaaucaguuuuuccaacaccuuuggcugaagugcuuauucuuuacaaauguauaggaauuaguugacuauucccauggacucaguucugcgucuccuacucugcucugucauggacacaugaaggaauacaguuuuaucacuguagcuuugguguaguuugaaaucagggggggggggugcuuccaguugucuccuuuuuugacguuguugucucucguuuagauucuuuguguuuuuacgugacuuuuaaaauugugcucuucucuguuuauuugcuuauuuugauuuuugugcaugugugugaacaugugugagcauauguguaccacaucaccauguggaagccagaagagggccucagaucacccagaacuggaguuaacaggcauuugugugucuccauaugggugcugggacuggaaccuggguucucugcaagagaagcacaugcucuuaauugcagagccacuucuccaauucccucugucauuuucuauuucaagaaaugaguauuuagaaagagacccuguagauugcugcagaugguaugggccugguagucauguaggaccaucuaguaccugaacucagaugaauuuucuauuucauccaugauuuuuauuucccagggcaugaauccuucccuccuuuguugaguuucuauacagugacuucuugaaauuguacacuguuuacacgcaguuaaagcucuacagccucucuuugucauauucucacucacugaaaacaauaagcaauguucuugguuccagcaguucaccuacuuggucuuuucccccagggugccaacgcucuggucacguaugcucucauuaguggagcugaugacagcuuccgaauugauccugagucuggagaccugauagccaccaagagguuggacagggagcacagguccaaguacucauugcugguucgugcagacgauggccuccaguccucagacaugaggauaaauaucaccaucagcgacgugaaugaccacacccccagauucuccaggcccguguacucuuucgacaucccagaagacacaaccccugguaggugacauauccugagauguguuuuucagggauaaccuuuaauaguaaugauggacucuucugauuguuuuaaguggcgaggagaguuuaccacagguuuacuucaucauguauacaucacauuuuguaauaguuugcaugacaucuuuuaugcaauucccggagaaaauuacuaauauaugagagcagaugaggagagguaaccuugugguuaguaacuguaggcaugacuguuucugaguguccccaugccuugagucaacggccuucauggcagccagccccacucuccuuuucuacuucaaaaaugggugaaaccaagaaaagugugcgaaaagcucuaguuagcgagucuagucuucaccagcugugugaccaggcagcacaacucuuuccuauaggcauccguuuuuccuucuguaaaauggaaauaguaaucauuagaauuggcaaacuauugauuuagaagauaaaugugaagcuccuugugguagauuacuccugugauacuagcacgcaggagguaagacaagagggcagccucugccauauuuuagugcugucugcagaacguaagagugcaacaagauaugguggcacaugucauuaaucccaggacuugggagguggagcaggggcaggggcaggggcaggggcaggggcaggggcaggggcaggggcaggggcagaccuaccucugaguuggaggccagccugguucagagugaguucuaggcuagccuaagcuacacagaaaauugcguagaagugacauucaaauaaccccucucuaggagaguuuccucuucacuuccugagaugagcuguucacuccuuaaugaauuucucagcaccuuuguucccuguauuaauuacagaaaugucaaaugacuacuggcaccaaucacugccagcuacaguguauaggauacacaucuauaauauugcuuggaaucucaguucccuacacuaguuguuggcuccaaugauuauauauugcuuuauugauaaguguaucacuugguagcauugggugaaaaacugucagaaguaagaugaccucuccguuaacccuugcagugcagccugagcuucauggagugucugacaugcucccugacuguggcuguggguccugagugugggggagggugugucagucuagaagucagcagaauacugugcucucugcuuuagagugacuuucuacuuaaaauauuugacugugaaaaugcauucuuggucucagucuauacauauggaaauauuccauaccccuuguuccacugauuuagacuuggguugucuuuccugcagguucccugguggcagcuauuuuagcaacagaugaugacucuggugugaauggagagaucagcuaugugguggaggaggaugacggggauggcguguucuuucugaaucuggucacuggugucuucaaccugacccgagcacuggacuaugaaacacagcaguauuacauccucacaguccgugcggaggauggugggggucaguccaccaccauccgagcuuacuucaacauucuugaugucaacgacaauccaccugucuucagcaugagcuccuacagcacauccuuaauggaaaaccugccucucggauccacgguccuuguguuuaacgucaccgaugcagaugaugguaugucguuucugugauggacuuacauacuccacuaaaaucgagggccgauuuugcaugcguucaauauuaauauuauaugauuaacuacacuauucauauuuguuuagaaaugguaugcuaucaagguggaaauuugaguuuugacuuaacuguagaggauuuuuuaaaaaaucaagcaacaugucauauaauuguuuuuaacuauacacauaauauguuuagauacuuuacaauuuuucccuuuaaguuuugcccuaaauauuuuaguucaguaauuuaguggucaggauaaagauucauucugaguuuauguuagauaaaauuauuauguguguguguauaaauauauuacuuaaacuuuuaaauuuaauuuuuauuauauuuauucauuuacuuggugcaugcauggguguguggacgcauaugccaugguguuuggaagucagaggacaaccugcaaaaguugagucucuccuucuacauuguggguucuguggaaggccaacagaccucgcugugagcacauuaaccuguccagccaucuugccaccucauauguaacuuacacuuugaaaaaugaaaauuuaaagacaaaagagaaaaaagucuuaaagaaaaauacuugauagugaauaacuaaauuauacaucaucagaugaaaauaauauucucauaauaauauauuggcaauaguauuauuauuggaauaauauuuuggcaagaauccagugccuggaaaggcugggauuuguuuagccuacaguauauaauaaaguuaagaauuuuuuaaaacauuauuuuauuuuaauuucugugcacuagugugugugugcauguaugugucugugugggugaauugcuguaugugauugcauguacagaguacacagcuuagguacugcugucauuguguaggcuugcccaccuuguuuuaugaaacagagucucucgcuggccugaaaucugucaggugugcuugucagucugacuguggauuuccagaguccaccugucucuggguccccagcaugggaauugcaaaugucuuucaccauaccuaacauuuuuauguuaguucuuggggaucgaacacaggagcuuaugcugcaguccuggggccaacuuccuaugcuaaacauguuucugccugguauguacauggguugugaucuguugaagcccaguguauucccuggaguaaguuucauuuacccucagaacauucaguguaaaaacaauuauaaggaauucacguaaugcuucaaaacuugcugcaaugaucccugcacaagcagccacagagauacagaaacuguaagcaccaaaucucuuguuaaaaaaggguguuccccccuuuaauugugcugguuaaaauuguaaacguuucaagcuacauuuagccauuguuuagccugaauacuuuuaucagugucauuuccugcaccuuggcuuaaaauagaggacacaguuccuauuccuucuggauuuggaggauaaugcuaagaaugaccuuguuugcaagaacaccaacauaauuauagcaaacgcuuccagugugucuaugagcaaugaauguuagcaagacacugaaauuaacagauucuucuuagccucuggucagaaaguuccugauaggucauacugcugucuucuacauaaacaaaugcucucggagagcgacuuugacauuuugaguugucuaugcacacacucagaguuuaaacuuuagguuacguaaucucaacaguaaagcaaaucuuauauuuuuguuaaggcaucagucauagcuuuauuguuauaaauauguauauuaauauuacuauagaguauugcauggaacaaaauguauagcuuaggacuauuguagcaacauguuggaugacuguucucuuaccauucuggaaaccacacaugcuugaggcaugauggucauaaaaggauguucagauagugacacaacugucacuuuuuucuaaaugagugagugugcucauugauccuuggugcaugcuauagacugagugagggcccaaccucauaguccaguucccucaagaccucguugaaagcguucugugaagaugacugguaacagccaguacuauguaucuuugccauguaacaaggaagcaaauacuagccuuuaaccuaaggcaacauuuauaaauuaugacuaaauguacacauucacaauauagccaacuuuauaguuuaaaaaugugugucauuacuuuuauuuuauauauuuauauaauguucuacaguccucgggaauaaaguauacaccaaaugccaauauuauauaaucacaaucaaacaugcacauauacacucauucacaacuauacauccccuccuaccacacacacaccuuugugcaucugcaaagcuuuauagcaauuaaauucccaaggaaaaucauggaaccacaugacuuccagcaaguugaacuugaauaguugaaaaacaacccauauccaguguaguauuccacuggacuguaaaagcccacccaauaaaaauucuaacguuuuacucaaaauuaagaaaaaguauguguuuccuguuuuucugcucugacauuugcugcaaggaacaggaggggaaaugguuagaucuuuguaauuuucuaaauugagccaguguugagaggagcucugaguccuucuggaaugcauuuuccuagguauaaauuucaaggccaagguugcuuuauuaauuagacucuuuggagggaaacgucuccuuuaaagugcaacucaguguaacacuguuauauucucauucugagauaaggcuuauuucuugccuuaaaacauuccaugauauaacagacacuuuguuguuucaaagaucauaguuaucucugguuuguuuuaaguggcauugccuaauuuauuugugauuaccccuuucccuucaugaaaggccaugagcuuugugaccuugucguuuucuucuccacaguuuaacauuuaccacgagggccaugaggaugcuuagauucaugacagcaggcuggaauggcucccaguugagcugauuugugcggaucccauaggucucuacugaagucaaguagaaugcuauuacuguuucuaauuuccauugaucucagcugggaaccauuuugcauguccacacagaacccaguuuuucauggacagucuuugguaucacugugacuccuagguguuggugguggcuauggaucucaguaagaacaagaauuccacauuugcuacuggcuuuaagagacucagaacauguacuuauuaaaacacacuuuauguaaaaaauacuccugauauaaucaacuauauuuaauuuuuuuuauaacaaaguagguggaaguuuuggcccuggacaggaguaagacauggugaaggaugcaguugacauuguccauucugaaacacugacacuuucauucuugcagguggauuguguguggucccugagcuuuaauuuuucacauuuccccugauguucaagccccuaagcucauaaaaucugcuucacucaucccagagcugucuucaguaaaguguuucgaugaaucaccacaaggcauggucugugucucuaaagauuuguguaucaaaguucucacaagaaauuuuagaucaguacauuagugucugacuuugccuucugagcaugauuucuugguaucagcauggcgggagagagagagagagagagagagagagagagagagagagagagagagagagagagagagagagagagagaacccuucgggugauaggaacagacuacccuggagaaggaaauucuauuacuuggguaauuugccucaaagggaacuagagaaucaaaaauagaaaagcaaacauguacucagguguuuucagaccccagaagaauaucuuucacaagaaaaugcuggcaaacuguucuaagagauucuuuuauuauuuuaauguuucuuauuagauauuuucuuuauuuacauuucaaauguuauguuaucccuuuuccuaguuucuccuuugaauacccccuaucccuuacccccucccccugcuccccaacccacccacuccugcuucccagcccugguauuccccuauacuggggcauagaaccuucacaggaccaagggccuuuucucccauugaugaccgaguaggccauccucugcuacauaugcagcuagagccaugagucccaccaugguugguggggguaccgcuuaguucauauuccuguuccuguucuaggagauucuuagcaaagagcagacauuguuucugguagguaggacucggaaggcucaguaauuacuuacuaugaggugggagaacaggccugccauugugagcuacuugagacacucuguucugagguaggaagucugcccucugacuguuuuugugcuuaccuagaaacugccuuucaaugaaguuuuaaaacauauuggcaaauauacuuuccuugccaucuucacuguagucuuuucugcaacuuuuaaaaauaaguugauaauuuguuuuaauuaaaggaugacacacucuuuagggacaaaaagauauuaucuaaacaugagucaccaacagcaugacccuucugccugugcucuuucauguauagcuauauugcuaaccguuccuuuaaggacuacuuuuucaaauguuugaaugugcauaaaguuugagaagagucguuuccuuaaaguccauuguuuggccagaugcauaauaggaauuaaaaguauuuaugaguucugacaagaaauguaaaaggagacuuuaagcauccaugacuaauguccuacacagaacauuuuauuacccuucucugaaaacuggugucggccucaauaaauuacugaaguuauaaauguuuagcuaauaauauagagaguggcauuuguacggcugggccccagggaguuccgugagagaaacaaagaaaaguuuagaaaaauaucugcuuucuggaacccuuucuuccucuucacguugguaauuuaacauuucagcauugcaguaaauaacacacccucguguauggaucauuuguacaccagauuguaaaugccuuucagaucaaaagcucaaaggagaccaagagucgugugugcaguauuuucuaaguguguauagcuguaaguaaaucaucuacaaucacuucaaaugauucauguacaaucugaaaaucaugauaguggguaacgugucggaaaugcucuauguagcagaaccuucuuguagcuuagauuaccaucucacccauucaauaaacuuaacuuuuccucuuucacuucuaggugucaacucucagcuguccuacagcauugcuucaggugacagccuugggcaguuugcaguggauaagcacggaguccucaaaacccucaaagcuuuggaccgggaaagccaguccuucuacaaccuggucauucagguccaugacuugccccagccuccuaccuccagguucaccagcacagcccaaguuucuaucaucuuguuagaugucaaugauaacccaccuauguuucuuucccccaaguugacauacauuccagaaaacacacccauugauacuguugucuucaaggcucaagcgacagacccagacaguggccccaacagcuauauugaguauacucuccugaacccuucaggaaacaaguucagcauugggaccauugauggugaagugcaucuuacaggagagcuggacagagaggaaguuuccaauuacagccugacagugguggccacagacaaagggcagccaccucugucguccucuacugagguugugguuaugguccuugacaucaaugauaacaacccuguuuuugcucaggcuauguaccgagugcagauuaaggagaacauacucacuggaacagauauaauccaagugucugcagcagacaaugaugaagguaccaacggacagguucgcuacggcaucguggguggaaacacacaucaagaguucaggaucgacucagugacaggggccaucacaguggcuaagucuuuggauagagagacgaccccugcuuacacuuuaacuguucaggccacagaucggggcaguagccccagaacggacuccugcacagucgccaucacuuuacuugacaugaaugauuuugucccuguauuugaguugucuccguauucugugaauguuccugaaaauuuagggacccugcccagagccauucuucaggucaguauacuuaaacacagcaggguauauaguaccauuaagacuucagaccaaaaaguuuccuucuugaacggucuucaggaucuccuucauccucucacuguuggggguuggggacaggaucgaugcagauauagaaagucuugaaaaucaaggcuuaugagcaccaugccugagacuuauguccuucgcauaaaaucauuuugugcacauuugcucaugugaguauuuuaaaauuauguuuuacuaugggaaugauauccacauauaaggugauguuaaauuuuggaagaguucauuuaaaauaguauucuaccuucccucuuugcaaaaaagauuaaaaaacaugguauacaucuuugggaaguuuuccacaaauccuacacacugguuuaugcauagauuucugcaaauaugucugcauaaugcauacuauaauuugcuacuuuaauuauaacaucuuuggguuuauuauuuuauauaugaauguuuagcccacauguguauaugugcauguugcaugugugcaccauauguacccagugcucaagguggccagaaaauugcaucugaucccccagaauaaaaguuacaaaugguuuugaguaccauguagguucucgggacugaaccuugguucucuacaaagcagucagugcucuuauucacugagcugucuccccaggucucuguccccucuauagcagcacugucuguacccuuauccccuguuaucucucacuuggcccacaugcuucacauguuagguaacucauuauagucccaugacuccucuccccuguaggugguggcaagagacgaugaucaagguccaaauagccagcucucauauguuuugcuugguggaaaugaagacaaugcuuuuguccucacggccaguggcgagcuucgggugacccagagucuggaccgggaagcaagagaucacuucguccugguugucacagcugcugaugcagguguguucuuaccgcuuugcucaguugugaaucagauccucaguagaaaaugaacgcaguuuuguuaaugaaucacauguuuauugaaauuuacuaaugauuggaacaguccccaauuuacauugaguauaguuaaugagauuucagugcuaaauugcaagagucuccccgcugaggugcagcuucugcauagaaaaauuuccuuguccugaaagcuacuugagcaucuaugaguauggccuuucacuacuacauacugaguaugggucaauuuuacugugaaauauauuuuuuuauuaauaugucaugacaaaauucuuguagaaugcauuguuccauauaaucagagugcuucaaggccccauucaaacaucaguaggggauuuggggauuauagcuaaugacauauuccaaggacagugccucucagcuuuaauugagcacuauccccccuuauuccaacucuucuguccuaaccucucucccucucuggaccuuguggagaaaaguaguagcccuucuguuuuuaguguguaugaauuaucuugucacauuauauacacaauuuuaaaucccaaggaagaggaacagaaugcaguacaucagccacacccaacuuaacccaaauuaaucagagaccugcucauuauguccaagucagcauucaucacagcucucagacucuagguguauguauccuuccagaaaaccaauggaaauuggcuuuaaauaccagucaaggugccugaauucaggagaaacucuaagggagcuggauuuaagacccaagguuuuauugcuaaaauauuccagccucagcugucaucacucauuagagcuggaaacauguggucaaccccagacacucacaaacacaaauacgguuuguggaaaggaaguagcaagaucggaaacuggauggaagauccaagcccucaaggcaucugucuccguaaaacucgcagcgccaggagggggucccaggggugguggguauucuggggugugggaggggaggaggguuuagaggugcaauguggagugaucugugaugggcagggaacaacacacacaggguccuggcagagaacucggcuuuggagcguuccaagccaggaggcauggcagaaaaagaccuucccacuuuagcuagaucaucuuucccuccaaggauuccuaaggauuccugaaaucagugggcugggcagcaagugaggugauguuguauagguaaagggauauauauauauauauauauauauauauauauauauauauauauauauauauauaacaaaguuuagcauaggacuuuuuuuguuaccaucucuauuagccaucauuaggaugagaacauuuaauacuuugcugagugucucacggccagugaauggcaaaguuaaaacaaagaugcccucagagcuccggguacucuaagacuuuagagaauguauucagucccaagccaucugguagauaaucaggcagaacacagccaguacagagaaggggagaauauugaauccaaaucacuuuguuugaauucugguuucuccaucaucuggguggaugguauugucuuucucuaccucagcaucuuuugugaaaugguguaaugaugucuuaguuuugguucuguugcugugcuaaaauacauugaagaaaaaguaaggggaagggguuggugugucucccaguacuaggugagaagcccucacugugcagaggccaggguggcaggaagucuacccuggucacagcauauccacaguccagagcagagaguaguguacaaaugcauguauguaugcacucagccugcucucucaucuuucuucaguccagggaugagccuaucauauguuacggccaacagaccuuccagauggaucacuggucuucgcuaacccaauuaagaaaguaccuuacaagcauguacacaagcuaagauaauccagacaguuucucaggugauuuuggauuauguuaccuugacaacaauggaccaucacaaagagaaaaauacaaaauucuugugagauauaauccuguccuauuuguuaagcugcucaauuuuauuacaaacccugcaguauacacaaaaauuuaauaguaauuucccuacaguuauugguagcaaaauucacaguggagaccaugaguauuaaucuuguacucacagacagaaaagcagauauuguguugaaaucugugcccagaacucaguugucaacuugacauacauaaccuggagucaucugaaggagucucaauuugagaaguacccagaucaaacuggcuuguggccaugucugugaggaauugucucaauuguugaaugaugugagaggguccaggcuacucuuaggcagugccacuacuaugaagguggucuggcuguuacaagaaagcagaaugagcaaaccacaaggaacaagccagugagcauuauuccuuuguggucuuuuguucauuuccugccuucaaguuccugcccuggcuccccucagugauugacuguuaccuuuaaguauaaacugaauaaacccuuuagucucucaaguugcuucuggccaauguuuaucuggacaauaaaaaacgcacugaaagauuucacuagaaucuuuucaaacuauugacaguccuguccaugaugaccacagccugggcccaaauaacuuccacauguauuuauuuauuuauuuauuuuacauguuuugaaaauuuuauacuugaguguucuauuuaccucagccucucuccccacagcuccauucuguuuuccacucacucauucuuaaaugcacagccuguucuuuaaauauuauuuucacacacaugugugaauauaaucucacugaauccauucuguguuguucauaugugcauguguuuggggcagaccaaucuggcauaggauaaccuaucaggguucugguccccagagaagacugauacucucuuucucaacagucauucauugucuauagcuauucaucuacgggagguaccuugugagauuugccccacccauguuauaauauugauugguguccauguacacgucuuguuuaaauaauuuaaauggaauuaaacuacuuagaauguuaaugcucuccuuaagagccauagaugaaccaaaucuccagugcuaggcaugggaaaccucccuuugagauguuaguaagaaaguccagggaauaccuacacccaaaacaaugcagacuuuuccuguugccuuuggaguucacaguaagacccuccaacauuuuugauauuauaaguaauuccauguucauuguaauacaaaugucaguguuaucagguuuuguaaucuauaauucaguccucuuuucuuggcuugagaucucuggcaauggacuuaacacuggucaccaugauuaacagucagagcaauaggugacaugagaaaaugcagaaaagugugaaggaucugggauaucaaaugacauggugucaaauucguagugugugaggaucaaggaaaugucauagugcucuucaggacaaucucugacaguuuuauuccaaaucuucaaaucaccucuguucuacucucuugaaacucuuacucacucuguccagcuguggcaauacucucuguccagcuguagcaguacgcuaaaaagugaugucagagcauuuuaaccaggcagagccccaaaccccugacuucuuucuuacugaacuccagaaugcccaccuugcuguguuuuuguuagugacucucugcaggcagugcaagagaagcucccucuccuguccucaugguaagcuccgcucauccuuucaacccagaugaacaacuaaagcagaacagggcauauaaaaauuccagcucagcuuuuuaacagcauuaaaaugcugaacacacugcagcuuaaucaagcacaacagucugcuugucuuuagucaaagauaugggcgccuugccagcuugaugugcugauuguugacaugcgugucauguguggcuuacuuuugucucuucaugcguaugcacuuaacaggguagaggccuuucugaaccuauguugccucuauccuuaaugaaggaaagugauccguuucuccagguugaagagaucauguugacacagcuaacgcccuucucaagguuacaugcccaguuucuaauagccucccuugcaaggguuugcagacacugucaucgcaguguagagaauacagguugucuuagguacaguaaacagcaucagcagagaagccagcauacuguacuuaaaaguucacuguggaauuuuaauuuauaaaauauaaagucuacccuggaguuaaauauauagacccuuaguguucaaccuacaaucagagauuucuuccaggcucuaaccacaguccuuuggacacauugucuguaacuaauaguaaaaguaaugcugaaauauaauauguauuacacaaauguaauauguaaugcacauaauauaauauguauuacacaaaauagcuaagaaucuggcuuauuagcuauugauauuaaggcucuuguuugauaagcaugucuuaaguuuaguagggucacaguaaauagcugugauucugaaacccugaacaguguuuacacagcugguaagggguaaaccuuaccauccuuuguccaguuuccucugcacauugaguuuauuaacaaguggguucagguucagcaagguucacaacuguuuuugaguggaucucauggucuuccucuccacuguaacuccucugcucacgugacggcaagggcaacagccaccucaaugccugucuuuccuccugcaugcuguuuuuuuccaaagacagcagaugaaccuuugcauuaggguucucuaaagucacagaacuuauggaaugucucucuauacuaaaggaaauuauuagaaugacugacaguaugcaguccaacuaacccacaauggacaacugugaacgggaaguccaagaaucuaguaguugcucagucccacaaggguagguguuuuuucaggugaucuagaucuauauaagcugguauucugaagaaguagauuacaagagguaugccggcaaggaaguguaaacaggugaagaaggagaaagagaaaaaaguugaugaagaagaaggaggaagaggaggaagauaguguccuuauauaggucaccagcagagaguauggcccagauuaaauuuguguacuaauacaccuggauuuggaacuugccugggacaaaaaacaaaaaccaaaaaaacuccaaaaaacaaacaaacaaacaaaaaacaaacaaaaaaagauccagaucagagggcuaugucuuccagccucaagaccuggaucacaggugugcccuccauucuggauuguacuucauuuuagauguacucaaguugacaacuaggaauagucauugugaccuuuauugucauaaauuggaucauuguaucucauuguugucuuaaaaauccuccagugguuauccuugaccacugcccagcuauucaggcacuucugauguucuugauccucaaacacuuccuagacccuuacccugagcaaucauggcacagggacugcaacuuccacucugucucuuuucugaccugucuuucugugucauaauauuauagucuuagcagaauuuuacuuagccuagggugguuggggcaugcuauaaacucaagaagaccuugaacuucuauuccuaguuuugggauugcaggcguguaccacaaggcuuaguuuauaaagugcuggggacugaaccaaaggcuuagugcauucuaaguaauuauuuugcacuuagcuauagaaucaacuaaauuauuuuucauauaguauaaaaucuggguaagugauggggaucuugaagaaguucggugagagagguaaauaucaaaaugugauguaugaaauucucaaguauuuaauaaauucuacuaaauuauuaaaauuuaaaauauuaaacauuugaaauccaaaaccaaaauuuucagggcagauuaucaagaauuauuguagacauguuuuauuugagauauaaugagaaaugcuuuucuuuuuuucuuauaguauagaauagaguuuauucagggcauggggaggagaguuaagaggguaguagaggcagagagagagagagagagagagagaagaaaaaggaggaggaggaggaggaagaggaagaagaagaagaagaagaagaagaagaagaagaagaagaagaagaagaagacgacgacgacgaaguagaaaaguagaggguguccaugaccauguggagagagggggaagggaaaaucccaagagggcaagagagaagcaagagggaaauauuuaugauucuacuuccuuaaaguagcucuuagaggaggcuauuuguaaauuagucuuccauuuacuggccugaucauaucaagaaauguacauucaaggauuucaugccguacuugguagaucuguaauaugcuaacaugacaugauauguguaauguacuccacaugcauguguagacaggcugaggaucugcauuuaauaagaggaugagauucaucuuagcauaaauaaaauccuuugucccuaaucuguuuguugcuuuagccagaaaguucuagaaugacugugaauccacauaauuaacaagucuauggggaaaaggucaguuaucagagucucuaaugaaaggcauucaucauccagcugaaagacaacauggcugcauucugaggcaggguggacauuguguuuuuaauggagaaaaacaugauguguuugcaaaacccaaccugaaaaaguuaaagaaccaagcaccaugugccaccuuccuggugaggagaugacagcguuuugaauuaauacuguccaccuguugcuuagaugggggaaggaccaugggcucaucaauggaucuguguuaaagaagaggcuagagcagugugcaggaccugacacagcugaagggaguuucacugacuauuucagaaagguugcauuuuguuguuacaauucugccugaguaaaaauugccuuguggguuauggugaagauuuuuaauaauaaaaauuauguccaugagccaaugugaauauagugguggacuuuccuuuaguuaucagaaaucaaugucgugggaugcccuuguacauucgagucuaagguaacuguuuauuuccaaacaaucauuuuucuuuuuauuucuaaaagaaaaaguuuucauuuuagccaggaauuuaguaauucauuccuuacuguuuuuuuaauacguuaacauguuaauuucaacauuauuguuucauuuccucucauuucuaacgaggcuuugcaucauagcucuuagugacauaaguauuuaauuuuuugcuguauauaaucuagccuucaauccuaaagaacuuuaccacagaggauuuuauucucuacagguuaaaaacagauacaauuuaacuucaaacagugcuaaaucagaccuaggauuuccauuauauucuguaagaauaaaacauaauaaggcaaccuggucuuugcucuucugugaacuuggaagcuaaggacacaagaacucuaacagcagggaggaaagaccuuucccaaguuacaaaacuucccacggcuucacagguaaacguuacacacagcagcuccaggcuugauuccuggauucuguuagucuggcacuuagcguucccauugaguggcagagcagguggaguucaguguuuggagacagcucugguguuucaugguuucaauguccgggugucuguuuccacucucaaaacagcaauuccucacagugaacuuuuugucugaauaaaagcuuuagcugauguuuaauuuuaaaaauuuaaaaaguuacuguaaacugcccuugcaauaagauuuaagccacuuugacugaacaggacacacauagcuguuacuuuacuaaagaaaacuauuucuuuucguucaccuuaucucuguagaguacaguuuauccugucauuuuugaaauaugaacauaugucaaaugauaccugucuauguauguuugguuuauuaaaacaugcucccaggaugaguaacuggucauaacauaguauuauaugugaaaauaauuagauaacaaaucucagugacauauaaacuccauuuucugugcuuucuggauucaacggcaaauauaacuugcgaaccucuaaugguaacauugaauggcugaauuucaggccauuuucaggggugauuugauaacugugagaaaaauggcccagucucucagucauaaauaccuggccuuuauugcauuuaacacaugugucaucccagggccagcacacugggcugcacgcuacaugguggcuaucaggaaugagguccauugagaaguaauaaaacgggguaaaaguuagauuucuucugcucuggucuuucccacugggaaaauguauguacuggcaaaugaauaagaugauuaauaaaacuaacuaaauaaaggaagcugagaaccacaggggaaaauguauguagugucuaagagccauaaaagugacauaaaaguugcauuuuugugaauuguagaguccagcgauauagucuaguuuauuacacuuauguauguuuucugaaaaugcuugccugaaccauuuucuuuugaaaauaguucuuuaaacuuacuuaaaugucauuuugauauguuugaacguacagugcuaccagucauaaaggugcuacacauuuaauuaguucccaaauuccaaaccagagacuguaacucagaggcuuucguuucgugcuuuuuuuuucguauauuuuaauguaggaagcuucuuguaaauuuauccaugcuuauacauucaugugcaugugcauauauagauaaauaaacacacacauacauguuuuuauguaguauguacaauuuuacaaaaugaaaucugaaauuccuaugucuuaugguuacuaauuacaauuagacuuuuggaguacaguugccauuuugacuuccaauugaagugucuuucuagcuccaguaauuacagguuccugagccauugccuucugcuuggauuguaugcuuggucuuuucuuuaggucacacuccacugggugugucucucuguaugcugccucuuucccugacugugucaauuuugauaaaugaauccagaugagcugugaccaucuggcuuuauuacagcacuguuaucagaucuauugaagcuacacuuggcucugucuuuuucugggauacagauuucauuaggccuucugggugcaugcaguuagaauacaccuuugaccuuuguucccaguauugcuuucugaccccagcuguaggcugucaucugccuuacaaaaugguucugcuaagguuuguagaucauugggcacugauucauauagucagucuguagcacugguuuccacauguaaaaugaaagacguuuaacagacuacucauguacuauuuguguagacauuuacaaagacaaguaacaguuucuucugccuccauucaacuaccaaguucgaggaaagccgaugagggugacaauggagaguaaaugugaauacuaaggaugccgaaguuugacaucagauuaguggauggaggaaaggcuguugaaagaaucgaugacuccauuuucuuguccauauucagaauuaaauaaagaagaaccaauucuuuaaauuuuagaguaacaguaaaauuaaaaacaacaccugcuucauguaauauguuuucaaaugagaauugcccacauuaaaugugccauuauaaaucucauauuaauaauucaauaauaauauuagggcuggagauuuuggucagugguuaagaguauggaacgguaauauugggcuggaggauggcucaguuacauacuguucuuccaagcaccuaugucaggaggaacacaccaccuuguagcuccagcuuaguagagucugauccauucucuguccccugcauacaauuacacucaucugcacacucccccuaaaaaaagccaacagcauauaugugauuauauauaaacacuuauauguauauauguaugcauauguguguguauuugugugugugugugugggggggguguuucugcgccaagcuuaauuuugauuucaugauuaguauacucauguuaagaaacacugguagaaggaagcugaaagauacuugaugacuaagaaggguacucuauuugucaaggcuacuguagaaaugagacucaccggacaguagacuuucucauagcuuucuugucgucuucuugugugaagugaggagcagugacugcugggauugauguuauaugugggcaaaguagagucuggcacuggcaugguggugguggcaguuggcguuugauaaaccucuuucccuagacuagaaguaaagagcagugauuaggggugcuuucuugggugcuugcaagacaacuuuguguauggaacauucauaacauaaccuugcuucugcuauuuacacuaagcaacuauucaaaacaugagugugguuuuaaagauugcaguggauuauagguagaauauauggggaucuaauuuucuguccucuaauguaaaccuguuuucucauagacaauauuucaauggucauguauuuuaacauaacuuaauauaaaugaaaugccuaguguaauauaguacuuauuuagaaagacauagacacauauacaguuugugacauuaauucucaacauguagcccaaauucugugggugagugucuaggaggggcuaugcuucacuccacucuccaccuuuuaugcuuguguaagcuauuuuaucugauguguaguuagcuuccuguacaggacccaugaaacagaucaccauuaugucaaucuguagucugcugauugaggcuccuacacauuuuaccuccaaggcuguuugguccugugccuugagcagcuacaaacuuucaucuggaagagacuuaaauuguggcaaaauaaauaucaucaaaugacaagauuacuagaaaaaaauaacacagaaaggcagugaaccucaacaucagucugugaugaucaagcuauuccacgaagcaugugccagccaacuggaggugucgcuuucaucucagaacccgugggauaaauacaaguacuuuguaagcuuccuacagaggaagacgcuuugggggaagagacgaguaaucccucaaagauaaaaagagaauaucugggccucauuuuauuuaguuaaaggcuguguguugcauacccuaugauuuuauuuggaaaaaauuaacauuugaaaaauggcuuugaaaacacaaccaaaggaaaugauuuucccuuuaacuaugaaggaaacccacagaauucuagccauuccccauuagaugugucugcugacuuuggacaacacacauucagcacuugcagcuugguugaggguucacucuggauuaaaugaugacaagggcugaaacaacguuuaaaugacuuauugaacguuuauagcaaauagcaaguaggugcaaaauaacuuuuauuagcccaucaauaugaagauuuugcuggaauauaauccaaagaucuuguccucacuauaaacaaguauuuauuacauagaaaagaggcuuaaauacuugaggagucuuacuguauauucagguugaauugcugauggucucaggcauuauguuguuugaggaccugcacagucaguguccaggucauuccuguuggcuguuccaagucugaugugcacuauuuuaauacaauuucagauacauuauggguaguguguccucugggguguuguuccugcuuugacgagucuguacuuuugagauggaacagaagcaugccaauguguuuuugugaagagucaugaauaggcaguugagcucuuaggucaccagcaggggaaaaaugaaaauucuguuacaauuuuccaugcagaauaaaaauaaaaucacaucuuauaugauuagaaauuauuccacaacucugucuacagcuaauaauugugaaauguaugguuguggcugucuacaagcauugaaguucuauuguauuuucuucgcaggauccccagccuugacgggaacaggaacaaucaacaucauuguagaugauaucaacgacaacguccccacuuuugccaauaacauguacuuaacuucaauugccgaggaugcccggacggggacagauguccuguuggugaaugccucggaugcagaugcugcggcaaaugcugucaucaggucugcacacugaacuccauaacauauuccucaucaacucuggucuuuaacagcacaugauaucuaacuucacuggggauuccauauuaauacugcuccugugagccauugucaagcaacuauccuggaauugagaaguagacaguagcgugucugcuucuucuaagucuguggauauuaaucuauuucucuauuucaucauuugcagaguucuuugaugacacaacugucccuuucuuuauuucuuccuuucucucugucugucugucugccugucugccugucugucugucugucuuuccuucuuucuuuugugcuauuuguugcuaacuccuguuuuuauaucuugugcucaucauggcauugggcuguucugcacuaugcagcuggcugguguuaaccagcgauauguagcugggaagagugcagcauagcaucacacacaggugcuugagcaggguagggugguggagaugaggcucaguucugcccucucucuccucacugagcaccuuaacggggugacuuucaacacgaugacuuucaguuucagaauuuuagaugggaguugcuaguuauagucauggucagacuuagaagugucauauaucacuuacagaauguucuaggaccaaaagcagcuucaccaauaggauaaauacacccaaggccugaagcaagaaaccuugaagacuuuauaaccaaguagucgcuccaacauuaacauguuuucuucaucuaaaaguuucuuuauauaaauccugguaacagaggacagcaguguggauucuugcuuaaagagaugcagaacuuguaauguguaauauuuggcuacuauagucccauuuucuucuuaucagcuccuucuaaauagauaaggaaagauuucccuauuucaagagauaacccuugaagauacauuucuauaauugugugggggcugugugaguuagguggguaagaacacagugaucagaagacagaaucugaaaaggucugagaugcugucaaguaacaacaacauaugcauuaauaauauggcaauguauguauuauauggcaauggaccuauuaauuauauuuguuauuuguuauuuauucuuguuauuugcuauugauuucucaugagcaaagccucuugggaaaccaguuucuuccugcugccaaggauaagguugcaugagguacagagucaaucacauuuaauaaacauugagucgcugauugagucuauguuagauaagacuaaagcucugcucccauugaacuuccacccuuugccagguagucagugaaaugcaaugaaguaagauugucuugcaugcgguuguucccaugaaggcaaaagaaaaugaccuaauuagggaaagagugaugggcauguucauccuuauuuuuacugugacaaauacuugcuugaaauaucuaaaagaggggaggguuaguucuggccacaguugcagaggcuuuagucuggauccaggacucugggccuggcauaaaggaggucagcauggcugaggguugcucacuugaugguagcccgaaagcaggcaggagucacaggaaggacaagagccaacauaaaccuuuccaaugcaugcuccagugacucacgucuacccagcaggccuuguugcuuaccgcgccaaccuccagaaggcuguucacauauuauguuugggucagagcuucugaagacacucuuguagacacauccagagguauccuuuccuaaccuccugacuuaguguccaaucaaauuucagcaguacuugucaugguuugugaagcucuaacaaaauauuucagaguagugagccuacaauuuguuuugacguauugcauguuauaguaguugaugggaaggacuaagguuaaaacaaggaggggacaguuucuauggugacuccugccgcugaauccucuggagcagaugaugcuacagcagcacagaaggggagagcagaugcagauagacauaucccugaagacagugugaauuccuucagguguugucaguauguuagagggaccugacauagggagggauaugaacuugauauuuuccucuaagaaggucaccaugccaaggucagaauggagaagggguuagacaguuaggugcaaaauauuaaggcaaucuaagagcuuuuggacuaugauauaaaguuaugaucauuacaauuuacuugcauaucaguaacuuuggcauguuuuaaaguugagguacaaacauagugcuacuaggagacugaagaaaccuauaaaguuccauuaacuucagucucuuucuucuacuucauccacauuggugucucucuuuuucuuuuuuuuuuucucugacagauuuucuucucaauagcucuguuagucucagucaccguggugcucuggcuacacauaguuaguucucugaauuucauauuuccugcaaagcagcuaaauaacucucacagcauuuccugcacacacacacacacacacacacacacacacacacacacacacacacacacacagagagagagagagagagagagagagagagagagagagagagagaaagagagagagacagagauggcagugcuaugucuauuacuauccaccaugucugaacugucauugugauuguaugacuccuuaccuacacccguuuauuccaugaucccauucucauguucccacgcuuccuucgaugcucuugucaaagcuccaguuuagacuacagguagccuaaggauaugguugaacauugugcucccugacaccuggcuacacucuaauguacaugauauauagauaccuaugccuaugugcggguucacuguucaacacuaagguaugcaggcuguuuagccuugcaucuucugguucaaugugggguguggaggcagacuagaucuuugguccagucagcaaaaacaucaagucacuaaucaucccugcacugaugcauuagucuugucugugcaaaugaaagaagacauucucggaaaaaagcagggugaguaccaagucucugagguaggagaaacuugggcaucagggaaagaaagacuggguaggugcugugugcaugggucuuggaaaacuaaugaagagauuaacauuuucuguuuuuuuauaggaaauaaaaaaccacaaacaaacaaacaaacaaacaaacaaacacaagugaagguuuaggccauagcaugccucacuggaauuuugagucaauuuuauuguguacuguagaaaguaauucagagaagguggaaccucagucagugauggaaugggcuguggccagaagcgaagcuugggcaucuucuggcucggccuuucucaacagucucuugguauuuucuauugccuauuacccagucucuagauuccaagacccaacaaaugggcucaggaacuucccaggcuuauugugcccuaaagaaagccaagcuuucagcaccauaaaaucauugucuggccuagugaaaggaucaggacuuucccaagccauacagccauguucauaccccacucuggccaacaccaaagcuuagcguauggacauacaaagaucagaucuggcucacugcugcuuuugaagccugauuucugaaccuagccauacccaucugaaacaaacaaacaaauaaacaaaaaaaccccaccacccuuucuguguuaucuuacacauguuuuaacagacaucuuguugaggcuggaaacacuaucagaaaccuauauggaaaagguugccugggacucuaccuuucuuccuuugacagcaauauucuauuaucagcuuagcuccuuauucccuucuucaauccuuaacucucucucucccucccuucuuucuuuccuuucauucucuuccuucccuccugccuacccucuuucucucuuucugagauggucucacuagguaacucuggcaagccugaaacuuguuauguacuccagguugacuucaaacucacagauaucuaccugccucuaccucuaaguacugggaucaaaggcauguauccccaugccuaaccccagauacggcauuuuauaucuuuacuguauaacuucacuugaauuuuccccucugaccauuguaguaugguaggcgaagagcauguugaagcuaccaagguugaagucuccaucuagaugggccauuuguagcuugugagcuuccugaacauagauuucccccauauauucagaugcaucauccauaaaaagucuaaggcuacauucaacuaaauggugaagaugguuuugcauuucaaggaaagaauauacaaauugccuagagugugucacacaaaaaguuaaauguugaucuuguguuggaaauguuuaaagaacagcauaggcauucaggacaccaugaaucuaucuaugacagucccugagggcccagaagcccaauaucagcuacagugaugagaccccaacugaaucucaaauaaaugagguguuggaacccugccacgggcuguauauaacagucuauuuagagacaggcgugugcuucugcccacucuucucaacuuagaagcauaaauuagcaagcaauugcugcuacacaauacuucauaguuaaaauaaguuuuuuuaugaccucagaauuuaauagaucccauaacagcaaucauauuaauauaguaguuaauucuuuuuuguaaaaauucguaagaauauuaccuauuuuuaaacauuccuauaggcagcauuaugucauacgacaugaaauaaauaauccguguuuuacuauagagguuuucucugucguguaguuaagccugcagcagcuacuaucugagacauugccugucuuuccaccuuugcuccuuuucuccaccauguaggaaucagcaaaguccaguuccuuuuuuuuuguuguucauauuuuuuaauggaugucuaugggagggaauaguuggcugaaucuugaucuuuguuguugucaagcuauugaacaauggucauagcagaacaaaucucaucuuuuuccuuacaaauuauuggaaaauauauagcuguugacagcaaccaaguuuuuagaguagauaucacacaccccucaggacuccauuuuccagaaauggucagaaaggcgaguacauugagguacuucauaagccuuggcuuuauaacuuuuagaauuuugccuauaaauguuugacaauuguacauaauuaagagaaaagauuuuaaccuuagagaggggugguaguuguaccuugcuauaaggcucuucaacuccaagaaauccaguacaauuuauucugguuuagguuucauucuggcauacauguaugccccauagggcgaaagccugaacaaugucaacuacuuuauacauccuuaagucacuucuuaaauaaauaauccugauauauuauauauuccugauucaguuguauaggaccacugaacucuaaaauauaucacuuugauagaauaauauagaaaggcugacguuuuccuucaucugcaggcacaucagggaauaugcacauugcuguugugacuugaggugacuguuucuugcccugcaguuucuaguagacauaccucauugcucucacauagccaaacaaaggcacgcaucugacuccaaggaggacaucuuguauaaagaggaaggcaucgacuuuuucuguucugcaauucgugcacugcaggcugucuguccugugaaccgugaggucaagcugcuucucugacugucgaccugaacuccgcuucagauauaaaaucaggaauaggcacaaguagcccccucuucagagaaaauggagcaucugugcuuggugaaaacuccugugaggucacugauuuguuuagcaucaaacuguccaggaaaaugucauccuuucuugccagggaaagagugaggccaccuuaggggugagccaugaggcaacauggaagcagaaauggcucuguaugcaaacaguccuuuugcugugcuggagagccaacaugcuacaaauccugaauuuucccuuuaaagaaugauauccccaaaugauccucauauuauagauagagcauaggaaagagaugcuuuuuaagauguuuuaaaauuauccacaagucauuaggaagcaucaaccccaguauuagaaaacggcccugugguugcaauuucuagcucauugccugcaugguaacugugcucuagcaugacuuuguggccuugcauugaucuaagaguguggagacuccuaaugaucuugcagaacucuuguggucauugaacauuuuagaauaaugauugcuuaugugacagcuacagaacauuucaagucacaauuuaauacauguuuuucuucauuguuguauguucaaauauuguuaacuaucuacauuuucuacuuguuuuuuuuuaaaauuauucauggaaagcagggugucaugaaacaauagcuaaagguaaccuaccucuauuugcucucuuccucaguuacaguaucaucgguggaaacucgcaguucaccaucaacccauccacgggacagaucaucacuagugcuuugcuggacagagaaaccaaagauaauuacacuuuggucgugguugccagugaugcugggucuccagagucucuuuccagcucuacuagugugcuugugaccaucacugauguuaaugacaacccaccccgguuccaacaucacccauacgucacacacaucccaucuccuacuccuccagguaauucaaugcugaggucacucaugugacucaguggcuuagcagacaaguucugagaacaaagcuacaauauauauauuguaauauauauauuguuuuauauauauaguaauauauauaagcuuuguuuuauauauauauuuauacacacacauauguguauauauacauauacauauauacauauauauacauauauauauauauauauauauauauauauauauauauauauauaugauuucuaauacaaccuaaucuggaaaacccuaaaaauugggaugugaaguuagauccaaugaaauuaaagagauuccaauccuucucuuguaaauuauaaucuuuuauuccaauuaguuguguacaggacuucacaccuggcacagcuuccgaguuucaauucucaaaaugcuucuucaauauagcaaaugaauaaaaucaguuccucuucguugucagugauggcucucaucugacauaacauuuguauguaaguuccuaagagaaggaacaagaucuuuauuccucguaccaauccccugcuuguuuuuguuguuguuuguuuguuuguuugagacaggguuucucuguguagcccuggcuguccuggaacucacuuuguagaccaggcuggccucgaacucagaaaucugccugccucugccucccgugugcugggauuaaaggcgugugccaccaugccuggcuuuccccugcuuguugaaggaaaauaaauauucaacuuuaauauuucauagauuuauuuucaaaauguugcauggaugacuaauuauaaauauugccuauuuucacuuccagucucacuucuauucuuaagcuuaugagccccuugugauugccaucuuggaaacaacaagaauuuguuuuccugaauuaaaaaaauaauaguuuaccauuuacuuuaugaguagugagaugcucucuuaggaucuaagcagauauucagaaauuuguaauuuuuggugaaaguauaaacaguaaaauaugcaaauauaaguaauacucccuuuucccugaauauauuuuacuggaagaauaaaguaguggauucaguauuucucuuuauguuauuugaucuccuacuaccuagagcauaucugauaccaauugaauaaauaaaaucuacaaauauaugugccagauugcuauaaaaaacauagggggucacagauacuugaaaaaaauccagcuggcacgaugcuaacugcaugauucugcgccauccucugauguacagaggggaauccucuaggcaaaaugagauguugguuaugacaucauucuauuaguauaacuggcaagacucauucauuggcucucaauggaauucuagccuuuuccuuuugucgcuucuguggggauguggggaaaagguuucugaaugagguauugaucauuaaaacuguccugcuggaugcuucucuacagauuucuacuacagcauguuucaagggcauccugccagacacuggugcuugaaauccaaacugaguccugucuucauuucuuaucccauaccacuuuacacuuacuuaaaucuauuaggcauauguguauauacauuuacuuuaucucuauaguagugguagcuccgagaucaaagaauuuugccaggaaacaaaggggguagugacccagaagccacauuugggaaggggcauguugguggacagguucucguucucaaaaguguuuucaacucaaagguguuuucaacucaaagguguuuucagaagcgagggaauggugagugcuuuucacugagcuggagagugguagcucuuggaagagcuuauaaacucuaguaucugcuggaagauugugugcaggggccgagauuccagauaaucagcugaucuucacccugguucucucaagggcuuuuugaaaaauaaguaaauaaaacauguguggggguuggucagaaauuaaaggcugguuucaaaagucauuaaucagauuugaccugagacaucagagacaauaaacuuuaugcugaucuucccaguaguguuggaaagguuaauccuggcagugccauggucucacacuuaucagggacucagccaagggauucccugugauuuuaacugagaaccuucucuguugcagguuccuuuguuuuugcugucacagucaccgacgcggacauaggaucuaauucugaacuccauuacucacucucagguagaaacucugaaaaauuucacauugacccccugaggggggcaaucauggcagcugggccacuaaguggagcuucggaggugacguucucuguccaugugaaagaugguggcucauuuccaaagacagauucuacuacagugacuguuagguuugccaacaaggcagauuuccccaaagucagagccaaagaacaaacauucauguuuccagaaaaccagccagugggcacucuggucaccacuaucacaggguccucuuugagaggagaaacuuugucuuacuacaucgcaaguggaaaccugggcgacacuuuccaaauugauccacuaacaggacagguguccaucagccagccucuggacuuugagaagauacaaaaauacguuguuuggaucgaagcuagagauggaggcuucccucccuucucuucuuaugagaagcuugacaucacggugcuggauaucaaugacaaugcuccaacauuugaagaagacccauuuguaucugagauccuggaaaaccuauccccucggaaaauccuuaccgucucagcaacggacaaggacaguggucccaauggacaacuagacuaugagauugugaauggcaaccaggagagcaguuucaccaucaaucaugcuacaggugaaaucagaagcauucggccacuagacagagaaaaaauaucccacuaugaacucacugugaaaucuucagacaaaggguccccuucucagagcaccuccguaaaagugaucaucaguauuuuagaugaaaacgauaacgcaccuagguuuucacagauauucagugccuauguuucugaaaacucccccuugggauacacaguuacccguguaacaacuucugaugaagacauugggauaaaugcaauuaguagauauuccauaguggacacaagucuuccauuuacuauuaaccccaacacaggagauauugucaucagucgaccuuuaaacagagaagauacagacagauacaggauccgaguguccgcacaugauucuggcuggacuguaaguaccgaugucaccauauuugugacugacaucaaugacaacacuccaagauuuagcagacccucuuauuauuuagauugcccugaacuuccugagcuuggcuccagagugacucaagugucugccacagauccugaugaggggucaaaugggcagguguuuuauuucauaaagucgcagucagaguauuucagaaucaaugccaccacuggagagauuuucaacaagcagguguuaaaauaccaaaaugucaguggcuucaguaaugugaacaucaacaggcacaguuucauugugacagcuucugaccgaggcaaccccuccuuacucagcgagaccacaguuaccaucaacacgguggauagcaacgacaacccaccucaguuucuccaaaauaaauacuuuaccccaguuaccaaaaacguuaaaguugguacuaaguuaaucaaagugacugcgguggaugacaaagacuuuggauuaaacucugaaguggaguauuucgugucggaugggaaccaccuagggaaguuuaaguuagacaacgauacuggguggauuucaauagccucuuccuugguuucugaccuaaaucaaaacuuccugaucagagucacagcaaaggacaaagggaaccccccacuuuccucccaagcagucguucacaucacagucacugaagagaacuaccacaccccugaauuuucccagaaccauauaagugccaccaucccugagagccacagcauugggucuguggucagaacugucucugccagagaucgugacaccgccaugaauggucugaucaguuacaacauuauuucggggaaugaagagggcaucuuugcaaucaauuccucaacaggugugguaacccuagccaaagcccuugauuaugagaugagcucaaagcacgagaugaccauuagugccacagauggaggauggguugcgaggacuggcuacugcagccugacugugagugugaucgaugugaaugacaauuccccaguguuuguuccugaugaauuuuucccaacuguuauggagaacgccccaagugggaccacuguuauccaccuaaacgcaacagacgcugacucgggagccaaugcugugauugcguacacugugcagucaucagacagugaccuguuuguuauugaccccaacaugggagucaucaccacucaaggcuucuuggauuuugaaaccaagcagagcuaccaccucacagugaaagccuucaacguccccgacgaggaaaagugcagcuuugccacuguggauauccaguugaaggggacgaacgaguaugugccucgcuuuguuucuaagcucuacuacuuugaggugucggaagcggcuucuagggggacugcuguuggggaaguguuugccagugacagggacaugggugcugauggagaaguacacuauuugauuuuuggaaauaguaggaaaaagggcuuccagaucaacaagaugacagggcagaucuacgugucugggcuucuugauagagagaaagaagaaagggugucuuugaaaguguuagccaagaacuuuggcaacauucgaggugcagauaucgaugaagucacaguaaauaucacugugcuugaugcuaaugacccgccaguguuuagucugagcaccuauagaguccagaucagugaaggggucccuauugggacccacgugaccuuugugagugccuuugacucagauuccaucccgagcuggagcagguucucauacuucauuggguccgggaaugaaaauggugccuuuuccauuaacccacagacagggcagaucacaguuaccucagggcuggaccgggaaagccugccuguuuauaaucucacuguccuggcuguagacucagggacucccucugccacaggaagugcuuccuugguaguuacccuggaagacaucaaugacaauggcccaguguugacugucagugaaggggaaguucuagaaaacaaacgaccaggaacucuagugaugacccugcaguccacagauccugaccucccuccaaaucaaggccccuucaauuauuaccugcugagcacaggccccgcuacuaauuauuucagucucaguaccgcuggcguucuaagcacaacccgggagaucgacagagagcagauugcggacuucuauuugucuguggucaccagggauucuggggcuccucaaaugucauccacaggaacugugcacaucacuguucuagaucaaaaugacaaccccucacagucccgcacaguggagauauuuguuaauuauuacggcaacuuauuuccugguggcacucugggcucugugaagccccaggacccggauguguuagacaguuuccacugcucccucacuucaggagucaccagccucuucaguaucccagcgggcagcugugaccugaguucccagcccagauccacagauggcaccuuugaucugacuguugucagcagcgaugggguucacagcacagucaccaacaauauucgaguuuucuuugcaggauucuccaaugcuacgauagauaacagcaucuugcuucguguugguguucccacagucaaggacuuccugacuaaucacuaccuucacuuucugcgcauugcuaguucccagcuuacgggccugggcacggcagugcagcuguaugcugccuaugaggagaacaacagaacguuucuuuuagcagcugugaaacgaaauaauaaccaguaugugaaccccagugguguagccacguucuucgaaagcaucaaagagauccuccuccgucagaguggugucaaggucgaaucuguggaucacgacccaugcauucaugggccgugucagaacggaggcagcugccuucgaagacuugccgugggcucugcgcugaagauucaggagagucugccugucaucauuguggccaacgagccucugcagccuucccagugcaagugugugccaggcuaugcuggaagcuggugcgagguggauauugaugaaugccucccagccccuugccacaaugggggcaccugccacaacuuaguugggggauuuucaugcagcugcccagagggcuucacugggagagccugugagagagacaucaaugaauguuugcccagcccuugcaagcauggggccgucugucaaaauuucccagggggauucaacugcgugugcaaaacuggauacacagguacguccguguguuacuuucuauguuugugacuaguuuucuuuaaaagacuuuagcuuugauaugcauguugucauuugaaugugugugugaguguauauauauguuuuuugagaauuucauacaugaauauuauguuuauaucauucccaacacucucucccccuuucaacucuuccuauauucccucucaaggucuuuaucucuucuauaacuauuauugcuauauauccauacacagaucuagcuuauugagcccauuuaguguugcaucuguaggggugggauucuuggaaauauccagcauuuauaaauuggcauggcgauuggugugguuauuuuaugggucucauuucagcaacaauguugaaauuucauggguguagaaucucugucauguuuagaagacacugucucacaccaggcaucuugguccuuaaaauccuauagucuuuccacccucucuuccaugucauuccuugggcauuagauaugaagguuaacaauuauuucuauuuuaauuuuuguacuaauuuauuuuauuauguaaaugcuuugccuguuuguaugcaugugcaccauggguaugccugguauccauagaagucagaugagggucagauacccuggaacuagaauuauagaugguugugggccaccauguggaugcugcaaauaaaaccuggauccccuacagaagcaacaaguacucuuggccaucucucugccuuugugucuacuuuucaaauauuaagucagagcuagugggucauacaacauaucucaggguuauauauguauacaccucuaaggaagaguauauaacauugcuuucaauagcuauguaugacuucuuuuuauuuuauauuucuacucuuuuauguuauuuauuuuugugaauccuacauaucacuggauauauauagcaccuacuaguuguagguauucauggauugcuaaaaggcauuauguuaugugaaauaaggcaugcacagaagaacauauggaaauaaaucaaagcauacauugguucuuuuauuuuuaucacaugugaauucuuuaugcauaucuuaaagcaauuucuuccacugaguuucuuauagaucucauuuuuuuauuggcucaugcuaauugcacagagacgguggcuagaauauuuucauacacauauuguauauacuggucauucacuguccucuucucuuucuuccccucccuugcuguuacaaaucuaugucugcuuuucugucauauauaaauacauauaugauuuuauguaucuauguaaaagcuaggaucuaggauugggagauggcuuagugguaaggagcacuagcugccuauguggaguaccuaagucuagcucucagcccacaagguggcugacauccaacugugacuccagucuccuuguaugcucaucuguugauguacaucuaggcuggucccuuuagucauugacuuuugugacuaguaagugcacacauaucucugcaguuggaaaugaaucccugggacauaugccugggcuugguauagcugggucaguugcuagugagcuggaagaguucccauuccucccagcagugcacagaaguuacccuucucuucauccucauuauguucuucaucuguuucaugguggccauccugauugugaugagaagaaagcacaaugcuguuuaaacuuacauuuuccugguaacucaggaugccaagaaaauucccaccaguuaaacaagcaugggggaaggaauggaagguggcugggcacauugcagccucagucaagaagcagagagaaaugaaugcuguuauccccaucacugucauuauucagcuccaggcucuaggccaugggcugugccaucuauauucaugaucauauuucuuuaauaacccaguauucuuuuuccaauucauuugcauguauaguggaacauagauaagaaagcacagagguaguugguaaccacucaggucuugucuuccuaccugcagguuuacaguuuguagcauguccuugagucccuucuaggagugaaggauaucuuuaagcucaaccagcagauaggucuuguuccuaagucuggagugcuuauaauacaccuagagcaugggcuuauaaaacacuuaguacauggcuucuuucuguguaccuccgcacaucuggauacaugucagguguggccuugggaaggaugcuuuggauuuauuaccaugugacauuuccuucugcuuugaaggaugucuuguuauuuuaggagaacaaacauauauauaggcugcacagaguaauuuuuccuaaggaguuugccaaacacaugcuuucacagaauggaaagaguacgaggcuuugaaaaaagaaucccaaguuguguaugagugcucugguaacuaugaggucaaagagauguaugaugcagaagaaaagaaaucugugaguaguuggggcaaagcuuuuuaaagaaaaauauauugagaaaaacauuuugauaaguuaaauuucuugguggcaccuuucccuggggaaaaggauggcaacauuuacauagugugcaaaaauaacuacuuggugcuaagauaacuguaaaagauucuaaggguuggagaaauggcucagcagcuaagaacacauucugcauucccagaggacaggagcuggcucucagaacuccugugucagcucacagcuaucuguaacucuaguuccaggggggucucaugcccucuucugcccccccccaagcacuguauacacuuagugugcagaaauaaccugcagggaaaccacucauacacauaaaauaauaaaauacuaaaaaauccaaauauucaucaucagaaugaauaacacauaugcaaauauuaauaauaaaauauguuaauaagaugaugauuuacauagaaaauggguuggaguaguuucuauauacucccuucugcucuguguauaaacacaagagaugugacagcauuugugguggaagauguaggugcugugcuugagaagacagaaugucucaucaacuauggauauaaaaaaauuuuaucuacagaguaugacaguauguaugaggaguuuucugcuucauaguuaauagcuaguuaauagcuucacucuaauuaucaaaaagaugugguguuuaacaaauacaccuugaauaucuuuccuuaauaaacguaauuccaacagggccagucuguagucaacaaacacuuucaucuucagcuaugaucagcacauccaucaucuucagccuguguuuaauguacccuccuauacucagucucuguucaagccaccccacuccaccccccaucuuuugccacacacugugcaucuuaggucgaacacuuccuguacacuuaaacccuacucuugggagcuguguggacacucuaucuaaugauuauauauucauuuucaccuucacuaguucccaguuuucaugugaucagaaucuacacaacccaaagcaacucuccaucugucuaugauauauagugauuaucagcacacuucaugaccagaugucaaagcagugagaacaauucauucuucaaacgcccgcuaugauaguaaccguaucugcacagagaaggugauuugcauugaggagacacagaucugcucuguacaugcaaacagggagcuuacaagccuagcgacucugaugggcauugcugacugacugaaguuaaggauccaagaauuuguuccaugcugcugcagcacacauggcaucauaccgggagauguugugguaccugaaacuucugccauuucugccugaucauaugccauuaacagaaguuaguuuacauuuacaggaagagccacacagaacagcugagaagugacuguugguuuccaucugggucuuauagucucaacauuucacaccugagaaauacauauauggugguucuuuuagauucugaaauuuaaauuaaauacauacguuuucaaauguagccuugaauauaagugucaacucuaucaacauaauggauuuuacauaauuuguauuaauuaaagaacucaaagaacauuuucaaauggugauuaacucauguauucugacaagaaauaagaauacuguuuuaaaaauuuuuuaacuucuuauuuaauggcuuuauuaacuuuuuuauguauuuuugauucuuaucuucuuaaaaauuucuaagagaguaaauuaaaguuacuuuaaauuuucuuuaaguuaaaauucuuaacaaaauuuuuuucugaaaauauguuuguuguaaagaugauaagucucagaauaugucuuauuuucuagcaauuuuagccauaauuguaguugcaguacauuuuaaaaugcauaaguaaggcuuauauuuauuuuaggguguuuuuccauuuuucuuugagcuaacugaaguuggugaauauuuauauuaaacuuagauguuuacaugaaaguaccauguauaaaugaaaaacguucauuguauaaguacacaaaaaauaaaccugaauuuauuuuauuauuuaaauagaaaaauuuaaaagauaauguuuucagugggauucaacucauguuagauuuuuuuuuuuaaugacucacuuuuagugauguguauguguguaugucuauauggugguaugugcaccuggguucagaagaggccagaagagggcacuagguucccuggagcuggaguuacaaaugguuaugagccuccugacaugaguccugggaacacagcaccaauccuuugaaagagcaggaguuguucuuaaccauugaaugaucuuacagccccuggaguagaaauuccaaaaauuagccaugucaguuuaaaacuccuacaguucauggagcccauguucuugcuacuccagccuagguuuucuguccuugcuucccugucccuugucuuuaggaaguaugguuagcuguuuauaucccacuagccacuaauauauugccaggaucuacaucucucccccacagacuguaagacauaugggccuacuauauaaauaugucacuuuuagcaguauucuaaaagaaauauucaaaugagaaagagaauaaugaaauaaaacaguacuuacccuuuuaguauaugggaaaauugccuauucucuacagcaacaaaauacauggaaggagugguguaugacuuucuuguaggaaaacaauaaaaaguuaaaucaguaggucuuauuuaaaucugcauuggauagagauggcauuuuaauaagggaaauguaaaccacauugcuaagaagacacauccuuuaugcagcagggaagugaguugucagguggagggggauguguuuccaggcagcaucaauggugugaaguucagcacaaacguacaauaacacaguccagccugugucucucuccuaccgcacugugaacuuauuuuuggugccucuaaaucuguaacuuguuuauuuucgugaucuccccugagaauucaggaguguucugaaaaugugcucugugcucugccuugucuggagguaacugcugcuguuuauaaaggaaacuaucaugugugugauucugugguguuuagaaaugggccugcagugccacaggccugacucagauuuauaaugucagacuuaaacagcuguggcuucagaaucaagccacaagaacaaaaaaacgaguuaaacaaaaacuuaagaugugugucaagcgaaguugcugugauguaagcuuugucuguggucagcuuugucucacuauggggacaaaauauccaugcauugcaagaugcacaaagugcuuauuaguggagcauaaacagcucuacagagugcugggcuagcaggcagagggcuuuaaguucaaucccuagcucugaaaaagcaacugaagguugggggagugucucagauggcagagugguggcugugaaucucuaggggcccagauucagauccauaacaugugcuuaaaaauccuagcaugaugguaugucugcaaucucagaguugggaaaagcaaagcaagcagacacuuagagacaauuaaccagccaucuuggucauccaaugaucuccaugcucagugacaaucuaucaaaaccuauuguagacaaccauugaggaagaugcccaguguugaccuguggccuauauaugcuuauguauaaacuuauacaugcauauacacacauucuguuucucucauacauacauauagacacaaagaacagauuuuugaagacuacuaauuaaaauccuaauuuugauaaauagaaauuaaaagcaacagucuuucuauuuguuagaauuggcaaauuaggaauuuucuaauagguguaauaauauagcacuuuaacuuuauggaacaacuuuuuaaauuuauauaaaaguaaacaaugaaacaagacaggguucagacacugcauuuggcuaucaggauaucaaaugcucacacagcccaguaugaacugaacacagaagcaggaaaccuaauuggucaguggcaccgucuaucaccucagaggcaggagacuuacuuccauauuagucacuuuuccuguucccgugucaaaauaucaacuuaaaggggggagggcucauuuuggcucacgguuugugagagucacaguagcagguacagaggcugcagaucauauugcauccacagcuaggaagcugagaggugguuucuggugcacagggcacuuucccuuuuggaucaguccugggauccagccuacuuuaggguggauauuuccaucauaguggacaggaucugaaacccguucacagacaugugcaacauugacacuucuaaggagagcucccuugacacauguaccuuuccuucacguaggguuaucuugauucugaccaaggaaguacucccuucaagccauuguccacuuucuuaucugcuauucucuauccacucucugccuggcccaauacugacgcaucugauuuaacaagauauacacagacaacauuuauaugcuggaacuaugcagcauguuacucuuucagaaaaagauaaagcauguaugggcugugcuaggggacaaauggacaaaugaaugaaugaauucgaaaugugauuaacagguuuucuauuuccuauucuguuuuaaacaaggcaugagauaaguucaaguuccgagauuugguuuuguuucauuucauuucguuuuguuuuguuuuguuugagcggugaaggaguggcuugacaagcccauucacacuaauucucccuuucaaauguuugagucagugaaaguuguauaauggaaagaauguuguaaaagucugaacuccauuccuggugggucaaugugaaggugagaucucaacacaagcaacaucagggaaauaauucaaauguucucaccaugacacuauuucaaaaaugggucucuuuccaagaugguuacauaaauggcacagauugcauaugucuuaaugauagcacaucuggauaagagacagaaccugucugagaaaugaucccaggguccuguuguugaguaggugggcuucugugucucugcucugugacuugguacuaaaggauguagccuuuuuauguagcuacaguaguugugguugguauauuuacuuuuaagauuucuuaacaaguuugauacauuuuaggaaaaaugugugaaucuucagucaauuacugugaaugcaaccccugcuucaauggugguuccugucagagugguguggaguccuauuacugucacuguccauucggugaguaaaauguauccauugcuaugcugaucuagggacuggcuguggcaccuggcucagcugucagagugcauggagccuuggguugaauuguuggaaccucauagugguacacucuuacaaucccagcaugcagcagaggaggcaggaggaucagauguucaaugcauaagagacuauuaaucauuuugcacaaggagauuaaauaaaaugaaauauuuaaugcugacuguuuuaaagguuaauugugaaaacgcuaccgaguacaucacuguaauuauuguuaggaaaaaaaauaccucaauguaauaacccuauugauaccucauuuuagucuagaacuuaauaauuaaaauacuaucuaagcacuuuuaauucuuccacaaauuucuaagaauagucaaaguauuuuuguuuguuugucuuuuacauuaauccaacuauuucuauacuagaugauuuggugagcuaaauguauauuaggcuuguauagauaauccuuaguaacuaacauaaacaauaucauuuuguucuuuugaggaucgauuagaaccguuuauauggcuuacuggauucaauugcuucaauuuuuggaacuguaguagagagagagagaacaguagacuccccaggauugcucucuguccuccacauacuugcagaacacacauuucuccaccacacacacacacacacacacacacacacacacacacacacacacacacacucacaccaauaauaauuauaauaagccauaauuaugaaaaaccaauuuuaccaauaagucugagacucagaaguuaagguauuuguucaaaaucaggaaaagcuuggccuagaccauccaugaugauuugacuagagagcaggcggaaccuauggacauugcugguaucaugccaauaucacauuuuugaagggucucaucaaaaugcucaugaagcaaaauguuugucaguaugaaaacagccacuuccucagaucuccuacagggccauuuuauugguaucccccagucaggcuucaggauuuaacuuguguuuuggaaugaaagaaaaguaaauuggacuagaaaguggaaaauaauuuucaagugacugacagaguguuuaugauguuagcauuccucgccauuucaaucgcaaauaugcauacuuagaacaauuaaugccaaacaguuagauaguuuuccauauggugcugcuauaaaacccacuguacuggggagagaacagggggcguaccuugggauccaaaaugaucuucccucacccugcagacagcccugggggagagaaacagcaugcucugaaauacagucagcagaggcuggcaguccagaucccaccuaauuccuuccaaaggcaaaaccccaaagcacuguugaaauguagacacugucagcugaccauagaagcauuuagaaaggaaaacaaaauaaaaggccuuggaauuccaauacaucauuccaagcugcacagacugaauuagaaggaaaaguaauuugccuucuuaaauugaaugugggugacacacucagaaagaagcggcagauggaaaugccucaaaaaccugaggugguaacacacaguguggugagacacgcaccccaaacucuagauucccuagggcuucaaagcuggaaaaacuguucuauucauagucucauucaccaaaauccauucuuuagauuucaauauauuuuuagauucauagauauauagguagauagaugauagauagauaaguagaugauagauaaacagaugauagauaauagaaaaauagaugaaagaaagauauauaagugaaagauagaugcauuguauugcauauguuauauauaugcaagagcuguguguguguggucacacagcaacuuguaaacuauccuguguguguguguguguguguguacuuauauauaauuacuaaauuauacuuauauauaauuacuaaauauuuuauaauuauagaucucuuuaucuggauuauuucacacagacauuuggaagagaaauguuaaagacauaaauuuuacuuuauauuuuaagaugggagauaucccuuucacagaaauaguaaaaaaaacucuucaagacaaaucuauauacauauuuuuauauuugaaaauaugguguaaguuugaauacaaaugcaaaacucauugucuaauaucuauacauuucaccuacauuuaaacuuuguauuuuuguguauuaguuacaauauaacaggaaaaggcccauagaaacacacuguauguaugauuuaccuuugcuuuuuauuaagcuucauuacuccuugcuuguagaaauaauauacaguguaauuucuaacuaauccaugagcauuacuguuuauuuguauaaauaauaugcaacacaaauucauaaaauauaaauaauguagauauaagucaauggcauauuaaagguuaccuauacauuauauuacuuauguguauauccuccaguuuuuucuccuuaacuuugguuuaagaguaaaaccaguccuagucauuugauugacugucaucccugccuggacagaaaaaugacaagauaaccuguguaggcacugcaaacucuccuaggccauuuuaucucaaaaauuggauauaaaaugugacacagucaaaacaguuaagcaagaucaguguaucuggcuuugaagguuuucucuauuucccaugauuccaugaccuugguuaagcuguaaauucucagugaaauaguggcugucaccucuugaaacagagcagcuuccuaacucuaacuucaaugcauuuacaguagauacuaaaucuaaacuaaagaaugaaaccuuuugaaggugaacaugaacccuuccugcggccauggaucacuuuccaggcaucagccacaucugccagugucaguggaaaaaaaacauuuugccuaguguagccucaucaaugaaacucaauuucaaguuggaaaaagacaguacaaacauauggacagaccaaaacacagucacucuaaaugaacuuccugugacucaucccaugacaaguugaaaaugagacagauaaaaacucaauacaggccgggcagugguggcacaugccuuuaaucccagcacuugggaggcagaggcaggcagauuucugaguucaaggccagccuggucuacagagugaguuccaggacagccagggcuagacagagaaacccugucucaaacaaacaaacaaacaaaaacaaaaacaaaacacaccccaaaacaacaacaacaacaacaacagcaacucaauacaggguggagaaauggcugcaugcuuaagagcacugucugcucuuccugaggacuacagucugcuucccagcacacagccaucuguaauuuuaauucuagcgcauccaaagcccucuucuggccuugguggguaccaggcauagagguuacacagacacaaaggcagacaaaagacccauuugcauaacauaaacaaaacuuaagguagugacuucugcgcuagguguagccuuguaaaauaacaucgagucuaggaccugauuuuuaagugaaaaccaccgagucuacucuccucaauugaacuaacgugguuuuaaagaauuauaacugugcaccauggucuuuguaguggcacaugcucuuaauucagcacuguggaaguggaggcaggagaggaucucugugaguuccaguaaagccuggacuacacagaaaaacccugggucaauaagauaaugagaaaaguauaagguugaacauuauaggauaguaaauuuuacaaacaucaacaaaccaauuuucaguguauuuugggaaugaacucucuucaaugaacuccuuuccauugccuuuaauuuuuaaaauguaggcauuuugagguagauuccuaacuaaccaaacagcaucagcaucucuucucucucauacuuuucugugucuucuuuggcgaugcuguaggcaggaccagcuugccaaugaugaccauggaguuucaucugguuacaagaauggcaacuucggauagcacuugaggaaggaugaugauaaugacauauuuaacggcacgauucauuauuauaacugaaaauauuuuguuacgaauaacuuaagaaaacacugcugggcuucaauguccuuucucuucccugcaggcgucuuuggcaagcacugugagcugaacaguuauggauuugaggaacugucauacauggaguuucccagccuggaccccaacaacaacuauauuuaugucaaguuugccaccaucaaaagccaugcuuuauugcuuuauaacuaugacaaccagacgggagagagggcagaguuccuggcucuggagauugccgaagaaagacucagauucucauacaaucugggcagugggacguacaaacugaccaccaugaagaaggugucggauggacaguuccacacagugauugcacggcgagcaggcauggugagacaucucuccucccucagcaucucuucucugcacugcagcccuucagccauuccuucugggaaucauguauacaguuccacauuacaggauaauaugcgaguuuguuguguggccccagagugauauuuuucuuuggcucuuguuaucuauagugaaguuucaggaaaaaugaaggauauaucauauugaacgauucuuucucagccgucuaccucauugugaggcacagccauggucaucugcuguguccuucuguccauggcugcagccagagaugggccauggucaaguauugaguaaugcuaaaugugaagaaaauauuucugcuauuacuaaauuggccacagugggaagaugucuuuacuucagaaaauaugcagaaaaaaaaagcuacuauuugauuuugaaucucuuacauuauacauuuuacaacaaaauuguaggaaauuggcaaagucauuaaucucuaggcuuucaucaucccacagccagaccagagaugucucaaucuacgcuccugcugacaggaaaagaaggaauauauuuuguuagaaaauguaguguuaugaggugguuuccaugacaaauauuuaaagaauuccaaagauuaaauugcaugagugacuaggaccuuuauaucuucuuugaguuuacaaacaaacaaacaaacaaaaaaacaacaacaaaaaagcuuuauagcuugagaaugcccacuacagaugccagccagaguagagcagguauucccugguuggugcauaagcaccguauauuuuguaaaaggauuuuggugucuuuaagaucaguguuuugcacacuugcucugcaaugauauguucacagcagcacucaaagugcuucuccgaaaugcaagguugcuuuugagguuggugccucuuaguuuuugaaauaacaccucaagcaguauauaaaaaaaaguggaacauaaauaucuugcauuggauuggaaugguagauuuuuuuuccaaaaaauaaugcuaacauuuauuauaguuuacuugagaggagaguaagaaaaauauucaugcagcucacaggaguuuguggagauuuuaauagcuguuacauauauuaaaagugaaugaauaguauguuuuaauauuacuauuuuaauacucacugggcaauagugauaaaugaacucuauuaauaauuucugaaagaagagaagguuuuaaaaacuuuucaaaaucuucccuuuaaacagccauguugcuggagagccccuaaaacucauaagcagauuuaacaaacugacgucauuuauauccaucuugaacuuggccuuauauuuaagacaggcaaucagaugucugcccugcuuuuaugcaagggaggcggcugauggacuugcuaugcaccugugcuguuccugcuguucauuacaaucaauccaugacccacagucacacaugggaagugcuuccuucagacggaugugccgugucaucagagaacacuuaggaggaauccuuucacggaaccaggaagagcaugaaguccacccuugcucaugguguuggacucccucuaccuugggcuaucuaguauaaugcuguacacugaaccucacgugcaaugucauuggcugaaaacuggaaguuuggcauguggugacuuuuagugauggucagggagugauccccagucucaccaugaaggauagcauaauggggaagugcaauguugaauguugucucucccacaaguagucuccuuggccauugcccagagagaagaccuuguuuucuucaaucagcuucuugggucuucucuaccccauugguggcucuuuacugaucaaggggucuguccauacgcugacuacacaggaagcuccaccugagggcuguggucccucagcuugcacaacaauggcuguugguugugacugaaaccccaugagagguucugggcaucgggcaaugaaucuguugacacaggagauugcugauauaauuugaaauaacaauuuuuaauauuaaugaggguauuuacuugauguuuguacauuuuuacagggagacaaggaaggggaaaccaggaucguaauagacuacauggaaauaauuauagucaacaaaaaagaaauaauaaaacacaauuuaaaacacaauuuaacauaauuuaaaacauaauuuacaacauauuauaguauauauaugcauaucucacaccuuuacacucucuuuguaaauaaggcagauagaauaagucuuuugagaaaauuugaaagacauguuaggauauuggauuauagaacagauauuuuuaguaaaauuguaaucucauggaauugauauuuuuuagacagaauaaaacuucuuaauccuuucucauauaaaugaggccaaaggacaggacuauuucccaaacagccucaauauacacauauacauauacauauacauauacauauacauauacauauacauauacauauacauauacauauacauauacauauacauauacauauacauguauaugcacacaugcacaugcacauacauauauguauauauauguacacacacauauacacacacauauauauacauuucuaauucauauauguauuucuaauaauauuucuaauucauauauacauauauaugaauuacaaauaucacagugaauuauaaauaucaaggagaucugcacuuauauguuaauauuuaaagcaagucauguggugugugacuaaguauacauuaaaucaaggauaucauaguaguaauaacuucacuuauccccgcaugagagccaugcuggaagcaucucccguggaggcugaugccaucagaaggccuuggugacuguucccucucuugcuuacaggcagcuucuuuaacuguggacuccugcucagagaaucaagagccaggcuauugcacugucaguaauguggcgguuucagacgacugguaaguaaaacgauagcucuguucucgucaucauuaaaauuaagguuuauaagaacuuuauuuuuuuuaauuuuuuuauuuuuucguuuuuugagacaggguuucucuguauagcccuggcuguucuggaacucacuuuguagacuaggcuggccucaaacucagaaguccaccugccucugccucccaagugcugggauuaaaggcgugugccaccacugccuggcuuacaagaacuuuaaaauaaguauucugcagaccuaauauuuccucauucccucaaagagauauucacucuauaaagcaaugaaugccagagaaauauuauauuaauguuguguuuaaaggucacaaaccaucgagucaaggauaaggaacaucguguccacugcagccagagcuguuuagauuggccuucaugaagugcuuuuauguuuccugaacucugcaagccuuaggacaugaucauucaauccaacacauucuuuccccauuucugcugcaauucauguauguuuucuaacagcacuucaagcugaauugcgcauugaccaaucaaaggcauaagggccuuugucaggagcgagauguaaagaugcacagugaccucccacccaguuuuuaucauuaugcuccagggcuugccauggcuuuagagaaccagagagaucagucauuacuucugugcauuuggucuucucuaccacgcuccuuuuuguuuuuuuaauucuuauuuuuuggugcugucaacauggccaugugcaucugauaguugaaaauauaguuucauaagcuucacugauuuuuuuuuuaauaugaagaacaagaaaucuugggagcaccugcuuugaggauagguguugaacugugaggcucauucucaaaaagcuaaguaauugagugaaaugugcucuguggguuuucagaucuuuacccuuuuguguucauguaggacucuugauguucagccaaaccgagucacuguuggaggaaucagaucacuagagccaauccuucagaggagggggcauguggagagccacgauuuugugggcuguguaauggaguuugcugucaauggacgaccccuggagcccagccaggcucuggcagcacaaggcauucuugaccaguaagauuuuauuucuuaucauuuaacaaugcaaguguggacauugagcauccaaaggcuccaguugagaccuucccugauugacagggcuucugugauguggcuugaccugcaacuuguuugcauccucuuucaggccacucuaucccugcuguuucccacauccaguguucugaguucacaguaggauuucacacugcuggccacucaguauggaaugaucuuaaaugucaccacuccuugagaccucaauacaaaagaccuucccuuaucccgaaucuggagauacaggagccccugugcucaugugcucuuaaauuuauacagaggagcucugucuaauaaaccacauaaacacauuucuccuuauugucuguuagugccuugagguaaagaaacucuucuccaugaguaugcguauuuauuucaucucacuauguacauggcuggugucauaccuggcuuauaaaugggcaaugaauaagacuggauuacaagugucuuugugagguacuugugggccuaaguuaacaugugccacugaaccaugcuaacuaaggauuucuggaccauugugcccuuacagaaguuguuaccuuuaguugucauuauauaaaauauuuuauuuagccuucuucuuuagugugaguuagacuguguuauaagguucuaugugauuaguagcugcaagguagcuggcacaagucccuuccuguccugcaagccugauauuaagccuauugaucaguccgugucugcuucaagacaaguuucuuucuuccaguuuggugccucaucccucauuucugugucucucuuguagguguccuagauuggaaggcacgugugcucgcaaccccugccagcaugguggcaccuguguggacuucuggucauggcagcagugucagugcauggagggucugacugggaaguacugugaaaaauguaggucgccauuuucaccuucacagggugccauugcauccccagaaaucauuuauauaugcgccuaagcauguuacugcauuuggacucuaacauggucauuauuaaguauuuaaaaugggguaaaauacaaugacaguuauaaacuggccucuuauccgaagggucaaauaacugaacuuaacuaaauucuuaauuucacugaaguuuuauagucucuaacugccucauauaaacuucagcagcuauauugagguuguagaucaauauuaucuaaggucuagugguauuucuccagucacauguuuuauaacuggcaggaaaaaaaguguacaugcuguaucacugaaugaugcccagcuccaaacacugugauuguuaauguguuaaaaauaaaagucccagucuauuuuaacuuaaguggguuuugaguaguacuaccucagucugcccacuaaugacuuuccauucuuaagcccaaaucuuauggugaucaagacaucuauaguacuagaaccauuagcaaaggauugcuuucuaauugaaaucugugcauucuauuauacccugagcccuuauggccacuuuauuuauaauugcuuuauuuugaaaugaaugacuagauuauugcuuaauucugacacaggcacccaaugaccuuuaaaagaaccauuuguugcuacuguaauagagaaugaugagaaaugagugauagcauuggaauauauuauaaucaagaaaauauuagaggcaggcagcauagauguaucuuagcauccuggcugagagagagaaagagagagagagagagagagagagagagagagagagagagagagagagagagagaccaagugguauuucuucagugagcuucccugagacucauaauucuucccauguuauucuguguguagaguguaacacccagggcagaguuacccccauugcauuuccccagugucccuuccugaguuauguuacuaguuauagagauguuaaccuuuuacuucugaaagucuuuuaucagaucugaugaugugcuauucaugacgauggcuucagguagaggggguuagaaguggaaaucuuuuugaggguccauaauuccaaaagucagaggcuagaggcauaagagucaaagguuuccaacuguaaaaguauauuugcuuaauaauuucaggaaugcauugaaauugagucacguuuugaguugugcauuuuggcaguuggcugugugcuccaugucuaggcuuucugucccacagcaaagaguuuggaugaugaguccccaaguaauuaaugauugucaucagggguuuuagguuucacagauccaaaaaggacucaacuauuggaaguacacuugcacaauuauucacaaauggaacuuguuuucucagaggaggaccagggacaguggcuuuagaaacuugagguuuugccauuucucauacucagaagaaugcucuaaacaguucagagagugccuucaauuuucccccuuuuuucuuggcuuucagcugucacuccagacacugccuugucacuagaaggcaaaggacgccuggacuaccacaugagccagagugagaagcgggaauacuugcugacccagagcauacgggacaccacauuggagccuuuuggggucaauagccuggaaguaaaauucaggacucggagugagaauggcauuuugauccauauccaggaaagcagcaauuauaccacagugaaggugagaaaggaugccaugaugaccccauggugacccaucagaugauuccuagcugcucugggggcucagucacuucuccuacaaauucuguccucuucucuacagucuuagaguucugaccuaugcuuggcaguaaucuaguaccaaccgccuuaaauguuuccagggucuggaccagagcaaaaaauaaauaaauaaauaaaaucugagagggccaguucuuaaacaccuucaucuuacuuuagaauagagucaacugucagguaggccaggauggauagguugucaagucuguuuugccugauaaaaaucaucauugcuuucccuccuacuguaagcaaaauagagcaugaagagugugccuugauuaugaagaauuacuuuucaucaagaauuuuuuuaaacacugcuaacagagguuaaaugcuaagauuagaauacgcuuuuagaaauuaucugacuuuguucugaaauaugcuuuucauucaucaccuaggaaaaaauccaugaaguuaaauguauuugguauuuauugugaguagaauuucuuuuugucucuccaaauaaguuuuaaugagagggagagggaaaggaagagguguauguuuugggccaggggccgggguggggggaggcaggaaucugugugagggauguauucucaguuccauggagacagagaaggacaugaggugcaauccuaucauuuuccuccuuauucccuuggaucagggccccucuuugugccuggagcucacaggucugcuuuccuagcugaccgggugcauuuaggauuagcuugauuccuuugcagcuauugacauuggugcugggguuccaaacucaggcucucacacguguacagaaagcacugagccacuucucugcccacuuuaaauaaaauaaaaaaacucaaaacaauaauuuucaaaauacguauucaacaagaagaguggauuugucuacgggcuuuuacuucacauuuccucucuauggcuagaaguaaaaaaaaguuauucacagccaugagccagucuuuucccacccuggugaccuuccaagagucugaaaugacaaccacagucuuucauguguagacaauagcaccaauucaccgacaagaucuuguauuuaguuccaucaacuguuuuacaagaucauucuguauuuuauaauuuuauugauacuuuuguauuggcuuuagaaaauucuuacaacaaacccaugcuuacuaacuuauuuuuccuaucaaaauuuuaaaacacauagaacaguauuagcaguuacuugauuuaauucacaaauauuaaaaaugaaauugauguuuaucauuaaauuuuagguuuugguuuuccagguuuuucuguacagucaauucuccuugcuguaucuuaggugucuguuuucaguaaggcacacaaacgacuaacuuuuucuggagaucuacuuguaucuuccucaggcauuuguuucuagauggaguuaccuccuaugguuugguguuuggagauguugcuuaugggaggggugaugguguuacuaccguguuuuugcuggagauuagaguugaauacccuaugauacaaacaguaccccaguggagaccuguguggucagaagugucagucaguguggaaucugagacaaggcccugauuuccuauaaggauaucuucaaauuuucacuuuacuuucauuacuuagacaaauauccugguucauaaauuaauaugccuuauaaaacaaaaaggucuuugaagugugcgcaaugugugcugcuuauaauuucuacuccaaagcaaacuagaagcaauaaagacagaagauaccaagagagcccuggccuaaagagccaugaccuaaagagucacuaucuaaagagaguggauuccacucccuagaacaccauuccuugcugggaggggacacugaggggacucugcucaaagucccuccauucugagaggccacacugcaguuuuugcaugagauuuucugugacacugcuuccaaguccagaugccauucaaaugacauaugacacauugcuauccgcagucuccuucagccaagacauucagaagaaauauaacaugguugaagaagcgagagcguccauaaggaagcugcugaauguuagggucgggcucugucacugugaaauuuaauaggauggcagcuugugccuccucaacguggugucccagaacuaaagaagaauugggcuaaacaaccaguaauuagcagccaugacauuuagugagaaaauugugagcagcaaguuuuuaaaacuaaggagcuuggcaggugaaauacauagaaaaggaaaaagcagucaaaaaaaaugagcaaaguggacucagagagcagcuguacugggcaggcaacaggggagggcgggaguugcugcagugcaauugaggaacagugggacagaaugugguauucuaaugucagcugccagccauccaagauccaugguuuuguuucuuuuggcucaccuucuaaccauuucuuaaacucuucauuuauugaacucccucccucccucccuuccccccccucccucccucccucccucccucccucccucccucccucccucccucccucccucccucccucccuaccucccucccucccucccugucuuucacacacacacacacacacacacauauuagugcccauaaggcauaagguucugggugguugagugaggauauaguuagaauaaucgaagggagaauucuagaaugguuccucucuggugauuuaauuugcauaugcauguuacauuuacauacacaucugcacugugugaguggaugguguuugcacauaagagagauacauacucugcaggccacagcgugacccuugcucucuucuuccaauuuuuuccucugccuuauugcuuugggugggucccuuacugaacuggaagccucauguauugcugucuaguaagaaagcuuccaagauccuccccaugggugcuggagucacgugguugugcucagcuuuuaauguggguguuggggauuugaacucagguccucuugccuauaaagaagcacuguuccaacucccaggcuacaaaaaauaggcugugucuugaauuaucacauuaaaauauuacuaucugacugguauauguaacugugacgcgaguucuccacaaagcacaaaugaagugauuugcaguguaccuggaagugguccuugcuuauagacauagugucugagcugagugacacacagaacugaccccugcuuucccuucagucacuccuggcucacuguauuucccugccuggacagcaguccuaucuggcaguagggaugggaagggcuuucugacccaugggcucaucuugccuuacaaauuauucauuuucugaaggaucagcucauaauacuggaaacuucugaguuggaaacuggaguguccuguuaccuaguguucuagugggugaacugaaagacaucaaauuccuuuagaugaauugaagagacagcuguaaugaaguccuggccaaauccccuguuacuuuaugguauucuaccuuggaaaugaaauuaugaaucccauuuuuuuccuaaaauuccaguguugugggacacagaggaaaaucuacuuuugucauuguuuuuccaacugcccugucuuuguagcuuccuaaucacuuuuugauauugaaagauuuuauuuuuauuuuuuuaaaaacuguuuuagccuuuuucauuuuuuaaaaaaugaaacuuagugauuuaacaugcuucccucuguccuuaaaauacaaauaaucacaauuaguaaaauuagugucaguuaucuaggcuaccuagccacuucaguauucagcucuguucuggaaaauuacacaccccucaggaaacuacuuacaaaguuaaaaccuguuagaauuaguaaauaagcaguuauguugucuacaauuaccaugauauuugugaguacaucguauugccaaagauuccucauuuguuccaacuccuucaggguaguaaauauuuuaaauccaucauuuucauauuuaaggauaucauguuugacccguguaugguuuuuuuuuuuuaaugcaucuuccagauuaagaauggcaaagugcacuuuacaucggaugcagguguugcugggaagguggagcgaaucaucccagaagcauacauugcagauggccauuggcauaccuuccggaucucaaagaauggaagcaucacugugcugucuguagacaggauacacaacagagacaucguccaccccacucaggacuuugguggcauugaggugcuuuccaugucucugggaggaaucccccccaaccaagcccaucgagacacucagacagguaaaugucuaguauauccaggaggaugauaaagcaaggggaaaucugcucuucgaaguguaggugauguuuguagcaaaggagguaggauggggguaaaauuuaguuuauuuuauaugacuuacuuccacagaguaauuccaucacaguguaguuuuuacaaagguaguuggauuuaugacacugugauuaugaaucuucucaucaacauaacugucuuuagagagauuggggucagggcacuaucacuuccauuaauggcuuuugccuaugcugcugagauuugauuuaagcaugggcuacucugaugcuugguguguccucaggaccacugucuauuaacuccuguguucaucaaagccagucucccagguaacacagcagaguaggguaggguccucacaggauguagauguuaccuuaggucagugguacaaagggaaaugcagaaaccgguguguucuuaagucagaaguauggugaagagugccaaaagguuuaauugauggaaaaaugugagcacaaaggcagauaauaaaacugggggauaaaagaggguauucuggcuggagagaguggacuuauuuauuucacgugcagaacagugaagaguaaguaagaauuuaaugaguauugcaguuaagcaugcuguaguauugaucaucuuucaggcuguuuaugaggaugaacuggggaggacucccaagaugagguguuagcagccaguaucagaaaagcacugcauuauggaaagcuauugucuuagugggauggccaagaugugacauccaaguaaauggacccaaaguaaucuggagggcaucuucaguaaagauccgggagaauucugacuuuucaucucaaaccaacuuagugcuaccaaggaagguggcuguagaagagaacagugaagcggaucucagggaauccugggguuugcuaugguacaaauggaguugaagcaccuuugaagggcauugaacagauuugagggacucggcauagagcugggcuagagaugucacccccauguguguaagugaguguugguggguauagauaagaugggauauuuuuguuuucugacuccugaauccugacaauuugcaacacugguugucuuagcuaccuccccuccugggaaauccccaaacacuauggccaagguuuuuucuucugauucacaaggacccauacuuggcuguuuggaaggcauauggucaaugauugcacaccccauggucuuguaguuguagcaauuggacuugauuuuguucuuucugauguucauaaaauaaauuugaucucgugguaacucuuggucuuugaccuguaagaaucaaaccaauaaacugauuaaaucgucaaauggaugaacagagagagagagagagaagggucaagacgauucuggccgaggagaccuuccuaaacauucugacucuucccauguguuaccaaacuacacugaucuggguuauccucagaggauaugcauuccccaucuuugaguuggcgcaucgcugagaaacucuugggugucugugagggcuucucuuccucauaucuuagcgcucagaagugauuacuuuucucuaaguugccuccuacucuaucgcccugacagguuuuaauggcugcauugccucagugcucuaugguggagagagccuccccuucagugggaagcacagcuuggcguccaucuccaaaacagacccuucagugaagaucggcugucggggcccuaacaucugugccagcaaccccugcuggggcgaucuucuguguaucaaccagugguaugccuacaaaugugucccuccuggugacugugcaucccacccuugccagaauggagguagcugugaaccaggucugcucuccggcuacacuugcagcuguccagagucgcacacagggaggaccugugagacggugguggccugccucgguguucucuguccucagggcaaggugugcaaggcuggaaguccagggggacacguguguguccagagucaggguccagaugagauauccuuaccucugugggcagugccugcaauugugggcagcugugccacagcccuagcgcugcugguccucaguuugauucuaugcaaccagugcaggggaaagaugcccaaaaaccccaaagaggagaagaagccgaaggagaagaagaaaaagggcagugagaauguagcuuuugaugacccagacaacaucccucccuauggggaugaccuagcuguuaggaagcaaccugaggggaaucccaagccggacaucauagagcgagagaaccccuaucuaaucuucgaugagacugacaucccccacaacucagagaccaucccuagugccccgcuggcuuccccugagcaggagauugagcacuaugacaucgacaaugccagcaguaucgcgcccucagaugcagacaucauccagcacuacaaacaguuccgaagccacacgccuaaguuuuccauccagaggcacaguccucugggcuucgccaggcaguccccuaugcccuugggagcaagcagucugaccuaccagccuucuucauauggccaaggguuaagaaccagcucccuuagccacucggccugccccacucccaacccucuguccaggcacagcccagcuccuuucuccaaaccaucugccuucuacaggaacagcccagcccgggaacugcaucuuccucugagggauggggguacgcuggaaaugcauggggaccccugccagccuggcauguucaacuaugccaccaggcuagggagaagaaguaagagcccucaggccauggcaucucauggaucgagaccagggagucgccucaaacagcccauagcacagaucccucuagaaucuucuccucccgugggacucuccauagaggagguagagaggcucaacaccccucgacccagaaaccccagcaucugcagugcagaccaugggagguccucuucugaagaagacuguagaaggccccuguccagaaccaggaacccagcagauggcaucccugccccagaaucgucuucugacagugacucccaugauucuuucacgugcucagaaauggaauacgacagggagaagcccguggucuacacuuccaggaugcccaaguuaucucaagucaacgaauccgaugcagaugacgaagauaauuauggagccagacugaaacccagaagguaccauggacgcagggcugaggggggaccaguggguaccccugcagcagcgucuggggcugcagacagcacccugaagcuggggcagcaggcaggcaacuucaacugggacaaccuuuugaacuggggcccaggcuuuggucauuauguggaugucuuuaaagauuuggccucucucccagaaaaagcagcugguaacgaagaagguaaaaguggggcagcuaaaccagccgccaaagauggggaggcagaacaguaugugugagguguaugugugggcaagaaacacucaaagcacgguguggcuucccaccagcgggggucaccuuuguaaaacaggccaguauagaccgguggccagggacacauuuaaaguuaaccacaaagcugcucacauagacuccaaacgacugacucuuuaauuuaaaugugcucaguggaacggaaugauccuccugcaugcaucuuguuuugugaugaguuuuggggcaugcaacauugggaaguguugcuuuguguuugguuugugguuuuuugccguuuauaccauugcaguuguagacucgagcuugugcuuucacagugggguugcuuguuuccauuguaguguuacgguuguguuuuaccuugcaagaucauuuaaguuuagccaacccguguggagugcaggaaggaggacuucccaccuuggagggaugaaaggcugcacauuuaacacucuucagaugaauagauucauaugugaugucgcucagacacaauaagggcuuguuuuacaugacgguggguacuaagaauaagucauuuuguuccgcacuuuaaagcuuucuuaaaaacuguguugacacuugugugucuccgugcgaacagucauggccuccugacuuaccucaggcuuccaggaagaacaagaugaccacauacuguccccagaacacugccaccuuuccucuuccgggauaacauucucagcgcacuucuaagagacaauuuuuaaaguuauuuauugaagaaaaaaaguucuaugcuuuuaacauuguaacaaauugaccuaugcaggcccuaauugguuuuauuuucuauccauucaacauuuaccccaaguacccaguuuuuauaauuuauauaaagucagauugcaauguuucuuacuuuccgucguuuuguagaucauuuuuuuaauacuguguaaaacuuuuuuuuuuuuuuuuuuacaccugagcugugguuuugauacugauauuuuccuaugccggaaacuuuucuugcuuucagggaagguaagaaaauguguuuuuuacauuuguuacuuauguaacauucauauuuucacaguuugauaucuguaacauacuguaugcuuucuaccuguaaaugccaacaauagaauuaaaauauuuauuuaa

SEQ ID NO: 12305 - RNA, 61132 nt, Mus musculus
uuaaaauguauugcaaaauguacagcauuuauucacauacagacaaaaaggcacaaauucuacuaaauaguucaacaaaaaaauacagcugucuucaacuaguuuuauaaauacuuucaaaaaggggguagaaauaaauacaggauugggccauguaauauaaaauagucaucucuacauagacuuuguuuaacuucugauuuuaacucuucaugcaccuuuuuuuuuucaauuuuaguugaauggacaccaagcuaggcacauagugaaaaauccucuguacaagguuacaaauguaaugacaagucuguccauuuuaaaauaauuaagauuuguacacaacacauaaaacccuucauuuaaauuuuguguuuauaaccuaacaaaugacauuccaggcaacuuuacaaaaguucaacuagccuacauuuugacauaauacauugaucauaaucaaagauauuucuuggucaggaugcacaaggaagauucaaaagaacaaacaaacaaacaaaaaagcucaauacuaauagaaugcaaguggguagguaggugggcugcugcugccuguggccgccucauacagaguucccagcaugacaugaacuaacuuacaaagcuaucauuacacugucagaaaccgugcucuauaccauugcauuucaaagcaguaauuaaacgugugggcuuuuuuuuuuuuuguuauguuuuugugggggaaauuuuuuauuauuauuuuuuuuuuuuuuuuucauuuuguuuuauuuguuuuugguucagcauaacuuggaacauuugaaagcuuuucaaccuaaauguggggggaaacagguaaggcauuuauuuuugcacaaaacuagcauuccuaauagugcaaaugaaucuggugccuccuaaaauggugagaggccauauacucacuagauuaauuuaggguuucuuucuauggcuucacagauuauuccucuauaaauucuauucucacccagagcuguugcuguaaucaaaagauaacuagaucagaguccagccuuuuccuguauccagcaaaagguuuuugcucagaugcaaaacaucucauuuuuaaauuaggcuacaagcaaaaguacaacuuggacuccugagaaucuucgaauaccaguagcaacgagcugaucuggacagcagucucaaaggagcuccauagcucaaaaaauagucaaucuaaaaccugggucauccuuuccccuccccugaauuagcuacuacaauguacuugagaaguuaagacuuaguuugaaaaugucauacauacgaugagaugcaucagaucugucauuugaucaucugauaaaacuugcauagcaagauggaauucaauaagccuuuucuguuguugacaaucaucuggaagacuugaaagcuucuacaaacucaaagcauugcucauuaaauaucagaaugucccugccacauggaaacagauguauaaaugagucaggaaucugaacauugauauuaauaaacuaaggguaauuuaggggaaacugggcuuauuccaaaugcccuuaauucuaaaucucauugcuaaugaaacuucccuucucuuaauuuugauucacaacuacauugaauuccaaagaaaauaacaggacuuuaacacuauccacuugucugaauacauaugcacuauaugaggagugcaaaaacagaacauuauacucaaauuuaaugcuaaauuuauuauugcugauaacuuacuaguuauugccauuugcaauucgaaaguccaaguuacaaaucagaguuuagaacuccaacuccagaaaccuauucaaggauacacuuugaauucuuuccuguauaaccuugaugcaacuuauugccuuucuauauuuuaaaauauaaccuauuuugcuuuuuguuuuccuuuuugcuuaaggaauccacucaugguggaagccuggauuucccaaauaugcacuagugguugacucuguagagugagagucaccagaaguucaucacuugaacuugaauaaccauuguauuauuggaagccagauggccaaguacuggcaguagccagggaaaucccauuuggauccaaaggccagcaguuaggaaagaggaaggucaagcggacuaguaacaccugggccucagcugcccugucucacagaaguuucuggacaacuuuuccuccacccguccuguguccacagcccacucagggcuucgggaccuugcuacacgggccccaaaucucagugcagcagcucugcucugucccugcagccuuccagcaaugccuguuguguaaacucuuccccuggaugccacaugugcaagaucccaguguugugaagcuucagaaccucagcuccucauaccacacagccugggagccaaaugccgucagcauuuaccauuccuagaaaauaagcuuugugggcuauaaaugguacaugagggcuucuagaaauaggacuuguucaccacacagaauucuaugauucuguaagagugaguauucaagaguuugugcuuuggggagaauguagagggcaauaauacauggugcuauucaagccuggcccucugcaaaguuacuucauuuguugguuuuuuuuuuauaguguuuaguucagguucuaaucuuagugucuuaugguuacagucuacucuucuguuuccucaacaaguugcaaauaacacaaacuucucacaaugauuuauaaaugacucuggaaaaaaauucaaucugaauugcaaggaaguaugucuguagcucagaaacaauggguauuugcuugccccuauuaucagagcucuccucagcacacggcaacaagccaugugcuuccacaccggcuguuucaucaagaggccaagaugcuucgccugaugauaucuguccuccugcugauggugcugcuggcauggauacauuucuucucugaugccucgcucucugagucacucauuuccccaucaggggcguacccaucauucucacugucagcucuuaaccugcucuucgcucucuccuuggcuggagcucggcuuacacccagaugggagcagucugagugcugguggcaggccccaucaugggcuucuccuugcugcugccgcucccccuucuuuggaauccggaauccuccccagcuuuucacugggcuggcagguguuauaggcacuuugacuagggagccauugcacuugggcacaaucuccuuccuggugccaggugcugacugcccuacuccaggggagguggcagcucuuguguuguccagaugccucugggaugugucuguggaccugagaggcuugugacucugcuuaaaagauuuguccuuuaagucuccuuuaacgagaucacaaugaaaacgauugucucuucuuuucccauggucuggggucaccacaccauuuuucuguugugcugaugauaggagacgugcuucugcaaaagucuuuucuaagcucagcaagcuuucugagaccuccagccccucccuucuaccacaaagaccuggcugcuuaugcgaggucuugcccucggucccagaacuauucugcacugcaucucguuuaugggacuuuuucaguggaugaaccaaggaagugcccauuuguuuccugaagaaugcagaaugccauuucaaguccucuaucuugggagcauuggggcccacagaaggacuguugaaaaaaagcauguucuccagugcggaggagcaggaagaaggcacaccuaggaacagaaaaccagaggaaaaauuacauaagcaaacccaaacucauaacauucuagacuggaaacaucauuauacaaacuucccacccaagcaagcagcagcagcacuuuguuuuaaaaaaaaagauaugaccugcuucaagaaucugcuuucaaucuuuguagucaguauacuagaucuuucuuuuuaauccaaagccacuaaaauacaguuuuuuaugaaacuuuggggaauccauuugaaaucuguccaauggcggccacuaccucuacauagcagcaauugucccaucuaccagucacuuuccucucugagacuaagcagagcuucuaaguuucuuucucagaggaccacggaggacaaguacauguaaaugugcaaacugaacacagguaagugcucacgguaauucuggacauguaauacaagaagcaaaguucauucgcuguauggaaaaugcguggaggucaaccugucauucaaguuguuaaaucauuaaaucagucuuuuaugcaaaucacaaaacucacauuucauagcuuaaccuaguaaaagcuuacauuuuaugaauuuaugaauaucaauucucaucucauuagaaacuggcacuuccuguuuuuuuuaaucauuuuuuauuuuauguguaugaguguuuugucugcauguaugucuguacuauauaggguacagugcccguggacgccagcagagggcaucagauccucuggaccuagaguuuauucuaauagacugugagcugcuauguggguguugggaaucaaacccagauccucugaaauauucaagcagcaaaauacucuuaaccacucuccagccugacacacccuaguguuuugucuguuaguuaugauccacgaaaauguguuucauacucauuaauaaaccuuauaacgcuggucugaaaacugcuggggaauucauaaggaccaugguucuauaagagucucaagaccaacuacaaaacagcaagucucgauguuuugucuccucuuaagaugugaaccacaagguucaguuccauuguguacuacaggaacccucauaagaccuuacaacccacaagaccuuaacagcaacacagcugagguccuuuuuacaagcugcucaucugaaaaugccugcuuucuccgaaaacaaucacuggagucgaucuugauggcauuugaaguguauuuuuuguuuguuuuuuauugaaaugccccuaaagcaaacaaagauggagaaggcccaguguugucugaacuauaauuucuaucuaccugacuugaagcucaggcaggccucccuuaaguaccacuuccacuaaagaagcucucauuccacaaaaugacccuaacuaguucccagaaucgcaaaaguuugagccaugaacucuaaaagacacauguaaagucaugggcaucucccuugaaagugucuuuaagggcaggaaacuaagcaucccagcuuagaaaugagaaagaaaagccacucuugggggcuucagcugcauuugcauagcaucccacaacaauaaagucuuuucaaaugguuguaauugcuguucagcucaaaaugaagaaaagauuuguuucucuuuucugaauuucugcuuuuguuuucuaauaacaaggucucauucuguagccuagcgugaccuagaacucacaaccuaguccagcugacuaaaauguuggcacuccuccuaccucagcccccagaaugcuaacaaguauaagccgccauguucagcagcagcaggacuucuggaugaacuacauuucaguucuaacccaaaauauguucugaccccuugagaagagccaaguacaaaucucaaccaugaugcaagcagcugccggggauacccauaaaauaaggacuccauuccagccacacacacaucauccuuuaucacugacuccuuagcaaguaccaaaagcuucaacuaggaggccucuguauacuaccaucaaccaucccagacaccaaagagauacagagugaacuuaaagaaucuaaacuacauugucuuuaaccaaugacacuacuuggaaaacuuacuuucaaaguuuacaacugaaguuuuaaguuccagauacugaaagacacuugguuccucugaaaaauacuuaaucuuagcaagaacacauuuaaaaguaugaggcacuugaagaggagaguauggcugaaaacuuccccucagucuuuuuugugugcuccgcuaaccagguuaucucuacuauguugcuuggaugccauaauuaucuagggaaaaaauccaaagacugaaugaacaaugacucuccacacaagcaagugccaagagugcugcugcuggaacuucaaagggcaaaccaagguggagucgcucauccuucuccacugaaggccagccuaagacccaccugcucccugagguaucccaggaccaacuuccuccaugaaaucuuacacuaccuacuuucuggggcuuaucaucaagaacacuggugcuaaucgcacauuuuagaggucaugauucuauaccagacuaacugaagaucauaugaaucccagagugaaacacuuggccaacauuaauaacugacacacucuccagaguagaggaagcauauucccauauuucucuuccuuuuuggcuggcuagaacaauguaaauagaagauaauuaauuaauuaaaugcccagcccacgcagacuuccaucucauccaucccuucagaaguccaccaugaguguuaggaaaugcguguaugugguaaguagucuuagcaaguauuuacaaugguagauugcuccaaaagcuagaccaugaagucacaccuuuguagcuauccccauguuuaucaacagcucugcaaugugcuacaguuuguuuuccuucccauauccugauacuuagguaacuugagauagcauccccacuuuacaugaaauuggagagagaaauuaaggucuaugacuugcuucuacuuggucaucagggagaugcuacaggucucaaagccuauuuaaugccaaauucuguuccuucccuccaauauaaugucuuuaauguuuaaagguguucccugaauaugaacagcugugcuacugaaaacuuucuacaggacaaauuggaagaacaacuguuuucccucaacagcagugucaaggcuucaaaccccugcccuacaucuagggcuuuaugcauaccugaaacuuuuucuugcuccaagagcuuaguguacugagugaaaauuuguuccuggacuuugcacacagaccguuuaaucuuuucccugcgggucaccauguaagugagguuccgaaccuagaauguagagaauaaagauucuaagugagcaauaugguaacgauacuucaaugcuuucauuucuccuuuaccugagauauacuggcccuacuaagaccuugacagagauuugaaaucaaaacauacccuaccacuagaagaauucugcuuauucauucccucguaucuguagcaaccaugaaguuacacugggggaguagcagagauaggcagagucccacucuuccccaccagucugcaauguagagacccccuacuaucuaaucaggacuugcugccuugugccagagagcuccgcuuaccauccaacagugucuucucagaaaucuuauuguaaauaguuugagcaauuaugaagcaaccucccugaauacuucuaucaaguaucuuccaggucaauggcauaaaaggaaccccugcacaaaguccucuagaaaaucaaaugagcugcuugguucacuggguacaacuuugcaaauagccagccacuacagcauauucauuccagugaggugugcaaaugccggggaacugccccagcauccccagcaaaucuuuggaucuauggaucaucaguuuaaaccugcuacuaaccucacccgcauucuaguuuaucuguaacggaaagaccacugugcugagauuccccacucaaucggacagaagacuucuucaaaucacacacauauguauuaguuuguggucaguagucgaggcuuccagagucauuauucccuacucuuaaaaccaucagucaccauuaaguacaaaaguaaagaauaaaggcacuaaaccccacugauccuuugggcauaaagacagaacaucaggugcagcccaccgcugaacaguugaaccuuucuucagaaagaugcccguaagaccucagccaccucagcagcaggggcagaaguggaaaaugacuacaugcuccccacuggcuagcaucuagggugugcuaaaaaugcauccuccuuuugagcagucuuucuuguaucauacuguaagugcaaguucaaaggucacuagcugcuucucugacacaagccaugcaguuuugcacacuggcugacacagauauccccucagucuucagaccuuucuccauccucacacucccagcugugcuccaggcugggaccuacaugaggacaugggccaugaagggaaauacuaccggauuuugcugacccuaaugaugcacuaucagggaguuccugccucuauuucuauauuaauaacuucuuaauacuauuagguucaauuaauaaaggauuaaaaagaaaauuaugcuccuugucugaauuaaauaugucacuuggccugccugccuaagggauagccauaaucccaggcaaggaagaaggugcucuuuagaaaaacccuaaccaacuuggggcugaaaguggcuaacagaaccuucuaucacccagaugagauuauggugggaacucagaaacaaagaaaggaucaaaccuaaacccucaucacaaauuccaaccucugacaacacacauaagccagcuucccaugaaaagucugauuuugggagacaugaagugggcauuauuauaguucaugcucacauucaacucaggugugcagaaacaucuuaagccugacccaugaaaaugaauagggaaggcaggaaucucagcucugauggcuucugugccagcaaaggcuuuaacacagccucuuaguaaggagagaaaagacaaaacaaaaaaaccuuuuccuuccagugaccucagauaaauaacauuucaauaaacccacaaaacaaaaaaagccauaauuuacaguugugcucucuaaugccuauuugauccagcuuuggcugaccccaaaauaaacaaaacaaaacaaaaaggaauucuuggcagaaaucuagacauggucuuugcccagagagcuuggccacucaauucaccuucccucagcggcuagcagcaggcccccaaaccucaccgucugacaucaggcuaaacccaagucaacuuuccccuuaaagcaaguucacaaacagaaaccaugaccgcccccgcccccacuccaguuugcacuuaguuuuccagaauguuacuguugcauccugagagcagcagcagaacaggcaggagaccuugcaguggguuuccugagcccuacgcagugccugccacauugaagccucgcgugcacuuuuguuuagucaacaacugaggucgcacugaguuuucaaaaaguuauguuccacugagugacaaaugcacaggacugucccccaggacuuggagccuuuccauaccaacuacagcaagugcaggaugucuuuauccaagcuaguaguucagggagguagucaggaaucccagaguaagaugacugccuccggaagcuggaaguuacacucgccacauuaccaaccaucucauuuagagccuccugauaccuauuccugucacguagcuuucugguccagaacugguacccaggugugcaaggcccccgagguguuaauuugccagaaagaacaauuaacguaaucacugagucacgugcaugugcugagugccacucacuuguucaggaaugaccacaugccuccgguccagucgccuacaucgacuggcucaagugccuaccaugugcugauaguucauaaaaauagacagaccacuaacuuacugagaagacaaguuaauuguaccuuuggacuuuuucuuuugucauggcugcccugauaaggccuuggucugauacacuuuuuuauaauugcagagcacuguacaacucuccagggccugccauagacuucagcuuucagacaguccucauggcagggggaaaacauaacaugucauuauaaauacgccccuuuuaaacugacacugacugcauuaaaaccguagacucuuuaauacugaauguugaguaaugccacacacacacacacauacacaggcacuggugcacacaaauccugauuuauucccuuaugcaccacaggcauuauucuacuuaaacgcaaaaugacgacuccaaaaaaaguugagaauuuaauuagaaguauauguuagucucaguaacuuaaauacagaaaaagaguuaauacacccaagcauuuucuacacuuuuauucuguggugauuguuaaacaaacacagucaaaacaugagacuucucgccuccccucccaacggcuaucugacuccaugcaccccaauuacagcaguuguuggguuaggauguagcuucucaacaaaauacccauuaacccugaaucccuuucucaagaacacaccacaagugcaugugguucuucgaacugaccaccagggguugugugggagccuaaccaaccugcucccaccuccccuuagccuaacuagcacccaccaccuuacccggaauccuaacaaggucuagaaaaggacaucucaagaagucagcauuagaugaugaacuaaaagggccucuaaugagcacuuagaaauacgugcaugaccaucuccaacacgguggugcaagccucugugagaacugauccuuuuggccaaguacauuugcacucuccugccuacgcucucaucucaaaucaccuaugagucagauccuguugccaagcaggugaugaaucacuccucucuaauaagugaggagcuggagggagauacgcauuagcuguuucaggccacuugggugccuuucggcacaggcugcuucaggccagacaacuugcauaccaucucugccacacuaaugaauuuaauagguaucuagcagucaggggaguagguauggaaggugcucaagacgcauccccaauuagcaagccuuggucaaaaaccaccuacgggagugggagacccuggggaggacaguccacuccuaauuauuccugcagcaggaaaaaagguccagccggggacuccagagguaauggagagugggggaggcaccaagcagcaaacagcugaggggagugccagcagcugaggcuccaggcagccaacagccacuuaaucagcaacccaggagugugauaaacacgugugugucuauguaugcaguguacugagauugcuaagggcuccacagacauacccaaugcccugugcaccaggaaucacaccacacgcagacaucacccagagagggaugcgcgccacacacaaucguacucuguaugugcacaaccucugugaugacuuagcaccucacugccaagacugucuucuguaauagguguauauaaguccaugcacacacaugagcaccugcagccuguucuucuccacaacagagcugggaaugccccuguggauuagccuagaagcaaagaugagccaaugggaggcagugcuuggcucucucuaacgagcccuucaucagcaccuaggaaaugucuccccagguuaaacaaggaauauuccugccgcugccccaucccccauaacucagauacaucccaguucucaaaaccaggcucuaaacugcugaguuaagcccuuggucauguuccuggugcuccauucccuccagcucuauaaggacaagggaauaggggaugaagauacaccccaucugaucuuggagaacaguaaagauuaacaggagaaauaaucacaaagcaacucccacacuggcagucuugcacaaugcagugaguuuaccagcccauaaauauguuuaaccaacaugaccucaugcuguaguguguacaaggaucugagaguaaugacuggcuaucaucucuaggcaagugcccgccucuuuacaucuucuucucuaagucauuauaaggugucggugucaaucauuacccucuccagguccugccgcaggugcgugaacagcugcagccuccuaaacaagacauccugcucccgcuuggcuagauuguccucuucgucuuucuuuggggugaugaggggcuuguugaaguugaucuuccucuucaacuuccaguacugguacaggaaauccaccacuuccucaggcagccgcagcgcccuggccacauccagcagguugacaaagguguagaacucauccuccagcugcuguagcuucugcuugcgaacacucacccggugggccuccucucgauucggcuccagacuaccauagggcuccagagggcucuggggagaacucucaggggccccauucuccugggcugcuccuucacccaggcccuccucggguuuccugugugagcugugcuuugggcaguaggacuugaauuugacuucaucauucucugccaauauggucuucaucuccaggccacggucaaaagcacaagucacguggaaggcuguccggcaguucuucacagagcacugcaaacaacacagggagacaguuacagagcgguggcaacaagagcccccacugcuggccaccccauaugaugacaaagaaacacucaaugagacagaaaagcuuuacaaagaugaacagguuugaaggaacgucagggcacaauguaggguaaagcuuucagagagcaaacuauaacuugcuugaaacaaucacagcacugaaaucucagagcaggggagggggagggcuguacaacuggcuccuguuggggaggguggcacaauccccaagcgaaugcacucuauguacagcgcauacucugaggccuuaauuuaguucuccacgacuugaacgcaguuuuauaaaaacugugaauagcaauguccucagugcacacauuccugaucaguuuuaaaagacugugaauccucagugcaacccccagcgggaaaaggucccaacucaggaagguaaacacaagcagcauggaaguagcaucuagggaucacgccagaggaaaagaaggagagacaagagcccaguucaggaaggauggagaaaggucucccugcugcagacgcucccuuccuuuaggccccaaggaagucagcacagaggccaggccucaucaagaugcacugaacacccugcucacuccccgccugcacagggcuacaauuuagugccuuugauccagauacaagccucuggccagcaggagcaaagugauuaacuucucgugucugaucucacugagcaaaucccuagaaagagguaccucuuggaggcugaagccagucccuuaaaagcaacuguauugugugaggccaagggaucccuggggcaugccaggcugcacagacaaccaaggagcuugugcuccaggccagcugaaaagcuuaauuaaacucauucaacagacccugccaucacauaccacagaguagagacuggaguuggguuucccccucaucacuucagcguuuaagaugcacuucagugccagccacaaucuaauccuuuacuguacaaccgcagccccuucaccaccgccaauuccaaucaccgaaagccuaugcaccaugcuuaaucuguaccuuuauaaauaaccucaauuacaagaagccugugaaagcaaucagcucugguggcagaacacacgcagacacaccuggccacucucaugaagacacacuguuucuccacacagcaggaagccgagcgggaaguagagcgggagcaggugacugaggugcagucugcgucugccuuaaacuacacuuaacccaggccuucgaaccuuaaagagaaaugagcugcagcagaguacuuauacgggacuuugaaaagaugccaaacggccuuccucuggguguuccuauucggguugacucagcaaacagauguuacagaaacaaacuagucuucccagcugcagacauuucugagaggaguucucuuuaauaaaaaucaaucuauuuauuuuguuaagauaugaaacgucaucugccuuccuuggccccuucuucaaauuaaugcucuggggacagagaucaguggcaacauaaauguccuuaagagugucucuccuugaaaaauagacagggcucgaguuugccucccacgaaacaucagcuaaggagcaggguugaugugcucagagcagcuaacccaggcacaggaacugccauccucccacacacgccagacacgcaaguccuuuuugaccucuccucgauuccuucugcccaaauucauuuuaguuuucaacagauucuacuaacaacaacaacaacaaaaaucauaucuuuaagauccccaaagccaaaucucagcugcccagugccugcccugguauuuuuuacuaaugccugaacagcaguagaaaccauaacagugaaaagucaaaccacucaaggcuuguuaagaaagugaaaagagcccaccuuuaaucccagcacuggugaggcagaggcgagccgaccucuugaguucaaggccagccuggucuacaaaaugaguuuaaagacagccagaguuacagagaaacccugucgugaaaaaccaaaauaaagaggaaaaaaagggggaggggggaggggaggggaggggauauaauaccagucagugguuugggcaccuuacucaaagaaucauugcucaaccaaaauauagcauauuccaccaaaugaagaaacuguuuuaaagccagggccacacuugucaagucaugccuguaccuguuguauucucuauauugaaagaagcugcccaaacaguguuucuguccaccagauuucaacaacaaacaaacaaacaaaagcaaacagacaaaccaaaaacugaagaaucugaggccuacuugggucccugcuggaguccaaauuaaccuucaacacaguguucuaggccucaaaucauaaccgacuagauaucaaugaaugaaugaaccccagaaaucaauuacucaagaguuucagacaacacacagauaccauuuucccauuaacucugcauaccucgugacuuucuguacuuaccuguaccuggccauguaaaugcaaucaaucagccuuuuacaugcuggcugguucacuagggcagcagugugugugugcuccagacucccucccgguguaaaagcagaggccugcccaacaccuaccucagcuacaggcauccccagcagggagcccugaggacuucuggucugugagacuggucugugguaaugagacuacaguggaaggcuagacaacucaagugccacagucaagaguaucuaagccucgguucuuaccaggaaugucugcuuaugaaaagaagaggacucuacuaggcuuaggccagacaaacuggaacugccuccaaacccaggcagauuuccagauaaccuuccuccuccuaacccuccaaugaaugcuguguagagccuccucccccacccugcucccuagcacacagaggaggaaaacaaagcuacgcuuacugagccauuguuaccuguauggaggccccgaauuucucauugcagaggcugcacacaagcgcccaccggcugcugggaaugugagacacuuuugugaugggcuccaucuucucagggcugccaaugcuuaccuaaagauccaaaauagccagaugggcaugacacggauaaucagagucguaacacagaccugagggcuagccccagggcccagcucuggacuagcagcagcagagcccagagaucagcccccauugauaccagcuugccagucuuuauagaccucucuacaaguuuucacuucuuucaaguaucugauagcaaaaacaucuaucuuaucguaacaaggcuaggggcuggagagauggcucagagguuaagagcacuggcuguucuuccagagguccugaguucaauucccaguaaccacaugauggcucacaaccaucuguaaugggaucugaugcccucuacuggugugucucaagacagcuacaguacaucauauauaucaaauaaauaaaaucuuuuuuaaaaaaagacuuuagauugacaagaauuuuuaaggacuaaaaacccauuguaaacauauuuaaauaauagaaugagcaaagagauaaacuauauuuaauaguauuacaucagaacacauaacuauauuaaaaguaaaaaucuagcaagauaaauauggaauaaugaacugcaaacugguuaauauuaaaccaaaagauccagugaaacucccauguaaaucauacccaggcaauuuuccucuggagggaaaaaaaaugcagcaaaucacacaccaaaaauacuggaauuuaaaugacaaaugauauucucaucacaagccaugcaaauuaaauuaguuaaggucugggacuggaaauaaauuagagcagaccugaaauuaacaagguggaagccgaggaagaauuuaaauaaagcucacagaagugugaccuagggcacugugguacugcacucggaguuuggcaaacacaaacuggcagggacaguagcauggcuacccucaggacagagccgugaaggugccaggccuggccugugagugcugucaucuacgugaggguuuccagaaauggaaaaguggggcuauuuguggacaccaggccacugcugccuccaggaagccccuccacagacccgcucugcucaggaucagcuuggggacagaggggacccagcagcucuacugcugccugugagucacucacucccaccuacccaaccccagcaggaaaccaggacugucucaauuaagaugcuaucagaaagcaggcuuaccucagggauccacagggcacagcugacguggacccacuugguuccgcugcgggucggcuucauagcuccgccuuucuugggacacagcaaacauuuuggcugaacucccagggcacauguacgacauagccaacugcccucuggcaccuugaggaucccauagcaagccuguaaggccacaacuuuguuauuuauguguaugggugucuugccucuauauaucacugugccacacacuguguaaugcccacagaggccaaaagagggugcuggauccccuagaacuggaguaauggccugcuguaagcagccaaugugggaucuaggaaucaagccuuuguucucuugaagggcggucagcaagucuuacgaggcaucgcccagccccuauuugugaacugaaaaacaaucuagaaggauuuucacagagccacaccaaaguagacaugcccauauccaccuaacugugauccugacccucgaggaaauaugccagcccaccuccaagcacccaugugccugagcuccaaagacacgccacaugugucuucagcacaggaagucccaagaacuugacaagagggauccuaaaauaacgaguguugcuguggugcggaagagacccagccauaagacaguuccaaccacugagcagccaaugcuccaaccuggcugcaggcuucaagaggguacaacagaccucucucugcuuucaugaugggcgugacacggaacgaaggcaaaacaaagcaccaaagccaaggugauaguggcugggcaaccauucgcugcucaagcuggacacacuccuccuacuggaguccaacagaguucaugcgaacagacagccgcagaagagcgagacauuucaaaaugagaguuugguuucuuucgcugauguuuaaaaacaaagccuguuuugcacaaguuggcaaaauuacacaagacaacccaaacugcagaaauuaaggcuuuuacaacugaaaucauuaugcugguuuaaagaaagaaaaagcaaauguuucaauaaggggaguaaauaaacaaacccaugguaguaccgggagugugcucagacagcccuuuaaaacccagacaguucacaacguuauccuuaaaugaacugcaagucggaagucacaggaaccuggcucuauuucuccaggcagaaacagcacagccaccaugaaauccgaacgcccaggacacaagaaggaaaacacaaggaugagagcggagcucagcaaagaaacaguaacaccgcaguccugagagcuccgcgcggccacgaaugagcaguggucaacaagucuaccagcaaagcaguguucuuacagaucucaacaguaguaggagggcuucaaacgccauggcguucuagagcucccuuugaagcgaggaucucguuuacuggaaaggcacaucuacacuaaucaaguaugccuuaaagacaagccaugaagaaucucacggaaaguaaaauaaagugagcgugaagugucgagagcagaagaagcggaagucaucagggccaacucugccacccacaugcuaagguguuggcacacagcccugauggcagcuuacagacuucugaagcacagagcacaacuggauuucaagcagaaaucucguaacagcaaaugucagaagacuucagggucacuaggucaaugagaggcagcagcaacaguggcagucguguggccucccaucacacacaccuccacagggacuccagggcaagacgcccucuggaccacaaagcccagauacaaaacagguccgucucaggguucccugugaagaugagcugagacggggccaccgcuggugaagccauggaguuuucuaaagcccuagaggugaauuauagagaaagggguaacccagaucucugaguguggcagugaguaugugugaucucagcacucagcggcagaggcaggaggauuaucucaguuggaggcuauccuggccuauacacugagauacaggcagccagggcuauuuuaaagaacaauaauaaaacacagagcucaggucacacaagcaacuuuccacuuucuccgagagucacugauggccucacagaaaaguacgucaggacaguuuucuaaaucacaaaacugccugguacacauguccccacgcaaauccacaucacuugaccaccacauucaaagucaaauacagaacucgacagacagacagcugugugguuaaaggcacuugcugcccuucaaggaccccaguguggcucacagcaccuauaucagauaucucacaaccuauaugcccagcugaggggauccaacuuucacuuccuccagcauucacacagacagacagauagacagacacacacaccaccacaaaguaauaauaaaucuguuaaguuacaugagggguaaaaggccccuguaucuaugcuuaagcuuucuaaauuaccuucacuaaaagacaacagcaagcccccaccaaggugggucuacugccaccuugaaauaaugcucacgaaaagggagucagagacggcucagcaguuaagagcacugacuacucagaguucccagcacaggcagugucuuacagccaucgcagagcuccaauuccagcggagaccccugacgugcucuucugaccucugggcaccagucguucuagguggugcacagacauacacaugcacaauauucauacacagaacuaaccaaaaucuaagacgaaaagucaaaggggugccugacccccuuccacagcuaagcugauacguaaacacaugaacgcuaugguuuauccuguaucccccagaagauacuuuaggaccgcaccaccaccugaaaacgggaccuuuagaaacaguugugacacacaacuauguaaacugagaccacacugugcaggcaggcaccuaauccaacaggaccaggacugugugagaagauaacccuaucuagacagacacacagggaagacaucgugaagacuaaugggcaagccaaccaccaaggacugacaagaauccaccaugagcuaggaagagacaaggaagaacaaaacuccaguuccagagacagcuucuguuguuuuagucaccgcaguuaaaagcuaacguagaguuuaagcacccuuugcucggguuuguuuccaguguucccaguugaaucgcagugccuucguggaguaaaggcagagagccaugcccugggauuacagucagguaagacuuuccuaaagcacaacugugggaugcggcuccauuaggaagaaccacccuagacuccaggcaguacaggcuggcugagaggcucagcaccagaacggcacccagcucucucugggcucugcugccccacucaccuggugcacacagauguuacacuugucacagaacaccaucucguugccguccucgccaucaggugacuggcagacaucgcagacaacgucuucgucguauucaauccccaagcccucuucugucucuauggcaugauucauauugucauagcaucgcuguucgaauuccuccaagacccuuuccaugguguacucguccagcuccggcaucccugcaggaaaacaccgcagaucuccccugaguaagugcgcagugagaauuauagcgaagacacuggcguguuuaaacucccaaauaaacauaaauaaagguaacugagcaccagagaaaaugcuacucugugacucugaggccaguccacagauaacgccuccauuccuuauggaagacacaacagagagaagcaaaacucaaaacaacuuccgcagcauccuaggauauuaaaugcaugcccuguuaaacgccccuucacacucuugccgacacugaucugacucagagaacaggacuacauauuaugcugcuuggguuuugcuguuuggguuuuguuuugguuuuaacuuuucuuucuugcuacuuuaaacaguucccugaagcagauuucacagcaaacauccuaacguuuuuaacugacuuaucccuccccacuuugaauucaccaaacugaaaugcauaaauuuagauccacgagcggcaaacacaaggaaaugucuggagcaaagaagucagcucacuaggaguuaaauaaaauacaacacacuuccuucuaccagcaaaugccuugagggagcaagggggauggugaugauggcucaguggccaagagcagguacagcaaaggaccugagcuggauucccagccccugucaggaugcuuacagcugccugucugugacuccagaucccagaggucugaagacucucuucugaccuccccaugcaccugcacacacccagacacacauauguaauuaauauaaagccuuuaaaaacgaaaaaaauaaagacaaagugguuacuguggccucagaaauggugagaaagcgcuauuuucuucuauuugcagauguccucccaacugccuauaaggagagcccuuguacagacaggaguccuaaagaaagucagcguccggcacagugcucaugccugcaauacaugaagucuauaaugguaaugaguuucaggccaguacaagcuauacuaggaccuggaaggggggugcgaaagggggaaaaagagaagaaauauaauucaggccuauagcuuacacacguuauugcaaagccaccacauuuucaaguuuuaagauuuuggaggugagcuggaaaggugccuccgcaguuaagaacacuugcugcucuuucagagaaccagacuucaguucauagcacuaauguagggcagcucacaaccuccuguagcuucaacuccaggggagccagcacccucuucugaacgccagcugcccugcgcucacagcugcccugcgcucaugcccugcacucacagcugcccugcacucacagcugcccugcacucacagcuguccugcacucacagcuguccugcacucacagcuguccugcacucacagcuguccugcacucacagcugcucugaacucacagcugcucugaacucacagcugcccugcacucacagcuguccugcacucacagcugcccugcacucacagcugugaacacaugaguucuuaguauuuaaaccacugaauugccaaucuuucggcuggauccugaacuggacaccuacaacuugccaaaugagucaguuuucugggugguuuuauacaggcgguguaaagcauuuggccagcucaaaagacaaaacugaaucuucuacaguggcauaauacaucauuuaguuacaggagaguuccuuuuaaacagauucuaaaaccaucccuggcuugcuacuguucugaccaguaauacuuaaagcagggaacaagagcaagaaaaucuacuuuguugacacaucucaguaacuaaccaguagaaaauaccaacguucccagcucagucauggucagucccaucaacuggcuggcagcaggaaaagcugcuaucagaguccaggcugagacaggcuccaugggaacacaacuuuaaacagcccuugcccuuccaaccuuugaagccaaacacacgugacuugucacaaugugcccaagucacacuucccaacccugcuuccaccacacaaaugucuuaaacuugaguucacggacacuccagacaaacuuuuauaacaacccuggggaagaaaggcuagaacauaaggagaccaccucagccuccacaccaugaaaugcggguaacugaggucuuaagguccaacccagcagagaaacuauccaagucugggcucucagccagggucacaccucacucagaaagccaggaaagaguuaaagagguaaaaacaagaggguuugaagcugacuuuguaggcuccgucugagaaacagcaggcugcaggcaguaaaaaugggacuuuggcaucacagcaguaaagaggagcagggcacuggcccaguccuccugcucccugggcugcaguuccuguaugguaaguaaggguagaagcagacggggacaggaauucaagucagaaacaagucaggcuuccgccccgcaguccaccacugcgcuaggagcuccaaguggacuguaugucucauugcaagugccaaagccacacaagcaaucuggucuccaaagagcugggacucuggugacauagguggcugugacagugagcuccaaccucucagggacucuauaugagucacugcggacuaaccagcccucucuccaaugugaguuaaugaaguaacagucucacccaucuccuuaaauucuucauugguuacuuccagccacgcagcauccauaucauugaggucauaccgacacacacugucugccagaguccggauaucgacguagccuaacgcugggggcucagagccggacgacgcgauguacuucuugggccugaugaacaugagagacuucucuucagacacaacccugguuaauaagaaaacaaacagccagauuacccuuucuguccuguagaagaaacugucaggggcaacuuccuccuccaacccccaagccagaccaucccuauguucauauagucuaagaauuugaaaccaaaugagagcaacaccucagcuagaaaucuucaaaguacccagaauggaagcagaugcugcagccuuccacagccaucuccuucccagcacaacacccuaccacaucuccaacagagucugcucccaaacuacaacaaauaaacuuaagccggccaccgguggugcaugccuuuaaucccgcacuugggaggcggaggcaggcagauuucugaguucgaggccagccuggucuacagagugaguuccaggacagccagggcgauacagagaagcccugugucaaaaaacaaaauaaauaaauaaauaaauuuauuuuaaaagaaaagauauuucaaggguugguuucuaaaucccuuuccauuauuggugcuugcucauugccccccggaaguugucagaacagggacgaacuugcuaagcacugaguucucaggaacagagacggcagggacagccacaagcuggaugugcacagcacacgcugaggaccacaagggacaccucugaauucucaccuuccaaaaagacugagggagaacuuugggcuguugccauuccuuuauucuaagcgccagagcccaugguccaugaacauauggccccagacaauuccucuaccaccacccccuuacaagcugugagcacgggagaauuccaccucacccuagccagacuagggacagcacaaaaggagcaaaucagcucgggccaggagcccagcagaggcucuguggucacaguccugccacgucugguuuugaccacauacauucacaccaacaggaugcccagaguuuauacguuauucacccuggaacugacaggaagaacuuaucugugugacagagaugggcagacaaacuggauguauuucuccugcuugagcaagaacagguaucaagugaaacgcuccagucuaucuauuaugaagucauuucauccugccuuggcacggcuuccuagacugacagccugccggugcuggccaaaagggaccauccccauccugugcgcccugagacccgcuucacaggccaugacccucaucugaagaagcaggugacuccugguggucaccuaugccugucuagccauaguauacuaucauauaauuugaacagagaucccaaaaugaugguaaucaaaccaaucaagugucuaaggaguuaagggccaagaagugaauuuaguccauacucauccaugguaagagaggcuauuucacacagcaaggagccagccagaugcuggcagagcuaucgggcacuccauccucauaugcaaaaguggggaaaaaagguaccaacucgacacagccugucccaaaggaagaucgaggacauguugggagaggugagcgacacggcaggagaucaagaggaaacaccagcgucugcaaagagccuguccacagcucaaauuccucaucggacacugucagcuccuaaaauacaaucagccacugcccgaagcaccaaggccaccacggcucccacuaagccacucagugaagugacauagaaugcagagagaaacagacaguaacaucagacuucgccuagucggucauucccaaaaacaucuuggaccuucucuucuccaguaagagggcucacccccugcgauaaugugcuaaauucagaggccacugcccucugacucaccgcccucagcgccugaacaguuucuacauuucugccucuugugaggccucauguuacuacagcgcuaacucucagcuucuaugccugcagggaggagagcagagaagcacgcgucuauccagggugccuaccuggccacaggcugugggauggucccugggcucacaggcaccuggaccccuuucucccacuccugucuccagggaucagccagcacguaguagucauccggguucagcugguaggagucaugcaacuucauggcagugaucaggucgguccuaaacaccuggggagacgagaaagggacaguggcacaggcauucauuucagagcacuggcagcugcaagggcaccauggagcugcccauaacaaggucacgguaucaacagaguaagagugcccuguuacagaaacccuucacuccacccgacacuccuuccccucgcccaggacugaagugggcuccagcuccuucagccgacacaagcagagggugcagugauuguaucgacucaacauaacuguugcacaaaacacaaccgcuccccucuccaagaccucucaauucaccaagggcugcugaacacaggcucuuggaaauccuucagggaaugacaagccacuacggagagcucucuuucgagcccauguuuuaaaacaaaacuucauuagccaauuaaccucaaggcagaaucuagaaccacccgguagaggucacuaucuucuaaacuaacugcuaaagaagcggccaaucuccugaagugcuagcacauggggcaggcggguggugagagcaagguccacuuuggcugacagcaggcagaaaugcaggccugcaaacaucuaggaguggaacacuagagcccuguugucccacgucacaggaugccgucagcccuggaagcaaguuucuguggaaagacagaaccaacccuguuuucacugccaucaagacucagcuugugcccaccuucuaagaaagcacccuaacucaucacagacagcaaagauaagcaaacuguggggaggcagcaccccugacucaugggcccuugccauccgaaucgacgaggcugacugaccguacagcacccugucuggcagccagggccacacagcugcuucccucuccggccuuguccucagcccacugccaugugaggauguguguaccaggaagcccugccauguaucacgagcagcaugcgccuggauccagaugcucugcucaguguacagagccacagagaugcaaugcacucccucacucgggacaggaagcgcuuucuugugcugcuaagcacgggucacaguauacaccuguuggcuuuucagacugguguucucuuuaauaaacuucaucuuaugaaaguacgggguagggucugaauuaaaaggccgcuucucucgcugucauugucaauacuggucuugugccaggaugccacucuuaacaucuacagucccauuaagcaacagacugacugugucccuucugcaaagaucucaccaugagacaaaagccccugaucauaagccuacagcaacccaaccccaaggaaaagggcuuugaggucaaaguugugaguccacaccaagcaaaucagguaaaagagagcccagcuaagcuguacaagaaaacacgcaaauuugccaaagaaaggaaggcagacugaggaaggagaugagaaaaggcagcuccauuccuacagaccugggagaggcucuggcccaaagcucagugccaaguagacaccaagggcaggggugacggcuacccgagugcuuuacguacaaagcacuuugcacucagaagauuugacacagaccaggcaaggacaggguguggugccugcugcucagagggcuccaaucccacucccaggcugaaguaacagcaguauaguauggacaccagaaagguguaguagcaguuaagagcugacucaggacuuaacagcagaguaaaauacaggugcagagacguuccgaugucacaaaaaaauaaagugcgcacuguaggucaaaacagacaccaggccagcagcacuggccacagcagccguccgugaguguuugcuggaacaggucucuuaagugcuuucuggcaggggauguuacuccaucuccaggaaacuccuccgcuccuagacaaggcacucuccagcuauaugggggcagcaugggaagggacucugagaaacaccugucgcugugugaccaccacaccacaagccaacugagcucaucccacaaacagugcaaugccagaacaacuuucccacagcuuucccugagaacccgacaggcugagacaccugggucucaaugcccggcgccucggaauggccgcagagaaagcaggucucaggacaacggggccccuaagcaaccgaggcuggcgggagacagaugccucuaaaaaugauuuuagcagggaaaugaacaacgaaacguagggcaucagggaaacauaaaaugugaaaacaaauugggaaagacggggaaagccuuaagcauaacgaaacucccagagucacauuggcuuguugccaaauaagccacagauccauggcuaaaacuaacuugaggcuggcagugacuuggcagcagcugaacccgcucauguccuggccagaggaaaacuuguugggagccagcgaagacggaacaggaaaggaaaaaaagaauacaauuaauaauaauagcuaacauucacugcgcaugauauacguguaacaugcuuugcguguucgagccuauauguauuaauuagcucacuucuuccugcaacaaggcacacaucugcuucucaccaucuugccgggguauaaaguggggcacuugcccagaccugcacagcauggggcaggcaugugggcggcagguucgcaugcacuuacuuacagcacacaugaucaaggcaagcaagcauucagaaguaccucagaaggcuuucgaucuucaggucuagagcagguacuacuccucccaugcugggaucgagaaugcugggaccaugucguugacaagccugaggaaacaaacauccaaacaggaaccauuaaaaaaaaauacaggcucaguauuugagcggcgauauggcgcuaguugcacaaaccugaggaccagaguucagguccccagcauccaaguaaagaguuggcauggugaugauaggacucugaacgucagagguuuagugaaaggccuugucucagaaagucaggcggaagagacaaaggagaaggcagucuauccgaccuuuggucuccacaccuaucuacacauccucacagagcacaaaacaaacaagcaaaaaagcacaggucacugagcugucaagaggucuuuccccuacaagaaaccuucagcgaaggaggagaaccugcagugccaucacccuggcuggcucugacaggguuccuuccuuccagucauuuucuaaggugaucacugucggcuccaguguacagggugcucugccuugugaacagcgagccaagagagccugcagcauaauccaggcuccgagcugugcucaagacgcucacagacccacacugguacaugaacuagaaaucaugccggaaguuuucagccaggaucaccgggcucaaccuaagguccugcccaaaacacuugccuccacgaggcacagaaaaaucagaaaccuccacacagcuuuaacaucaccuacuacacugcucuuccgaggugccccaaucccuccuguagcugaucaccaggaaaccccaaauccuaaguguuuccaggccugaaacuuuccuguagcacugagcuccccugccugagaugcccccuucaagccacacugccuugcucccuggggcccuaauucucacggucucuccauuuccaagcaguuccgaaguagccgagucucuaaccagaacccaggggagccuaagagaguugcacucuuagacuaggcgcucucagcucgcugcagagccaguaucaccuuggugguagacaucaacuucccagucauucuaaaaucugucagcucugagcaaaaaucccaagcuccgugcucugcaugaacaugcucacuuucaccucuuccggcccccaagaugaaucccacggccuuuucuaccagaggccagaaacccacaagucagucagacucuccuccuuccuccucagaaggcagccagucaacagccaaguccuaggccaaccuuccaaugccucaaaacccuagcuccuccuccugccuauccggcccugcugccgccccuucucauguguguggccagcuacaguggccucucugcaggcacacaacugcagccggaugggaacagcauucccaaccaccuucauuucuccccuaacuuacagauaacucaugucaccuccugucugucacuacagcacccgggcacugaacccugucacuucucagaaacugacaaaaccccaagauguuaaaaagcaaaagccuaagagagccaccaauuugacagugaagcccccugucacucaagcccuuccuggcccagaaucagcagacagacacaucaacaaacugaagacacagcuccugcacauaugccucucauccaauucuuagccacagccacagggacugugagagggcugagaaggaaggaaggucucugagcuacccuucaauaccaguacuagaucaucuggcgccaucacuccuguggaaugaaacuccacccuuauaggugauucguaccauucugugaccacaccagaagauccucuggauucagcaggaaguggggcuagggugcagccuagugcacagagccugcccagcagucuccagacccgagguuccagugccaacuccaagcaauaauaguccuuggacucaaaaugcaugggaaaugccacacacucucgaaaccaugugagcacacugcgaaugagacuggucgucccugagaaggaagugugggugaaguccacagaggacucugugucagccagaggcuucuuacaccuucccucccacaacccggauauggagauagaaaaugggcauaaaaacaagacauuuacugacuauaagccaaagagaaggaggccaugaaugugaaaggcagcagggagcaugggcacaguacaaaaguuuggaggaagaaaacagaaagggaaagugaugguauaaaauauaagaauccuaaaaauuaaaaauaauaaaccaaggaacagccuaaaacuucaccaccagacuguaaaggauaaauaaaccaugacacaucccuucagugaaacacuagccagcaauaaaaaggaacacauuauaaacagaugggugugaagcacgugcuucguguaacauagacaaauacugaaauaaauacacucagugaaugaauccaaggagccagaguaggcaaagguacacuacacugaugcaaaguucagggaaaugaagacucaucuaucccgacagcagcucaguggcugccuggggcaaaguuggauggacauguuauuuugauuuugaugacauaauacaugcaaacacagcuaaaccucucaaagcauacacuuaaacaugugcagcuugcuguacauaaauuauccauuacgaagccaugagaaagcuaucgccacuaagaagcaccguucacaguaugaaaaccuccagcccccuuccacuggugagacacagaaauccuaggcuggaugggaccccaaugaacgagcagaacaggaagucaugagaccucccugcaacagggagucacuacuucacagagaacaugcagauaugacguucagaauucagaggaguucaaaccagucugcacacacacagaaaauucucaguaaguagaauuuugaauagcagaugauuuuucuccuuaaaaaugucauggggggggggggggcacuggguacugcuguaagggaaaccaucacagcacgccuagagcugaagacggugggcacaggaauacacuccuaguuuaccuuguacaaagauguuucugagcucccaaaaaaugaggcaccauucaguaucaguguggggccacugcucucuuguggaaugcuugccuguccaugacacauucugaaagucaaaagaucucaggccaccguguggaugguaucacagcagcgcccuucccaaagccauccucuccaggcugggaggggaucaucaggaugcuccaaugauacucccaacugagugugcagaugugccucugcuacccuggcaacaagggagacuaaaggaggaggauacgaagcuggaggccagagugggugauguagcgagauccagccucaaaaaaaccuaguagcaggaauaguaauuacuuacauuccucauuaauuaaauuauagcauaaaauacuuuuuuagcaagaggagugucaaaugggaagugagcggucucaaugucuaaguaacucaugcuauagcaaagaccagcaucugccaaaaauuguauggugacaacguggagccaguauuccucuuugugacaucugagggcaaacgguaccaucaggaaccacacccaucaucacagcacuuggggguggagucaagagagucaggaguucaagaucacccaccacuagacauaauuugggaacccugucucaaaauaaagauacaggaaguacacuaacuuuuguucccaccucuugcauucagcagaggaguggcgaucuuggcaauaaugucuaaaacaauggccauucacaaguaagaauguuaccuaaagcuaaguccuuucuacugacaaauuugacuuaaaaugucuuauguauacaguacucaaguaagaauaguuuuguugggcuaacaagaugacucagcagguaagagcacugacugcucugccuaagguccugaguucaaaucucagcaaccacaugauggcucacaaccacccauaaugagaucugacgcccucuucuggugcgucugaagucagcuacaguguacuuauguaaaauaauaaauaaaucuuugggcuggagcaagcagggacugagugagcaggguugacuggaguagagguucuaaaaauuucgauucccaacaaccacaugaaggcucacaaccaucuguaaagcuucaguguacucacauacauaaaauaaauaaauaggucuuugaaaauaaaagaauaguuuuguuaaacuaucucaaacacugaaaagaaugaaggaaaaagaggugguggugguggugguggugguggugguuguuguuguuguuuuacuuccaugaggacagauacaacagcaggcagcgggucccggcuaugcaagcacuaagccucucccagccaccccagaggugacucuccaugucugagacaugcuucugcucuuagaacuaaaaaaucuuacuauguaacacaaggccagcagugcugagugccauggaccagugucacaacaucaggaugcacacguaacacauugcccugggcaaauaaaguaauaccacauaaauccccaacugggauuacacagacagcacaugacaacccgguguguacccugggaaggagccuccaucugccucagcucuugcagccuugcucggccagccucuaugguccaacucacuccaccuucugaaaagcauaugguuugacaguauuccuuaaauacuauuuaguuuuucucacuuuuauagggaaaguauguaaggauauagaucagagcuauaauuagccucagacaaccaauaauauuccugcccuaaaagggauguuuuaucccaauaagucucugcagagaaaaugaaaccuuuggaaauaaugaaacuaacugguggacccucuucucacauuuugcuggguggaaaaaagugggacuuaagggccuaccuucacacccaggcauagggucuaacuucagagucgggcuaggcuacccaguccccagagccuagcaauuccagacacugccuaaaaacucccuaucaguauuucgcccaacugcagggaugggccuccagggcagcuggagaaagaccaacaacagugccgucagcagaugagggcuggcaccuggcacagaaaaggcccauccauccccaacuguaaauaccacacuguuguuccccugggccaggccagaaaacaaagcaaugggcuacagacucagaagccagaagcagcaggccccagcuauuccuguagcuggugcgguggccccaugcugacgucugcagcugccucucuuccaccuggacaugcugccaaaaucccaucaggccuguaagcuggagaggcugagagguggccacugcacagcccuagccccuguuguaagcaagacucaggacauggaaagcuaucacagguggcccucgcugcaugggcgaaaagaugccacuccacccacaaaccgaaauaauacagggaggggucccaaugcaguuacaaugaacuagcugcuaggggagaaggcgagaagaguccucagcgcgcagccugcagacacaacguccgaggccuggcauucagucacagcuaccugcucuucaccaccaacauucaccauaauuaucaagucaauaagccugaccagucagacaucaaacaggaccauccaccauauguucuauacugaaccgacugcauggcaaaacuacagaugaccgucuggcaacugucacucuuauccccccgcaacuaccaucagagcgcagccaagcgcuaucugugcaugguggcgcuccagccuaaccuuccagaugaacagacugaacugaguaggaaaaaaauggccccucacaguaaagguuauucuggauggagacugugugugugugugugugugugugugugugugugugugugugugcgcgugcgcgugugugcgcgugugugcgcgugcgcgcguguguacaagcacauguguggaggucagagggcagacaacuugcaggaaugggguccaucggggucugagugauaggacucggguugccagcuuuggcaacaagagccucaauacacucugccagcucuggacacacuugcugugggcacuuucugaauuuaaaaguccaacuuuaaaaaaaaaaaaagggcaggaaaaauugcauacagaaguaaacaggggcgauugaggacacuuugacagacaggugucaccaacagucaaagagaaaauagcaagcucuugccagagaaguaaaaagcgggagccucacacccaacuuggugucccaagcucccgcugucugcagcucagcguucuggcaaccucagauuuucacaauguagcugagaaccaggaguucguuggcuuccaggcagucaaaauaaauguauauacugccugcauguauacugggagccucaacagccucccaggaaguaagaaagaacucugcuuuggagagaacuuccuccuccuacuucccgcuucccgcuuccucccucacagcucccuugccugguccagaugucaacucuccaguuucucaaacaucuaucagaucuggccuuggcuuccccuccucccacacaccaccaucacccucccccugccccaccccuuuguuccccucccaucauucucguuccauacccacugcuccuugccuucaacagcaacggccacaguucagccagacagcccaaauccacaccacaguuucaaauuuguggaccuuccaccuucugcguggcuggccucgaagcccccacggcagcauauccaugcuuguguugacuaccugagaugccaggcguucaaacaacccugccuacccaaagcuuuuuaucccugggacccacccaaaaagcugccuccucccuaggccuucccaaaccgccucuuuugaguugcuaaguugcuaccuaucauuucuaaagcacauagaaagagcuguauaacugcccugguaacaucacaucagggcagauccuaaugucugaggcaacgugccuagaaagcaggccaggucgcuuucccaccucacaguacagcaagcuuccuuuccaggcuuccagaguuuaaugugcaaugucaaaccuaagcuaacaggcugcaguugcaggcacugagcuagguaccgucugaagggagcgccucucucaacagucuguuagcuccucaacagacacugugugacauuuauuuugacugccuggaagccaacgaacuccugguucucagcuacacugaaaaucugagguugccagaaagcugagcugcagacaguggcgguaucacuccauccugugacagcaggaaagguuagggacucaugugccuggacuugguacccucacgucacgcugggcagcccuucauucugcccucggagccccggcaggcucagccaguuaaucauuaccuggcuuugauuaagucuccucuucauagagagcaaugcgagguaccauaaaugcuguuuaaugaaaacagacacaccaguggcucuuggaacuaaauucuucucccuggauaacacacaggaagccugcagaaggccugccugcagucaaccuuaccgggaaagaucugcuuccagcccugcaguagcacacucagaugucuuucuccaggccuugccuuucucugaccugccugauaugcaaagggccucgacuauuuagagcauuauacuauaaaaucauguuuucacacugacccaagccccgguaggcuccaagaacaacaaagcaggacuuacugccauugucgucagaauccucacugcugcugggaaggcgaccucguuucaugaucuccccgggagacagcaggcagccugcaaagcaaugagacagcacuuaacccaagaugggaacacgcgaucaucaacuugugcuucagauggcagccaggaugcugcaaacaaaagcaaacacgggccucaaguagcauuugaauugcaaacagugaaaagaccaaaggcacauaauuagcugaaaucauuaacagagcagguuaagaguggggggggggugagugguaaagucacaugugggcaggucucccaggugccacccuucccuccaguucccagacaccacuacaacuacuccaggagucucgucagccccggcagccagcacuacagaaaacaauccuccagcagugagcucccucagacagauccaugcucugugcuuguuggggggcagggauggggcugugccuacugcuguguuuacaaugcugcacuggcaugaucaggcuuccuuggcaaggccugcuaaaaugagccccaaauuuugccaaaaugagcuaugcaacaagcugcagcucuagaaugaaccaguggggugaugggaagacacccaucuucaucugccuuccccaaccccucagaggaaccacaggcuucaggaaccccgauccggaccccuuccuuugcuccuuacagcaacccauccaaggucguacuagucggggaaaccccacuccuuauuacccaaauccuuucaggacaaguaugaacuaauuaauaaucagugguacaacagccuagccuaccuggccaguccuucagcucaccucaguucagaaaaccacugccuucaugaaacagaacagugggccaagacuacacagacaguuacagaagaacuuggacagaacuauaucaacaguguuccaacaagucacaaaagcuucucuacacuaaaauuauugauugccuugacgucugugggaccacaaccuuccugccaggucaaugacucccaaagaaaagggagagcuuuucagggcaggagaauggcagcgcuucaccgccccauccaaccaaggcuccuugcugggaaucaccacaaacguaaugaggucuguuuugcacagaggggcaguguggagagccacugcaguaaagcaagggaguaauuaaaaccccaaaguuccacuccggacagaccugcaaaagggaagucaaaagaggcagaaaacaccagaccauagaggaacaaaacaugccacuugggccuaaagguuauuuugaguugccuucuuccugccugaucauaaguuuaccuuuuguaaaggaaauuuccacuuaggugccccacaaaaacagcucuuauucauccccaauccucaauuaccauuaaucucauacauacuucaagguccucuucccucaaaccuaaccccuccucuugucgagguccucucacaauguacugcccuuuuuaaagagcagcacgaggggcuagagagaagcgcugugguaagguagcucuugcacagcaccagagcucagcuaccugaacccacugcgcgcccccccccgcaccccccacuauguucuguaacucuguccagccucugugguacugacauucccgugcucauaccaacccagacacauaauuaaaaauagaccuuucaaaaauacaacaguuuacuaacuccauaucuaaugcugcuggggugcuucucacucuuuuaaugugacacaaaccacacacacacacacacacacacacacacacacacacacugauguuuauauaccucuguuccugaaucguugacaacggauaguaaguuuccccuuuuggaacagacccacaggauucauucaggaauucaggcuccuggacuuuaagugcaauauuuuauauguuccuccagagaaacucacucaauuaaaaaguuugugggcuuuuuuguuuaccaacugauuuucuaagaucacuggaaggagacugacuguagagaugguuugguugguaaagugcuuguaaccucgugugaggaccugauguccacacccacagcccacauaaaaaggcaggguucccagaaagcagguagaggcagaaggacccauaggacucccuggaagguagaccagacuaaccuaaccaguaaggcccagaccagucagugagagacccugucuccuaaggcacacaugcacagccacacaugcaguaaaggaaugcccuguaauuaccaggcguccacacggaaucaaaagcccccuucagauagacacccugugagcuacagcuucauucacagaaugggcagccacaguccuaagauccacccauucauucuucccagaaaggacucucaccuguaacucugguccaucuaacaagcagucuacacucugaccacuuacguccauaacguccacgacugacacacaccugugacccucuuccgcuuguaauggcucucuucccugccaucccugugcuugaagcaccaacugcugacagcuuuacucucugccagccuuugagggccaucccugcuccccaggggcacagagagaggacacaccucuccucacagcagcuucagcucucuggagccugaguuagaggguuuuaaaauucgaaaaucgccaccugaagguggaaugccuaaagaguaacagugugaugcagccccgccugaacggagugcaccaccuccggagcaggugaacugagaacgaugagagaguccagggagacccagagaacuugccugcuaaacaaagugcggaaguuccuccauccucacucaccagucaaccuacauuuuccuaaacaaaguggcgagaacuuggagucacugaccaucaaaacgcccucaucccagacuucagggaacaaccucaagcuagacugauauuccaaaauucaagcaacagcaagaauaaaauuaguauuuuccuucugaugagucuacugguauucacccugaagacccugcguaauggagcuaagaacagugugcucugccuguggugggguuaauguucagcaaaauucccuccucugugacucuaauguacuuaaaccuugacaucaggcugauuuaucucacccagggcuacuuacuguaucagaaaaucaaagccugcguuacuaucuuuaacacacacaauagaggcuguauguugcaagccgcuguccacuaaaaggcagcaggaggagagccucugcgucacuauccugcugucuggagcacuggcugguugcuaccuacgagaugguagggagcaaagugauaaucaauuaaaaggacuccucacaaaccuccagagaaagcaguaagaugcccaccugcaugagcggcaaacaccugaaaaggugggaccuggcuuugcagagcuucuggccuacagaaugaagacaggcgaaaaaggaaagccagcauccccggugcucaacaguggugaacacuaacaagagccuguaugaacccagaaggcugaggaauggacguaagcaucaagguggcguagccagagaggaaaagcaugucugcauaugacuccagacaccaucugcauacuccacacacacaagguuuaaguacauuagagucacagagugguuuccuuaacaguggaauccauuuccuuuuuucauuuaguauguauggguguuuugucugcauauaugacaaugcaccacauacaugccuggugccugagagggcauaagauccccuggaacuggaguuauagaugguugugagccaccaugugcuggaauucaagcccgaguccucuguaagaacagccagugcccuuaaccacugacccauaccaacagcuccuagucauccuuucuuguaugugacugccaaagcuuacugauugacaucguguaacucugucaagucccccuacuucccuauggguuuggucuucaaccacuaucaugguuugaauucauccuugaaacaagaaaacauuccugaacagaaguauggagggguggagagucaugggagaugcucacagcccucaggacuacacaaaugcuucucucuccaggguggguaccacagaugugaauuuggccaguuuggcucacucaccuuguuaggaaggcucucaccagauguggucccucauucucggaauuuccuaggcucuaaagccaugagucaaauaaaggucuacugcccugcacuuauccagcaucaguuacucuacuguagcaacagaaaacagacuaaaacagccacuucaccuagauguccuugccacaaccaacuacgaaugaaccacuccugagaugugcucaagucccacaaaucccccucuccagucuauacuuugaacgcacgccgaagugcaaagugcccagaacccuucccagcuuugcccaagcauccauccuagggacucccagacaaugccuuggaugggccaggccucuugucguuggggucucagaucucagccugugccaagguugcucugcugucuuuccaagggcuaccaguucaaagacaucagacaucacccugcacucuaacuccacacagcucacucuguaccaccuaguucagcaauuuuccucuugcuaaguugcuguucaagaucaguauuuacuuuaauagucaaugagcagggcaugguagcauaugcauguaagcccagcacaggaggcaggugcaggauuccaggccucaaggccagucaggaguucuuaagaucucuucucaaaacacacacacauggggccaucaagaugguuuagcaggcaaaggagcuugcuaccaaguauuaaccugaguucgaugcccagaaccugcgugguggaagguaaguacuggaauauacauacacaggcacugugcacaugcgcacagagggacacauccacacacacaugcauauccacacccacuuguaauuaaaaaguuuaaacacaguaacaauaauggaaaagagaagacauuacaguagauuucuucaaaggagacagcagcacccugugaagugagcaagcaacagagucuugccgugaggaaagaagaugacgucaaggccagacuggcuuacagcccggcugaggaacaaggcaggauggagugauguuccuaggagggacuccaggaaaagggaucuaacgcaacagacuugguaagauuagugcagaagcccagccaggaguuagugcuggaugccucgugcaggcaacuuuuucugaacuggcugagcacaacucuccauuuuaugugugugguguuuugcuugaaguacaccuguaguaccagaaaacagaacuggaguucugcaaaaagccauugcaucugggaauuaaccuguguccucaggaagaacagucagugcucccaagccccaagccaugccucuaucuaucuuucuugguuuuaaacuaguuuucuaaguuagcauacagaccaaugguuacauuauggccuuuccauguuuggguccuuauauuugguguuuauuugccccucuccugccugcccucuucuuacuggcccucuuccucccuccagacagcgaccccugcuuucaugucacauguauuccauuagccuuuggcuccccuauuccaagauuucuuuccuuaacagggcugauaaagacagagaggaaggcucaaaccauucugaggucugagaacagccugauaaccccugcuccccagcauacaguguucugaguucccugcagugcgccccugaagacuacaauuucuggagaacaaugacuuuuuuauaaugccaccaaaccuggcuuaaauggauccaauguacaggagcccagaguccacucacugaaacaugaggaacaugacagccauacuacuagggagcaggcacgucauauggagcauuaggaagucaguccuuccuagauagcuaaggagaaguggcuggccaaugaccccaacuggaccacuaaucggccaucuggcaucucuguucacugcaaggugagauacacccagacagcuagacagcuguggugggagcgcagggcaccacucugggucaaaugugggggcaaacacauucaaucuguggcaugagcuaaaacacagucuuuaccaacacagcaacucccagaaaacuacaccuaguagaaggcuacacuuugaacaagcuguagacuauuuguugcugccuuccuggauggaguaacccuugaagcuacggucuguguggcuagcaaggucccucaaaaccuucaagcuuuaguuuccuuugacugaaacugaagcagcugccaggcaguaacaggaaagagccagcagcugccugcucugcccuaaaauagcuccagaacuggagucacugaguucaguggcccaagggucagaggagaagaaauuucaccgaagauuaagaaaggggguuguucaacgcuacuccugagcuaagggacucacaggaagagacaaaucagccaggacuggaccgaacagggaccauuuaucaggccauaaacucuacagcucuaauaaggaucacaccccagugauuuuacuaucuuauggcuccuaugcaaaaaggcugccuuuucccucaaaugucaauuuuaugcacuaugucuccauuguuauuuaugucacuggcaagaaguuccagaagggacucaauuaaaaccucuacacacuuccuuagccagucaucacccaguucaggaugaugucuacaggacuugccuccuggauaaauggcugagucccugcagugaccauggcccaugcucgcaggcuugcuggccuuacucaccagucagguaucgaaguaacccuuaacuggagcaccaucuguuaugcuagugugaaacuuauugguguccuuccacgcucugucagugaaaugcacucucccaaggcuguccugucaaacaccaggugaccuuacacagagcugaaaucacaccagcuacucugcuguuugcccguuagcacauuucaguauuacgcaauugugagccccuaaaagauucguguuccccacccccaggccaucuccuucuguuccgaagugcguacagauuucuaagcaaccagaugcacucaguaaaaccugccuaccugucccuagauuaaugugaaagaaaccaaguguuaucuuaacuuuuaaggcaauggggcauaaaauuacuaaaacuaauccauaugcucaagucuaauacagugacaacagcuuacacauuucccauuuuaacuaaaaugagaaaccauaauacaucuaaagccagaucuaacccacaagcaaucaggaaguuaaauagaucccaguuaaacuuacgggcacugcagucuaaauauuucaaccaaaauaaaugagcuuuaaaauguguguaugucauauaccaaacuuuaaagaaaaggcugcccaagcuacuagaggaccuugcuguagagcugaugccagcguaacuauguccuccaaaaaagaacucugacaacugagccgguggguacucacucccguuucuaguggugcaaacauucacacugcccuguaugugaaagcaccaacucauauagauucuuuaccaauuagucugaacucagauuuuaaaagccaagaaaaccagcugggagaaucuuaaggaauuuauaaaugaaggcuccugagcaaaucacaggcugcucucacuugccaauuuauaaaugauucaaucacugcuuacaccuaagacaauccuuuaagcccccgagaucuaugacugagcacuuaauuaagagucagaagggaagcaggucaggagaagaggacgaaacaagaugugaguguaaagccagccuggguuacauaaggaguuccagguuaggcuauacugugagacccuagauuggggguugggagggcugaauaagagcggcuaugagaagcacuguaggucaucggugccuuggugcccugauguauuuuaacuucauuuaacaugaaaguaaaugaauucacacccagaaaguaacaucaguagucacccgggccucgagcuugaucgucccaguccuaguuccaucuacagggaaucccuuccuguaagacaugcuaacagauggaaggaugagccggcacagacuuaaagcaaaccaggcaagugguagguguaaaaacuccaacgagaaaacaggcucgcucacacauacaggaggacaagggaugcacgcgacuucuuaugcucaaagggaaagucugaagaacagaaaagggccauggugagucuaagaaaggggggucguggcccgcuguacuguagacagaaaguacuaagaacuuucauaguucuggaagaccuuuaccaugaaugguugccaugcuucuaacaguaaaaaccucaaaucugaaguuucuucucgccagaacugaaugagcagaccuggaccagaagcuaagcacccauauggcaagcagcaccagcaagcuacauauacauauacacauaccugcacacacaaaugcacgcacacaugaacaagcacgcacaagcacacccguuccucggaugggguacuacccagauuaucucaagaguaucugauacagaaagcauagaagaaaaucuugcuuuccaaggcauucagaaguuaccauucuguucugccucgagguccuugaaccagguucuaacacacaggccacacuaggagaucaucaaagaaugacauuuuagggaaggugcaaaaggguuccaaacccacuauugcaccauuaguggaauacacuaagagauaaaaucucuacuggguaauuuaaaggcucacacagauguuccuacugguuacauacaaugcagccuuugcagaagcuaggcucgaacugcuaaugacaauuacgcccuacagacugacauguggcugcuucugaggaacuuugucccuugaucagagccaacuaucacuagcaaugcuaagucacaaaaaaaaaaaaaaaaccaacucugcagcacuguccuaguggaagccagagaaacaaacacccaguguguguguguguccaaagagccagacagcaaguguagugagcacugcacuucucaucccaaguuccacgugagaacaaacacuucaccacaauuacacgccacacugagauggcuguagaaacaucagauggucugaaaaccuagcagaaggucugcaaagcaccaggcuggagcggacgccucucacaacauuacacggcuacaggaaaguuucccaaaaggaaccauagagugaaaacugcagugcugaaccagacuccagagaugaaagaauggaugcacgcucgcaacuuuaaagagagcacacagaauccugcagagggccggcagcacaggaagaauacagaggccacaagcugagccaaaggucccuugccagguggcaagcacacuuccuccuggguccuggaccauggucuucccagauuccuggaggacuacuacuagaaucggaacucccuaaagacugaagccacucugugcuaucagcgagcaguuacguagcaugaaguccaaacagcaaucugucaaaugaagcauggcuccuugcaagcuaauguaaagguggcugccacugccacccgcacaggagagcacacuccaagucccauagcccucuccaccacaggcaggcaacccucagagcagcaggcacaacugauuuagacaggacgcaugcgcucugcuuggcaucgcuucccccuggcgaggggucucaccagggugccugcugcucacccaagaccucuuauccacacaggugacuacaaaagcacauagcaccccuggagagggacacaggagccuaaaaccacaacucugagaacaccgauuccaugugauggaaugcagcguuacuccagucugauaugacacaauaaagucaauuaagguuaaauagaugauugacugacagaagacagauaaaggaagaaaagaccgcccucagacuaaucaacucucucuauauuuaaucaaacuuuuugggggggggaaggugaggggaucccagaauggccagcaaugcccuaaacaaccucagaugaccuugaacuucuaaugccccugccuccaccuccuuaguguugagaccgcaggcauguaccaucaugccuaguuuuauauggugcuagggaccaaacucaggguuuuguggauguuagguaaaggucacacuguacagccugucucagagagccuggauuauggacuguuuucagauaucugaaacagugaaggagaaaugauucaccauucaaaucacuggcaaugugcugcucuccuguagcugcucaguagcuacugugacccagaugacccacagacaccccuaccccuucacaaaagcuccuacuggcccuucaaucaaucaucaggcaggcgauuauacaucuacaaacauggggugugucugguuaaagggaucaauuaccaggucccagauagagaucuuaaggcucagagucaaggauuaggcaugcuaacuccuuaagaagucccagaccagaagaggaggaaaaacaaacaagagaccagugagcggcugagacaggaggcauccauaauggcgugaaucucccucaaagucaacccugcaggcugcuguagggaccagugggcccucuguaauaaaagcaaccaaacugcuuaucugauuuuccagcuaauaacagaaaaauaagcaccccaaacagcaauuuaacagaagaaggcaaaggaugagagagagagagaccuacaaagucaccagaaacacuuaaaggaauuuugacuucuuuaaggagcacacugaagccacucugaagccaaaagucuauacuuccuacccuccugggggacuccagcagccacaagccccaaaccaaggcuuggaaggagagccuuggauaacugagaaauuuuaaacuuugagaguacuacaugcugaacagacagaaaccaggcacuugcgccucaagaagcugcuaaguuggcucuauuucuuguucuuuccccuguaguagaaaggaaacaaaagcuaaccaguguacuccucagcuugaacccucacugcugaaacaggugcuguaaauagcuguucagaaacugucuuggguaagggaacuuccaggacaggagacaccugaugcucgguauuauuucugcuuacuccaauugaggcauucaacaagaacacacuacagcuuucauuuccucgcaaaagagcccaaaagaaccuaagcuuuuaaaacuaacgaaaaaaggagaaaggauggagguguggcucggugguaggacaggugcuuaguaagugugagacccuaggauccacccccagcaccgaaaagguagaaguaaucuaagaaugaacugacuucagcaaucucaaucgccucacuauucuguaccugcagagaauaaagcaaaaugguaaacacuggcuuagugcuagaguaacaaaaguguggguacagcccagagguagggagggcacuuguuuagaacacaagaugcccagagcucuucuucaacacugcagaaaaaccaagacuggccucuaaacaucugcuggaugcacacaccuaccacuggucuaguguuaauaaaggauucaaaauuuaaaaugugcagccccucuccuagaaucaagccauccaccucaagucuaguauuuuuauuuuuguuacucaggugaguaaaaacucccccaggaaccacucaggacuuggacuagaaaaggaucaugugcuaugugcgagcauaaacccugcuaaaucugacugucacacucagcugcagggcaaagggauccuagggccaagccuguauuuagaaggcagaguaacuuaccaacugaccccaacccuccuuaaauacacaaaaauaaaaauacacaccuaccuucuucacagaccuaaguuugugcgggaaaaugucagagaaacaagagacuaucaacuaaaucucagccugagauuacauucuacaaauaugaaaguaccugccccugguacuguuagcacagaggaaaaaauaaauaaaauaaccaaacaguaguugucaaauguagggauaaucucuuguggacuaugagcacaggaggaaaaaaaaagcauuccccugucacucaggagcuaaauggccaaugacaacgcaggagaauaggcaggucauccggaaaagagaggcgcucuggugagaaccagagagagaggggcuucaccaugaacauucgucaccaaggagucaccgguaggauaccaauagaguaggagcaaccaggacaaaacuaaguuggcaagugccagggcgguggccgaguaguaaguaggguaagcagccacaaacagguuagaauagaugggcaacuaccucaagcagcuucaguauacagaaggucucccugucuuuauuugggaacucgaacaaguguagaaaagccagaauucauuuugcagucaaacauaguaguaauucuaguuuuaaacuucuuuguugagccuagagccauacagugcuaggaaagacccuguucuauugggcagaacacccagcccaaaacucuuaagagcagaagcagaaaaugccacaagauccuggaaagggagagaauaaacuuaaacauaaaacuuccaggaaaacaaacuauucucaauuaaacgacugcuaauuaauguuguuacaaggucaauguauuuuacaagcgaaggacucgaagcaaguuccaagugucacagaggaaaucggggaguaagaacauaaugcuguacgcagugccaaccuccuaagggagaaccugacaaagaaagauguuuaagaugcucagugucuagccaaagcucaaugccauuucaaaccagaagcaagacaugcugccagcaaugucccaguaaccuucagagacuacccaaucuauaauaaaccugugggaaacuggcuuaaguaccaacucuugacagcccacugacaaaugauguaacagguacuuuuaauacuaaaccaaaggacaaguaagagaaggggacaggagacauagcuguagacagucauuuagucccuccucacucagcccugucaaggaugcaauccccauccgagaccuuugcacaggcuacaucccagccacaucacaacugaaacuuaagacaacucuuucuccaggugaucugaaaacacauacaccagaaaaccacacuuccuuuucaaacauuuccaaaucuaagauucccaaauuacaaugaagacguuugauuugaggaucuuaacucaguuuacuucacggcccuagguucguccgcucacucucaggagcuucgucaaaaaguuaggucacaugcaaugaaugguccuucaagggccagugguuucaaaaaagcuggccuugugaucagggcuaaaugggaaauggguaaucaaugagacaguucaacaggcuagcagacaagaaaaagucauggauaugaggcuuauuuggauucaagcacacagacacuguacuggaguaaaacaucuguauuuuccaacaacuaacaccacuaauaacuuucugacccaagggauagucuaucaccuuguggggcacacgaaacucugcuucugucugugcauccccaugguugguucacugucucccccaagccucuaggcuaggcaagcuuugucucuaaauuacaacuccuuaaacuugucuaugacucugucuacugugcaaccgcagacuacagaguaaagucauuuuucauagaguacagagcuucuucaaguuguugaaggaagacaggcuaccccugcccccuuuggcuaugcugaggacugaauccagagcuucaggcaguguaggcucgcagcuccagcaucacuuagcuacaguccuguccugcuuuuccugacaguugagaucccugcuacaaggaagcaacaugggacugugaaggagaacaaaauucaagucuacuacacacucugggaaugacuauccacucugcaagcauggacauaaaaaacgcgcaaaccucggacauuagcaggaaacuguauuuguucuagaagaugaaacucaaggucaaauacauuuacaaacauacgcaaacuuuauuaagggcauaaaacagcaaacauucaaaaaauguuuucaguugaccguaguugauaagagaauguuggacucuggggcagagcuagauuuauacucaggcaaugcgugguucaauauuuucaagaggccacuuacggcauuuaagacagguuugaaucuaaggugaguauaaaccucuacuugcuucuaagcagacauaguacaugcccccuucaucuacguuuuucaguuuucugugacaaugcccuuggucaacaauacuaaauguaauaaaggucaacaauacuaaauguaauaaagauuuucaaacauguaaaaaaaguuauaguaagcggaacuuaagaccuuugugguaagaaagacuaaaaauucugaauugcacagagcaggucaccucaacugcggaugugaucgacuacuaccuacaagaaauccccaacgugaaccgaguuaaguccaaugaacccuuccuuucuccagguacaguccauucuacggacuuaacuaguguggucuaaaaaccaaugaaucguuuucaagaaaauuauucugucuugaaaugaguucauuagcuuugauaggcacuaacuagccuucagcaacaagcggucagagaguuaccuccuccaccacagguauucuaaaaagaacaccuaagggagcccuuugagaaggaaccccacaaaccuucccaggaaugaggaccugagguccucuucuacuuuccuaaaagcugagcucuguggccaaacccaaacauuucacauaaggaaauauuaaauuccccacagguccgggucaacaaagggcggaagaccuucgccaccacguuucuagaaagcaagccaccuaaagcugcuuuaaaugggucucguagagaugacgagcucaaaccgguuucgaaggcacauuuaaaucgcccgcuuuuuuguuguuguuugcucacagcaauucaccagcgccgagagugcggccgcccccgcgcgcccagaagggggagcccgggugugaagcccgagccgggagcggggaugcggagcccggaaagccaugggccgcagaggcggucacagagugagggucucggguguggggggaaccugaagccagggaauaaguggugggaaugggaggcccucgacccaggacugggggggggucggaagugcggagggaggcccgcacagggaagcucuaggggcuggaaaguggggggaaugugggggaugggagggaacgauagcuccguuaaaaggggugcagggcccgaauccccgcuggggaaggccgggugggguggggaaacaggcuggagacccgggguggggccgcgaaccgcgggcaucccggccacccgcccgcccgccaggcgcagggcccggcuuggcgcggcgccgcccccucgcgcucccgcuccucccgaggcgacaggaacaacagcgcgggaggaggggaaaguaacuccggccccggugcggggaugacaccgccuccccgcggcgcagccggccucgcgcccgcgccgccgcccucggcguuugaaaguggccaccccccgccgccgcucccgcccgccgccaccagcugcaccaauccgcucggccccaguugcaaaucaaacgcucccucgcguccgcacgccacuugcgccgcugcaaacggcuacgccgucccuccccggccuccccgcgggcccggggagcagcagagcggcgguggagcaacgcggcgggcucggcucgcgcucccgcccccagacaguucuggaaacuguggaucaccucugucacaggaagccauccggcgcgcagggcggcgcgcaagcaacaaacaaacgccugcggccgccgcgacgcgggaacagggacggcgacgggcggcggccaccccgcgccgcgggcuuugugcgggacuccggcguggggacggggccgggccacccccgcgcggacccgaagcgccugggaccguuaggcgacgcucgggcagcgacaaggaaccgccuuggggccgccgcccggccccgucucugcgccggccaccucuugccugcgcgggagggcgggcugcaaaaguuggcccuggggccaaccagcaccugcccacgugccgcguaggcucgugccccggcguacccagucccuucccccgccgcccgcgagcgccaggucaccuauuaccggugggaggggagcccggcugcuauuuaaacgcccgcggaaguugaggcacccccaccggcggugcugugcaccugccucccgccgccgcgcuccgccacuuugagcagcagcggcguccucagccccgccuccugcccgaaggcgggcgggagggggguggggggggcggguaggagguggaagguaucgaauuucuccagcaaaugggaccguuccgaaaggauucgguucuccggucaacauuccacauuccaucccucucccgcauuugcaagccuacgccgagccgacccagaaagccuacuggcuaccgaacaacagcacccaacucgcaaacacacucacaggcaccagacacgugcacgggaagguuuugcaacuugcagucccggggugcacaccgcaugugcaugugcucauaagggagccaggagacacagagaccccacccccacaauuugcagauggugccaaagguugcaaucugcaauccguuuuuaaguucaugauuaauagguacuuugcucuaccaaugaaguccuccucaauuucaccgauuaagucuuuuacacuuuacaagcagucucgcuggaaguaaaaggucucaucauuggaaacccauucuagaaaaaucuaauugccaagcugucccuucauccccuucucacugcccuugaauugaugcaaugaauauuuuggacauguggugacgcggugacaggaaccagggcugcggccacuucacacagauguacccccucacaccuauguuugggaaaacauacccucacagccuccuucccccccaaaacacacacugucaaacacucuggaaacauauauguacgcgaaccugcgcucuaccauugccaucugucuaccaaguugcuacuaugcuuuccacuuucaugcagccuaaggcaguugggcuuuuuuuuuuuaauguauaaacuaaacuggguuucugcugcugaaaacgcuggaugaaucaccugaaaaccucauguucuucguacauuuaaaaggaaaagcucuaaaccuucgcccuccuccgaucgaaaauaauaaucggaauagaacuuacugauccgacaccgaucaauucucgggcuccgcggccaucccggccucguugccggcccccacccggcgaugcccaaguugcuggugggauagugccgcggcgcgggcggccgccuccucccuccgcgcuacagauccacagcccaaucuuuuggcgccauauuaaugacguacuauauuauuuccacuaggcagcgaccuucggcauuacauuacucccgagaacucccgagcgaagcaacaaaaccaucaaauauggcugagccucucggcucguccugcagccgccgcggccgcggccugagacgcgcaccccgacccgcgcgcccccgcgccuccgcccccgcguaccugcugcgcacgggcugggccuccgcgggcugcgcgccgcgccgcauggguccgggccaccgaggccccgcggggagccgggcgggccccugcugucgcccgcgcgcucggccggcccggcgcgcccaggcccucccgguagggcgugcggcuggcggcggaggaagcgcggggacgcagacucauuucugggucacugcugccacaggggggagcacuuuaauccccagccaaaggagaggguggggacgguggggcggggagccgcugguaggggcuugcucccguuaacucuugggguccugacugcagccagaggggcucuccccccucacccaccucuggagcccgcaaacccuccaggugucuccuaggaggaagaagguuugugaaaucacccccuccaaaacugcugccccaguuccaacuccgggcgacaugcagaaaugcauuuauugcaaauuaguuuuaaaucaggucgacuaggaacauggguauuaaagcgaauaguuugagugaaauguuuuuuguuucuaggaugaauaagaaauaguuguuuuuguaguaacaguuuugaaggaguuaugaauucgaaugacaauuuuaaacacaaucuaauucugggauggggaacuccagcuuuaccuaaauuuguacugaacucauugaaaauuagcauucacccacuaaaagacaaccaccuucugaaaaaugucuugauuuuuauguuagagcguucuugucagaacuggacauuuuucuccuuccaaauaggacugagaauaacacuuaaacucaaacuuuagacuaguaugaaagcaaucgccagauuccuguugauacauauguguaaaaaaugaguggcuguugguuuuucauauacuaaaaacuaacuuuuuuauggagaauaauuauuuucauggaguccccaaggaaauacauuuauauuacagucaauauccaaaggaggaaaauacacauuaaaauuuccauuuagaaaauaagaacaaugauuauuaauuacaaaaucagauauugaacccaaaagacaagaucauaauucugaauaaaacagguuugauucacagacgucauagugugauaaaugggagaauaaaaccuaacugugccuuucaauuauuuuucaggaaacaaagcaaagcagcagaaauccuaaaugugugugcucuuucucccucucccauuuccuuaacaaggagcauaaagacucccucccugacaggaucucugcuucgcucuuccguccugcuaagaacaagugaggcgacaaaugauggguagaacccuuacuaguacuguguggucuacaguucacacacacacacacacacacacacacacacacacacgagacacagagagagacagagacagagauagagagagaaaugagggagguuuucaagagaggugucuccaucaccacugccaucuuguucauccaucaucucucugugacaaacugauugcacccguucuaaccuccagccagccuuuauucauucuaucuaaauaaguaaguacuuucuagaaaccucuguugggccuggagguauggcccaacauuaagagcacuugcucuuucguaagacuuugguuguucccaucagccacauggugguuucacaccaucuggaacuccaguucuagggacuccaacaucaucgccugaccuccacggauauuaggcauauacgucccagaagaacccucacaccacacacauaagcuaaauaaauccaagaagguguuuaaaaauaaaauaaagccacuguuuugcaugcuuguuuguuuuccugacaagucuauugccuaaaacauccagcaaaaaaaaaaaaaaaagcaauguauuaguggagcacaaaaggaauguaaaauggcucacucuccccacaauacagaggcuaugaccucucaauucugacacagauuaagaauaauggucaauaggucuucugcauuuauguuguggcuguauagcuugguguucuugugggauuccuaauggugggagcgggggaacucagaaauccaccugccucugccucccaagugcugggauuaaaggugugcaccacgaccgccuagccugaaacuuguuuuuuugggaaguuuguuguuguuguuuuuguuuuucaagacaggguuucucuguguaacccuggcuguccuggaacucacucuguagaccaggcuggccucgaacucagaaauccgccugccucugccuccugagugcugggauuaaaggcgugcgccaccaugcccggcuuacuguaacuuguuauugccaaguuugguugagaucucugggaggcaugcucuuuucugaagggaaacagaaaaagaggagaucugagggagaggggguggcaggggugagagacugggaagagaggagggaggagaaacugaaguugaaauauuauauggagaauuaauugguuuuuuaaaaauauuggucaggggcuugaagcuggagugucugcuuagcaagcaggaugcccaagauuugauccccaggagcaaagaaaaagaggaggggaggggaggggagggagagugggaggggaggagagaaugaaaguuguacuuguacacaucuucagacccagaauuugggagaggggcagaaggaucaaugaguuugagacuagccuaagacacucaagugaggcuguuucuuaaguuaaaaauagcccuggccuagaaggaggaaaacacacacacacacacacacacacacacacacacacacacacacacaccagcuaccauaagacucaggacuaaacucuuugaucccuguuuucuccccugagauuauaagaaagaugacaucuaaaagucucuuuccucauuaacaguugaugauuuaacuguucuccuuauuuugagccagggugucacuaugucaugcuggccgagcgaccugaaacucaagagaucuaccugccucugcuuucccgguccugggaugagagcuaugcuucacccgccugcauaauuuacuugccguuuacaaacuuacagaugugacggcacuuugaagaaauggagcgcaacuggaauccacuaggaacaggaaagaaacauuuagucguucaugaucaggguuggcauaucuuaaaauaauagccaucuuuuaccaucaucccacaagaagaacuuucauacaaccaauuccucucugaucugggaaaggcgaugccacucgguuugccucuccgcaacacaagcagcacagcugaggauggagugugcaaguguguaagugagaaauuugacaacgagaaagaaacucucauuccucccugucacucucccuuugccaaaucauccagaucaccguuuccuagucucuggaaccuucuguuaugucccacugugccaucagagauggaaggguguucaagaaacuugcugcaaaguagugugguagaaaccccaagucgcuccucuuuccugcagcucuguucccaugugacaauuacaaugccauccguagccccuguugcauucagcucuggucaaacauaguucggccauguucuuccauguuaauggauuuuuaaccaauuaaaaacuuggauauuuguauucguauuugugguguagaaaccauaccuaauuaauccucugaacacucacuggguuauguuguuugugcguuucucuucacauaaagaauugaaaggccuuggcaggaggauaaauuguuuauaacucaugaugauacagcuugguggcagagcuugugccuggcacucacgaggcccuggguucaauuucuccuacagaaaaaacacugcuuguauuugaaacgaaaagagucuguagucauuccuucgggaagauggauggaaaguacuguugccaguugguauguauguauguauguaugcauguaugugacacacagauuuuucuuuuccacaaggucggucuuagauagaaugguugcagucugucaaacgguuauuuguuuuuguuguuuuaauuuaaauuugauuuguauccuaaauaguguuaucaaagggauuuuuaagaauaauugucacacuguaugacugccaaggaccacuuuguuauuguuaaccuguuuggauuauaucacauggaagagggcucuguuucacaacauguucuuccacauuaaaauggauuuuuaacaaacuaaaaacuuggauauuuguauuugugguauagaaaucauacaaaucauguguauaaaauucuuaacaaauuaagaaccauauucuuccacauuaaaauggauuuuuaaacuaaaacuuggauacuuguauuuguauuugugguauagaaaucauacaaaucauguguauaaaauucuuaacaaauuaagaaccaucuuuaguuccugcaucauaccuaggaggagagaugguagguuaagggauuggacuagaguucccuagcuggcauaagagaugaggucacuacuccugaacagcuuaugaagccuucacauggauggugacaguuuucaauccacagacugacuaguaacaaugcccacccaggacucuuguguugggaucaguaccgacuacagucucuuccuccaccccaacaugauucuuccuuuucucuguugucuucugccaacucuguugugguuuugguugccuucauucugcccugcuucauaguuuuaacauaaugugucaaagagagauuaagugugaagugggagaagaugugaauaacuuaauccagccagguggacacguccaaggcugaggauguucaaaggaagaaaagcaucuauuaucuauaaauaucacaggacuuugaaaguuuaggaauacaaaggaaauaagcauucaaucauagacauaacuuuuguaaacacugccacauuucuauguuuucccugccauuuuccugaaauuggaaugaggccaaacaucacaucuuauagccaugcuuuucaccuacaauauucacuucuggucaggauuuuucuuuucagaugguguguauuaucuuugggucuuuggccaccucuguucagaucuuucucugcuggacacuucccuccccggccaucaucgcuuguagaaaugucuggcguuuuuaucaccaagcucaacuaucugcccauuaguuaacuaccuuuagaacuuccacaaccuucaugccuugccccacuuuucuuuuuuuaaagauuuauuuauuuauuauauguaaguacugucuucagacacaccagaagagggagucagaucucauuacggaugguugugagccaccaugugcuugcugggauuugaacucuggaccuucggaagagcagucgggugcucuuacccacugagccaucucaccagcccgccacuuuucuuuuuaucugagaaccgacucuagcuuuugauccagcuuuauccagauacuagaaaagauguaguuaaaaagacgaucucuaaccaacuucauggucagcagcacugaggacucgguagaaacccauuccuguuggccccaucucagaccugaagauuuugaaaguaaaauccaaccaccuacauggucaaaaccuuucaguaauucuaacccagugguggcucaaaaaucacuuugugaaacccaugugugguagcauccaccaauuauuuuugcccuugagagguugaggcacagggaucuugagcugggaggcagcccggccuacacagaaagaagcgcuuguguaauuccuguccccuccccucacauuccaagugcuuucucaaccgguuggucuacucccagaaaauggcgcgcuccucggcauucacuaaccccaaccuuacucgugauagaaccuggggccaugccuacguuaaacaagcaagcauucuaccucuggacuacauucacauguuuuuauauuugcuuuugaaacagggucucauuauguccacgugggucuguaguucaggcccggaauuuacaauccugccucggccucuccagaggcugagauuauaggacuaggccauaacagucagacaaacacacuuucugaaccccggaacuugagggugaaaaaugaaggccugaccaggcggggauugggucggaggccccugcaaguuacuaggucagagaugaaggaggucuggcguggaaucggucauaguugggaggccgcaggcaaaccagccuagauaaaggcguggccagcugcuccgacaagaucaguuccucccuccuggucccuggaagagacagugggaggccccacaugcagagggauccugggucauggcuagggugcacacagggaaaagcagagaagagcagggcccaaucagagagaccuccagguagugggccccuccucccacagaccaggauuccaaggggccugcugggguccauuuuaguagucaccccuaagagcucucuuaggccguuaccagagagcuccacuuucuccuuuucuuccacauuauacuucaaugguaugagccuacuuccuuagcaaaugagaaaaacaauacagauuuucuuucuccugaagaagaacuaacuaggaguuaggagauaaaagcuuugaggauagcuagguccaccacuuacuugaauguuugugaagcgaaggaucccaagucuugguaugacggccacacaauucacucacuuuuuucuggggugguguguguguguguguguguguguguguguguguguguguguguuuaagagagaggcgggaggugaagggggaggggaaagugagggagagagagagggaggaggaagagggagggaggggggagggaggggggaggggagggggagcgagggaggggggaggggagggggagcgagggaggggggagcgagggaggggggcaggggagcuccaucacgcacgugcuugccuuccugagccaucuugagggaagacgcccagaacuuccagaauucaaauucuuucccguguuugaaagauacugacuucuaagcuaaggacaagugagauggauaaaccaggcucuuuacaggccuccauucuucugcagaaagguccccacaugacuccaaccuagaccucuagacauccaagauacacagaaaauacacaggacgggagaggaaggguauuggaucaagagcugggcuucagguccuagguucgaaguuaccgcagagauuaacagguugugggaagcggaggaaugaaauaauuugaaagaauuaagaauccagggcuagauucagcagaaugagccgcuaagcguuauggcuuuccugacggagucuuuugggguaguuccaagauggcugaaucuggaguggaagcagagcuagagaagcaugggacagggguguagcccacuugguagggugcuugccuaacaggccccaaagccaucgcauggcgcagaccagucccgcagaccagucccguaaacucacgccugcaaucccagugcucagggccaccgaagcuccaauccaucccaacgucaaugcuuuuucccuccagcuuggacuaccaaagaucuggucucaaaauggugggcgccaagggaaaggaaggcaaaaaaagggcgggaaggaaagcccagaccagggcggaccggcuugagauuuacgcucacugguuccaggauauuauccccccuaccucaacuaauccuggaagccucugcccuucccucaccagugucccccuucuccccgagaccuaucuccaagguggaccaccuaccucagcacuuugaguagagccccgaguuuccucagagguagcaggcgagcggacaaggaugucuucugccuucuagaacccaaagag

SEQ ID NO: 12306 - RNA, 81166 nt, Mus musculus
agcccgcugcagaucccguaagacgggagucugcggagucgcuucaguccccgccgccgccacauucaacaggcagcagcgccgcugucgcgcggccgcggagagcuagagcggcccgcagcguccgcccgucugccuuggcguccgcggcccuugucagcgggagcgcggugcccgagcugccgggcuccgcggccuggucggugccccguccuaggcacgaacucggaggcuccuuagacaccggugacccagcgaaguuaaguucugggcgcguccguccgcugcgccccgccgcgccugacuccggcgugcguccgccguccgcggccccccaaucucggagcgacacucgggucgcccgcuccgcgcccccgguggccgcgucucccgguacuucucugcuggugggggaggggcgggggcaccauggccgaagcgccccaggugguggagaccgacccggacuucgagccgcugccccggcagcgcuccuguaccuggccgcugcccaggccggaguuuaaccaguccaacucgaccaccuccaguccggcgccgucgggcggcgcggccgccaaccccgacgccgcggcgagccuggccucggcguccgcugucagcaccgacuuuaugagcaaccugagccugcuggaggagagugaggacuucgcgcgggcgccaggcugcguggccguggcggcggcggcugcggccagcaggggccugugcggggacuuccagggccccgaggcgggcugcgugcacccagcgccgccacagcccccaccgaccgggccgcugucgcagcccccacccgugccucccuccgcugccgccgccgcggggccacucgcgggacagccgcgcaagaccagcucgucgcgccgcaacgcguggggcaaccugucguacgccgaccucaucaccaaggccaucgagagcucagccgagaagaggcucacccugucgcagaucuacgaguggauggugaagagcgugcccuacuucaaggauaagggcgacagcaacagcucggcgggcuggaaggugaacggccucugggcggcccuggggggugggguggggauguguuggggccggcggagggucggcaguguggguguucggggcccggaaaugaugggcgcacggagagagcggggcgagaaauggcagguguggcgggggcuucccggagacccagagccaaauuuggaccaggugcaggcgagggacuucuagagagacccgggcagggcucguuugggaacuuaagugaaauggcagagcaggcgugaaaguuagcuuaguuguuggagcgagggguucgcuuccaaggucccucuccauuugacacuccagaccuccugcgagggggucgggcgacuccuccacccacacgcgcacccacucucccgacccucggccgccaagguuuccccgggacccgaccgcggaggugcggggcgcacuggagacaucccccacccccacgcgcgcgcacgcaggcgcggggcucccgcagcuuuugggauagccaaacgcgcagcuggcugagccgugugcgggccagcgguugcagaaaguugcggaggccggggcaaauuugguuuuaaccaaaguggccugggcacugagcagguggucgagcguucccacucacuggguacgguuucggacgcgcgcaaguggguggccaaggcuuuuaggcucugggcaaucuaaaguucaagugugacccuuggccggggcgggagcaggcgaggagggagggaccggguguacaggaagcuagaaccuuuaaagggccagugccuccaggcugggaggccacacuuuuugcacucagagaaaggcuuccacaguugggcuggcuuggggagguaugcauuuaauugaaagccgagaggcugcugugugugaccagauuaugcgugaguguuggggagugauuuaccguaaagcaugcagcuacccacgaccgggcaagucugggagcccugaagugaguauuugguggaagucuuaagugcucacuuggggaauuacggaagaccuuuuugccucgaaggaggauuggagacuuauaaauuagguguuuaaggccuuuguuuaccuuuccggugggagggagaggacaggugacucaguguggacuguggcaucccuaccaguggagguuggggugguauaagggcuggggccuuuggggaggagagaaucuuaccuagaagucccucucgagguguggccaccuguggcugacaguuucucagaaucacaggugggacauaugucuuaagaauauccaguuuuuucccccuccuggccuuggcugugcagcagagcagagauuagccuucacggcaugauuguaauagcaaggugguuucacauacucugucaucccugugguuaaagucucuaaaaggucaacuuacucaccucagacgaaaguucuugcagaaagagccagaggggugguuuuauuuuucccacagugaguuuuaaagauacauacaagaccuuacccuuacgugcaauauuaccaaguguuccaaaaugcaaaauaccuauuuuucaaauucuaauucacaagauagugauugacuuuaaaauccaauuuuacuuaacagugacuuuuaaguacuccagugcuuuacuugaucgugggagcuucaacuguuacauaaagcauuugcuauugaaaacaaaacaacaaaacagaaaaccucuuaaacguuuugggcacccaaagcacaguguguaguuaacccauucuuuccuguucucaguuuauagccgugccuugcuuuaagaauaaggugauguuugcgggaguuuuugguuuugccuuucaggcggcauugugaagaugcucuugagaacuauaacuugauuuuuaaaauuaguucuuagaaaaauagguuaugucacaauaucuuuuuaguuauuuuacuccauucuucugauuucuuaauaaugugaguuuaaugauuuauguauuaaauuguuuuucuccuuggcaccaagaaccuagaagcucaggcuuuggagaagugaagacccagccagccauugccugaacagcaagugagcuuuggacuagggagcaggucacuguguuuucagaggaguagauagaugcuugacaguaaagucugucggcguaagcugaaccacggcaaguguguuuucaguuugaguaaagggguauuuuaagaagaaaccugaacgguuguaacucauaacuaggcuucugguuaacguuucauaagaaugaguucugagacuuguuaaagcuaaguuucacucucaggucugagaauucauaaaggaagaaacuguaucaugacuuacacuugaaauccuacagugcaaagcaaccagagcuugacuguuugaguauuaaggagugacagcuuugggguaggcuuuauuuccuguaaucagcuauugagaauuauuaauuaacugugcuucaugguggucuucuuaagggcuugccugagaauuugaaggacauaguaacugggaagcuguuaguguccaaaauuuauuuuuagaaagugggauguaguucaaugguaggaugguuuccuaacaugcaggguucacucccugacacuguauaaucaacagggcguugugguccaugccaucaguuguagcauagauagauauacagggaaaugacuuguauacuuguauacuuguauacacagguuaaacauuauggagaauuauuauaaaacguuggaauuggaggcuggaggauuguaaguuaaacggcaucccaaagaugucuguccugggcuacuucgggcuacaugagcucuugagacaaaaacaagagcaaacaaaagacaagaaaaugaaagaaaaaaacaaaaccuuucaauguuuaaagaaguguugucuuuuucuuguuuuuggacaugguaucuaaguaacauuuaucuuaaauugauagugcgagcacacauuugucaacugguaugcaugcauauguguugggggucuagcgggucucauucuuaguuucugggucucuuacugugacagauuuggucagacucgguuugagaugaacuccggggaucugcccccuguaaugcauacaggcuugugugucggugccugaaaccagaacucaggcucucaagcaucugaggcaaaugcuuccugacugagccgucacucuggucuccuaauuuuaguuugauuuuggcuacaauggucauaaguaagacauaaagcgguacuuaacacuggaaaacccaggcucuuuuaaacagcccaguguuuguaaacaaugaaaccucauuuccaugaccggugccaccuuccgacaccccccccccccccacacacacacacacagaaaacuuucugaagcuugggaaguagcacuuuuuucuuuuuucuuuuuucuuuuuuuaaguagugguuuugaguugacucuuguuuauuguuuugauagacuaccuaaaagaauguuuuagggcuaguaguugguagugugcuugccuagcuagcaugcaggauguccuggguuuuauuccucugugccaagugaaugcuggugauccuagccugugggaagucgaggcaggaggguaagacguuuaaggucacucuuggccauacaugcccugggcuacuugagacuuugcuucagcaacaacaaaauuauuuauuuaaaacggucagauacuuguucauuuggggagaaauuucuuuuuuaaucaaucaaaugauagugcuaguauauuuucuuuaucuuuaaauuugucuuuagucuucaauucagugcuuuaaguauagccacagaaaucugauugggaggauggcuacuauauuguacacacagaccauugaauuaagagaccccuucugagguggguuggaggacuuuaugguaucuuuccuacuucuaguuuauuauuuuuaaaaugguuaccuuacuguaagugugccaccuguguguaugcagccauggaguccagaagagguguuggguccccuggaacuagaguuauaaaugauugugagccaugauguagguacugcuaagccaaccuugguccucuacaagagcaguaagugcuuguaaccucugagccaccucuccagcccauuucuagugucuguugcuuuuucucuuccuggucacaaauugccuuaaaaccauuuuacuagucagucagaacccucagaacggcaauauacuaacuacauagggacagggagaugaagaaaggaugagcuagcugaggguguguaucuuacuuguuaaauaauaaaccauuucagaaauuggagucauguacuuaaccccacuaacaggaacaccauagauagcaagcucacccuaccacccccaacugaaaagagacaccaaaucuggaacguauaagaauguuauuuucuucaccuaugaacuuuuucucagcgggaaggaccauccauguuuauuguuuuuuaguugcacuuuguauauguagguuuugauaaaucaaaucuaccucucauucccucccuauuuccccaguacuuccucugcccccuucaugugcuguggugguaaaggcacuuugucuacucaaugcugucuguaugugccuggguguaggacuguccacuccagcauugguagcgccuuaagaccucucauccuugaagaaaacugauucuccuuccccuugcaggaaggcugucaguacccucucagcuaagagugggacuugaugagccccucccacaaccaugaugggguuucagcugaccuuguguuggucuuacgcaugcagucauagccacuaugaguucauguguacagugguucugucaugcccagcaaauagccauuuugcuguagcuggcuacugccuguccccucuucugagaagagaagcuauuguggugaguguugagagaugagcgaaucuacgguuauuaagauaacuuagaggacaguucauuaguauguucguuuagcaugguaauaccagagucuuuccuagaggcuacguagccuaggcggccacgggguuggcccacuaaguaguaccaggcaggaguuccauuuugagaagcaggcuuuaaauccaguuagaaagugauuagcugccccaguacuauucaugcuacugcuugccaggcuggucauugcuuuagcuuucaggauucacagcuagguauggauguauaagaccuuucucuccuaauggugugugugcauagaaccuuccagcacugaagcuagccaguaggaaugaagugucugguuugauuucuucauauccugugaccuagauauguaguggcuuuagcaauagagucuuacugucaaguucuggaugguaguuaaaagcaauggcaagagcuguagucucauuguuguagggaaaggggcauuaauggaacccugcugacaacaauuugaugugagguaguugguaccuggcaacuuauuugauagccuaguuaucuaggaaaggcauugugccacccucugcuguuuuaggauaguaucauuuaaaugucuuuuauauguguauaugugugcuuguaggaggcaucugcaguaguagguuucuguacagacuuuucaaaugucuccuguguucccauccuucccuguguccccccccucuacccugcccuccucccaccaccgcguuuauccuuccuguuacuucccugucagccuucauacaccugagcuccauccauucccuucucugagcgcuaaauccucuguggccccuugcuaauuuucugauuucuguaauuuccaauuuaauacacacacgcaucuagagauucacagccagccaucacaugugagagaacauccuguuugucucucugugccuguugccucauucagaacgauuacuuccagguccauccaucuagcugugaguuuuguaauuuaauuuuucuuuauagcugaauguuuuuccacuguguauuugcauuguucgucagggauggauauuaaggccguugcauuucccaggcauuguggauuagccgcagugaacguggauggacagaugucucuagugggauagagacugcuugagaauaaggccagaccugggauagcaagaugacaugguagaucuguuugaggaaaccacacuuagcuguaguggaugucccaguuugcaguuuuucuuuuuguuaugacagugucucaguacguaucccaggcuggccuggaauugacuauauagaccagguugguuucuaacucaaaacuacaccugcuucugccucccaaguaccaggauuaaagcuguauacccuaccacccaacuguaauuugcauucuugucaauaugcauaauaaaauuuauauguauauguuuuuauuauggucauuccgauuggaguaagaugaaaucucagaguaguuuuaauuugcauuuccugauugcuaaggaugucacacauuuaaaaacuauuucucagccaucuguauucuuuugagaacucuguguaguuucaugcuccaauuuuuacuuguucuugguuuuuuuuuuuuuuuuguguguguguguauguuuagggcuuuucuugggggggggguuguugauuuauauuuuauuuuuugaguucuuuguauauucuaaacacuaaccuuaugucagucuaguaguuguuaaaaauguuuucccauuuccucuucuggauuguuggugcccuuugccgaacagaauguuuuuaguucaugaaggguuuuuuuuuuuuuuuuuuuuuuuuuuuaauuaauuguugaucuuaaugccuauaauccuuuccgggccuauaaguugaaacaguccuacuucuccuaccagguucagggaaucuggucuaauuuagagguccuugaucauuggggauugaguuuuguuccggcuaagggucugguuuuucuucuacauuagcuagccaguuuaaccagcaccauuuguugaaguugcugucuuuucuccaauguguaauuuugaacuucuugucuaaaaucauuuggcugugggaacguuguguuguacugaugagucugucugucugucugucugucugucugucuuugugugagcaccaugcuguuuauuacuauagcucuauauuauaacuuggaaucagagauggugaaaccuucuauguuuuuuauuauugaggauuguuuuugcuaucuuggguucuuuguguuucuuuacgaguuuugagauuauuauuucucaucuuuuuguuggguuaauuugaaauuuugaugggaauuauauuaaucaguagauugcuuugggcacaguagccauuuucacauuacuuuuccuaaucugugacuaugggagucuguucuguuaugggucucauugcuauggcucuguuuaaauuauuuaccuuaucuuggauuaacuuugauccuaugcagcuagagauucauccauuuccuuauaaagugucccuuuucaucuuuaauuguauuaauuugggucuuuuagaauuucgacuaguugggcuaaggauuuguuaaucuucauuugauucuuccuauugauuuuuaauuucuaucauugaucucagccugauugaucuucuggcauaucaauaucaaugacuccacuucaguuccuuucuccagguuuuugucugcagucccugccuugucuucccucgguuggcuucauguguugguuucugucagucuuuuaucagugauaaaagagaacuaagguagguuuguguuugccuacacuggcaggagaguaagcugaucguggggagaaauggcugcagggaaaacaguguuaggaaaaaguguugcaggagugagcagauauugauaucauaucaacuaucuuggcaucucuuguuguuuuaugaaggcauuuuuaguucuaucaucguuguaugucauagauucuguuaugauguauuuagauuuucauucaguucuuggaaucucagagguuuuccuugacccaguugucauuuaguuuuccuaagcuuggaugguuucugcaguugcuuuugcuguugauuccagugaagucugauagacugacuacaguauguuauuuuuagcuuuuccuauguuuaagaguuccuuaauguacugauaggugauugauuuuggagggaguuccguggcugcagaggaauacauauuccuguugguuacaucucugcugcugggaaagugcacggagagagggaguuaaggaagaaacggguucgugcuguuaggguuuuugccagcaugguacaaaauaaggucaccuggaaacacugaaccucaagaaaaugccuccaucaugcuagcugugagccacucaguggggcauuuucuuauguagugauuaaugugguggguccugcccacuguaggugcagccacacucggccaggugggugguccugguguugaaagcaagcugagcaaaccaguaagcaacauccauccauugacuccacuucaguuccuuucuccagguuuuugucugcagucccugccuugucuucccucgguuggcuucauguguugguuucugucagucuuuuaucagugauaaaagagaacuaagguagguuuguguuugccuacacuggcaggagaguaagcugaucguggggagaaauggcugcagggaaaacaguguuaggaaaaaguguugcaggagugagcaggaagauggcggacauuucaucugcaaacaggaagagagaaaacagaagguggcgggaguaaggcuauaaaccuucaaagcacaugccugcucauguccuuccuccagaaagacuccuaucuccuuccgguuccauuaccuccacaaaccaccagcuggggaacuguugugaagagaccccaugaccaaggagggagagacagacagacagacagacagacaggcaggcagaggcuuugaaaccucaaagcccaccuccguugacccaguucuuccaauaaggccacaccuguucuggcaaaaggauauguauacucuuuaauccuucuaaacuuuccaaacaguuguacuuccuggugaaauauauguguuuaggggccauuuuccuuaacucaccacaggggccaaguguuuaaauucagagacaugucuuacucagaaaccacaauuacucauuaguguuuggguggaguggucuguaaaugccaugugauguuauguaacuuauugucucuguuuaguuuuugucuaaaugaccucuuuguuuguuuguuuguuuguuugcugagauuauuuuauuuacguguauggguauuuugccugcaugcacugauaaauacaccauguacaugugucugccuuggguccccuggaacuggaguuacaggcaguuguaagcugcugugugggugcgggaauugaacccagguuaucuagaggugcagccugugcucuuagccacugagccauuucuccagcccacugggugaccuuuuuauuggcgugaguaggauagugaagucaacaguuagcauguuuuaggucaaguuuuaggucuuuuguggagugugcaggaauuaguccacacauggcuagaauuguaguaucgucuugguaauuguuucuuccaugacuaugaagggaucauccuucucccugcuuacugacuaguucuuauuggaaaucuguuuugucagguauuaaaguaguuaacaccuccuuauuuuuuaguucucuuugcuuggaaugccccuuuucauccuuugaauuuaaguugguauugagguguguuucuuggagacagcaaaaaaguauucuaauccaaucuuacagucuauaucuuuuguuggagaauugggacaauuaauaugaagaguugucauugagagauguguguuaaucccugucauuuugauggucuuguguuuucucagaccuccugacuaaguaagugucuuggcauuguuuguuccuugugaguucuuggauguauucguucucuucagaccuaaguacccucuguggagcuggcuuuaguguuuacagauuccuucagcccacuuuuagcauggaaauuuucaauuuuucuuccauuuuaaaagauaguuuugcugaguguaacacucuaggcugacgguuaggaucuucuucagaacuuagaagacaucguuccaggcucuucuggcuuuaaguuucugucauagaaccagguguuacccugauggaccaguagucgugugacuuaaccugucucugcugcagcuuguacuaccuguucuucaaucugugccuuccguguguuaaaggaugucugggaguuucuuuucacaauggugcuguccauugguguucucuaccagaacgggcaucucgcuagaguugggaaaguuucuccuaugauuuuauuggaacuauuuucuccgccuguaaugugaagguuaggcacuuuugugguaucccaaagccuucccauguucucuccauaucuuacaaauuguuugcacauuucucauugacuuacugagugagccaauugcuucacuuccuuuccuaguucaggacucuguuuuccacaccauccauuugauugaggcucuuuccacucacagguuuauuuggcuuccugguuuguuuugguuucagcauaaauucagugugggccuucuggucuaacugugcuuucccguccuucucacuccucugucccagguugucuuggacuacacacaucuucuuugaguuguuugaacauaguuagaaucauuucuuaaauucuucugcaguucuuccacgugguucuucauuguaagccauuacuaaggacucauacauuuuggagaagauauguuaaagauuauugguuuuguuguuugcuuuuuuuuuuuuuuuuuuuuugguuuuggcuuugguucuguuuuuuugagacaggguuucucuguguagccccggguguucuguacuacaggguggucuugaucugaagaaaucugccugcuucugccuccugagugcugggauuaaacaacugugccugacaaauguuuguucuuuuaaaaaaugagacauuucuucuuucuccucuuacuccuccucucuucccuucuucccccuauuucuuccuauuuuauuuuauuuuauuuuuuauuccuuuagauugggucuauguaggccacgcuguccucaaagucaguauguagcugagcguggccucaaacccccgacuuucugacaucagccuccacaggcugagucugauagcugugcugccugccguaccugugugaagaagagacauucugaguugaaguuugcaaccacaaaauaaguuuguggcaguuauguggaauuuacaauucugcauggauuaauaaaaugccuuauaauuuaaaugugagcuguaauugcacuagugauaaguuagcuggcuuugauaccuuucuuauuauuguguauuauuuuauccacuagccugauuguaggaaugagauguuucaguugauacugaagcuguuagaugugguuaggcaaaccucagagcagugccaaaugacccagaaugaugccaguugacuauaguaaaugugcucagaauaccagaguaagucugacuaguuugugauuaaccaauuaguuugcuuauacugggcaagcacuuuaccauugcuauaucccaguccuugaauuuucuuuucuuuucuuuucuuuuuuuuuuuaaaacggucucaaguuuguggccaaagcugacauugaacuuaagaccuccuucagccucccugaugaugccuggagucacauauagcagugugccaucaggucuguccacaguaaaacuuuauuguggcaucacaaaaggcauauauacagauuauuaaaacaaagcagccauuuuagacacaaugaagauacuuuaguaguguguuuauagcaguacugggagauaguauuuuguuugaaagauacccugcugggaaugggagacaguuaaacacacuaaacucaccacugggacguuuuauguguauauuaccuucuacauagagaaaagagcuuucuucgagagacgguuucucuguguagcccuggcuguccuggaacucacuuuuguagaccaggcuggccucgaacucagaaauccgccugccucugcaucccaagugcuggaauuaaaggugugcgccaccacugcccggcugagaaaguagcuuuuagaacacauuaguucaccgcacuugcauggugguuuauuacaccaggccaaugggguggggggaccugcugauuuaaaauuuugaaucaguauuuguuuuuauuuccagugcaguucuggauuucauccuguucccguaccccacccauuccuucacucuaaguagagagcucccucagguaucuuugaccuuuaaguugugucuccuugauugugaucugcaaugggaaaaaguauaggcuauuaccugccucagggaggggagguggaagucccuuguagagcuagggggaggaggacauuuucuaccgagaucccugcacgccugccauuuuuaggugaguucuuuaauugcugggauaaagacacaccuaccuuuguagagagugguaccgcugguguccugucuacaacagaauucucaugagaagugcucauaugugcaggaagcccaacuuggccacccauggaaacuuugagauugccccuuuucucauagugauuuaguuucaacugcuuuagaucucuggggaucaagacucucugcccugaugagauauuugucuuaauuacagugugucauucugugcggcguaagaccugagucuaaugacaugugcaggaccuuaacagcacaacucaucuaagugaagcuguggggaggagagggaaggggagggaagggaggggucugcuuccaggugucugucuccugggaauaaagagaguucuugaccaccagguuuucccagguacuauuccucacaaagcuggaaaacagcggguacugguuuugugaauuacuaccugcaucagaccagaaacuugaaauauucaguuggaggaaaaaaaaaccuguuauuucuguuuccaaccauguuucuuguuuggcuuugugagguaccgucguuauugaguaucccaguuaacacagaaacaauuaagugagccugacaucuggucucucauacaacaggcucccuguuguaacuguuguagaaaagacuuccuugaagucaaauuccagucuugagcuggggaggagccuaaggagagaagauaaggagggagacagggaaagggaaacugguuuaaauuaugugggaaaauaaagacuaucuuuucaguggccccacauuccaaggaguuagcugaggccuggagauaguuuuuccucuuuauuagcuucucuccccccacccccccuugauuguuuuaagauuuauaaguacacuguagcugccuucagacacaccagaagagggcaucagaucccaauacagaugguugugagccaccaugugguugcugggaauugaacuuaggaccucuggaagagcucucaaccacugagccaucucuccggccacuuccuuccuuuuuauaucuguuuuuuguuuaaauacuuuguguguaguauuuuacacauacuacucagugccuucagaggccagagagggcauggguccccggggacuagaguuacagaugguucuaagcuaccgugugugcugggaauugaacucagguugucugcaggagcagcuggugcucuuagcuacugagccaucucucuucucuguuuucccuuuuuaaaucuggaaaacuguugucuuuccccucagugcuuuccacuagacgucugccaugcacguggacaaggggaaaagccuugccugagugagaaaucuaaacacacguaaagggucuuugcaagguggcaaaagcaggacuuagaagacacugcauucugcauccgaggagcacugcauugagaucucuaauucgggaaagaaauuauagaaacacucaauuuccaacguuacaaauauuguguccuugaaagcuuuugaaaacaaacaaaagugucagauacuugagacaguuugguggcuuggugucaagaucaaaggauaugguuuaacuagaggucuuaguuuuuggcagauucuugaguuaguaaugaucaaaauuuggauuuuacuaucccaugacccaaguauaggguugcauggagaaguguguguucacugcagagaaggguguguguucagacuccgaggcuuuuaccagauguagcuuuuuggcucuugcaacaggcuguggcagaagugagagugcagugccggccgggcuucaguccuccuuacugugcacuuaucacaaaagcccaacaacuucaagacaaguuacaacacuuacuccugcguguauuucuacaaggcucauuccugggacugaaggcaaacaugccaaggagagaugcuggcagaacucgcagcugucuacugaggugguuuguggacuggguugguugcuagcugccuguaucucuaaauuuaauagaaaauauuacucucgggcuggagagauggcucagugguuaagagcacuggcugcucucccaaaaguccugaguucaaaucucagcaaccacauggugacucacaaccguccguaaugagaucugacgcccucuucuagugugucugaagacagcuacaguguaguuacaaauaacaauaaauaaaucuuuuuuuuuuuuuuuuaaagaaaagcugggaggugguggcacaugccuuuaaucccagcacuggggaggcagaggcaggaggauuucugaguucgaggccagccuggucuacagagugaguuccaggacagccagagcuacacagagaaacccugucucgaaaaaaccuaauaauaauaauaaaauaaaauaaaauaaaaagaaaauauuacucucugaauagguaaauaaaaaaaucaacauauaaaaucuacaugcaaugaauaaaaaaagccccaugucccaucuuacagccccucccccauaauucaugauugaguagacggacaguuacgguauuugcauacaucaaaugugaaaaaucuuguacuucucauucauuccuuuucugucuuucccagucucccucccccucccucccccucuguguguguguguguguguguguguguguguguguguagcagucagggcaguguggccuuuucauuuguuuuguucuugacagcagugcucauagcuucuguaggucucucccucagugauccaggaugcagucuugagcugcuuucuguuuugucucccauuuugagacagggccucucugcaguucugguaggccugcugcuugcuguuuauuauauagcccagacuagcugggauuacagacuuggagcaccacuccuggcugucccugguaacugagugcacaugaagguaccucuacuuuccuuugucaugucaagaauaaaugucaaguaaguuguguugagcuuacucguuuguggcuuguugaggugauuucaggacucagcuaguaaaaaugaucucaguaggaauggagcucguuagucagaggguacucuggaggcucugcguugcuucccgaggguucugcuuggugacuguaugcuuagggagcucugagaaaaagcuuacuuugguagggaacagacauccuuaccuuugcuguggccucaagcaagcugcaguuaccugucugugaaagguucuucgagcacaucauauuaaaaagcccacaguacccaagcagacugccuaguuaaaugauagcaagcaaaugaacuugaguaauccuaggacagcauacugaaauaggcugcaaaaauauaauuaaucuuucaggucuucuuaagcuuaaagcuuuuggauuuacaguuucacacccauuuauaaauacauugguagaguuuugaccaaauacagggcacaguauuugguaugcugccugggggucuaacguucuucaauuuaagugggauucccuuuguuugucuccuguuuuagcaagggggaaauauauacuuugguuuuucaaccagagguggaaaaagacagggaugcgggcauaaauguggauuguauaaggaagguauuaaugacauuacugggugugguaaauuagcauacauuacagaaguuugagacaagaaaaguauuuggaaggcagcuaugcucaccacucuaccaccaacgcagcacaaggaaaguauuugguuaagugaagaauuuaaaaauuccguaauuauguuuggucauauuuucuuugauuuggaaugcuaucuuuaacugguuagacuuuuaaaguucuugaauugcuuugcaguccugcaucuacacacauacgcacauauggugguauggacugacacuagucuuuuggcugguaguuguaccagaccuuugccuacugucagaggggaaagagccgagcaagggcuauuuugcugcuacaccucagaacuacgucugcuuccuaaauuaaucagaagcaccagaaauaauuacucuuuuaaaauuuucuuaaaauucaaauauccagaaguggaggcaaguugguaagcuagaguucuaaaauuacugucuuuuuuuuuuuaagucaaagccgacuuuugcuuggagcagaaggugugguucuugugcauccagucuacagugggcaucccugggcugcuuuuugcugauucuccauuucucaucucagacugaugcuccaggucacaccuggugaccacaagggucggacaagcucauccguuuuguuuuuagcugccugcuugguguggaaugccugucuguagccagccucugggcuucuucgggaaguagcaucuggguggauuuguagucagugcaguuuucccccacuuugcuggcucugugguuuuaaauuuucccauugcagguugcuaaugugaguuuaugcucuaacaccacugccgucuaucauuaauacaaguaaagauucacuuugacagacugacugggcauucuugugggugccacuuguuccugguuccuaggguuugggugccaggacuuuuaaacuuacucagcuuuguaauacaaaguacaaugucauggagucaauuuuaacagaauguuuuguuuuguuugagauaggauuucucuguguagccauggcuguccuauaacuugcucuguacaccaggcuggccucaaacucucagagguccgccugccucugccuccugauuuuuuuuuucuuuucuuaaagacauguucucguguagaucaugguaguggagcaugaccaugagccccugccuccaccuugaaagggcuaggauaacaagcaugguccacugugaugacuggaauagauuuucacuuuaucaguagggucucauuggcugucuugggaaucugggggacccuccagcaccagccuacuuauuuauuacugaugugagccaucauacuuggcuugagcaggauuuauuuuauuguauuuuuuuaugaauuaguuguauuuuuuaugugcaugccuacuuugccugugcacuaugugugucucgugccacagaggccagaagacauuggguccccugaaauuguuguagacuguuguuaaccccauuagagguccugagaaccuggguccccuguaaggaacaagagcuguaaaccgcugggccaccucuccgacuccuuguuguuuuuaugugugguccuuuucauucauuuuugaauagauuuuuaaucauuugaugcaguauaucuuuugcuugguugaccacuuggagaauuuugaaaauaaccuaacuacacuguauuaacaagaaaagcaaugaaaacaaacaccaugggagacauuuucuucagugguguagggacugguacgaugccugcaugcuaguaagugagaccccacucuguugaugaaaggaagagaggguuagcugaaggaaggaggguuuguguagguaauagguauaugaaugugaucaagauauauaaauaugcagaugaaauuguucaaaauaccagccaagccaaaaaaaaaaaaaagugucuuaauccauuggcuuguuucucuguggguugccccuuccacacagccugcuuuggaauaggaagcgacauugaguuugcuuggcugguuccguuaaguucagugagacagccuggacuuucugcucucggcugacuaguuuggagucccacacauuucuuugagaacacuugaauauuguuguccaaauguaggaccccaaacagauuuuuuuuauuauucaaagugaaauacagagaacacuuugagauggauuguguugucugccuucacauuuugaaguuuauaguuuuaaccucuacacuauaaaauuaugaggccauggacuugggaaauuucuuacguuagcaaaagaaggcacacugugcagggaguuuguuuucugugcuugaccgucacgggagauaguacugccuuuguuuggggugggugaacaaguccacagauaauuuauaugacgagaagacaaagguuugccugaagcuugccuggcuguauguacgggaucugcagugccuagaggucucugucccuguaaaccgcucaggacucccccugagcugcauggucuguguaaccuggugugucaggcaggacaagugcacaucuuucuucuuacccacccacccucugcuguauuuguguucuuaaacuuagaacucuccugccucugucucuugagugcuggaucacagcauguaccacccuacuugagccauccagagcuuuguugccugagguuuccucuacuuccauguggauccugcuuucucgcucacucugccuuuugucagccugugguucacucugaggcccuuuguucuuucuguuugaggcagcagucuucacuccaccugggagcuuugauggcuggggugugcauuucagauuccugccuucugccuuuuccugcauauaauuuugagcaaugauaauuggcuagccagugucagcaucuccaaagcaugcuuggagguguuuggaccaaaggugcugggguguuccaaaaccuauguuagggucacuacagaacuaccagaauccacucuagcauuugcuuuuuguaauacucucaauuucccucagagcuguaauuuuguguaaauauuagaagucuuggucucuguuucuggauuuauguuuugacagucaguuagcagcagcagcaguagcagcaggaacauccuaaucuguaaaguggguuaauacugagaaauauuguaggacaaguugagauauuccaagaggcuguguggauguaucaugcguuuuagcauuagccaaaauuuuggggcauagaguucaaaggaacuaagagucuacuggcuuccugauuuugugcaacauuuucagauauaaacaaaucagaaccaaaagaauaaccaagaccacacagauuaaccuucucaauucuguacaaguagcguaaggguacuguugcaccccugaggguuuuguuguugcuauuuguugguuggguuuuuauacagggucuuagugugugggccagccugguuuggaacucagcucuguaguccagguuguucuugaccucacagguauaacugccucugucuccugaggaguugcuuguucacuacaccuguuucuuggauuuuauguuuuacaggaauuuuuguuggguugaggaauaucugaaaguauaaaaaaaggaagauuauuuaugccuguauaguccugccuuccugaggcugaggcaggaauaucacuugaacacaggaguuugagaccaaccugggcagugugcugagaucuaaucucaaccaguggguggaguuaggggcuagagauguauguaguucaguaguggagagcuugccuaccaugggaaggcccuagguucaaucugcagccuaguaagcgagcaagacagaccauguaaacuguagugguaugcaguacugugaccacuugguugcuguaucagaaagacaaauuaucuuuggaauuuuagagaaaaggcuagaacuuaauguuaaaagaaagaucauaauaaaguauagauaaucagugaacacccagacuagcuguccucuguaccccagacuggccuuggguuuugauuauuguccugucuuagccuucccaguagcagugauuccaggccugggcauuacaguuggacccgauaauagaaauucguuggauucuccagcuaaauaacuagaguuuguuguugguuuuuuguuuguuuguuuuuugcuuacuuuguuuuccuuauuggugcuaaagauugaguacaggacuugaugcuugguguguagauacuguggcccugagcuauauuccaaaccauuaacuagaugccaaaagaugaaaaagugcuuugauauaauaagcucuggauugcugacuuuucuuugaggagaaauacucaucuguggugaugguaauaaagucaugguucaaggacacucaugguuucuauaccaccagauggauacugcucaaauguagggcaagaguaauucccucacugaugggcuuauuccuucugaugcuguaggauuggcagaugguaacaaacauuagcccauagagaugagagagagagcguuguucuuggaaugaacuuaacuuugggaagaccaucccuucuaagggauaagggcagaauacagcugacauccaugucuagcguucuacagguauuggcuuuccuugccauuugaguacugauuucuucuuuauccaucgguccugucuccuuuugcauggauaggaagucagggucaagauauucuaagugacuugcgcuugggcugguccugggugggguugggagguuccagagucaccuuguauuagaauaagguguggucuauauacugggugggagucucccuagauuaaaaaguuuauugguuuugcuuugaaagcuguguguguguuggggggguggggguucuggggcaagugacugcuuggugucacagucucaucuggauguguguaggacccugucucugagcccugcccaagcaccauuuuuccugacuagacuucuaaaauucaggacucaguaguucauucuuuugggucauccuacagaacauugcuuauaugaaguauccacuuuauguaccuuaccuguuuuugguuuuuuuuuuuuuuuuuuuuuuuuuuuucccugagacaggguuucucuguauaguccugacuguccuggagcucacuuuguauuccaggcuggccucgaacucagaaaucugccugccucugccucccaagugcugggauuaaaggugugcgccaccacagcccggcacgaaccuuacccuuuauguuuuguuuugugaagguuguugaguuguuuauuuguuuugagacagugauucuuuguguagcccuggcuguccuugaacucucagucuggacucaaacacacagagaugugccugccucugagugcuggaccuaaaggugugcgccaccaucuccucgcagguuguuuuguugagacagauuugccuuauauaacccuggcugaccuggaacuugccugguggacuuuccuuauauaaccaggcuggccuugaccucacagaaauccaccugcuucugccuccugagucugggguuaaaugugugugugcuucacugccuuuucuugagcuaaugauuaauagaaguacacaauuuguaccuuuggcauacacauuucuagauguuuauugaugugguuuuaauuguaaaguaguaggauuucuguuuauuuaagcucaagagcucuguuuacagaaguccugugaugguuagaaccuuaagcauugucacaaaaucuagccaaaauugauaagcuuaagcuugaaccaguuaacauucaacucuuggucucugucuaaaaugagaacacuugugggauugcagaaaguuaucacaugggcuucccacggaggauggaggcugcuguugcucuuguccuuauuauuuuaauuguagacuuuucaaauagaagggaaaaaugaaaaaacaaaaccucuuuaaguaugucuauguucucagucuacagaagaguaggugaguaguuuccaauuagguuuuguguuccucuaccuggugcaugagucuuugguuugucuuagcuucuugggaggauguuguuugguauuggcaucuagugacaugaacaaaagaugcuguugaauuccacagagccagccuccuacaauuaggaguuaucuaaacucugcuucagguaaaauaacucaauuuuuucugaaguaaagucuguucuuugggggcaggagagagaagagggagcuggcuuagcaggugaggggggcuugccaccaagcccaaauaugacuugagguuugacuccugcagguuuguucucuaaucucaucaccuaaaacuagaggaguaaguagaacccuagaucuuaaacuccagacagagccaugaaggguagacugccacagagggucagagagcugaagucucugccguccccacuuucugaaucuuccuuuguccagacuccugcuuuggauuuguuugcgcugccuaauuccuuuccuagcccucaagccccaaauaagagagaguagaauggaacuguuuaaaccaauuuauuacuuucuaaacuuuuuuuuuaauaucuucuuguuauauuuaccccuuucccacuuuuucaaaggucucucuuguuuaagguuuaaacuggcagauuuucucuaugcauaguguuuuagucugaauauuauauacuuccgucucucuggcuugggauuuggcauccuccugccucagcauuuuuaguacugagauuacaaccugagcaguuggaccugauuuuuaagaauuuucucaaaauccagaguaaaguggguagacagaaucuuuggucgguagacuacuggugguaaaauaggagcuguccccuauauguccuccgcccggggcuucuaaacugcucucucuuuguaauguccacugcacacguagacgucuuaguuuugauuuuuaacuacacauucaaaguucucccuguaaagcuguuacagucaguuugggguuuuguaagucacaacgaaugggucgucauagcacuuagcagcuguguuacucagacuccagcuacauugcuuuucucagugaaaagugggaacaaccagcggguuucaguuagaaucgaauaaagugcuaaauguguucuauaguguguaagacgaguuuucuauguggaagcuauuuuuaucacugaacaugagacagugugugugggguggugguggugggggggggguuugaguugguuaauguuugauagaagguugagggugaaaccccagugaaggcacuguuuuagaauuguacacuggggccaauacgagcuguugccuuugcguuugaguuuugaauccagaugcccucugcuugugcuugagauucugucuuuuaaacguuuauaaguuagauuaacucaguugugugucaguucguccacaugugugugcauguguguguguccacaguguuuguguggaguggggcaacuuggagggguuguucucuccaaccaggucaccacuggggguugaacuaagacuugacagugagggccuuuaucugccaagccaucucgcuggcccaaagcucuguucuuuaugcuucaguuuucuccuaaggugggcuaacaacgagggaggcucguguggucucacgugugcacugauccauaucucgugcuuaagacagugucugaacauuguuguaaugcucagcuucugaggccagccaguguacuggggcucuaugcagaugauccucacagcagacuuguaccaccgucaucugccagguuacggaagggagcgugauagcaaaccugguucuugccaagguugugugccuuguguggcagagauuagcuggagccccugcuucucccgugcugcuggggcaugcauccuuggguacccaggacagggagggcagcagugacugugggcugcucgugcggcugcaagggucguggugagggauucacugaagcaucacuccugacaggcugugcucagagcccuuccucagaagugaccagcugaccccacuguagaaggcagugauuagaggucagaugucuagauuaaaggguugcuuagaccaucacauuauccagauguuuuuucccuguaaaauacugugccaggauuucugugaagaguuuucacuauugucacagcagacaguauuugucaccguuucaggaguguuugacagucagauuuugagcugagcccugggacugcaagcuugagccgucguguguuuucugaaagguuuccgagacaguguggucaugcauccuccucuccucccccaguggacuguaguagugcacuacacgucauggcucuaacuagaaacacgccauugauuuccuauuacaugagcuggcauuguugguccugcaaagcugcugaugacguaguagccugugaaacauuuuaucuucaguuaacauggcuauuuuuuuuuuuuuuugaaggaagaaccaaggagucaguauuggaaacagcauuuuucucauugucuguuugcuguuuucuugcugucauaaaauagcagggcacugcccucuaacacugauuaauaaucucagagacagaggcaggcugaccucugaguucuagaccggcguggucuacauagugaguuccaggccaggcaggaugaugaugugagacccuguuuaacaacaguaaccuugacacggcccuuacuggaugguuuguuugguucacaguuccaucaaggcggggaaaucacaacaggagcuuaggggaccugguagcauugugguucagcagagagggagggaggccgaguagcugcucagcucccucucugcacuuaggucaugcagggucucagccugggaguccuccugaccacucaggaucggauuggcguuuagcacuguuagccacccugagcgggaagugaagucugugauguaucuauccccagaagccugcugagagcauuguagcccccugaauuuggaguuugagagugcuugugcacugccuccuugugcuggaaacaaaacuucacuccaguccucugaaagaagagcaggagcucuucacugcuaagcccugguguaugccagaauaaugccacaugcucaucaaggaagauguccaauugguuaagagucauaaaugguaugaguuggguguagaggcuuggguuuuagcaaacguugaauggacauugaauccauaaagggaggguuuguguguauguguguguguguauguguguguuuauugggaccaaaaccaccuuuguuuuuauguuuaaaaugacauacuuguuuuuccuucagcuucuuagguuuguaucuuuacuuuauugaauauggcacuguucauuuauuaaugucuuugugagguuugauauuaguuauguagcgagccauuauuaccugucaguuacauaauucucuagacagaaaccacuuaaauugcugagcuccguguagcuggugucacuagaaacguucuaaagugaguuuuaccuaggacaacuugacaggaaacugaagcuuccuuaacuguaaaucacagaacuguggagccacacuuucuagacuugucagauaccuguaauguagaccgaggguuaacuugcuaagucuuagauucugaauaguuuauaagacuaagcgaaccccucagaacuaaguaucuagcacuuccacaguaaguacuuuauuucuuuauuacaguaguuccuuuguauuuuuguuuguuuuuuguuuuuguuuuuguuugguuuguuuuuuuuuuuguuuuuuguuuuuuuuuggauuguuugaaauggggucuggcuugguagccaucucugccucagccccuaaguguuacaguccugugcuguagggccugacugggguuucuuuagaaaaugugguaauagccacaaaaaauacaccaucagccauuuugaguuguacugugcacuagaguuaaguacuuuucguaucgguuugagacugucaguaccaucuuuugucagaucucuuuuuaucuuguuuucccaagcuuugugcccauugaacacuucuucccagcuucgccagugaccuuugugggguugguuggugaauugacuucuccagguacuuucucugggaaaugcugauacguguuuaaucaucugcugcaaagugguucugccauuuuacugccuugucccugucccucccugcccuaggcaggucuuuaauggcacuagaaagagugguuucuacaccgucaaacaccauacuuggcauuaauuuucccuuaaaauauuuuaaauuaguauugccuuauguaaaaugaccacaaaaucauagcaccacuuuccuguucauggaaauuagaguuuugggcuguauuuaaaccaauggaaauuugaguguuauaaaaagcucuguuugagcucugcauuuucugcugagucacaugcagauguacugcuucuguucucugcuuugagugucugaaaucuucacagagcagugcuuagaaucugcagguaaagaacugccauuggauauuaccagcaguguaauuugccaucuuauuuuuauuuagauagagauaccuuggauuaagggguuuugcaaugauaacacauuugguacuuacuaauaauuucuuugcauaucagauuaguuguauaucgagaacuaagaaccauaacccguaaagucuacuaaggagccagcggacuuagugcugaccauguggcuuguuuuucccucagcuauguagguuuauauuuuaguuuauugaaugugaccguucauuuguuaaugucuuugugagguuuguuauucguuauguagcaagccauuguuaugugucuguuacauaguucuguagacagaaaccaguuaaauuacuaagcaguuuacagcauaagggcuguaagguccuaugaccugaaugccguacuugaucaauguagucagaggccacaacacugcuuucuguucccauuguucuuuauccugacucaccaccggcuuguacucuuccagcccuaggagauuugguuugaauuagugguaaucuugcagucgaucauuuguccacauaggcgugauagcagugguaaugugauaaggugguugguauaggcuuacaucuuugagauacccuugauuuggagaagcucucugguaguugcuucuuagauaacgggcagaacauggaguaguuaaaaaguacaaguuaaaaaucagauucaagucuuuugcucucccugcuauuagugagaugacagucuucuccuuguguucaucuuuguuaagcguuacguaaucaaccacuaaauucugcuuuacagcauagaugacagcccguaggagcuggagugagugaaggugagcgugagggagugguugagcgagcgguguguuuagugugucugcuguguggcuuacucuaagccuggaaauacuucgaaaaguuuaccugcaacaccagucgcugccaucuuagcaggaauguuauauacugauuguuuugccucugaagaagcgaggccuggugugugugagcuacccuuuuuguucuuugugaacuuagcuaugcgcucuagagccuccccuccagaggaugccacaaguguucaauuucgcuuguuauucuuacauauuguauagggaguuaggcuggaauuucaaaggaaacccucuaguuuaaacagaaauaccugguugcuacuucauucccucccccugcccugaugaaauacccuucauugcuguuucuguaacaucuuaaucaaauccagauccuuaaacacacacugcugguaaacaaaccaugccggcaccagguucaaucaacugagaagaaagguaaaacacgaggaacguggaugcccacaccuuucagucccucaagcugugugccaucagcacaagacgccauacuuacagcccuucugguggccgccuggucugaacacugagcccgcagaauggcuucuuuucacaagugguuuuaacagguacccaggggugguacccuuccacuucauucuuagugugcagugcugucacuugacacacaccccccugcccguguguguucgugugugugugugugugugaucucucuccagaucucgcacucuccaacaacuuguucccuuucacaaacagaaguuaggagaggcgggaucucggcaccuccagccuuguggccgugcauccugauguggcuguagauucguuuucuagcaacugcagacaaguaaccuccuucauugcacaagcuugagcucugaaacagccuuaguaacuguuuaccccucugagucacuagggauggauuauuucccuacgugccagaguauguuugauuugaaaagcaucuaaaaauaccugcucaguuacuuguaaagcaggaugguauggggauagacauaugugcuugaauguuaagagagauguaguaaagugagcaaauuugugccaaaauaaaaucaaguauggacgugccuauuugcuaugagaacugcccacugcccacuaaucccacuggccuaagacuacacacggcacagacuacuuaucugccccaucuuuaucuguccuccucuuucgggcuccuaguguagaccaccuuguaguguuuguuguuuuuguuacuuggaucuacuuccaagucuuacuucugcugugcuuucuuccugccacgcugccuuacagcucugagaugcgucuuccucuuccugcguuccagccuuguuuaucuccaucugcaguagguucagcugcccaguguggcccuugaauggacaccaccguuucuguuucucccugaguguccugaucccgcaaccuccgugcauuuuguucucuaucuauacuucuugaguuucuuuuccugucuuucauuagacuuugcaucuuuccuccauagaacucaguauagacacccucugugguccucacgguuuccuuaacugcuuaguuuuguucaucuuuuggugcuaggaguuaaaccuuggucuuguaugugguuggcagcagucugucauugaguuauaccucaagcccauuugucaugacacgucuugucuuuuucuuugugauuccuguaagcagcggugcuucugucccuuuccguguguuuguuuuguuuuguuuuuacugagugugcaguauuggaugaacuaaacguacuuguuuuguggaguuagagcaaauauuucagauaccuaaaagcacuuacuaaucuuuccaaaggaagacuaggcauaugguaauugucagaaaauucuaugaucuuaucuuggcuauacguugcccaacaguaggauagguuaugagaaacggauguugauuuugucauuggagaagcagcuggcacugcugugaugucauaaggcugucacagugagucagugccaugcgugugcuccgguguucacugcagcugugcuggguagcaccugacuaugcauacacaucccuuuggacucucauccuguccauggcuaccccugcuccaugccaccuuacuugccagcaguacucacuaugccauccccucacuggaccaaagggaccuugcuccauccuuucucuggggccugacugcagagguuucccccccaaccccccgcauauucugugcuuacuugucaggccaggcuuccccacgacuuggggcuuucccgggucuucugucugucuggaacauggugucugccuuucccguagcccaucggcauacaccucaccauucgugcagucuucccaacguuugugcuccguguuccauccauuugggggaggggggaguguuauuuuuauuuuucauaggaggugggaccuugccacagcagaaucuucccaagaacacgcaucuucucugcucuauauauuccuuuacuuaggauguaguggguacuggccagguacugucgcagaaacucaguucuauacucuguugagccucugccucacuggguuaacuggaaagggucaggagaacauugucuuauuuaguuaccacauauagagaguguuuucuagcauauugaagacacuucuucacacugccaaguaggucucccagcuacuuaucuguggcucuccagcugagagggggagggguuucagaaaggaagcugaacuagguaaaguuacuggcucucauuuccugcacaguaggaaggcagcagggauggggaggguuggaggucucugguagcuagcucacuggacucuccucaguuuguuguugacagugguggccugccgagguugguggaaggaaggcuggccagcagaugugagugagagcugcuauugugcugccuugcucuuugcaggcugggggccaggcacccugacuaccugcucaggaguuuguagccacugucacaaccaaaugacaucacagggagaucugauguccucuuucuaccgggucuguuuauaaagugaaauggcgcuccuguaaaaauucacagcuuuuacagucccggugaccuugaguuguguaggucacucucucugugcaguaaagcugcugugaggauugacuguccugcaggaccucauucagaaacgcugugagguccaguugucugcauuguccaugccuuucccaaguagacaggacucauggucagcacauaccccgacgggcagacagguuaaccuucaaauucaagcucuuugaagaggugaagaaagugagaaccaaucauauaagagguaauuuggcuucugaguaucucggccgggugggcuuguauagaacaaguuggccauagggcuucuugcuguguugaauuuuguucuuccuucugaaagagaagccacugacaucaggaacugaaauugcuagaaaauacuuuugggaacuuaacacuacaagguagaggaagggugccugccaaugaaaaggcugcagugcgguggcuuuucccuuuagagaggucacuuuacuuucucuucugucacugaaagcauuucaugggcuccuagaaaaaugucacccaccuccgggguccagguuuaaaucuuggggaagcugcccuggguucugguggaagacgaugccacugagaagguagccagucacucuggugaccugacuuguucccucauggagcgccugucuuaaacacggcccuaauggcucacagccaugcuagucucaauuaaugagagucuagaaagucagauucagcgucugugaccuggcucugcuacccaugcacauagcaugcccuuaaugagagcgucugagaggauguggcuggucacacugacgcuguauauggaagcugaguccaucuugcugugggaacugcaacucugauguuugagaccuaggugugauuaaagucugugugguaacucuucauucuuccuuucuuuccuuuccuuuccaugucaaacagaauaaaaauugauuuagagagacuguuugcagagccauccucaggaggaggccccuuacaaaccacacacauccgugucauccauauuuuuacccgaagacgagagugcugacaggccagagugcuuugcaguuuccuucuuuagauuucucugauuucuccuuagaguucucuucagagcacaugcuagcuaccauguaaagaagacaguuuuccugggcugggcugugcugugcugugcugugcuguguggaugaguggcaguacuggcagagaaguaguaucggccugguuggaugacuucucuguagcucugauuccaaggcucagguccugugaucaugucacagccuuuuuaaaauugugucugaaaugaagcugugucuugaugacagaaauacggggacaagagagguagacuuugugggucauugcucuuuuaaaaguugaguuaacugagaagcaguggaggcuggguugcuuagcugucuuggccauagauauuguauugccacuuuucuuuuuuucaaggcuauuuuaaacuaccuugcauguuugcauguaugcgaaugcauaguaacacagagcgagggacagggagaaagggguguguuuggcuuucuucauucaggcugaaacccuggugucaucccacagauuucauggagaacuugguacaguuuucccuccuagguugcacauuccauuccuuuaauauuuuuguucuauguuauauggcuguuguuuauaggaccccagauuucgucaagaaccauagcuuuuuaucuggaagauucaaguccucugaccucugaggagugacagcuaacauaagaggggcacugaagacauuguuacugccugucccagcagaccucugagacccagugcugcccuuggucaggccuguaagccugcggggugaggccugcgcagcuccugguucaugcuugucaccauugcuuuuacauugcacaccauauucauuaagaagagcauuuucugcuucauaaacugugaccucaccgcggcacaucugcuguuugccguguuacggguucuucucgguuagcuccaucaugccagagguguacagaggaggggaaggugagugggugggagucgauuuguagaaggguaagacagccagggcucaacucuuuauuguaauaauucaagaaagcuauagauuugucuuuauacacauuguacacugagagccuuuucuauaaauggaaauuuauuaaucguauuaaaauauauguuguauaccaaaaguugccuguaggguuaucuuauauuauuaaauguuuuaagcauuguaguagcacccuacaugauuugaguaagaaauaaguuuccauucuaaaaugugucauaaauguuuucaagaacccacacuuacugucuucagauacacuacuguucaguuaccaugauuauuguaauccacauaagucuuauauuacauuugcagaaaagaugccauucagugagcuuuuggggauggggguuagccgucugacucuaaaccuccugccucagcuucuguguugcugaugcugcaguguaccaccaagcccuggaagcauuuguuuuugacaaagauguuuucucuaacauuuuguugagagauuacaguagcgaacauuuugguugcuauaauguccgugcugugugaaaaacacaugcauagaacccagagacccuaaugaccgaggaaagguccccugcuguuuuagccaggguuaccaguugaauggcgauuuacaugagccccacucuaucuggaugaagcaaaugcacuugauugguuaucuuagcaucccaggcugccuguugucauaaacuuagcuuucugguauuuauguuuuuccuucuagguguuauugagcuauugucuuauaacccauauuaaaaacaugcuggguuuuuuuuuuaauggauuaucgcuauagagcuguguuaauaaaauuuuuaaauuugaggcagaauaacacaguuauuuuucuauuuuccugugaaaacagccucacaagugaaccacaaugaacaaugauguauuuccuccaucgugauggaaaauaagccauuauuauuucugcucugacucacaaugaacuugcugacacugagauauuuuaaaaucauaaucaugaggaacagguuagggcagaaacuuagaugcuaggcccaggguuaccugcuuauuacaguguuuuacaacuuggaugguucaagcuuuccaguguagugucccuaagccuuacacacuaaacacccgcugcacaacuguuuguugcaguuuuagauggugccaaauaggccaaaaccucauaauaauuaccauuuuuaaacuucauugauauagagcaugugugugugugcaucacauacacacacccgucuucucucuuuccccaguacacucaauucugucccauaaaaagagcuucagauguccaguuaaugaggauaggccccuuagaguggggaugcaggaggugaaugggguaugucuccagcauuauaauguaaguaacacuugggguugcagagaacacugacagagugcuuaaguacacuuacuaaagcugccacauggcagaugguuuuccuaucgauguuauguaaucagauucagugguggaagguggugagugaacgaaccuacugugaacugugugugacgggaaacgugcugggguugaauuuagggccuaaugagggugagguggauguucuguuagcaaacaguucuacuuaguauuuugaauuuagaauuuuuuuuauuguauucgcaguauguauguguaugcauguacuuauguacaugagugccacagcguguguggaaguuugaagacagcuuggcaaauuugguuuucaccuuccaaugugaguuccaaagaugugaaggaaacuugggucacccaguuagcuguuacccaugagucaucuugccaguccaguuaauacuuuauauuuuugacaucaacuaucaccugaaagcaucaggguguuuguuuguuuuaaaaauagaucugcuuaucuuuuaagugcauggugguucugcuugcauguaugcugugcaccgugugugccugguaccuguggagacuauugaguuacagguggcagugaggcaucgugggggugcuagagauugaaccuagauccucugcaagaacuaauuuucuuuacugcugcgccaucucucaggaaaaaguuauuuaaauguaucugucauccacagguaccacuaguauuugcuaucuucaaaaguuuuuuugaaaaaaaaaaaaagucaaauguuacuuuuguuuguucuauauaucuccccuggaugauuuuacuacuacuacuacuguugcugcugcugcugcugcuacugcugcuacuaaugcaguugcucaccaaugccauguucuuccaaugggcuccaggugaaauauagccuccagggacugcuuuuuccuaugaaaucuuuagacauuagauuaauuauaugcaaaugguaaagauaguuauccagguugacccuguaguucuaaaccacaaagauuguguuuucuuggccacguucuacuuagccuauggcuccagggagaaaugaggcuucauuuuccguggaaaaccaccaacaagcauaauaacaaaagguuaacagacaccagggcuagagagauggccacuccucagccccuuuaaaccuuuuauucauucuuugugaguuuuauauaaugcaccccaauuuucuguuucuuuguaucugccuucugccuuugcaacuuucccccaagagaaaauuaaagacaugaaaauuaaaaacaaaacaacaugaaaaacaucucaauguggaagcugcagugugucacgagugucccacaguguauacccucuguccacacagcuuuacuuggaaauguucauugcagugggucuggcuucugcuacacugucucuuggauccccuguuguugcccucugucauggagaugcugggguucagaucuuuuacgguucccugccccuguaacucugguuccaugggauccaauggaugcaggcuucuggcuuccagggguguaugcacucaggcccccacaugacaccacaaaacuaaacaagaaaaggggggguggcuuuugaaaauggagauccaagucacgaguggcacgcacuugaaggaggaggauauugcuuuccaaaucuagccuggccuaagggucucuguccccugaaagcgguagaucuuuaaaaucugcugucugugaugcuuugugacacucgaugugugacacuuacccaugacuuuauugcaugauguguuugucauccaaggguaauuuuauuucaagucugccaagccucaaaacuuagaagugauuccgauaauuaaaucugagugguuugaauagcauugagcuauguguuagucacaacugagagacuuuggcauuugcauuagcugucauuguucgauguuacaccacuauagaaguccuuuaaaauagcaaacauacauuugaacauuuauuccaccuggggauuuuaaagcaaccuuuaaaaaaaaaaucauuguuaccuacagugaaagacacacacucccucccaccgcucagcaggauccaucacagcagcuggaaauugucuucuaacaacugaucgugacaaaucuuaaugcuuugcagagaggaggaggaauuuggugaggugauucugaucagaaaauuuugucccacccucuuacauaauacuuuauuaacuacgggauuacuuagagacaagacuuuaauuuggagaccuguucuaauaaaaugaaauagaauaagagacgcuacauuagcauugagcugacacucugagcaacaacaugagauaacagaagugguuuugguuugaggaugcagccagcuguugcugcauaacaguaagaagcuagccacuucuucuuaguagcaugaaacuuggauaugucuggguuugccuggacagucaguccacuuuggggucuaucuuugaggucaagacuggaaaaguaagugacuuuuagguagguuuucgugaaagugccagauguguaagaacgggcuuggccuuaaaaucuuguuuuguuuguguguauuuuuuuuuuaagauuuauuuauugggggugaacaaaagcuugauaaaggcccaaagucaacagaaauggguuuaguagucaaaugugauaaugcagcuaacuggaaaaagaacauugaauauaaggacaucuacuacuuuuguguacugcuuuaaauaguguagaguguuggauuugggggagaggagauuaagacaggauucacgauggagaccuuccacucguguggccuaugcuaaccuguagguccagacucuucuugccucagcuuuccaggugcuagauuuuuaaggugugugucaacauguacagcuucaguaauaccuccugacugcuauauugggcuagagaagaggcucuaagcuggcaaagccuuauuguucauucauuuauaacaucuauuguagccucugccugugccaguuauaacauaugcagaagacacaaaugaaauauccaaacagggacuuuggggcaagcucucugguugguguccacgauuaacagcuaaggugaacagcugucugguuuuggguguuagaaugucuuuguaguccaaggauugaaacaccaacuaagaccuuugacucuuugguguguuguauagccagaagucuuuuucuggcauccaagauacauaguuuuaucucgaaggccggcaugaaaauaagguuacaccacccugaagaagauagagaaagccaugcuggagaucauuuugaguauguucuugucuugauugaagaguggaagacauaggcuggacgauauggagagccuucugggaaaucaggauguugcaauaaauuuggaggagccuaagcauaguuuguagggagagaacgggugagauggggcuacagggaaggaaggcaggguuaaauuagaguugucugaauuucaucuaucucaggaaugugaucaguugugagguacgggccaugcuuaugggucaguaagcugaccugggcagacaccuggcaaauagcaucuaauaugagcaucucacagcccuuagcccugccuucucccuuguccuuccauaaaagggaauacagugugcugucacauagaacuuuccauaagcuaacaagcuguuaaaacuauuuuugaaauguggguuccuguaauccuguuccagggucauagccccagguagccagacaggugguguggggguaacguguuaggaucaaagaccacagaacccuuaguauggaaauugucagcuuggucacuauaguaacaaaugcuuugagaucuuaauauuuucuauuugguuuauuuuaguuaauaauauuuagaggauuguuuuaacuguggucuggcuaaauggaacaugccuuuaguggcucccuguaucccuguauuagaacaguuucccuucugugccacacuugcugaugcauugucauguguccuugguacaguuucuggacgauaagguuggcucuuaacuacccuuaaguacuugucaacugauacuaagaauuauuuaaacuuuuuacauguuugucugaauguguaguaucuauguucauguguguuuuuuaagugugcacaugugugccugcauguggaagccaguggaggauaccagauucucugcucuaucacucuucugaguguuucucacuaacccugaccaguaagcccccaaugcccuucucuccacugccuucagaacuuccuucugaauucacacauagcguuuacauggaugcuggagauuugggcuauugauugucuagcauaccguguguguggugugugugugugugugugugugugugugugugugugugugugugaacacugacguauagaugcaguuucagcauccuaauagcaaguagcaacagucuaaugggaagaauugagagaagcaguggguggaguugggcugaagauggaccagagauugaggacugugucuccucaguggcuuuagaaaguagagcugcugagagggagcuucccuguguugagagaggacacugauagugugcagugaguguaaggugcugacugaggggcugcagcacugagcacugugagcaucuauguuuccuugauaacaugucucugcugacuuaaaaugagguccaguugagagcugagggcucauauuuauauauccaugugugugcgugcguaaauuuugguuuuucuguucugagcaucucauccaggacuuugugcaugccagguagccaaguagucuaucaccuuuguuugcuuguguuuuuaagacaaauugccuugaacucugagacggccucaucccuuacccugagggcuggcguuacaggaguaaggcaccgucuuucuguuuguuaucauuccaacccuagcuccucucccccaggauuuuaaagacuuuuuugguucuaauuuuguguaacuaaaaaggccuucuaauguagcauaauuacuuguccugauaauguguguccuuuuacugaaaacugugaauuguaguugacguuguguugagacagaugucauuugcagcccaggccuccuggauugcagugccgugcaccucuggccaguccuugcacuuagaaaguuaguguagauuuuuaguuuuuuaaaauuuucuuuuguuuuauugugugaggguuucugcuuacauguauauauguguccugcauguguagcacucacagaagcccgaggacuuugggaucaccuggaacuggaguuacaauugugagccacuguguaugugggugaugggagucgaaccccucccuguguugucuugagcagcugucugcucgagucauaggccaggcugggcucacugccuuccucccacguucccagccccugaugcagcuuuuagucugauuaauaaagaguaaagaaggaaaacuucauuuccuacuuuuguuugauuaaagaaguaaguccuaguuuuuaaguucuaaagacaaaaacuccagguuucuauuggaacaaauucauagcaaaaucugcauuccagccugauuuccaaaagaaaucguauaagucagcugagagaaccagcucagcuuuagaaagaggaagcugaugucuagcuguuuuguccucuguaacauuagauaagugcacuuaguuuuaucuggaagaaaacagugucucagccugguggcagguggcuugcucuugugcauaggauuguagagauagcaauauuugcaaauuaaagaauaaagauaaaaaauuuuauuuuuccuguugcaaccuuuucagagaggaaugcuucuaucagagacaggcuguggugagugacauugccacccacugucuguaauagacauagguaucucucugccuuucucugcuggucaccugguaucuugcuugauacccauauuaugcuuggcuugaggcaucuuaaacaauuuugauauaaauggggagauaaacauguuuauauagccacagguaguccauacuguauauuccaaauguaaauggaauuguaaacuuaccuguaucaaacuaacugaaauaauuggaaguacacauggucauauguauacauuaauuaucauuuacauauacugucaucauucuguguuugccaaaggguuuuuacagacaaguaaaauugagcacucuauacuuuuuauuguuuuguuuuguugaaacagaguuucauuuuguaguucuggcugcuucuagacuagauuggccuuaauaaauuuacuaagauccucucucagagugcuggguuaaaggcauacaccacucauguacauugaaagaauaauuuuagugcuucugucucaagaguuuuuauugcugugaugaaacaccaugaccaaaaccaacuugggucugggggugggaaggcaguauuuuauuauauauuucuccguaucaaaggaaguuggggcaggaccugcuacagaggccaucggagaaguacugcuuacugacuugcuccuguggcuugcucaacuugcuuucuuacagcacccaucaccagcagugagcugugggaggugccaucaauuaagaagagccuugcaagcuugccuaccagccaguguuauccaggcaguuuccuaaaguucuaucuccccagaugacccuagcuuguaucaaguugacauaaaaacuagcuagcagaguuucuuagguagugaguguuggauuuuuguucguuuuauuuuuaaagagaaauuguaacgaugguugccaucacagucaguacaaaccacauuuuaaaaacaucccggaggcaagagagguggcucagcaguuaagaagaccugaguugaguucccaguaccugcaagguaccugacagcccucuguaacuccagcuuuagggcaccugacacacacaacaugcacaagacaaggaaagacaaaacaugccaaagcugacuuucuuuuuggccucucuagcugcccuacuugauucccuagcacuaagcuuauucaacccuccagauuccuuggagcaccucuuggggagcaccuggagcuguaugagcucacagcuguggucucccucugggaucaguucugccuuuguaagcacacuugcuuucauguuguuguuauuguucauuuguuuauugagacaguggcccugcuguaaauccaccugccucugcauccugagugcuaggauuaaaggcauggaccaccacaccuuuauacaguaauaaugaugaugaugaugguaauauuauuauuauuacuauaauuaucucuauauuauuuggaucuagagaaaugguucagcagcuaagaguccucccaggggcuggagagaugucucagugguuaagagcaccuuccucuuccgaagguccugagucccagcaaccacaugguggcucacaaccauccauaaugauaucugaugcccucaucugggguacuuacuaaauaaauauaucuuuaaaaaaaccaaaaaccagccggguguaguggcgcacgccuuuaaccccagcacucgggaggcagaggcaggcggauuucugaguuugaggccagccuggucuacagagugaguuccaggacagccagggcuacacaaagugaguucucccaggugacccaggcuugguucccagcacccacaucauaucucacaacccuguguagcuccaguuccaggaacucugaccccaucuucccaccuccaugcacacuagcagugaaaguaguguaggcaggcaaaucacacauacacaaaauaauucuuauuuaaauuuuuuaaaaauuccaauauaaaagaacauuagcugcugaauaccuaucuaaccuauuuuauuugagaaucauuccauuucuucucauggcauaaugaugaaacugauuuaucuuaagucuguucuaaaagagaucuagaauacaaauaaaggaauagucaucguggacaguugaaagaaccuuaagggacaauugccagugccacagauuaaaacggaugaaaugcuccugccagguugaaaucaccuuaaagugacuuaacuguuacugaggugggcagcgaguggacgcauuugggauuugcccucacauccaucguaaauagcagcuguagagcuucccgcggaugugcugggugucuggagucaucuucacacgugcuccauaaauaggcuaugcugguguccugcucuaggucucugucaugauccuggaaaaggcuggaaugggcuucagugacuggcauggugugcugggugguugcagaucagccugcuagacagaacagagcucaccaaggcggaaugaaauggaaacaaacauuuucuaauguaaauggucuuucauagaaaauaugaacauccuaaaagcuguauucgcucaugaaggcauuucucuccacucuacuuagaaacaacauuuauguugccugugaaaugugauucucuuugaacuugaacaaauauguuaaauauauaucuuccacccuccacauuuaaugucuuaugcuuuaaguugggcauaauucuuccaaagugaugcuggagagaaacaaaacggugagcuuuuacagacuuccuucuaaagcuuuuauuuacauuaucauacauucuuugugaagacuucucauaggcaaacaguaagcuucuugguuuguugcuugcuugcaaguguguguguguguguguguguguguguaugacugauuuaaaagccaaaauccccuguucguuguucacgucccagccuugugcucagauuugccuuuaggacauaagggaaagaaaguguaaccuuuagaauuacaguguaaguugguuagugaauuuggagacuccguuuuuaaguucaaaauguuaauuaguuccuuucauagauucugcuguguguuuucagccagggcaucguggugcugagagcuguguaugugugauuucgagacaguagggaauguauucagauccuccuucgucuuccaucagacaacaacccucuagcuugcuuugcagcaacaaagcugcugcacuugauucuccugccucagccucccaggugcugggguuacacaugugccgccaugcuugucuaggacugaagagcuuaauacauuuccccaaaaaaccuauauuccccugagugugcuaaucaaguccuccaucacuggccuaugccugcauauaugaaacaccuuucaauuacuguugaacguuuuuacaugcuaauaguaaacagaagcaacaguacgaaucguuuuuggcacgcauguuagagaaaguaccagcguguguauguaauaagugggucaaaggcuggguuucuucagauuuguuugauggcuugaacaaguuuggcuuuaaauuuguauguguaauuaaaaauggaaacagaauagaacauuuuaauucaaagcaauguuuuaggaguguuuucccuuuuuucuauacauuacuauuuaaaaguaacugcuuuuauaguuagugugcuaacacuugcaaacuugauuuugauauacagaaauaaguucaaccaaugaauauguacaauaccuuggcaagugacuugagcauauuaaucucuggguuuuuuuuuaaagauuuuauuuuauauguaugaguguuuugucuacaugaauguaugugugcugugcacgugccuggugcccacagaguacagaagaggguguuggguccuaacucccucccuaggaccugagccucugcaguaauggaggaaucuuugguuuuaaaagugugugugugugugugugugugugugugugugugcauuugggccagccauggcauguuuggaagucuaggagauugaagaaaacuuuguuguauucauucucuccuuuaauguuucaaguggguuccauggaucaaacucugggggccaggcccgaccagcaaguaucuuugcuuguugagccaucuugccaguuccucaagcagacugcugauacagaagaggucuggggauauaguuguugguagaguguuugccuggcauucacgaaguccugccugguucuaguucucagcacugcauaagcugugacagucagcuuggugacacaugccuaaaaucccaguguuuuggagguggagacuauaggaucauaaauucgagguuaucccaaguuguauaggaaggucaaggcaagccuuaacugcaacagaaauuguguucuuuaacccacagaagaggggugcuuuaggacccaguugccuuggagcuaaauucuccuuuccuuguuuuauuuacccauucagaaaaauagguaaacgccuccucuugaguucucacuuaauaucuucuagacugccuuaaugcgcaaguuuauuuuuauucccucauccauggaaguuagugcgagugcagagaagggagucacuucacacgcaggagucuuagucucaccuggacucauggugccuacuuacucaguuacuuacuuaguuuugugacaagggucucauuguguagcccaggcuggacuggacuuugugaccauugucccucagccuccugagugcugggaccacaaucaagaaucaccaacuuggccccuuuccaucuuugauuuauagaggauuucauggugaaggagcacuguucauugguugaaaucaucuuaagaugcaugaggaagaaaucuaaaugaaaaauuuguuaaaugcaguggggccagaacuuugguuuuuuguuuguuuguuuguuuguuuguuucgagacaggguuucucuguguagcccuggcuguccuggaacucacucuguagaccaggcuggccucgaacucagaaauccaccugccucugucucccaagugcugggauuaaaggugugugccacgaccucccggcagggaccagaacuuugaacgcccaauuuagugaagugcuuuaaaucccacuggugauucgcaaauuagguuagagcugacauaccaaaauuaugcuaggacuaaauuagaguuuggaagccccauuaacucuuugagaguacugggguacuauuuagucuucccaaacaguaauuuacuaaguuuagcaugccgagcgagacaguaguuuucaagugaugcccuaaaggaucuggaagacagcgugaugcugagaccucgugcuuugugggguggggggugggggugggggacggggacgacugacucagcagucccagaaugcggcucgaacagguguugagcucugagcaccuugugcagagagagcugcuccucgaauugaggcuggcacguuucuguccuugucccaccacgucucugcccugcugcaugcucucaguugacaucuccaugcagccuguggaggccuuugcagugcuggccugucucgcugucuccacaacucuuccucagcuuuucucugguuucucaguucagcggagacuacaugacuuguugcuuaaaacgugucaccacuuucccacauauaaugugaguaguagucacuacuacuuuaaaaaaaaugguuuccagacucuuaucugggagaaacuaccaguugucccugccuucucuaucuuguaccccaugguuucaucucacaccugaucagacucuaaucuuccuguccuuugcugccaugaguguucuccgcuccaggaaagcagcugcauugcacacagcuuugccuuccuucagucacuugucuccucggacaucuugacaaugugguccaagaccauuuaucccugaaagguuagcuuuccccaguuugccuuccuaugugcuuccagcaaccauuccccgcucuccugccuuggagaugcccuccacacuggauauuugauuuaacucuccuuuucugugcaaucacauugcucuuuuagaacuacucagaaaaggaagccaggcccuagaaggcgcauggcccauaacucugugaaaaagaaggaugugugcuagcucuggcuaucugugaggaagaugggcuccugaggagcaagaauuaaauaauaguguuugaagagugagcugcguaguagcugcagaagacaaauauucaaguucaaugccugugcacacuugcauucuugaguguuguauaaauuaaaccucaauaaaaagugauguuaugcuccucaucuaaagugcugugcugaggcuccguguugugcccacacagugugggucacaguggcuggcuucuuggaggggauacccggucucuugauagacagaaauagugcuugucaguuggagacgcacauaugacucccucccucacuaggcugacuuugcauacgguuuagggguugcagacuugcacugcugggauggaauucgaggcucgacuucaucugggagcuguguucccagccagaaagguuccguuuguuuuucacagugcuacucacuggagguuuauugcuguuaguauauuuuguuugcuuucguuugugauuaugguuuauuuuguuuauggugauguuugaucuccaguagaaaugauggagcaugacuugauaaauuaagcaguuugccccuuuaucuaucugcauauaucuuacgaagaacuuugcauuuacuuuuaauguauuuaagggccagagagauugucuugucagcagguaaaguuguugcugagcaagccuugugacaaguuuggucccuagaaacugugugacauggaagaagagaagcaguuccacacaccuccaugugugauggcaugcacagcuaaccgugagagugugugugugugugugugugugugugugugcgcgcacacacaauaaguacugaagucaagcuuaagauucuuuugcagaguguguuuuaguuaaugaagaagaauuuuguugcuggugaugguggugcacagcuuuuuccagcacuugagaggcagagucagaggaagcucugaguucaaggauagccagaggaagccugccuggaggggugggggaggguuuuauuucgguuuuuuuugugauaggugugucuuaggccgguaagguguucucuugacucaccuuccaagugcugagacuacagagacagacucacuaugcucagcgguaggacgcacccuugagaagaggacuuaccggugagcauaauacaacuuaaugcaggaauguguugggcauguagcauauguuacaguaaugugcguagcaacaucacuuuuuaagguaggguuuuuaauuagcauaggaaagucauuuuaguggcacucuuaaaauuacccuaacuguucuuuaaauacuaaaauaccuuuguagauggcucauaaagauagucauaucuagacuagcuccaagguccuaccuaagcugcuaguccuugugcuguacuugaaguggugcaguuaggagugaaagcucuagagauggggcaaguaaggauuagcagguaagucugaguggucugcgcucacuuccccucuguaacagcagggaaggcgggcugcuuuuguuagucuuguuuguuuguuuguuuguuuguuuguuuguuuguuugagacagggucucacgaugaaacccuggcagguuuggaacuucauauguagaccaggccagccuugacucaccaacauucacuugccucggccuccagaguacugggacuaaugaaauagugagccaccaugccuggugauuucauuaguuuuguuccuucuuccaaauaauauaucaggaauauagaaauaaguauuguuugugaacacuuccaaaacuaaaccaagaagucccacagugccaaacccauuuguuaccauacccgacacucaagcucaacaagaucaccaccaccaggcuaaagugagcaggguuuacagcagcgugccugcccucucucuguagcucggcuuccauuuguccccagugcagccuccugauucuucccuucagucuugauucugcagagagcguguuauaguugacuuuaaccucgcucugccagcuugugauuugaaacagagaaaaacucacuacaaauugaaaccuagaaccugacucuggaguugagagcagagcauuuugggaaugggucccucacacgccugccagccugcucuuuaacuuucuuagugaagauguuauagcauaccucuacuaccucugaaagaaagggcucuuagcuggggauggcguucaugucauugagagaggcgcuuucacacuauccagaaaagggccccauagagaugcacaaggcuugcucagcaagaacuuuuagcugcugaccaucucucuggccuuuagaaugcaggucuguggcguccuauuggcucagaguagcuauuuacauuuagacagagaccugauagaggcaggccaugguuacguaauccagauggugacgggcucucucauuucagguucuaaccuauugugagugugcuucaaacuaagaaaaacaagccccuggagacuuacauaucagacaaguguguaggggauuacauggaggguucugauaacagacauuaucauguuccuaucaccucuccacugggaaugucucagagaaugagggagaggucccaaggcugcaugguaggguuugaauggcuuucuccucagugaugauagucccgacugugucacaaaguacuguggacauugauggaaguuuguuauaaaggaaaaggcuggauaugaaagcauuaacaaaaugugacuauucguaagccacguucucaaacucuuaccucugacuuccuccagugauggacuguaaccugaaaacauuuaccucaauaaacucuuucuccaccaaguuccuuuugucucaggacauuuuaucucagaacccggugaagaaaccaagacuccucuccccaagacaucuugcuuuguaccccgcuuccccaugguuaggagacugaguggggcugacugaacucuuucaaugguagugaaaucaggaagccuuaagucaguuguagguggcuuuccucaaggcagcuuuuauaaagugguuguguugugaugacaugaugccuuaaaaugcagccccaaguguaaauuaccucagaggauauaaagcccggauuguuggcuguguuuuaguagauuuuacuggaaccccaaggauucuuuagauaaucaauguuugggacaaaugacaaagagggaaagcuccauugugcccuuuguuccuuggaaaugugcagagcuggcuccuggguugaggugagcgcucagagaagaguguaaggcguuuacggugccauaguuuuacaggauuuggauauuuuggagaaauccuugagaacugauacuugagacuguugaaggcagacuguuuucaguucuuuauuguauugucacucaaacuccagccugagccauagccuuucuguuuguuugguggucacuggaacucacuacauagaccaggccggccucaaacgcagauccaccugccucugccucuaggaucaaagaugugcuagaccacacccagcuugcauaauuggcauuuuuuuguuguuguuuaaaguguauuacauuuugcuuauuuacuguucguuuguguguacaugguccagcacaugcauagaugacaauuugcaagagucaguucccucuguucacuauaagggaacuggggucaaauucagguggucagguucagaggccaaaugcgcuaacuggcuggacuaucucacaagcccuuaaacaauaccuuaaacaguauuaaaucaccuaauguacauagagagagcauagacagacagauagacagauagauauugagagggggagagaaaggaugugaguguauguaugagugagcgagcuaucucacaggccugaacuuuaaacaauuaguuauuaaguuaacugagagagaaagauaaagcaugcuaugucacagguccaaaccuuagacaguuaguuacuaagugagugagugagagagagagagagagagagagagagagagaugugaugugugaguguagagaucagaggacacaggaguggcugacuuccuuccacacucacucuguguuucauagcaagacagucagggccugccaguaguguaaaguaguauucaaggguucuucucugcuugacugacugcugagcaccggggaaagacaagugaccuagacagaagguucucaucucugagcgagcagcuuccauucaaggcagaccuccuccaagaugucugcccaaauucaggauccucagaaaugaccugaaggagugugggaaccaaaugccuuucaccaugcacuguucaggacaaggaagcuuuuuacacugaucggucugugauucauacaaguuuauaauucauucucucucucacuuucucucucucucucucucucucucucucucucucucucucguguguguguguguguguuugcgcacgugugugccaauugguccuccuuucauuauguguucuaaggaugcacucagguugucaagccugugucaaguguuucucccugaugugugaucucacuggcccuuugcuuaccccauuuuaaaaucacucccuuaaagacccccgcaggccaagcucacaagugauguuauaugcugagaagaagcuauccugaauucacauagggccgggcauagguuuuagaguuagucugucuaggacuaguugcuguuggaggagagagcgauagcucggaggcuggggacggcagugacgcugcgugcaagagguacaguacguagaaucugcauauggaggggcagugucacacgucuagagaugucaucugaccucucuacaaagccuuaauuuauggauugggaaaugaaaaaugucuaaugcucugucaugguuuuaagugcugcacuugagaacuuagacccuacucagagcuuaggggaagaugggaggacuaaggcuuggaaguuugagugucggcaauccauggcaccauuuuguauccagccuuucucauguacgggaaagucaaguuucuuugauagauuuuucuuaaguuacaaagugauugagaagauggaaauaucucuaacaguuuugacugagguagcacuggaaucucuuaccucaaggagaauuuuacaugccacugaaccaaaaggccuacauuucagccaguuccgcccugcauccacucaggacaagacggucacugugucuguagagaagaccugucugcuuuggagcucuuuaguuuacaccuguaguuucugcagggucagccaugucaaacgcacugcccucacuguaucuccuuugucuguaugcaagcagcguguuccagauguccacacagggcaggcuccuccucagcugugacuuguuauagagucuaauuguuugcggcacgugacuguugaacaagaagagcugcuugcugacuucuggggcaguacgcugaggugauguuuaaggagacccuuauaaaagucaagccuuucuuugaauguuuuaccauguaaauauauuucaaaaaaagaagaagaagaagaagaggugaccaguacaguucuugcugaaugacaaagcacuucaaaauucaauggcuaaaccagcaguuucaguaggaccaggaagacugcuccuuuuggcugcguauuuggagugggcagggaugguccagaaccugagugugcggcgugagugagaggcuguaugcuggcgcaaugucagcagcuggggcuccacaagcaggaacauuucuuccugcuccuucaaaacagaaaaacucacuuuguggcuuucgcaucaaguuauucaaccauauauauacauguauauguguauauacacacacacacacacacauacauacaaauacacacugacaccuacuacaagaaaauaggcacccagaacaccaaaacagugaaauuucaaaacaacuggcuuuucuguuccuaaguguugucaguuuauggaccuacuaaauauuuauuucuucaguuccagcuauguuuaccaacuggguccuguccuagccucagccuagguugacucuccacugaguccccucuucaguuggucugagcugaguuugcuuucuuagcuucugggaggaggucauaguaccauguauucaaguggaaucuccaaccagaccacuguccacaucucuguaggucagagcaaguuagcaacuguucuuucuccucaguggaccugcagaguggcacugucaguccugucuaaagguuuuuagagccugagcaucgugcuauuccuauacauagauuaaagaccagaaagcagaggcauggacugcagaaagauagacagugauagaaugcaagagacugcuaaaaagccaguguggaaaggugaauuuagcuugaaagauaaugugaucuuagcaguuuaguaguuauaagucuggcugugagugaaccaucaaaauguaagauguauccugcuacccuagcauaucaguugacuuguuuauugauuuagagaaaagcugcagagaaggcauuacuugugguauauuguuuaaaguggaguagcucuuagugugugcccccaccccaucucccaccccacccccaugccuacugggcuuccacagagcaaacagauugaguuagugccuuggcgcucuggcuugguguuagcauuguuucaucuucagcauuucaggauucucucucuggaacuaucacuuauugggcagcuggagucugcucugcagaacacaaagcacguuugccacccucuuuccucucuugguuggguuacuuagaaagggccuucucuaauuucuuaauucuaugaucguagcauuuaaagagucuuguguucucaguugaaucacugaguagccaaaaggucacuggcuggaggaugccuccugguucuuugcuuccugucuuacaccuggugccucuuuccaagguuggcaaaugaaaaggaaacuugaggcagucucucuccugcauucacuugacagguaacaagcucucacacccuugacuuaaaccugggaggagguguguuugagaagugaucauuuuuggggggugaggggaguguuuuggggacaguggccuccuggagucuucauguaagaaguagcuauuaaucucagcagcagguaauagugugguuaggccacaguguaggucccucccuuagucuguuugcucguguggcuuagguacaagauacugcucagucuaguucauuguuauguaagaagaggucugauuggucaucugagugggauugcccgucacuguuggcagucacucuuggacagcaauggcauuuuagaaaacauuuuauuacaucugguacuuauuguaugcacagguucaagcacaguugugggacucugagaagucacugccccuuccacugugugggcaggcucuggggguugaugguguggucaggccccacaguaagugcccuucccugcugagccauccugcuaacccagagguggcggcaucuaaggaguguuucagacuuguuucagagguguuauuggaggaguagaguaggacucuuaaacggcagagagggaaagggcuggcauucuuauauguagacuuccaggaagacuuuuuuuuuuuuucuauaauugcauacuugacaaaagagcaaggcuuuuguaacuccucucugcuauuuccuuccucacaucuuuguuucugagcagccuuaaacauuuugguuugggcgcugucuaguccugcuccaaggacuggcugcagcuccucugugagcuccucuaugcagccgccuggaagcugcccgagcugcacgugucaacaugcauuuccugugucucagcuccugcaaggcugcagugccgcuuugaaauugcuuugaaagacuugguaaucuguucagauguauuuaggagguagcagaauucauuauuugacuuauguuacugguuaauuacccaaacuggagcauguuucucuuuccaaauugaguguugagagaauaacaaagaccaaauauuuuacaacacagaccuuugaguuuaacucugaaauagaucuuuucuuugcaguacuucugguuuuagugacacuuacuacuguguacugucuauuuuuagcaaacuuugaauucuaaguaaauaaaaaauuaacuaaauugguuuuuaaaauaauacagauuguacuuuuuuuuaguuucccauguccuaauuggaaaagaaggucuuacuugggauagaaaugcacauuuugugccagccucuucuuuggaauuggcaagcguuguauugaguuguuuaugagaguagauagaaguguuugacauuucuuuuaaugcauauuauugcugucauuuuuuuaaauugacauaaaaguuguacacguuaagaggcaccugguaaauaaauguuuccacauccucgaauugugauguucaaaucagggaaagaguaucuagccucuuaaauauucuuuucaaaaaacauucaagaucuuuaagaagcuuuuauugaaauacuuagcauguuauccucaugcuuugucagccugucacccagaguauuucuccccuccagcuguaauuaaaacccuuugacuaagccccguccugaccuccaguagcaaugcucagucagcgucuguugaaaccaacauucuauauugcauguacuggugagacuguauagcugucuuauauaaugugcuucaggucugcucacguuuaaaugguaagacguuguccuuuuuauagcugaauagauaguccaugaugugucguuauacacucgucaguuaccaccugucuuagggauaguagauaucaguggugcuuugagaccauuuguguuugcucuguuuguuacugauguagugacaaaccuuuuuuuuuaaugaauuuauuuauuuauauguaugaauacacuguuacuaucuucagacacaccugaagagggcauccgaucuugcuacagaugguuaugagccaccaugugguagcugggaauugaacucaaaaccucuggaagagcagucagugcucuuaaauacuuagccaucucuccagccccagaccuuguuuuuaccaagaaaagucgcauaugugcccacuugacuucauugaagauuuauuuaaggcuuggccugaguaaaccuaggcuuagggguuaauagaugagggaauagaggagaauuuuuauugugcucuagucucuuuaaaugguuucauccuuuuugguuuuuuauuuaaaauuuuuucagucacagagaacccucucucaaaaaacaaacaaaccaaaaaacaaaaacaaaaaaauuuuuuucagucuaauacaguuugaucaugcuuugccuccccuacugccuccucacucucaaaacaaacaagcaagacaaacaacuccaaaauguuggaguagcaaaccaacaagauuuuuaaaaagccaaaacaagauaaaaagcccucuaaaacacaugguugugggguuauuuauuuauuuauuuuugcguuagccaacuacuccugaacaccucauuggaaaaagcagauuuuuuuucccuuugccagcagauaaaaaucgaaaaucacuuccugguuggaguuggguggguagaaccacccauguccccuucccacucuuaguacuggacccucgucuggcuugaacucgugcaugcugccgcagucugaguucauauguacaucaguccuguuauaucuggaagacagagcuuccuuggagucaucccugacccccuaccuccccuucccugaagcucccugggccuggagggggagggguuugaugaugacaucccauucagggcuggaugcuccagcuagguguggggauacacacccugaaugccagcagcacucaggagguagaggcaagcagaucucuugaguucaaguuccauguuguucuaccuagcaagcugcaggccagccagggcuacacugggacgcugucuccaagcaugcuggcgggccucucagugucuacaugcuguggucucuagguuaguuagggcauagcaauauaagcuuaggagcaggauaauaguggauguuccccuuaggcccaguacuauccagucuuggguucuuugccauuucagaggugugguuucagcuuauggucaccuguuggcuuaaaauaaguccccuugaacacaaaguugugaagauguguuccaguuuuauaaauaaauaaauaaauaaauaaaucuaucuggucuugauucuuuuagauguuuugguuuggcaauuaugaaggaguguagccauuuuuuuuucuuuccacuugauggagaagagaaaggauuaugggauuccugcuugguucacuugagauagucucuuggcagucuucaggcgcugucaaagaagcgaggcucgccaguaaacauagacaggucugcuucacagccgccucuggccucggcgagcagagaguugaggggauuuuguuuggccuguuggaggggugcccuaucauuuggacagguuggauagugaguuccucuauguuuuuccacaucuagcuucuaucgauuaaaucuccuauauaggauaaaucuccuauccuauuugguuggcccuucuguuaauuguucgaugcuuauuauccccagaucucacugauaacguacucuugaguccaauagcgugagaaucaucucugucuagaaaaaguuucuuuuugguucucauucagauggguugccccaugguaagccacaggagucacccugaagucuuaaagagguuggaacccauuucauucacccaaauucaguuuuagagacgaggaaagaauacuccaacugcugaagacagcacuucaguuggauagauuuguacuaagugucucugugaggcaagauuuuuguuccauuugccuuuccagaacauuugcuagaaauugcaaaggaauggagaaagggcucccgucucagugggcaggaguaagagccagggcagagacgcugcuacaggagggaaaguggcuuucugcagccuuggaaggagacugccuucagccaugcuuaugauccuuacggccaauaaguggggcuaggcauaagcccuguuuuccauucuggagcccucccagacccccaaacaauaguuuuuaagugacucuccaauccaggguaauccaacguugaguagagauaaaugacauuugggguuuguuuguucauuuauucuucccucccucucuuccauauuuguguuugaagggaaaagauuaaacucuccuaguuaguuuggauaauuaggacuuuugcuugucauuuuuguguccucugugaauaagcaaagcugccacugccuuuuaaugccugccuuuaacugcggucuccacuguuuggagcccuucuaggccgaggucgggcagguacacacacguucugaaaagcaggugguaggagaaaaguguggaauaauaagcccuucugacaggauccaucagcuuaccguuggugcuguggguggaguuauucuuagagccccaguuugaagaugguugugcaaaaacccaucuguacuguugguugccaacauuucugguacaaauauugucauuugcucuuaaggcaaucugcuauuucaguccuagauucaguuuuauaauaugcugagcaaaauagcagaggagaaaaauaccugaagcgguaguguaaucuucagcuuaaaacacacagccguguucuccaguccaggauuguucaucgucucuccuuaacguagcauaaucuacauucaucuuuuucaugcuugccugaggccugacucgcuuguccugacugcaggucaguuaguucuguacccacugagcggaauggcagugcguguguggauacaggauguuaacauggugcuucuuuuaagacugcgcucugagaguauagcacgcccggcuucuuuggcugaaaacaugaaugcacucagaaaccagugggcacggggucaacuacacagaaugaaauaggaagcaggccacucccuaaagagaaucggucaguuugggaggcugaaaguccacagagcauaucacaaggugacgggcacucgcuuucuacuucccaucacguugccuacgucugucuucuuuaagccaccaggaagcagucauggguuuucugcgccugugaccuagucuagccuuuucucagacgcccuacucuaagcaccacagucaguggcucccccucuuaacauacgguguugggggcuaagcaggagugugagaggcagagcaggauugaacugugucuuuagcacuugguuacaaaaauugucaaaugugacgcugcaccacuguucucuacuggugcccuucacugccccaggccucgaguuacagcugucauggagguaccagacacccuggcugagcuuugcauaaggccuuguagaguagguguggggucucuagaagcugugggccugccugacaguguggcuugugagaagcacacacagugagggccagccugacaguguggcuugugagaagcacacacagugaggaucggccugaaguguggcuugugugaugcacacacagugagggucagccugacaguguggcuugugugaugcacacacagugagggcaagccugacagugugauuugugugaugcauacacagugagggccagccugacagugugacuugugugaugcacacacagugggggccugccugacaguguggcuugugugaugcacacacagugagggccagccugacagugugacuugugugaugcacacacagugagggccagccugacagugugacuugugugaugcacacacagugggggccagccugacagugugacuugugugaugcacacacagugggggccugccugacaguguggcuugugugaugcacacacagugagggcaagccugacaguguggcuugugugaugcauacacagugggggccagccugacaguguggcuugugugaugcacacacagugggggccugccugacaguguggcuugugugauguacacacagugagggccagccugacaguguggcuugugugaugcacacacagugggggccugccugacaguguggcuugugugaugcacacacagugggggccugccugacaguguggcuugugugauguacacacagugagggccagccugacaguguggcuugugugaugcacacacagugagggccagccugacaguguggcuugugugaugcacacacagugagggccagccugacagugugacuugugugaugcacacacagugagggucagccugacaguguggcuugugugaugcacacacagugagggcaagccugacagugugauuugugugaugcauacacagugagggccagccugacagugugacuugugugaugcacacacagugggggccugccugacagugugacuugugugaugcacacacagugagggccagccugacagugugacuugugugaugcacacacagugggggccagccugacagugugauuugugugaugcacacacagugagggccagccugacaguguggcuugugugaugcacacacagugagggccagccugacaguguggcuugugugaugcacacacagugagggccagccugacaguguggcuugugugaugcacacacagugagggccugccugacaguguggcuugugugaugcauacacagugagggucagccugacaguguggcuugugugaugcacacacagugagggccagccugacaguguggcuugugugaugcauacacagugagggccagccugacaguguggcuugugugaugcacacacagugagggccagccugacaguguggcuugugugaugcacacacagugagggucagccugacaguguggcuugugugaugcacacacagugagggccagccugacaguguggcuugugugaugcacauacagugagggccagccugacaguguggcuugugugaugcacacacagugggagccagccugacaguguggcuugugugaugcacauacagugagggccagccugacaguguggcuugugugaugcacacacagugagggccagccugacaguguggcuugugugaugcacacacagugagggucagccugacaguguggcuugugugaugcauacauaaggcaguaccuuacagaacagugucacacuaacuacccuucagcauaaaagaugcucgaccugccuucauucauguaaaaaauugcuggcccugagucucuaaguagauuuuuacgacuuuauggauugugaucuagaguuuuagccuggggcagccugcauuuuuccacgaccuucaagucuuggccacagcccugaagucaggagagagguaaaugaauccauauauggaagauucguccugggauagaugggaagggaguucacggucaacuuaaagacacauugaaggauuuagguaguuaaaucaauagucucucuuaguuggucgcaaauauggaacuaguuaaaauuacacaauaaaccaggcagcucugaaaaacaauuuuuuauguccucagugacagacuagacaugauaguuugauacuuaaaauuacugugguuaagccacuuuccugacccugggggacccgauaacuaguugucugcaaaaguuccaaucucaugaaagguaauuccaauuuucauuuccucaaauaugaaucccaccuuuaaccucaaguuggcuggguuuucagaaauauaaagaauuuuggguguuaauaauaguacuugauuuaaagagcaaaaccaaaccaccaucaaaaacaaaacaauuuacauuuugcaaaaaaaaaauuaaaaaaaaacauugucuaggugugaaccaaugugauuugcugggcucagacuggcucuggacagcuuucuuccacacaggcaggcaaggucuuaauuuuugcugguuggcauaaggaacuguaaucuugucaaacucuauugugaaguuaguucaguguguuaaaaggaaauacugcauauuaaaagggaaagcgggggaagaaaauuccaggaaauugaaaggugagguugacauuccacauucauuaauguugcuucuaguguucuuucugaaaaacagcgaugacuucagaauuaacuggcuuucaucuguagccucgugauuguauuucaaggauauccuuucuuaaacaucuaguaaauugccuuuuacaguuugauacugacuaguaaacaguauugcuaacuucauguuucucagaguugguggccaugugcucacuccuuaggaauauucuagaguuucacuuucuuccuguugaagcacagucauguggaauagcaugguugaggugaaaagaaucauggaggugggcuagacuaaacauuagcaaaccugagggauauuuaguaaaaacuccaggccuuacuccacaccaacugaauccuaguaucagaauguuucuaaagcuuucugaccaucgcccaggcugguaaccacucaauuugaaggugaggaaaaggaaauuugcuuugcuuuguuggguaauugaguuagcaguagcaggaggaguagcaggaggagacacucuguugugguggggcauggguuaagggugaggcccugggucagauggcauuuauguuuggguaccauguaggugaaugggagcucccagccuagaggucuuuuuuguuaaaaaaaaaaaaaaaaaagugaguuuugcaaaagugaguuuuguaguuuagagucuuggggaaugugcuugaagcguacauagugcugcucuacaggcuuuugucugugucagcuucaccaaguauaggagcagcuagaagucccgccuuuagacaccccaaacggcuugucggcuuauauacuuaguaccuacauuuuacuccaaguucugacaaauaccacuggucuuccucuaaaucgccuuucuuccucuguagaggcagccacuaaguccagagcagagguccuccgcugcuuucugaagccugggccauggcugagcugacagaugugggcccugaaguccuguguaaaacugcccagccucuuuuaacucacaaagauguuauuuaauacaaaucucacccagugauucaauuaaaaaaaaaaaaaagcauuauauuuuugaaauuuguccaggucccaucuucaccacuaaaagcaggaaaucaaacccauacaacuugaaaaccuuuccaaauugcuguagagagggggagcuuuaaaaaugggagagaugcaagaaguagguggggagguuuuguugcauuuuuaguauagagcauuggcacuugugggaaaauuauuaguugaauaguccagcauuacuuaaugauauuaauugcagcacauaagaaaaauuguuucugcuugcagugagugcaguugcuucgcuguaaucccaacaggugacaguuaaacucuguagcaucaaacaggaagcaggugggggcuaauuuaaguucuguugaugaugaaaggaugcugaccaagaagcagcugguuucccaguuugaccacaaauccauacuauuguauaagggaagccccugccuuuucagccaaccaccuucugucuuuuccuccuccuguuacuucccauaccagacuucacauuccuucaucucaguuaaugucagcucuuaaagaggcagaggagguuuggucuguuguuguuguuguuguuguuguuguuguuguuguuguuguuaaagacacugauguuaucuuaguuuuuuuaguuucucauguuuggggaaggacagaugucugugggaguuccuuuacagucaguagucugacaugcaugcccugacagggguugucuuuguccuuucucucauuucugccaucaagggccacagaauacucgggcuucuugggcaccuaggucagguguguucuuugguaaggaacuugggcaacucugaagcuuccagcuugagucccccuugagcuuuggggauacuuacaucucacaaaugccuuugaagccguugcaucuauuacaguuaguaccucuuaugggcaguucagacaggcaagaaagcaaaucauaagauuuaaaaaagauauccacaagucauggcuacaaagaagauacaguccggguuaaacacuuuuacuaguuuguauuaauuauacauauaaugaguucuaguauaauauuuuauaguauaauauacacguacauaauguauuuucacuauaaucucugucuugauuaccaucguucuauuagauuuuuuucuaacauaugugccacuaaauauugguuuugaaauauaguaggucaaaaagagcaguuagagaaccaugacaucuguauguuugugcuugcacauacuggcaguuuauuaacccaucugaccucuaugccuacuaagcaaaaagccguaaauuuaguggaguuuguuuaauuuucuuugcuuuguauauaaauuagcacaaaacaauuuaucagaaguuuauuuuaaaaauaaauaaaucucauuuaaguuuauaccucaaguaggcuuccuuaacgaauuguuuucaccacaaaaggagccauuauuuuugaagcauauguuaaagagugcuagaccaugguggacuguuugaugauagguguucucugggaaacuggggaguccagagagugcacuaagaugcucacagcugggggacguuuaucagucagugaaagcaggccugcuugugggugccccagagaguguuuguccugucugucgcagccucuaccucugcuauguuguacgggagagggauuuaaauagaccuagcacuguucuuggucugcccagaaccagcguucuaggggcguuuaucaggugcacuagguaaaaacguguggcaggcguuggcacucagaucaggcggcccuugugcacuuaaugcagugugugacaaagcaccuuccccugcaggacagccucacugcaauacuuaguguucaacucuacuuuaaacuauugucuugucauuuaacugggagcuucagggaagguccaguguggaggucugagggcauucucaggagucaguucuccccgucuacuuugacaucuugaaguagguuucuuuagaccagacagaagagauacaggaaguaucuuagaaccgcucccucccugguccaggaccaaguugcuucucacucaagugaaguuguuccaggcauuugugugucacacguguuuuugaauccaggauguagaaauaagucuuuugcuuuuuuuuguugugagucaggguaguacacuguaggccagaaugggucaaccucccggaaguccucugcugagccuccccagcacucguguugcaucugcacccccacauccaacuaaaaccugaaauggcggagugagcuggagcuccuuuucuugacacguacucaacugucuucaugaguugaccuauuuauuagagucccuuuguuugauaguagcugugacuucugggcacagugcucagcugcuuuguggaaggacaaaggugugaagucagaggcggggcuccucaugguggaaccaaaaaggcaggcgggcaagaccucucugcugaggaaggcuccugccacugucaccugcuuuuacuguugaauuaagcguuagggaacugaggaggcaggccaucuccauugagacucacacugguccaggcuaaccauggucugucuugcucauagauucuuuucaggaaccuaucacagucuugucuaaagugggagaaauuuguuaucaguaugucuguguucaugauaaauaagucauuguuacauugcaaggcauuauuucccuuaauuuccuuuaagcuguggagaaacaccugaaagauuugggcaauccuagauaguaaccucaagaaacaaaaaugaaccaucacaguauaagaauugagcuugugugccagauguuaagaacaaagaauaaaauguuugaaaacaggagccuuuguggagggagguuuuuaaaauuuguuuuuaacaaauaguccucauuccagcaucuuaccauuuuaaaugugaggaucggugagggagagcagagcuuuuugucuuauaagucaugagacaaaagaaaaggcuaacugaacaguuuggaagugcuaagggugucccugugccuggagccugucuucuucaucacacaggccacaccaccauucuuaagccaaagaugcuuuucaaguuggagacagcagucuguucuuuuuaauuacuggccguguguguguguguguguguguguguguguguguguguguguguguguguugcccauuucuuuauaagcagacuguguaucuaaagcauuaauucuuccucaaauucuuccaaauagcagcuuguuuaggauaaaauuuuagacaggacauucugucgauuguuuuaaucugugaaagcuucguuguucuuaccucugaauuuauaucaacgaguauaacuuuguaaauaauuuggugacacauauuucugacuauacccgugagcagcauagauagacccacagcuauaacucugacaaaguuuccuuucgucuuuuaaacuuccuaaaaacccuaaaguugauauaagccuuucuuuccgcugcgcuugcuuuuauacccaauucaaggucuuuguuggagggaaaucgguccuaaugugcuaguugguuuagauuuuuauuuuguuucuguuuuuuuaauucuuguagccaaauagauaagguaguuaauuacguuuuaaugcuuuguguuuauacaaccauuuuagauuaggggaaaaaaugguauggccuguaaaauagacaaagauuuucauuaggaaacagcagaaucacuuuagcugcaaaugagauuccuuuuaauauccuucugccgguguguguuuaaaagagcuauuugccaagagcaacaaaaaagguuuguauugcgaauaaccaauuagaugacauuugagcuggagagauugcucagugguugggagcacucgcugcucugacaggaccuggguucaguucccagcacacauggcaucccaucagcuaggucugccuucuucaggccucugugggaaccaagcacagacgcccauauacauaaacaaauuuaauagaccuguugggaaggaguugugauugacugcuguggacuuagcaguacuuggucucugccucccugagggguaagggcucuggaggacacuugccagguggguggaaaugggaucaaucccaggagaccaggcuuccuuuugaaacaauuguaagccuguaacaggucacuuuaaaaaugcuaacaguggcaagcuagggaagaccaagauuuuagcucuaucuuccauggggaccuuacuaacugggguuaccacuguauaaaguuggcuuuguuggauuuuuugccauuuaggucagagccuguagaauaucaagcaguucguucuccagguuaacagagguuauagaaggacagugagggggugagugagugggugaguaccugguagguggacuagagggaaagguucaucuguuggagcccuuuauucaaccucacguggauuaagagccuugacuuugggaguacuuccuuucuucccucugugagugugguguauaccuaucaaggcguguuuguggcagugaagaggacaagcuuggcuauugccccuuguuugagacaggaucuccuuucguguucugcuacacuugaucaggcaagcagguccgcaagccugggggauuccaucuucuuguaagagcauuaggguugccugugcaaacugugucugguugugcguggguucugagaauccaaacucguguccucgugguguacauuaggcacuuagcacggagucaucuccccaacccaacaugucauuucugggaguggauaagcacaucacuggaguccauuucacaugcgaauaggaaguuuccucggauaaaaggcuuuccugugccacacaguuaaacuuuauggcaaaggcgaaacaccacuuaucacaguucacuaccuucuaagaaguaaaaccuuggcagaaguaauaucauuuagcacauuuuuugagaaauuucaccccgagcacuuugccucaaauaguaaaugagauauuaguccgaauuguuuguugacuaaggaacuggcgagccauaggcaucuuuauuuucucucagggcuuucauccuccuuuuuaagguuguggcaucuucauuuuccaucuuugguuuuguguguguguguauguguuuguguguguuuugaguguuuuuuuuuggggggguucaaggcaggguuucucuguguagcccuggcuguccuggaacucacucuguagaccaggcuggccucgaacuucgaaauuugccugccucugccuucuaagugcugggauuaaaggcgugcgcuaccacugccaggcuccuucuuuguauguucaugaacgcuccauuccuuuaugcucucaggggcgcuuaagguguaauuuuuuaaaguuaaauggucaggguauuagaauauaugaucacagcuugaguuccagaacccugccuaggggcuacagggagugaagaaaggacauauauggggacauacacagacacacacacacacacaagcauugacuaugggaccuagccaaugggacgccaugugugcuuggagcugaacccagguccugucagcagcgagugcucccaaccacugagcaaucucuccagccucaaaugucacuuaauuggucauuuacaauacagacuuuacuauuaccagacagccggaaacuucaguguauggauuagguauagcacagggggaaggguuaacuagucugaguaggaggucucugucaggcuguaacugccccucugcgcacacacacacacacacacacacacacucacauacacucacacucacacacacucccuagauuacaaagcaaaaguugcuagucuuugcacacacugauaaguauugguucauaaagaaucauucuuagacuuccuaaaaaagcuuugccauuucucucuugccuggcccgaauggguaauggcuuugccaauuucccaugggccaauuggucuuggaguccuuaacaggcagugccuguaucauuauucguuugcucagggcuucuuccucagcuccuucaucucccuuucccauuccuuaugaaucuccacacuuaguugaggucagguucaccucagucuccacacugaagauggucaggaguaacaugacagccacugcauaccaacaaaacaaaaggaaugcccuauagguuaaagggaguaaggccccaaagcucacuaaguauugcuuuuuguaauauuagcaagagaaauggucugauggugagccuuuuguguuuuuagcaaaugccaaaacaguuggacuguguauuugcugccguuauugaguccaagcagaagauggacccaaaucacuucccagcucuggcuuuacuugaagaaguucuugucacacacacacauugcuaauccaugugauguauuaaaucauacuuaauuugcagggcuauagccuacucugaauaauugauugaagcccacuggaacuucaggugauuagaauaguaccccucaaaacaaagggaaucguuaaguaggggguauuaaagaguuguaaccaagcugcuguuaaaaagcuguggucuacaaauauaaguccaguaagcuuuuuccacgaccaguuuuaccuguauggauaugauuaucagccaucugagaagugugacugcugaguuauuccccagucccacgugucuucagaccugaaaucagguucuucucuggacccuagcggcgauuccacaccuucugggaagacagaagcagauguguucuuccucaucagcacggcggggggggggucaaggcaucuucuggcacaucugucuaagugcacaucaggucucacucuccuguucuguagcaguggggcugucuucuguacagucuaaaucuuuuaauguaauaaggccuuguuuagagaaaucuucuagagaaaggcuuugccauuccucuggagccugacccauauggguaauaacuuugcccaguuuccagugggcuaguuggucuaggaguccucaacaggucaugcccagaucaaaguccacauccacccaggacuucccucaggcaggguuuccuccacuccaagcagaucugugccauguggaauuuaagaagccaugaguugcauccacaacaguagucccccuagaguaauacugacggucaauauuggagaacaagcaucauuuucauaguugcuacucacauaugcugcugcauuugucaacaucaugucuucccucuccugaagcagucuuguggacauucugaaauaggcugccaaagauaaagauaucaaaaauacucuauaaacacucccagaauuaaaucuguaaucuaugugaggaggaaaaaccacgaggauugcaguucagcugugagaacguggaaacaagccugaggaagccguuaaacaggaaguuugugaugaaugacuuaaucgaguuggaacuauucaugauggcuuaaaaauuccuguuuauauauuccuuacuuccuauaacaaaguagccaguuuuauuuccuuauguuugugucaagugauacccaggcccuuccaugcauacaugcuaccccacucuacccuguguaguccucugauagccauugacagguguuaagagccaauacucauugagacccugacugacucauucuaggaccaccuccaucucagggaggcuucccaugcuacccacgaguccccucgccucuccuuuuugcugcuauuuuacaugacaacuguaucucccccacccuguguacuauggaagaucgcuuuagaggaauuuucuuuacucuggaaugcuuugaauaagaugaagcacuuuggagcaaaaugggaauccacagcaguuugguaacuacaguuccaugucagauggccuagaaagacggucgugucuuagaguguagaccagaugaauggugaguguuagagcuuugaggacagcuuugggaucaccagagaagugucaggacuuuaguguagacagguuaugguuuagagggugcucaggugagaauagagcucugaaaugaaaccaucuuuauggagaaaaagcaaggcuucucuuacaacaugcuuuugagucaaauuucauguacacuauuaacaauuuaugucuaaaugcacacagacugucgaguaaaugucucaugauuuccuucucacaagcacacuggacacuagucauuauuaguaguaacucaaaucggaacucugaguaguggagugggcuuugcuacucugaaucuugaguguguuuucacauagcaguguaaaaaggaagcacgagguggcaucgauaguugcugggugucuguaacagcugcacacaauuagaaagcucaaaaaugagggaaaauacuuugggaaaaucuaguuugucuagcauuuuuuaaagaauuuccaaaauuccuacaacugggcgcuuuuuagccauauguuccagucucugagcaugagauucuuuguguuuguugucgacaccuaugcagucagguggcacuucucagcagacgggggucucuagggaccauuucguuuuccuugugaguucucguagccucuuuacauaggcuuucccugggaaaaugcauaccugaaacucagcguagcuucugucauaaagcacccacaggguagcaagucuuauuguguacauugacuagccauuagggcaaacgcuggguuuuauaaagcaguaagugcaaugacuacuucucccccaguguguuguguacucauguuacuccaguguguugcuuugcuucuugauacaagugaguacuaagaggugguuuugucagcuugcagcaguguaguagggaaucacaaagucuugcccgaguucuagcuaaugggagggagcuucuuucugcucuaguuucccccuuucuaaagugugaccagugacaccugucuacguguagacuaccccguagggugagaagagauguagccacaacaguacacuagaaaggaagagccguaagguacaaaggccaggauuucaugagcaaggugcaaucagcauaaauugcugccuggugguuauuacuguauggaaagaaagaccaagggugcaccuagaauugaaaaguagaaagaaauaggaaauguaaaaagacccaggccaggccagcagguaguggccuucgcacggcugagaagcucaagcgcuaaaguaugguucaggucagacgccaggguucugagagccagggaccuggcaaucaggaugaagagagaugccucggaagcaccagauccagcaggugacaggaacugaaaccaguaagcaggggcagggcaggguuuccagcaggcuuaggggguggugagaggcaggcacggagucuauguuugacuaacuuaugacucgguccucaccuccgauuuuuguuggagauucagcauuccuagaagucuacuaugauggaugaguaguuuccaauguuuuguuuugcuuuuaaaucucaugcccuuuuuugauagggcuucaaguuguucaugcaguucagauauauuauguauguucuauagcacauuguuagacauaguuuuuugugugagauuuaaaacuucaagguaaaugcauauuuauagauucugcacuucagugauugccugauaauugcuuuugacugggaggauaaaaacaucuugguuggaagaacaaagaacaaaauaacccuguccugugucucuaugugccugacauuucccacccuaggacaguacaguagaucucauucaaaaccgacccaguggagagacccagcuauggucauuaaagcagaucuguuuuggccagccaggacuagaaaacugacuguaguguguaaauuuaggcaauguguguguugagaaaccaucagacccuuccuugacacgaguugcuauuucccauaaauaacaugaaugcuuuauacuaguuggaacacuggaaucugguuaucuuauauguauaucuuauauacauguacaaaacauuauuauucuaaagaugcugguguccuaguaguguuauuaacuaacuucauuccuauugauggagacgggcauuuuuacacaugcugccuuguugaguauguugaacuguccuugacauagaagcugaggaaguugacggcuccuagaaagcucugugggggucaucuguugguuugucaaaugacucuuacuauucccuuccuuucacagaaccucuggaggguagccuggguccuccuuccuuccuauuuccuuuucugcugucuguaccaugagcuguccuaauguggaacaugaaugguagaugccuaagagaugccuaaaaccucacaucuucccuguaauguuuuuggggugucagucaacaaaguuuuauugagcucauguguguagaacaccuguuagaggcuuugagguuagaaacuuaaguuuaaucuuguguuuaaggaacuuggagucuggucuauaggggcauagagcagagugcucaggagcagaacagguugagcaucgggguacaccagguuugugucuaccuuucuggcagaacuggcuugugucaggcucccuuagcaugugcuugcaguguucagccauccagaagcaucaggaaugugucugcggcuccccugagcccagaaagccagcagggagggcagugugguugguacagagagaugguugccuuggcccuucucuagugguaucguacagacacaggcuuugaauaaguguguagcacugguugucuguuuccucacagaaugcuugcugggagagaaugcugagaguauaaaaucccagagcuccaucaguugcaggcagcucccagcagaguauuguggacauagcaccucaagccugcuccucuuuagugucccacuggcugcaugaaaaacaggaauuuauguaacaagcucugcacagcaaacguuuuccuguuguggggguggguggguaauuguuggcaaaguuaguauacagcucuguuacacagagugaccugaaauguccucagaaaaauauguagugcgauauuuugauaaguuaaggauugcuauguccaaaaaaaaaaaaaaccaaaaacaaaaacccaaccaacaauaagcagaagucguccaagcauuuaguggauacuaacccugaaguuagugaacuauuuuuaaacuuuuuaggagucuucguuauuaugucuucuuugguccugcugaaaacgccccccaccccagcccuggcgucuggcagaacugccucaggcuuauagagcuguaccccccccuguuagucaggcagucaggaagcugaucucuggaaggaucgccuccuauacucucuguauuauuaacuaaaugugacaggaccggagcaagcucccucucuuguagaggccuaucagagcuuaucuguguggcuauuguguuuaaagaacaaauugucauggaagauacggugcccagacucccagcauguagguggcuuuggagaaugcaguuacagggcuggcugcuuuccaggccuugcccaggcaggcugcugcuuuuuaaggaggaauuggggauuuugaucacugguuuugguggacacaguagccagagcuguagcucugguggggguaggaugacagggagguggggacaaggaauguuuuugagaauacauggaauugagauacaacgugaaagaaauguauuccuuagccuuuugggagauguuuggaguucacgaccucauaacacaccuagagcugagauagaucguaagugaaagaacagaaugaagccucaggagagacuaccacugccacauacccacauaccugccuggcauccaaccagaaagcuccuguugggccaugucugauccgcccucacucugcacccuggcagcaggacuuaacacauagcuguuguguugcaauccuuggguggaauguagugcagaaugcauuuugaaauaaggguuucuaagcucucuuaggucugugucugacuuuugucucuuuuuacuaagugagauuaccauuacacucacuuuguuuuccaucucuuguugagaaaaggcacuaaugugcucagggucacagagaagucuggcccuguauauuguucugaucugguagaacgguuggcacuuuaagcaccuucagucgccgucaacaacaugaggaugugggcacuguggcugccuccuugggugaccacaaaucuaguuagagccuuuugugguccaacaggggucacagaguauuugggcaacuaagccuuguacuagguuggcagagaaggccaaaaauuugagaagccaggugcauagcucugcauagcucugcucugaggauugugagacauccagaauucugucccuggacugggcauuaggccccuucagagcugccaggugaauauguagcaacugugcuggggcaggaagccuaaguguucuucacauucccagauuuguaccacaggaucccccaaacgucagaagucaugcuggggguuccuugccuuccucuuguauucuccuguggguuugcaguuugcacacauuugcgguggcuuuguuguaguauccuaucagcacauccacugaguaggagcagaagggccucaccucacuuaggggagcuugcuucagcccggccccccucuaguuaccacucuggacggcauacucucuacaguguccuaaaguuagugcuuugcuuagagcagagauguucucacauuugaauauugcauuuuguggcaaguuaacuuucucaagaaaauagcuuuucuuuauauucauuuuuauuugccugauacaaagacucugguguaaacaaguuuaaguccuaacuuucgggggaaucuaucuaucuugggagugaguuagauaguucaaacuagccccagacucacucaaaaccccgcugccuuuucagcugagauccuaaguugauacuguguauugcuuuggguuuuuguuccugaguaggaauagauccugcuucaucucccuuuauguuacccuaugggcccaaugacagagaaugucacuuuguagaaaugguguuuauuucaccugaaaaaauguugagaagagcuuuguuuuugagucagggucaaaaacuguauaaaagaaauauaugaaaaucaauauauguguauaugcauguauaaaagagaauauaaacuaugagcuuauuuaacuagagaaauaauuccuuuuuuuagaugcuguuuuuccuccaucaacuugcgaucucuuacugaguuuauuacugcuguugagagccagugagguagcuuguuuugcugcacaaguuuuauucucagaacccaaguaaagguggaaggugaaaagagacuccaaaagcugucuucugaccuccacacaaauuacgagcuguuaggcugcucagaaugggcacuguauaucucugauccccauugagcaguaaguuuuccaaggggggagugcugcacuucuaacauacuguuuugcuuugcagaauucaauucgccacaaucugucccuucacagcaaguuuauucgagugcagaaugaaggaacuggaaagaguucuugguggaugcucaauccagagggaggcaagagcggaaaaucaccccggagaagagcugcguccauggacaacaacaguaaauuugcuaagagccgagggcgggcugcuaagaaaaaagcaucucuccagucugggcaagaggguccuggagacagcccugggucucaguuuucuaaguggccugcgaguccugggucccacagcaacgaugacuuugauaacuggaguacauuucguccucgaaccagcucaaaugcuaguaccaucagugggagacuuucucccaucaugacagagcaggaugaccugggagauggggacgugcauucccugguguauccacccucugcugccaagauggcgucuacgcugcccagucugucugaaaucagcaauccagaaaacauggagaaccuucuggauaaucucaaccuucucucguccccaacaucuuuaacuguguccacccaguccucgccuggcagcaugaugcagcagacaccaugcuauucguuugcaccgccaaacaccagucuaaauucacccaguccaaacuacucaaaguacacauacggccaauccagcaugagcccuuugccccagaugccuaugcagacacuucaggacagcaaaucaaguuacggaggauugaaccaguauaacugugccccaggacucuugaaagaguuguugacuucugacucuccuccccacaaugacauuaugucaccgguugaucccggaguggcccaacccaacagucggguccugggccaaaauguaaugaugggcccuaauucggucaugccagcguauggcagccaggcaucucauaacaaaaugaugaaccccagcucccacacccacccuggacaugcacagcaaacggcuucggucaacggccguacccugccccauguggugaacaccaugccucacacaucugccaugaaccgcuugacccccgugaagacaccuuuacaagugccucugucccaccccaugcagaugagugcccugggcagcuacuccucggugagcagcugcaauggcuaugguaggauggguguccuccaccaggagaagcucccaagugacuuggauggcauguuuauugagcgcuuggacugugacauggaguccaucauucggaaugaccucauggauggagauaccuuggauuuuaacuuugauaauguguugcccaaccaaagcuucccacacagugucaagacuacaacacacagcugggugucaggcuaagaguuagugagcagguaaguuuauucacugcaguaucaagaggccuuuugaaaaagggacacaguaccaugugucuuccuuccaugguuagacauuaaaaaaauaaaaauaaaaaaaauaaaaauaaaaacguaauuaaagacagggucuuauguaacucaucccuaccaggccuggcuuacuuggugcuggggucuaacccagggcaacacugacagagcuaugcccaggguugcauuaggcuuucuucuaaugccaucugguugcaggugcuuaccuguuauuguccuccccucccucccucccuccguuuaucaguuugccuuuugggguuaaaauagagugcagauugcuuuagcagcuuuuaagacuuucuuuucacuguaggauggguugugcuuucugccagcucuaaaauaaauggacacauuggaaucaaaucagaugccaaaggucuuuucuuuuccucccauuuuuucucaauaaagaaaaaaaauguacccauugaauaauuuuguagcuguuugagaaggcuggagcuuccccuacccccaacuugauuaaguacaauugaguugaaaaugacuauauuuuuauuguguguguuuuuccccuuuaggcuacauuuaaaaguccuucagauugucugacagcaggaacugaggagcaguccaaagaugcccuucaccccuccuuauaguuuucaagauuuaaaaaaaaaaaaaaaaaaaaaaaaaguccuuucuccuuuccucagacuuggcaacagcggcagcacuuuccugugcaggauguuugcccagcguccgcagguuuugugcuccuguagauaaggacugugccauugggaaucauuacaaugaagugccaaacucacuacaccauguaauugcagaaaagacuuucagauccuggagugcuuucaaguuuuguauauaugcaguagauacagaauuguauuuguguguguguuuuuuaauaccuacuugguccaaggaaaguuuauacucuuuuguaauacugugauggucucaagucuugauaaacuuugcuuuguacuaccuguguucugcuacagugagaagucaugaacuaagaucucuguccugcaccucggcugaaugacugaaccuggucauuugccacagaacccaugagagccaaguagccagugaucaaugugcugaauuaauggacuugucaaacuuuggggcagaauaagauuaagugccagcuuuguacaggucuuuuucuauuguuuuuguuguuguuuauuuuguuauuugcaaauuuguacaaacaacuuaaaaugguucuaauuuccagauaaaugacuuuugauguuauuguuaggacucaacaucuuuuggaauagauaccgaaguguaauguuuucuuaaaacuagagucuacuuuguuacauugucugcuuauaaauuugugaaaucagagguauuugggggcugcauucauaauuuucauuuuguauuucuaacuggauuaguacuaauuuuauaugugcucagcugguuuguacacuuugcgaugauaccugauaauguuucugacuaaucguaaaccauuguaauuaguacuugcacacucaacguuccuggcccuuugggcaggaaaguuauguauaguuacagacacucuguuuuguguguagauuuauguguguauuuuaaagaaauuucaccugcuuuuauuacccugugaguuguguacagcgcauagcaccaagucuucagauagaugccacgugcuuacagccuucuagggaagccugccagaugaugcccugugucacgcugucauaguucccaugggaacucugucugucgcucaggaaaggggaacuuuuaucuaaggugauguucuuugucugacugggguucgccuccuacuacucugagcuguuggcuuuugucacgauggagguggcuuuguggcucuguccugaagaauccugucacuucucgguccccaccucuguucucuuuggcucugaacaguguaaaucuaaggaggaaguuuacaaauaggacuucagugauuuauggagugcucugugcgccuaaguacagacaguggcaggauuaguuaaaaaugaaggcaguaaacuuggaaaccagccagcuauaaauggacauuuauuuugaaauccuuagcuuaagaauuugagaaguuuuuucagccuugagcagccuaaugugucucaaacauuuacguuuuuuauacauucuauuuaccugaaauccugccagaccaggauaauugguuuuaccucucauuccguccaucgguguuucccagucucccacaguuugaggaauagauguaccccagcaccccucuuugccuuuaugagaaggccugguuugcaugagaagaccaaauugcacuuccaugagaagaccaaauuguuuguaguguuacuuagcucuccccucguuuguuaguguguguuaacaagaauaaaaugucccugcuuucacccaccguuggccagcuuugucauaggcuucccaccauaacuuucacuauuuuaaacacauauugagccacugcucgucugacuaccuuuguuugggcacuccaaaacaggacuuguuuuagaaaugaacuccuccaaguagagccuccuucaaacagaguagaauuuccuggugucaaagaacccgggucugucucccuuuccuccucccucugccauuucuuaccauugcggaaagagagagccuccguguguaaucauucaguagaggcagcuaccgcccuggcaguggucuaccugcugaaugccacugaaugacuaggaggugucucucccuucagaagcugucaauuucagcagcaaccccuguuuuccuugguguuaagaucccagugugaaucaugggcaguugucuggggcacagugaacuccaggaaaggcuucguaucuguuuugaaaacaaacaucaaacgugugagcuccgaggguccuuuucugggagaauguucgcuuucuggucuauuauuguacaugauugcucugugaaaagacuucaucuaugcagccuuguuugauucauuuccuuugguguguucuguuguuaagagcaaauuguauuauagagcuauuuggauauuuuaaauauaaagauguauuguuuccau

SEQ ID NO: 12307 - RNA, 81166 nt, Mus musculus
auggaaacaauacaucuuuauauuuaaaauauccaaauagcucuauaauacaauuugcucuuaacaacagaacacaccaaaggaaaugaaucaaacaaggcugcauagaugaagucuuuucacagagcaaucauguacaauaauagaccagaaagcgaacauucucccagaaaaggacccucggagcucacacguuugauguuuguuuucaaaacagauacgaagccuuuccuggaguucacugugccccagacaacugcccaugauucacacugggaucuuaacaccaaggaaaacagggguugcugcugaaauugacagcuucugaagggagagacaccuccuagucauucaguggcauucagcagguagaccacugccagggcgguagcugccucuacugaaugauuacacacggaggcucucucuuuccgcaaugguaagaaauggcagagggaggaggaaagggagacagacccggguucuuugacaccaggaaauucuacucuguuugaaggaggcucuacuuggaggaguucauuucuaaaacaaguccuguuuuggagugcccaaacaaagguagucagacgagcaguggcucaauauguguuuaaaauagugaaaguuauggugggaagccuaugacaaagcuggccaacggugggugaaagcagggacauuuuauucuuguuaacacacacuaacaaacgaggggagagcuaaguaacacuacaaacaauuuggucuucucauggaagugcaauuuggucuucucaugcaaaccaggccuucucauaaaggcaaagaggggugcugggguacaucuauuccucaaacugugggagacugggaaacaccgauggacggaaugagagguaaaaccaauuauccuggucuggcaggauuucagguaaauagaauguauaaaaaacguaaauguuugagacacauuaggcugcucaaggcugaaaaaacuucucaaauucuuaagcuaaggauuucaaaauaaauguccauuuauagcuggcugguuuccaaguuuacugccuucauuuuuaacuaauccugccacugucuguacuuaggcgcacagagcacuccauaaaucacugaaguccuauuuguaaacuuccuccuuagauuuacacuguucagagccaaagagaacagagguggggaccgagaagugacaggauucuucaggacagagccacaaagccaccuccaucgugacaaaagccaacagcucagaguaguaggaggcgaaccccagucagacaaagaacaucaccuuagauaaaaguuccccuuuccugagcgacagacagaguucccaugggaacuaugacagcgugacacagggcaucaucuggcaggcuucccuagaaggcuguaagcacguggcaucuaucugaagacuuggugcuaugcgcuguacacaacucacaggguaauaaaagcaggugaaauuucuuuaaaauacacacauaaaucuacacacaaaacagagugucuguaacuauacauaacuuuccugcccaaagggccaggaacguugagugugcaaguacuaauuacaaugguuuacgauuagucagaaacauuaucagguaucaucgcaaaguguacaaaccagcugagcacauauaaaauuaguacuaauccaguuagaaauacaaaaugaaaauuaugaaugcagcccccaaauaccucugauuucacaaauuuauaagcagacaauguaacaaaguagacucuaguuuuaagaaaacauuacacuucgguaucuauuccaaaagauguugaguccuaacaauaacaucaaaagucauuuaucuggaaauuagaaccauuuuaaguuguuuguacaaauuugcaaauaacaaaauaaacaacaacaaaaacaauagaaaaagaccuguacaaagcuggcacuuaaucuuauucugccccaaaguuugacaaguccauuaauucagcacauugaucacuggcuacuuggcucucauggguucuguggcaaaugaccagguucagucauucagccgaggugcaggacagagaucuuaguucaugacuucucacuguagcagaacacagguaguacaaagcaaaguuuaucaagacuugagaccaucacaguauuacaaaagaguauaaacuuuccuuggaccaaguagguauuaaaaaacacacacacaaauacaauucuguaucuacugcauauauacaaaacuugaaagcacuccaggaucugaaagucuuuucugcaauuacaugguguagugaguuuggcacuucauuguaaugauucccaauggcacaguccuuaucuacaggagcacaaaaccugcggacgcugggcaaacauccugcacaggaaagugcugccgcuguugccaagucugaggaaaggagaaaggacuuuuuuuuuuuuuuuuuuuuuuuuuaaaucuugaaaacuauaaggaggggugaagggcaucuuuggacugcuccucaguuccugcugucagacaaucugaaggacuuuuaaauguagccuaaaggggaaaaacacacacaauaaaaauauagucauuuucaacucaauuguacuuaaucaaguuggggguaggggaagcuccagccuucucaaacagcuacaaaauuauucaauggguacauuuuuuuucuuuauugagaaaaaaugggaggaaaagaaaagaccuuuggcaucugauuugauuccaauguguccauuuauuuuagagcuggcagaaagcacaacccauccuacagugaaaagaaagucuuaaaagcugcuaaagcaaucugcacucuauuuuaaccccaaaaggcaaacugauaaacggagggagggagggaggggaggacaauaacagguaagcaccugcaaccagauggcauuagaagaaagccuaaugcaacccugggcauagcucugucaguguugcccuggguuagaccccagcaccaaguaagccaggccugguagggaugaguuacauaagacccugucuuuaauuacguuuuuauuuuuauuuuuuuuauuuuuauuuuuuuaaugucuaaccauggaaggaagacacaugguacugugucccuuuuucaaaaggccucuugauacugcagugaauaaacuuaccugcucacuaacucuuagccugacacccagcuguguguuguagucuugacacugugugggaagcuuugguugggcaacacauuaucaaaguuaaaauccaagguaucuccauccaugaggucauuccgaaugauggacuccaugucacaguccaagcgcucaauaaacaugccauccaagucacuugggagcuucuccugguggaggacacccauccuaccauagccauugcagcugcucaccgaggaguagcugcccagggcacucaucugcauggggugggacagaggcacuuguaaaggugucuucacgggggucaagcgguucauggcagaugugugaggcaugguguucaccacauggggcaggguacggccguugaccgaagccguuugcugugcauguccagggugggugugggagcugggguucaucauuuuguuaugagaugccuggcugccauacgcuggcaugaccgaauuagggcccaucauuacauuuuggcccaggacccgacuguuggguugggccacuccgggaucaaccggugacauaaugucauuguggggaggagagucagaagucaacaacucuuucaagaguccuggggcacaguuauacugguucaauccuccguaacuugauuugcuguccugaagugucugcauaggcaucuggggcaaagggcucaugcuggauuggccguauguguacuuugaguaguuuggacugggugaauuuagacugguguuuggcggugcaaacgaauagcauggugucugcugcaucaugcugccaggcgaggacuggguggacacaguuaaagauguuggggacgagagaagguugagauuauccagaagguucuccauguuuucuggauugcugauuucagacagacugggcagcguagacgccaucuuggcagcagaggguggauacaccagggaaugcacguccccaucucccaggucauccugcucugucaugaugggagaaagucucccacugaugguacuagcauuugagcugguucgaggacgaaauguacuccaguuaucaaagucaucguugcugugggacccaggacucgcaggccacuuagaaaacugagacccagggcugucuccaggacccucuugcccagacuggagagaugcuuuuuucuuagcagcccgcccucggcucuuagcaaauuuacuguuguuguccauggacgcagcucuucuccggggugauuuuccgcucuugccucccucuggauugagcauccaccaagaacucuuuccaguuccuucauucugcacucgaauaaacuugcugugaagggacagauuguggcgaauugaauucugcaaagcaaaacaguauguuagaagugcagcacuccccccuuggaaaacuuacugcucaauggggaucagagauauacagugcccauucugagcagccuaacagcucguaauuuguguggaggucagaagacagcuuuuggagucucuuuucaccuuccaccuuuacuuggguucugagaauaaaacuugugcagcaaaacaagcuaccucacuggcucucaacagcaguaauaaacucaguaagagaucgcaaguugauggaggaaaaacagcaucuaaaaaaaggaauuauuucucuaguuaaauaagcucauaguuuauauucucuuuuauacaugcauauacacauauauugauuuucauauauuucuuuuauacaguuuuugacccugacucaaaaacaaagcucuucucaacauuuuuucaggugaaauaaacaccauuucuacaaagugacauucucugucauugggcccauaggguaacauaaagggagaugaagcaggaucuauuccuacucaggaacaaaaacccaaagcaauacacaguaucaacuuaggaucucagcugaaaaggcagcgggguuuugagugagucuggggcuaguuugaacuaucuaacucacucccaagauagauagauucccccgaaaguuaggacuuaaacuuguuuacaccagagucuuuguaucaggcaaauaaaaaugaauauaaagaaaagcuauuuucuugagaaaguuaacuugccacaaaaugcaauauucaaaugugagaacaucucugcucuaagcaaagcacuaacuuuaggacacuguagagaguaugccguccagagugguaacuagaggggggccgggcugaagcaagcuccccuaagugaggugaggcccuucugcuccuacucaguggaugugcugauaggauacuacaacaaagccaccgcaaaugugugcaaacugcaaacccacaggagaauacaagaggaaggcaaggaacccccagcaugacuucugacguuugggggauccugugguacaaaucugggaaugugaagaacacuuaggcuuccugccccagcacaguugcuacauauucaccuggcagcucugaaggggccuaaugcccaguccagggacagaauucuggaugucucacaauccucagagcagagcuaugcagagcuaugcaccuggcuucucaaauuuuuggccuucucugccaaccuaguacaaggcuuaguugcccaaauacucugugaccccuguuggaccacaaaaggcucuaacuagauuuguggucacccaaggaggcagccacagugcccacauccucauguuguugacggcgacugaaggugcuuaaagugccaaccguucuaccagaucagaacaauauacagggccagacuucucugugacccugagcacauuagugccuuuucucaacaagagauggaaaacaaagugaguguaaugguaaucucacuuaguaaaaagagacaaaagucagacacagaccuaagagagcuuagaaacccuuauuucaaaaugcauucugcacuacauuccacccaaggauugcaacacaacagcuauguguuaaguccugcugccagggugcagagugagggcggaucagacauggcccaacaggagcuuucugguuggaugccaggcagguauguggguauguggcagugguagucucuccugaggcuucauucuguucuuucacuuacgaucuaucucagcucuagguguguuaugaggucgugaacuccaaacaucucccaaaaggcuaaggaauacauuucuuucacguuguaucucaauuccauguauucucaaaaacauuccuuguccccaccucccugucauccuacccccaccagagcuacagcucuggcuacuguguccaccaaaaccagugaucaaaauccccaauuccuccuuaaaaagcagcagccugccugggcaaggccuggaaagcagccagcccuguaacugcauucuccaaagccaccuacaugcugggagucugggcaccguaucuuccaugacaauuuguucuuuaaacacaauagccacacagauaagcucugauaggccucuacaagagagggagcuugcuccgguccugucacauuuaguuaauaauacagagaguauaggaggcgauccuuccagagaucagcuuccugacugccugacuaacagggggggguacagcucuauaagccugaggcaguucugccagacgccagggcugggguggggggcguuuucagcaggaccaaagaagacauaauaacgaagacuccuaaaaaguuuaaaaauaguucacuaacuucaggguuaguauccacuaaaugcuuggacgacuucugcuuauuguugguuggguuuuuguuuuugguuuuuuuuuuuuuuggacauagcaauccuuaacuuaucaaaauaucgcacuacauauuuuucugaggacauuucaggucacucuguguaacagagcuguauacuaacuuugccaacaauuacccacccacccccacaacaggaaaacguuugcugugcagagcuuguuacauaaauuccuguuuuucaugcagccagugggacacuaaagaggagcaggcuugaggugcuauguccacaauacucugcugggagcugccugcaacugauggagcucugggauuuuauacucucagcauucucucccagcaagcauucugugaggaaacagacaaccagugcuacacacuuauucaaagccugugucuguacgauaccacuagagaagggccaaggcaaccaucucucuguaccaaccacacugcccucccugcuggcuuucugggcucaggggagccgcagacacauuccugaugcuucuggauggcugaacacugcaagcacaugcuaagggagccugacacaagccaguucugccagaaagguagacacaaaccugguguaccccgaugcucaaccuguucugcuccugagcacucugcucuaugccccuauagaccagacuccaaguuccuuaaacacaagauuaaacuuaaguuucuaaccucaaagccucuaacagguguucuacacacaugagcucaauaaaacuuuguugacugacaccccaaaaacauuacagggaagaugugagguuuuaggcaucucuuaggcaucuaccauucauguuccacauuaggacagcucaugguacagacagcagaaaaggaaauaggaaggaaggaggacccaggcuacccuccagagguucugugaaaggaagggaauaguaagagucauuugacaaaccaacagaugacccccacagagcuuucuaggagccgucaacuuccucagcuucuaugucaaggacaguucaacauacucaacaaggcagcauguguaaaaaugcccgucuccaucaauaggaaugaaguuaguuaauaacacuacuaggacaccagcaucuuuagaauaauaauguuuuguacauguauauaagauauacauauaagauaaccagauuccaguguuccaacuaguauaaagcauucauguuauuuaugggaaauagcaacucgugucaaggaagggucugaugguuucucaacacacacauugccuaaauuuacacacuacagucaguuuucuaguccuggcuggccaaaacagaucugcuuuaaugaccauagcugggucucuccacugggucgguuuugaaugagaucuacuguacuguccuagggugggaaaugucaggcacauagagacacaggacaggguuauuuuguucuuuguucuuccaaccaagauguuuuuauccucccagucaaaagcaauuaucaggcaaucacugaagugcagaaucuauaaauaugcauuuaccuugaaguuuuaaaucucacacaaaaaacuaugucuaacaaugugcuauagaacauacauaauauaucugaacugcaugaacaacuugaagcccuaucaaaaaagggcaugagauuuaaaagcaaaacaaaacauuggaaacuacucauccaucauaguagacuucuaggaaugcugaaucuccaacaaaaaucggaggugaggaccgagucauaaguuagucaaacauagacuccgugccugccucucaccacccccuaagccugcuggaaacccugcccugccccugcuuacugguuucaguuccugucaccugcuggaucuggugcuuccgaggcaucucucuucauccugauugccaggucccuggcucucagaacccuggcgucugaccugaaccauacuuuagcgcuugagcuucucagccgugcgaaggccacuaccugcuggccuggccugggucuuuuuacauuuccuauuucuuucuacuuuucaauucuaggugcacccuuggucuuucuuuccauacaguaauaaccaccaggcagcaauuuaugcugauugcaccuugcucaugaaauccuggccuuuguaccuuacggcucuuccuuucuaguguacuguuguggcuacaucucuucucacccuacgggguagucuacacguagacaggugucacuggucacacuuuagaaagggggaaacuagagcagaaagaagcucccucccauuagcuagaacucgggcaagacuuugugauucccuacuacacugcugcaagcugacaaaaccaccucuuaguacucacuuguaucaagaagcaaagcaacacacuggaguaacaugaguacacaacacacugggggagaaguagucauugcacuuacugcuuuauaaaacccagcguuugcccuaauggcuagucaauguacacaauaagacuugcuacccugugggugcuuuaugacagaagcuacgcugaguuucagguaugcauuuucccagggaaagccuauguaaagaggcuacgagaacucacaaggaaaacgaaauggucccuagagacccccgucugcugagaagugccaccugacugcauaggugucgacaacaaacacaaagaaucucaugcucagagacuggaacauauggcuaaaaagcgcccaguuguaggaauuuuggaaauucuuuaaaaaaugcuagacaaacuagauuuucccaaaguauuuucccucauuuuugagcuuucuaauugugugcagcuguuacagacacccagcaacuaucgaugccaccucgugcuuccuuuuuacacugcuaugugaaaacacacucaagauucagaguagcaaagcccacuccacuacucagaguuccgauuugaguuacuacuaauaaugacuaguguccagugugcuugugagaaggaaaucaugagacauuuacucgacagucugugugcauuuagacauaaauuguuaauaguguacaugaaauuugacucaaaagcauguuguaagagaagccuugcuuuuucuccauaaagaugguuucauuucagagcucuauucucaccugagcacccucuaaaccauaaccugucuacacuaaaguccugacacuucucuggugaucccaaagcuguccucaaagcucuaacacucaccauucaucuggucuacacucuaagacacgaccgucuuucuaggccaucugacauggaacuguaguuaccaaacugcuguggauucccauuuugcuccaaagugcuucaucuuauucaaagcauuccagaguaaagaaaauuccucuaaagcgaucuuccauaguacacagggugggggagauacaguugucauguaaaauagcagcaaaaaggagaggcgaggggacucguggguagcaugggaagccucccugagauggaggugguccuagaaugagucagucagggucucaaugaguauuggcucuuaacaccugucaauggcuaucagaggacuacacaggguagagugggguagcauguaugcauggaagggccuggguaucacuugacacaaacauaaggaaauaaaacuggcuacuuuguuauaggaaguaaggaauauauaaacaggaauuuuuaagccaucaugaauaguuccaacucgauuaagucauucaucacaaacuuccuguuuaacggcuuccucaggcuuguuuccacguucucacagcugaacugcaauccucgugguuuuuccuccucacauagauuacagauuuaauucugggaguguuuauagaguauuuuugauaucuuuaucuuuggcagccuauuucagaauguccacaagacugcuucaggagagggaagacaugauguugacaaaugcagcagcauaugugaguagcaacuaugaaaaugaugcuuguucuccaauauugaccgucaguauuacucuagggggacuacuguuguggaugcaacucauggcuucuuaaauuccacauggcacagaucugcuuggaguggaggaaacccugccugagggaaguccuggguggauguggacuuugaucugggcaugaccuguugaggacuccuagaccaacuagcccacuggaaacugggcaaaguuauuacccauaugggucaggcuccagaggaauggcaaagccuuucucuagaagauuucucuaaacaaggccuuauuacauuaaaagauuuagacuguacagaagacagccccacugcuacagaacaggagagugagaccugaugugcacuuagacagaugugccagaagaugccuugaccccccccccgccgugcugaugaggaagaacacaucugcuucugucuucccagaagguguggaaucgccgcuaggguccagagaagaaccugauuucaggucugaagacacgugggacuggggaauaacucagcagucacacuucucagauggcugauaaucauauccauacagguaaaacuggucguggaaaaagcuuacuggacuuauauuuguagaccacagcuuuuuaacagcagcuugguuacaacucuuuaauacccccuacuuaacgauucccuuuguuuugagggguacuauucuaaucaccugaaguuccagugggcuucaaucaauuauucagaguaggcuauagcccugcaaauuaaguaugauuuaauacaucacauggauuagcaaugugugugugugacaagaacuucuucaaguaaagccagagcugggaagugauuuggguccaucuucugcuuggacucaauaacggcagcaaauacacaguccaacuguuuuggcauuugcuaaaaacacaaaaggcucaccaucagaccauuucucuugcuaauauuacaaaaagcaauacuuagugagcuuuggggccuuacucccuuuaaccuauagggcauuccuuuuguuuuguugguaugcaguggcugucauguuacuccugaccaucuucaguguggagacugaggugaaccugaccucaacuaaguguggagauucauaaggaaugggaaagggagaugaaggagcugaggaagaagcccugagcaaacgaauaaugauacaggcacugccuguuaaggacuccaagaccaauuggcccaugggaaauuggcaaagccauuacccauucgggccaggcaagagagaaauggcaaagcuuuuuuaggaagucuaagaaugauucuuuaugaaccaauacuuaucagugugugcaaagacuagcaacuuuugcuuuguaaucuagggagugugugugagugugaguguaugugagugugugugugugugugugugugugugcgcagaggggcaguuacagccugacagagaccuccuacucagacuaguuaacccuucccccugugcuauaccuaauccauacacugaaguuuccggcugucugguaauaguaaagucuguauuguaaaugaccaauuaagugacauuugaggcuggagagauugcucagugguugggagcacucgcugcugacaggaccuggguucagcuccaagcacacauggcgucccauuggcuaggucccauagucaaugcuugugugugugugugugucuguguauguccccauauauguccuuucuucacucccuguagccccuaggcaggguucuggaacucaagcugugaucauauauucuaauacccugaccauuuaacuuuaaaaaauuacaccuuaagcgccccugagagcauaaaggaauggagcguucaugaacauacaaagaaggagccuggcagugguagcgcacgccuuuaaucccagcacuuagaaggcagaggcaggcaaauuucgaaguucgaggccagccuggucuacagagugaguuccaggacagccagggcuacacagagaaacccugccuugaacccccccaaaaaaaaacacucaaaacacacacaaacacauacacacacacacaaaaccaaagauggaaaaugaagaugccacaaccuuaaaaaggaggaugaaagcccugagagaaaauaaagaugccuauggcucgccaguuccuuagucaacaaacaauucggacuaauaucucauuuacuauuugaggcaaagugcucggggugaaauuucucaaaaaaugugcuaaaugauauuacuucugccaagguuuuacuucuuagaagguagugaacugugauaagugguguuucgccuuugccauaaaguuuaacuguguggcacaggaaagccuuuuauccgaggaaacuuccuauucgcaugugaaauggacuccagugaugugcuuauccacucccagaaaugacauguuggguuggggagaugacuccgugcuaagugccuaauguacaccacgaggacacgaguuuggauucucagaacccacgcacaaccagacacaguuugcacaggcaacccuaaugcucuuacaagaagauggaaucccccaggcuugcggaccugcuugccugaucaaguguagcagaacacgaaaggagauccugucucaaacaaggggcaauagccaagcuuguccucuucacugccacaaacacgccuugauagguauacaccacacucacagagggaagaaaggaaguacucccaaagucaaggcucuuaauccacgugagguugaauaaagggcuccaacagaugaaccuuucccucuaguccaccuaccagguacucacccacucacucacccccucacuguccuucuauaaccucuguuaaccuggagaacgaacugcuugauauucuacaggcucugaccuaaauggcaaaaaauccaacaaagccaacuuuauacagugguaaccccaguuaguaagguccccauggaagauagagcuaaaaucuuggucuucccuagcuugccacuguuagcauuuuuaaagugaccuguuacaggcuuacaauuguuucaaaaggaagccuggucuccugggauugaucccauuuccacccaccuggcaaguguccuccagagcccuuaccccucagggaggcagagaccaaguacugcuaaguccacagcagucaaucacaacuccuucccaacaggucuauuaaauuuguuuauguauaugggcgucugugcuugguucccacagaggccugaagaaggcagaccuagcugaugggaugccaugugugcugggaacugaacccagguccugucagagcagcgagugcucccaaccacugagcaaucucuccagcucaaaugucaucuaauugguuauucgcaauacaaaccuuuuuuguugcucuuggcaaauagcucuuuuaaacacacaccggcagaaggauauuaaaaggaaucucauuugcagcuaaagugauucugcuguuuccuaaugaaaaucuuugucuauuuuacaggccauaccauuuuuuccccuaaucuaaaaugguuguauaaacacaaagcauuaaaacguaauuaacuaccuuaucuauuuggcuacaagaauuaaaaaaacagaaacaaaauaaaaaucuaaaccaacuagcacauuaggaccgauuucccuccaacaaagaccuugaauuggguauaaaagcaagcgcagcggaaagaaaggcuuauaucaacuuuaggguuuuuaggaaguuuaaaagacgaaaggaaacuuugucagaguuauagcugugggucuaucuaugcugcucacggguauagucagaaauaugugucaccaaauuauuuacaaaguuauacucguugauauaaauucagagguaagaacaacgaagcuuucacagauuaaaacaaucgacagaauguccugucuaaaauuuuauccuaaacaagcugcuauuuggaagaauuugaggaagaauuaaugcuuuagauacacagucugcuuauaaagaaaugggcaacacacacacacacacacacacacacacacacacacacacacacacacacggccaguaauuaaaaagaacagacugcugucuccaacuugaaaagcaucuuuggcuuaagaauggugguguggccugugugaugaagaagacaggcuccaggcacagggacacccuuagcacuuccaaacuguucaguuagccuuuucuuuugucucaugacuuauaagacaaaaagcucugcucucccucaccgauccucacauuuaaaaugguaagaugcuggaaugaggacuauuuguuaaaaacaaauuuuaaaaaccucccuccacaaaggcuccuguuuucaaacauuuuauucuuuguucuuaacaucuggcacacaagcucaauucuuauacugugaugguucauuuuuguuucuugagguuacuaucuaggauugcccaaaucuuucagguguuucuccacagcuuaaaggaaauuaagggaaauaaugccuugcaauguaacaaugacuuauuuaucaugaacacagacauacugauaacaaauuucucccacuuuagacaagacugugauagguuccugaaaagaaucuaugagcaagacagaccaugguuagccuggaccagugugagucucaauggagauggccugccuccucaguucccuaacgcuuaauucaacaguaaaagcaggugacaguggcaggagccuuccucagcagagaggucuugcccgccugccuuuuugguuccaccaugaggagccccgccucugacuucacaccuuuguccuuccacaaagcagcugagcacugugcccagaagucacagcuacuaucaaacaaagggacucuaauaaauaggucaacucaugaagacaguugaguacgugucaagaaaaggagcuccagcucacuccgccauuucagguuuuaguuggaugugggggugcagaugcaacacgagugcuggggaggcucagcagaggacuuccgggagguugacccauucuggccuacaguguacuacccugacucacaacaaaaaaaagcaaaagacuuauuucuacauccuggauucaaaaacacgugugacacacaaaugccuggaacaacuucacuugagugagaagcaacuugguccuggaccagggagggagcgguucuaagauacuuccuguaucucuucugucuggucuaaagaaaccuacuucaagaugucaaaguagacggggagaacugacuccugagaaugcccucagaccuccacacuggaccuucccugaagcucccaguuaaaugacaagacaauaguuuaaaguagaguugaacacuaaguauugcagugaggcuguccugcaggggaaggugcuuugucacacacugcauuaagugcacaagggccgccugaucugagugccaacgccugccacacguuuuuaccuagugcaccugauaaacgccccuagaacgcugguucugggcagaccaagaacagugcuaggucuauuuaaaucccucucccguacaacauagcagagguagaggcugcgacagacaggacaaacacucucuggggcacccacaagcaggccugcuuucacugacugauaaacgucccccagcugugagcaucuuagugcacucucuggacuccccaguuucccagagaacaccuaucaucaaacaguccaccauggucuagcacucuuuaacauaugcuucaaaaauaauggcuccuuuuguggugaaaacaauucguuaaggaagccuacuugagguauaaacuuaaaugagauuuauuuauuuuuaaaauaaacuucugauaaauuguuuugugcuaauuuauauacaaagcaaagaaaauuaaacaaacuccacuaaauuuacggcuuuuugcuuaguaggcauagaggucagauggguuaauaaacugccaguaugugcaagcacaaacauacagaugucaugguucucuaacugcucuuuuugaccuacuauauuucaaaaccaauauuuaguggcacauauguuagaaaaaaaucuaauagaacgaugguaaucaagacagagauuauagugaaaauacauuauguacguguauauuauacuauaaaauauuauacuagaacucauuauauguauaauuaauacaaacuaguaaaaguguuuaacccggacuguaucuucuuuguagccaugacuuguggauaucuuuuuuaaaucuuaugauuugcuuucuugccugucugaacugcccauaagagguacuaacuguaauagaugcaacggcuucaaaggcauuugugagauguaaguauccccaaagcucaagggggacucaagcuggaagcuucagaguugcccaaguuccuuaccaaagaacacaccugaccuaggugcccaagaagcccgaguauucuguggcccuugauggcagaaaugagagaaaggacaaagacaaccccugucagggcaugcaugucagacuacugacuguaaaggaacucccacagacaucuguccuuccccaaacaugagaaacuaaaaaaacuaagauaacaucagugucuuuaacaacaacaacaacaacaacaacaacaacaacaacaacaacagaccaaaccuccucugccucuuuaagagcugacauuaacugagaugaaggaaugugaagucugguaugggaaguaacaggaggaggaaaagacagaaggugguuggcugaaaaggcaggggcuucccuuauacaauaguauggauuuguggucaaacugggaaaccagcugcuucuuggucagcauccuuucaucaucaacagaacuuaaauuagcccccaccugcuuccuguuugaugcuacagaguuuaacugucaccuguugggauuacagcgaagcaacugcacucacugcaagcagaaacaauuuuucuuaugugcugcaauuaauaucauuaaguaaugcuggacuauucaacuaauaauuuucccacaagugccaaugcucuauacuaaaaaugcaacaaaaccuccccaccuacuucuugcaucucucccauuuuuaaagcucccccucucuacagcaauuuggaaagguuuucaaguuguauggguuugauuuccugcuuuuaguggugaagaugggaccuggacaaauuucaaaaauauaaugcuuuuuuuuuuuuuuaauugaaucacugggugagauuuguauuaaauaacaucuuugugaguuaaaagaggcugggcaguuuuacacaggacuucagggcccacaucugucagcucagccauggcccaggcuucagaaagcagcggaggaccucugcucuggacuuaguggcugccucuacagaggaagaaaggcgauuuagaggaagaccagugguauuugucagaacuuggaguaaaauguagguacuaaguauauaagccgacaagccguuuggggugucuaaaggcgggacuucuagcugcuccuauacuuggugaagcugacacagacaaaagccuguagagcagcacuauguacgcuucaagcacauuccccaagacucuaaacuacaaaacucacuuuugcaaaacucacuuuuuuuuuuuuuuuuuuaacaaaaaagaccucuaggcugggagcucccauucaccuacaugguacccaaacauaaaugccaucugacccagggccucacccuuaacccaugccccaccacaacagagugucuccuccugcuacuccuccugcuacugcuaacucaauuacccaacaaagcaaagcaaauuuccuuuuccucaccuucaaauugagugguuaccagccugggcgauggucagaaagcuuuagaaacauucugauacuaggauucaguugguguggaguaaggccuggaguuuuuacuaaauaucccucagguuugcuaauguuuagucuagcccaccuccaugauucuuuucaccucaaccaugcuauuccacaugacugugcuucaacaggaagaaagugaaacucuagaauauuccuaaggagugagcacauggccaccaacucugagaaacaugaaguuagcaauacuguuuacuagucaguaucaaacuguaaaaggcaauuuacuagauguuuaagaaaggauauccuugaaauacaaucacgaggcuacagaugaaagccaguuaauucugaagucaucgcuguuuuucagaaagaacacuagaagcaacauuaaugaauguggaaugucaaccucaccuuucaauuuccuggaauuuucuucccccgcuuucccuuuuaauaugcaguauuuccuuuuaacacacugaacuaacuucacaauagaguuugacaagauuacaguuccuuaugccaaccagcaaaaauuaagaccuugccugccuguguggaagaaagcuguccagagccagucugagcccagcaaaucacauugguucacaccuagacaauguuuuuuuuuaauuuuuuuuuugcaaaauguaaauuguuuuguuuuugauggugguuugguuuugcucuuuaaaucaaguacuauuauuaacacccaaaauucuuuauauuucugaaaacccagccaacuugagguuaaaggugggauucauauuugaggaaaugaaaauuggaauuaccuuucaugagauuggaacuuuugcagacaacuaguuaucgggucccccagggucaggaaaguggcuuaaccacaguaauuuuaaguaucaaacuaucaugucuagucugucacugaggacauaaaaaauuguuuuucagagcugccugguuuauuguguaauuuuaacuaguuccauauuugcgaccaacuaagagagacuauugauuuaacuaccuaaauccuucaaugugucuuuaaguugaccgugaacucccuucccaucuaucccaggacgaaucuuccauauauggauucauuuaccucucuccugacuucagggcuguggccaagacuugaaggucguggaaaaaugcaggcugccccaggcuaaaacucuagaucacaauccauaaagucguaaaaaucuacuuagagacucagggccagcaauuuuuuacaugaaugaaggcaggucgagcaucuuuuaugcugaaggguaguuagugugacacuguucuguaagguacugccuuauguaugcaucacacaagccacacugucaggcugacccucacugugugugcaucacacaagccacacugucaggcuggcccucacugugugugcaucacacaagccacacugucaggcuggcccucacuguaugugcaucacacaagccacacugucaggcuggcucccacugugugugcaucacacaagccacacugucaggcuggcccucacuguaugugcaucacacaagccacacugucaggcuggcccucacugugugugcaucacacaagccacacugucaggcugacccucacugugugugcaucacacaagccacacugucaggcuggcccucacugugugugcaucacacaagccacacugucaggcuggcccucacuguguaugcaucacacaagccacacugucaggcuggcccucacugugugugcaucacacaagccacacugucaggcugacccucacuguguaugcaucacacaagccacacugucaggcaggcccucacugugugugcaucacacaagccacacugucaggcuggcccucacugugugugcaucacacaagccacacugucaggcuggcccucacugugugugcaucacacaagccacacugucaggcuggcccucacugugugugcaucacacaaaucacacugucaggcuggcccccacugugugugcaucacacaagucacacugucaggcuggcccucacugugugugcaucacacaagucacacugucaggcaggcccccacugugugugcaucacacaagucacacugucaggcuggcccucacuguguaugcaucacacaaaucacacugucaggcuugcccucacugugugugcaucacacaagccacacugucaggcugacccucacugugugugcaucacacaagucacacugucaggcuggcccucacugugugugcaucacacaagccacacugucaggcuggcccucacugugugugcaucacacaagccacacugucaggcuggcccucacuguguguacaucacacaagccacacugucaggcaggcccccacugugugugcaucacacaagccacacugucaggcaggcccccacugugugugcaucacacaagccacacugucaggcuggcccucacuguguguacaucacacaagccacacugucaggcaggcccccacugugugugcaucacacaagccacacugucaggcuggcccccacuguguaugcaucacacaagccacacugucaggcuugcccucacugugugugcaucacacaagccacacugucaggcaggcccccacugugugugcaucacacaagucacacugucaggcuggcccccacugugugugcaucacacaagucacacugucaggcuggcccucacugugugugcaucacacaagucacacugucaggcuggcccucacugugugugcaucacacaagccacacugucaggcaggcccccacugugugugcaucacacaagucacacugucaggcuggcccucacuguguaugcaucacacaaaucacacugucaggcuugcccucacugugugugcaucacacaagccacacugucaggcugacccucacugugugugcaucacacaagccacacuucaggccgauccucacugugugugcuucucacaagccacacugucaggcuggcccucacugugugugcuucucacaagccacacugucaggcaggcccacagcuucuagagaccccacaccuacucuacaaggccuuaugcaaagcucagccagggugucugguaccuccaugacagcuguaacucgaggccuggggcagugaagggcaccaguagagaacaguggugcagcgucacauuugacaauuuuuguaaccaagugcuaaagacacaguucaauccugcucugccucucacacuccugcuuagcccccaacaccguauguuaagagggggagccacugacuguggugcuuagaguagggcgucugagaaaaggcuagacuaggucacaggcgcagaaaacccaugacugcuuccugguggcuuaaagaagacagacguaggcaacgugaugggaaguagaaagcgagugcccgucaccuugugauaugcucuguggacuuucagccucccaaacugaccgauucucuuuagggaguggccugcuuccuauuucauucuguguaguugaccccgugcccacugguuucugagugcauucauguuuucagccaaagaagccgggcgugcuauacucucagagcgcagucuuaaaagaagcaccauguuaacauccuguauccacacacgcacugccauuccgcucaguggguacagaacuaacugaccugcagucaggacaagcgagucaggccucaggcaagcaugaaaaagaugaauguagauuaugcuacguuaaggagagacgaugaacaauccuggacuggagaacacggcuguguguuuuaagcugaagauuacacuaccgcuucagguauuuuucuccucugcuauuuugcucagcauauuauaaaacugaaucuaggacugaaauagcagauugccuuaagagcaaaugacaauauuuguaccagaaauguuggcaaccaacaguacagauggguuuuugcacaaccaucuucaaacuggggcucuaagaauaacuccacccacagcaccaacgguaagcugauggauccugucagaagggcuuauuauuccacacuuuucuccuaccaccugcuuuucagaacguguguguaccugcccgaccucggccuagaagggcuccaaacaguggagaccgcaguuaaaggcaggcauuaaaaggcaguggcagcuuugcuuauucacagaggacacaaaaaugacaagcaaaaguccuaauuauccaaacuaacuaggagaguuuaaucuuuucccuucaaacacaaauauggaagagagggagggaagaauaaaugaacaaacaaaccccaaaugucauuuaucucuacucaacguuggauuacccuggauuggagagucacuuaaaaacuauuguuugggggucugggagggcuccagaauggaaaacagggcuuaugccuagccccacuuauuggccguaaggaucauaagcauggcugaaggcagucuccuuccaaggcugcagaaagccacuuucccuccuguagcagcgucucugcccuggcucuuacuccugcccacugagacgggagcccuuucuccauuccuuugcaauuucuagcaaauguucuggaaaggcaaauggaacaaaaaucuugccucacagagacacuuaguacaaaucuauccaacugaagugcugucuucagcaguuggaguauucuuuccucgucucuaaaacugaauuugggugaaugaaauggguuccaaccucuuuaagacuucagggugacuccuguggcuuaccauggggcaacccaucugaaugagaaccaaaaagaaacuuuuucuagacagagaugauucucacgcuauuggacucaagaguacguuaucagugagaucuggggauaauaagcaucgaacaauuaacagaagggccaaccaaauaggauaggagauuuauccuauauaggagauuuaaucgauagaagcuagauguggaaaaacauagaggaacucacuauccaaccuguccaaaugauagggcaccccuccaacaggccaaacaaaauccccucaacucucugcucgccgaggccagaggcggcugugaagcagaccugucuauguuuacuggcgagccucgcuucuuugacagcgccugaagacugccaagagacuaucucaagugaaccaagcaggaaucccauaauccuuucucuucuccaucaaguggaaagaaaaaaaaauggcuacacuccuucauaauugccaaaccaaaacaucuaaaagaaucaagaccagauagauuuauuuauuuauuuauuuauuuauaaaacuggaacacaucuucacaacuuuguguucaaggggacuuauuuuaagccaacaggugaccauaagcugaaaccacaccucugaaauggcaaagaacccaagacuggauaguacugggccuaaggggaacauccacuauuauccugcuccuaagcuuauauugcuaugcccuaacuaaccuagagaccacagcauguagacacugagaggcccgccagcaugcuuggagacagcgucccaguguagcccuggcuggccugcagcuugcuagguagaacaacauggaacuugaacucaagagaucugcuugccucuaccuccugagugcugcuggcauucaggguguguauccccacaccuagcuggagcauccagcccugaaugggaugucaucaucaaaccccucccccuccaggcccagggagcuucagggaaggggagguagggggucagggaugacuccaaggaagcucugucuuccagauauaacaggacugauguacauaugaacucagacugcggcagcaugcacgaguucaagccagacgaggguccaguacuaagagugggaaggggacaugggugguucuacccacccaacuccaaccaggaagugauuuucgauuuuuaucugcuggcaaagggaaaaaaaaucugcuuuuuccaaugagguguucaggaguaguuggcuaacgcaaaaauaaauaaauaaauaaccccacaaccauguguuuuagagggcuuuuuaucuuguuuuggcuuuuuaaaaaucuuguugguuugcuacuccaacauuuuggaguuguuugucuugcuuguuuguuuugagagugaggaggcaguaggggaggcaaagcaugaucaaacuguauuagacugaaaaaaauuuuuuuguuuuuguuuuuugguuuguuuguuuuuugagagaggguucucugugacugaaaaaauuuuaaauaaaaaaccaaaaaggaugaaaccauuuaaagagacuagagcacaauaaaaauucuccucuauucccucaucuauuaaccccuaagccuagguuuacucaggccaagccuuaaauaaaucuucaaugaagucaagugggcacauaugcgacuuuucuugguaaaaacaaggucuggggcuggagagauggcuaaguauuuaagagcacugacugcucuuccagagguuuugaguucaauucccagcuaccacaugguggcucauaaccaucuguagcaagaucggaugcccucuucaggugugucugaagauaguaacaguguauucauacauauaaauaaauaaauucauuaaaaaaaaagguuugucacuacaucaguaacaaacagagcaaacacaaauggucucaaagcaccacugauaucuacuaucccuaagacaggugguaacugacgaguguauaacgacacaucauggacuaucuauucagcuauaaaaaggacaacgucuuaccauuuaaacgugagcagaccugaagcacauuauauaagacagcuauacagucucaccaguacaugcaauauagaauguugguuucaacagacgcugacugagcauugcuacuggaggucaggacggggcuuagucaaaggguuuuaauuacagcuggaggggagaaauacucugggugacaggcugacaaagcaugaggauaacaugcuaaguauuucaauaaaagcuucuuaaagaucuugaauguuuuuugaaaagaauauuuaagaggcuagauacucuuucccugauuugaacaucacaauucgaggauguggaaacauuuauuuaccaggugccucuuaacguguacaacuuuuaugucaauuuaaaaaaaugacagcaauaauaugcauuaaaagaaaugucaaacacuucuaucuacucucauaaacaacucaauacaacgcuugccaauuccaaagaagaggcuggcacaaaaugugcauuucuaucccaaguaagaccuucuuuuccaauuaggacaugggaaacuaaaaaaaaguacaaucuguauuauuuuaaaaaccaauuuaguuaauuuuuuauuuacuuagaauucaaaguuugcuaaaaauagacaguacacaguaguaagugucacuaaaaccagaaguacugcaaagaaaagaucuauuucagaguuaaacucaaaggucuguguuguaaaauauuuggucuuuguuauucucucaacacucaauuuggaaagagaaacaugcuccaguuuggguaauuaaccaguaacauaagucaaauaaugaauucugcuaccuccuaaauacaucugaacagauuaccaagucuuucaaagcaauuucaaagcggcacugcagccuugcaggagcugagacacaggaaaugcauguugacacgugcagcucgggcagcuuccaggcggcugcauagaggagcucacagaggagcugcagccaguccuuggagcaggacuagacagcgcccaaaccaaaauguuuaaggcugcucagaaacaaagaugugaggaaggaaauagcagagaggaguuacaaaagccuugcucuuuugucaaguaugcaauuauagaaaaaaaaaaaaagucuuccuggaagucuacauauaagaaugccagcccuuucccucucugccguuuaagaguccuacucuacuccuccaauaacaccucugaaacaagucugaaacacuccuuagaugccgccaccucuggguuagcaggauggcucagcagggaagggcacuuacuguggggccugaccacaccaucaacccccagagccugcccacacaguggaaggggcagugacuucucagagucccacaacugugcuugaaccugugcauacaauaaguaccagauguaauaaaauguuuucuaaaaugccauugcuguccaagagugacugccaacagugacgggcaaucccacucagaugaccaaucagaccucuucuuacauaacaaugaacuagacugagcaguaucuuguaccuaagccacacgagcaaacagacuaagggagggaccuacacuguggccuaaccacacuauuaccugcugcugagauuaauagcuacuucuuacaugaagacuccaggaggccacuguccccaaaacacuccccucaccccccaaaaaugaucacuucucaaacacaccuccucccagguuuaagucaagggugugagagcuuguuaccugucaagugaaugcaggagagagacugccucaaguuuccuuuucauuugccaaccuuggaaagaggcaccagguguaagacaggaagcaaagaaccaggaggcauccuccagccagugaccuuuuggcuacucagugauucaacugagaacacaagacucuuuaaaugcuacgaucauagaauuaagaaauuagagaaggcccuuucuaaguaacccaaccaagagaggaaagaggguggcaaacgugcuuuguguucugcagagcagacuccagcugcccaauaagugauaguuccagagagagaauccugaaaugcugaagaugaaacaaugcuaacaccaagccagagcgccaaggcacuaacucaaucuguuugcucuguggaagcccaguaggcauggggguggggugggagauggggugggggcacacacuaagagcuacuccacuuuaaacaauauaccacaaguaaugccuucucugcagcuuuucucuaaaucaauaaacaagucaacugauaugcuaggguagcaggauacaucuuacauuuugaugguucacucacagccagacuuauaacuacuaaacugcuaagaucacauuaucuuucaagcuaaauucaccuuuccacacuggcuuuuuagcagucucuugcauucuaucacugucuaucuuucugcaguccaugccucugcuuucuggucuuuaaucuauguauaggaauagcacgaugcucaggcucuaaaaaccuuuagacaggacugacagugccacucugcagguccacugaggagaaagaacaguugcuaacuugcucugaccuacagagauguggacaguggucugguuggagauuccacuugaauacaugguacuaugaccuccucccagaagcuaagaaagcaaacucagcucagaccaacugaagaggggacucaguggagagucaaccuaggcugaggcuaggacaggacccaguugguaaacauagcuggaacugaagaaauaaauauuuaguagguccauaaacugacaacacuuaggaacagaaaagccaguuguuuugaaauuucacuguuuugguguucugggugccuauuuucuuguaguaggugucaguguguauuuguauguauguguguguguguguguguauauacacauauacauguauauauaugguugaauaacuugaugcgaaagccacaaagugaguuuuucuguuuugaaggagcaggaagaaauguuccugcuuguggagccccagcugcugacauugcgccagcauacagccucucacucacgccgcacacucagguucuggaccaucccugcccacuccaaauacgcagccaaaaggagcagucuuccugguccuacugaaacugcugguuuagccauugaauuuugaagugcuuugucauucagcaagaacuguacuggucaccucuucuucuucuucuucuuuuuuugaaauauauuuacaugguaaaacauucaaagaaaggcuugacuuuuauaagggucuccuuaaacaucaccucagcguacugccccagaagucagcaagcagcucuucuuguucaacagucacgugccgcaaacaauuagacucuauaacaagucacagcugaggaggagccugcccuguguggacaucuggaacacgcugcuugcauacagacaaaggagauacagugagggcagugcguuugacauggcugacccugcagaaacuacagguguaaacuaaagagcuccaaagcagacaggucuucucuacagacacagugaccgucuuguccugaguggaugcagggcggaacuggcugaaauguaggccuuuugguucaguggcauguaaaauucuccuugagguaagagauuccagugcuaccucagucaaaacuguuagagauauuuccaucuucucaaucacuuuguaacuuaagaaaaaucuaucaaagaaacuugacuuucccguacaugagaaaggcuggauacaaaauggugccauggauugccgacacucaaacuuccaagccuuaguccucccaucuuccccuaagcucugaguagggucuaaguucucaagugcagcacuuaaaaccaugacagagcauuagacauuuuucauuucccaauccauaaauuaaggcuuuguagagaggucagaugacaucucuagacgugugacacugccccuccauaugcagauucuacguacuguaccucuugcacgcagcgucacugccguccccagccuccgagcuaucgcucucuccuccaacagcaacuaguccuagacagacuaacucuaaaaccuaugcccggcccuaugugaauucaggauagcuucuucucagcauauaacaucacuugugagcuuggccugcgggggucuuuaagggagugauuuuaaaaugggguaagcaaagggccagugagaucacacaucagggagaaacacuugacacaggcuugacaaccugagugcauccuuagaacacauaaugaaaggaggaccaauuggcacacacgugcgcaaacacacacacacacacacgagagagagagagagagagagagagagagagagagagagaaagugagagagagaaugaauuauaaacuuguaugaaucacagaccgaucaguguaaaaagcuuccuuguccugaacagugcauggugaaaggcauuugguucccacacuccuucaggucauuucugaggauccugaauuugggcagacaucuuggaggaggucugccuugaauggaagcugcucgcucagagaugagaaccuucugucuaggucacuugucuuuccccggugcucagcagucagucaagcagagaagaacccuugaauacuacuuuacacuacuggcaggcccugacugucuugcuaugaaacacagagugaguguggaaggaagucagccacuccuguguccucugaucucuacacucacacaucacaucucucucucucucucucucucucucucucucacucacucacuuaguaacuaacugucuaagguuuggaccugugacauagcaugcuuuaucuuucucucucaguuaacuuaauaacuaauuguuuaaaguucaggccugugagauagcucgcucacucauacauacacucacauccuuucucucccccucucaauaucuaucugucuaucugucugucuaugcucucucuauguacauuaggugauuuaauacuguuuaagguauuguuuaagggcuugugagauaguccagccaguuagcgcauuuggccucugaaccugaccaccugaauuugaccccaguucccuuauagugaacagagggaacugacucuugcaaauugucaucuaugcaugugcuggaccauguacacacaaacgaacaguaaauaagcaaaauguaauacacuuuaaacaacaacaaaaaaaugccaauuaugcaagcuggguguggucuagcacaucuuugauccuagaggcagaggcagguggaucugcguuugaggccggccuggucuauguagugaguuccagugaccaccaaacaaacagaaaggcuauggcucaggcuggaguuugagugacaauacaauaaagaacugaaaacagucugccuucaacagucucaaguaucaguucucaaggauuucuccaaaauauccaaauccuguaaaacuauggcaccguaaacgccuuacacucuucucugagcgcucaccucaacccaggagccagcucugcacauuuccaaggaacaaagggcacaauggagcuuucccucuuugucauuugucccaaacauugauuaucuaaagaauccuugggguuccaguaaaaucuacuaaaacacagccaacaauccgggcuuuauauccucugagguaauuuacacuuggggcugcauuuuaaggcaucaugucaucacaacacaaccacuuuauaaaagcugccuugaggaaagccaccuacaacugacuuaaggcuuccugauuucacuaccauugaaagaguucagucagccccacucagucuccuaaccauggggaagcgggguacaaagcaagaugucuuggggagaggagucuugguuucuucaccggguucugagauaaaauguccugagacaaaaggaacuugguggagaaagaguuuauugagguaaauguuuucagguuacaguccaucacuggaggaagucagagguaagaguuugagaacguggcuuacgaauagucacauuuuguuaaugcuuucauauccagccuuuuccuuuauaacaaacuuccaucaauguccacaguacuuugugacacagucgggacuaucaucacugaggagaaagccauucaaacccuaccaugcagccuugggaccucucccucauucucugagacauucccaguggagaggugauaggaacaugauaaugucuguuaucagaacccuccauguaauccccuacacacuugucugauauguaagucuccaggggcuuguuuuucuuaguuugaagcacacucacaauagguuagaaccugaaaugagagagcccgucaccaucuggauuacguaaccauggccugccucuaucaggucucugucuaaauguaaauagcuacucugagccaauaggacgccacagaccugcauucuaaaggccagagagauggucagcagcuaaaaguucuugcugagcaagccuugugcaucucuauggggcccuuuucuggauagugugaaagcgccucucucaaugacaugaacgccauccccagcuaagagcccuuucuuucagagguaguagagguaugcuauaacaucuucacuaagaaaguuaaagagcaggcuggcaggcgugugagggacccauucccaaaaugcucugcucucaacuccagagucagguucuagguuucaauuuguagugaguuuuucucuguuucaaaucacaagcuggcagagcgagguuaaagucaacuauaacacgcucucugcagaaucaagacugaagggaagaaucaggaggcugcacuggggacaaauggaagccgagcuacagagagagggcaggcacgcugcuguaaacccugcucacuuuagccuggugguggugaucuuguugagcuugagugucggguaugguaacaaauggguuuggcacugugggacuucuugguuuaguuuuggaaguguucacaaacaauacuuauuucuauauuccugauauauuauuuggaagaaggaacaaaacuaaugaaaucaccaggcaugguggcucacuauuucauuagucccaguacucuggaggccgaggcaagugaauguuggugagucaaggcuggccuggucuacauaugaaguuccaaaccugccaggguuucaucgugagacccugucucaaacaaacaaacaaacaaacaaacaaacaaacaaacaagacuaacaaaagcagcccgccuucccugcuguuacagaggggaagugagcgcagaccacucagacuuaccugcuaauccuuacuugccccaucucuagagcuuucacuccuaacugcaccacuucaaguacagcacaaggacuagcagcuuagguaggaccuuggagcuagucuagauaugacuaucuuuaugagccaucuacaaagguauuuuaguauuuaaagaacaguuaggguaauuuuaagagugccacuaaaaugacuuuccuaugcuaauuaaaaacccuaccuuaaaaagugauguugcuacgcacauuacuguaacauaugcuacaugcccaacacauuccugcauuaaguuguauuaugcucaccgguaaguccucuucucaagggugcguccuaccgcugagcauagugagucugucucuguagucucagcacuuggaaggugagucaagagaacaccuuaccggccuaagacacaccuaucacaaaaaaaaccgaaauaaaacccucccccaccccuccaggcaggcuuccucuggcuauccuugaacucagagcuuccucugacucugccucucaagugcuggaaaaagcugugcaccaccaucaccagcaacaaaauucuucuucauuaacuaaaacacacucugcaaaagaaucuuaagcuugacuucaguacuuauugugugugcgcgcacacacacacacacacacacacacacacacucucacgguuagcugugcaugccaucacacauggagguguguggaacugcuucucuucuuccaugucacacaguuucuagggaccaaacuugucacaaggcuugcucagcaacaacuuuaccugcugacaagacaaucucucuggcccuuaaauacauuaaaaguaaaugcaaaguucuucguaagauauaugcagauagauaaaggggcaaacugcuuaauuuaucaagucaugcuccaucauuucuacuggagaucaaacaucaccauaaacaaaauaaaccauaaucacaaacgaaagcaaacaaaauauacuaacagcaauaaaccuccagugaguagcacugugaaaaacaaacggaaccuuucuggcugggaacacagcucccagaugaagucgagccucgaauuccaucccagcagugcaagucugcaaccccuaaaccguaugcaaagucagccuagugagggagggagucauaugugcgucuccaacugacaagcacuauuucugucuaucaagagaccggguauccccuccaagaagccagccacugugacccacacugugugggcacaacacggagccucagcacagcacuuuagaugaggagcauaacaucacuuuuuauugagguuuaauuuauacaacacucaagaaugcaagugugcacaggcauugaacuugaauauuugucuucugcagcuacuacgcagcucacucuucaaacacuauuauuuaauucuugcuccucaggagcccaucuuccucacagauagccagagcuagcacacauccuucuuuuucacagaguuaugggccaugcgccuucuagggccuggcuuccuuuucugaguaguucuaaaagagcaaugugauugcacagaaaaggagaguuaaaucaaauauccaguguggagggcaucuccaaggcaggagagcggggaaugguugcuggaagcacauaggaaggcaaacuggggaaagcuaaccuuucagggauaaauggucuuggaccacauugucaagauguccgaggagacaagugacugaaggaaggcaaagcugugugcaaugcagcugcuuuccuggagcggagaacacucauggcagcaaaggacaggaagauuagagucugaucaggugugagaugaaaccaugggguacaagauagagaaggcagggacaacugguaguuucucccagauaagagucuggaaaccauuuuuuuuaaaguaguagugacuacuacucacauuauaugugggaaaguggugacacguuuuaagcaacaagucauguagucuccgcugaacugagaaaccagagaaaagcugaggaagaguuguggagacagcgagacaggccagcacugcaaaggccuccacaggcugcauggagaugucaacugagagcaugcagcagggcagagacguggugggacaaggacagaaacgugccagccucaauucgaggagcagcucucucugcacaaggugcucagagcucaacaccuguucgagccgcauucugggacugcugagucagucguccccgucccccacccccaccccccaccccacaaagcacgaggucucagcaucacgcugucuuccagauccuuuagggcaucacuugaaaacuacugucucgcucggcaugcuaaacuuaguaaauuacuguuugggaagacuaaauaguaccccaguacucucaaagaguuaauggggcuuccaaacucuaauuuaguccuagcauaauuuugguaugucagcucuaaccuaauuugcgaaucaccagugggauuuaaagcacuucacuaaauugggcguucaaaguucuggucccugccgggaggucguggcacacaccuuuaaucccagcacuugggagacagaggcagguggauuucugaguucgaggccagccuggucuacagagugaguuccaggacagccagggcuacacagagaaacccugucucgaaacaaacaaacaaacaaacaaacaaaaaaccaaaguucuggccccacugcauuuaacaaauuuuucauuuagauuucuuccucaugcaucuuaagaugauuucaaccaaugaacagugcuccuucaccaugaaauccucuauaaaucaaagauggaaaggggccaaguuggugauucuugauuguggucccagcacucaggaggcugagggacaauggucacaaaguccaguccagccugggcuacacaaugagacccuugucacaaaacuaaguaaguaacugaguaaguaggcaccaugaguccaggugagacuaagacuccugcgugugaagugacucccuucucugcacucgcacuaacuuccauggaugagggaauaaaaauaaacuugcgcauuaaggcagucuagaagauauuaagugagaacucaagaggaggcguuuaccuauuuuucugaauggguaaauaaaacaaggaaaggagaauuuagcuccaaggcaacuggguccuaaagcaccccucuucuguggguuaaagaacacaauuucuguugcaguuaaggcuugccuugaccuuccuauacaacuugggauaaccucgaauuuaugauccuauagucuccaccuccaaaacacugggauuuuaggcaugugucaccaagcugacugucacagcuuaugcagugcugagaacuagaaccaggcaggacuucgugaaugccaggcaaacacucuaccaacaacuauauccccagaccucuucuguaucagcagucugcuugaggaacuggcaagauggcucaacaagcaaagauacuugcuggucgggccuggcccccagaguuugauccauggaacccacuugaaacauuaaaggagagaaugaauacaacaaaguuuucuucaaucuccuagacuuccaaacaugccauggcuggcccaaaugcacacacacacacacacacacacacacacacacacuuuuaaaaccaaagauuccuccauuacugcagaggcucagguccuagggagggaguuaggacccaacacccucuucuguacucugugggcaccaggcacgugcacagcacacauacauucauguagacaaaacacucauacauauaaaauaaaaucuuuaaaaaaaaacccagagauuaauaugcucaagucacuugccaagguauuguacauauucauugguugaacuuauuucuguauaucaaaaucaaguuugcaaguguuagcacacuaacuauaaaagcaguuacuuuuaaauaguaauguauagaaaaaagggaaaacacuccuaaaacauugcuuugaauuaaaauguucuauucuguuuccauuuuuaauuacacauacaaauuuaaagccaaacuuguucaagccaucaaacaaaucugaagaaacccagccuuugacccacuuauuacauacacacgcugguacuuucucuaacaugcgugccaaaaacgauucguacuguugcuucuguuuacuauuagcauguaaaaacguucaacaguaauugaaagguguuucauauaugcaggcauaggccagugauggaggacuugauuagcacacucaggggaauauagguuuuuuggggaaauguauuaagcucuucaguccuagacaagcauggcggcacauguguaaccccagcaccugggaggcugaggcaggagaaucaagugcagcagcuuuguugcugcaaagcaagcuagaggguuguugucugauggaagacgaaggaggaucugaauacauucccuacugucucgaaaucacacauacacagcucucagcaccacgaugcccuggcugaaaacacacagcagaaucuaugaaaggaacuaauuaacauuuugaacuuaaaaacggagucuccaaauucacuaaccaacuuacacuguaauucuaaagguuacacuuucuuucccuuauguccuaaaggcaaaucugagcacaaggcugggacgugaacaacgaacaggggauuuuggcuuuuaaaucagucauacacacacacacacacacacacacacacuugcaagcaagcaacaaaccaagaagcuuacuguuugccuaugagaagucuucacaaagaauguaugauaauguaaauaaaagcuuuagaaggaagucuguaaaagcucaccguuuuguuucucuccagcaucacuuuggaagaauuaugcccaacuuaaagcauaagacauuaaauguggaggguggaagauauauauuuaacauauuuguucaaguucaaagagaaucacauuucacaggcaacauaaauguuguuucuaaguagaguggagagaaaugccuucaugagcgaauacagcuuuuaggauguucauauuuucuaugaaagaccauuuacauuagaaaauguuuguuuccauuucauuccgccuuggugagcucuguucugucuagcaggcugaucugcaaccacccagcacaccaugccagucacugaagcccauuccagccuuuuccaggaucaugacagagaccuagagcaggacaccagcauagccuauuuauggagcacgugugaagaugacuccagacacccagcacauccgcgggaagcucuacagcugcuauuuacgauggaugugagggcaaaucccaaaugcguccacucgcugcccaccucaguaacaguuaagucacuuuaaggugauuucaaccuggcaggagcauuucauccguuuuaaucuguggcacuggcaauugucccuuaagguucuuucaacuguccacgaugacuauuccuuuauuuguauucuagaucucuuuuagaacagacuuaagauaaaucaguuucaucauuaugccaugagaagaaauggaaugauucucaaauaaaauagguuagauagguauucagcagcuaauguucuuuuauauuggaauuuuuaaaaaauuuaaauaagaauuauuuuguguaugugugauuugccugccuacacuacuuucacugcuagugugcauggaggugggaagauggggucagaguuccuggaacuggagcuacacaggguugugagauaugaugugggugcugggaaccaagccugggucaccugggagaacucacuuuguguagcccuggcuguccuggaacucacucuguagaccaggcuggccucaaacucagaaauccgccugccucugccucccgagugcugggguuaaaggcgugcgccacuacacccggcugguuuuugguuuuuuuaaagauauauuuauuuaguaaguaccccagaugagggcaucagauaucauuauggaugguugugagccaccaugugguugcugggacucaggaccuucggaagaggaaggugcucuuaaccacugagacaucucuccagccccugggaggacucuuagcugcugaaccauuucucuagauccaaauaauauagagauaauuauaguaauaauaauaauauuaccaucaucaucaucauuauuacuguauaaagguguggugguccaugccuuuaauccuagcacucaggaugcagaggcagguggauuuacagcagggccacugucucaauaaacaaaugaacaauaacaacaacaugaaagcaagugugcuuacaaaggcagaacugaucccagagggagaccacagcugugagcucauacagcuccaggugcuccccaagaggugcuccaaggaaucuggaggguugaauaagcuuagugcuagggaaucaaguagggcagcuagagaggccaaaaagaaagucagcuuuggcauguuuugucuuuccuugucuugugcauguugugugugucaggugcccuaaagcuggaguuacagagggcugucagguaccuugcagguacugggaacucaacucaggucuucuuaacugcugagccaccucucuugccuccgggauguuuuuaaaaugugguuuguacugacugugauggcaaccaucguuacaauuucucuuuaaaaauaaaacgaacaaaaauccaacacucacuaccuaagaaacucugcuagcuaguuuuuaugucaacuugauacaagcuagggucaucuggggagauagaacuuuaggaaacugccuggauaacacuggcugguaggcaagcuugcaaggcucuucuuaauugauggcaccucccacagcucacugcuggugaugggugcuguaagaaagcaaguugagcaagccacaggagcaagucaguaagcaguacuucuccgauggccucuguagcagguccugccccaacuuccuuugauacggagaaauauauaauaaaauacugccuucccacccccagacccaaguugguuuuggucaugguguuucaucacagcaauaaaaacucuugagacagaagcacuaaaauuauucuuucaauguacaugagugguguaugccuuuaacccagcacucugagagaggaucuuaguaaauuuauuaaggccaaucuagucuagaagcagccagaacuacaaaaugaaacucuguuucaacaaaacaaaacaauaaaaaguauagagugcucaauuuuacuugucuguaaaaacccuuuggcaaacacagaaugaugacaguauauguaaaugauaauuaauguauacauaugaccauguguacuuccaauuauuucaguuaguuugauacagguaaguuuacaauuccauuuacauuuggaauauacaguauggacuaccuguggcuauauaaacauguuuaucuccccauuuauaucaaaauuguuuaagaugccucaagccaagcauaauauggguaucaagcaagauaccaggugaccagcagagaaaggcagagagauaccuaugucuauuacagacaguggguggcaaugucacucaccacagccugucucugauagaagcauuccucucugaaaagguugcaacaggaaaaauaaaauuuuuuaucuuuauucuuuaauuugcaaauauugcuaucucuacaauccuaugcacaagagcaagccaccugccaccaggcugagacacuguuuucuuccagauaaaacuaagugcacuuaucuaauguuacagaggacaaaacagcuagacaucagcuuccucuuucuaaagcugagcugguucucucagcugacuuauacgauuucuuuuggaaaucaggcuggaaugcagauuuugcuaugaauuuguuccaauagaaaccuggaguuuuugucuuuagaacuuaaaaacuaggacuuacuucuuuaaucaaacaaaaguaggaaaugaaguuuuccuucuuuacucuuuauuaaucagacuaaaagcugcaucaggggcugggaacgugggaggaaggcagugagcccagccuggccuaugacucgagcagacagcugcucaagacaacacagggagggguucgacucccaucacccacauacacaguggcucacaauuguaacuccaguuccaggugaucccaaaguccucgggcuucugugagugcuacacaugcaggacacauauauacauguaagcagaaacccucacacaauaaaacaaaagaaaauuuuaaaaaacuaaaaaucuacacuaacuuucuaagugcaaggacuggccagaggugcacggcacugcaauccaggaggccugggcugcaaaugacaucugucucaacacaacgucaacuacaauucacaguuuucaguaaaaggacacacauuaucaggacaaguaauuaugcuacauuagaaggccuuuuuaguuacacaaaauuagaaccaaaaaagucuuuaaaauccugggggagaggagcuaggguuggaaugauaacaaacagaaagacggugccuuacuccuguaacgccagcccucaggguaagggaugaggccgucucagaguucaaggcaauuugucuuaaaaacacaagcaaacaaaggugauagacuacuuggcuaccuggcaugcacaaaguccuggaugagaugcucagaacagaaaaaccaaaauuuacgcacgcacacacauggauauauaaauaugagcccucagcucucaacuggaccucauuuuaagucagcagagacauguuaucaaggaaacauagaugcucacagugcucagugcugcagccccucagucagcaccuuacacucacugcacacuaucaguguccucucucaacacagggaagcucccucucagcagcucuacuuucuaaagccacugaggagacacaguccucaaucucugguccaucuucagcccaacuccacccacugcuucucucaauucuucccauuagacuguugcuacuugcuauuaggaugcugaaacugcaucuauacgucaguguucacacacacacacacacacacacacacacacacacacacacacaccacacacacgguaugcuagacaaucaauagcccaaaucuccagcauccauguaaacgcuaugugugaauucagaaggaaguucugaaggcaguggagagaagggcauugggggcuuacuggucaggguuagugagaaacacucagaagagugauagagcagagaaucugguauccuccacuggcuuccacaugcaggcacacaugugcacacuuaaaaaacacacaugaacauagauacuacacauucagacaaacauguaaaaaguuuaaauaauucuuaguaucaguugacaaguacuuaaggguaguuaagagccaaccuuaucguccagaaacuguaccaaggacacaugacaaugcaucagcaaguguggcacagaagggaaacuguucuaauacagggauacagggagccacuaaaggcauguuccauuuagccagaccacaguuaaaacaauccucuaaauauuauuaacuaaaauaaaccaaauagaaaauauuaagaucucaaagcauuuguuacuauagugaccaagcugacaauuuccauacuaaggguucuguggucuuugauccuaacacguuacccccacaccaccugucuggcuaccuggggcuaugacccuggaacaggauuacaggaacccacauuucaaaaauaguuuuaacagcuuguuagcuuauggaaaguucuaugugacagcacacuguauucccuuuuauggaaggacaagggagaaggcagggcuaagggcugugagaugcucauauuagaugcuauuugccaggugucugcccaggucagcuuacugacccauaagcauggcccguaccucacaacugaucacauuccugagauagaugaaauucagacaacucuaauuuaacccugccuuccuucccuguagccccaucucacccguucucucccuacaaacuaugcuuaggcuccuccaaauuuauugcaacauccugauuucccagaaggcucuccauaucguccagccuaugucuuccacucuucaaucaagacaagaacauacucaaaaugaucuccagcauggcuuucucuaucuucuucagggugguguaaccuuauuuucaugccggccuucgagauaaaacuauguaucuuggaugccagaaaaagacuucuggcuauacaacacaccaaagagucaaaggucuuaguugguguuucaauccuuggacuacaaagacauucuaacacccaaaaccagacagcuguucaccuuagcuguuaaucguggacaccaaccagagagcuugccccaaagucccuguuuggauauuucauuugugucuucugcauauguuauaacuggcacaggcagaggcuacaauagauguuauaaaugaaugaacaauaaggcuuugccagcuuagagccucuucucuagcccaauauagcagucaggagguauuacugaagcuguacauguugacacacaccuuaaaaaucuagcaccuggaaagcugaggcaagaagagucuggaccuacagguuagcauaggccacacgaguggaaggucuccaucgugaauccugucuuaaucuccucucccccaaauccaacacucuacacuauuuaaagcaguacacaaaaguaguagauguccuuauauucaauguucuuuuuccaguuagcugcauuaucacauuugacuacuaaacccauuucuguugacuuugggccuuuaucaagcuuuuguucacccccaauaaauaaaucuuaaaaaaaaaauacacacaaacaaaacaagauuuuaaggccaagcccguucuuacacaucuggcacuuucacgaaaaccuaccuaaaagucacuuacuuuuccagucuugaccucaaagauagaccccaaaguggacugacuguccaggcaaacccagacauauccaaguuucaugcuacuaagaagaaguggcuagcuucuuacuguuaugcagcaacagcuggcugcauccucaaaccaaaaccacuucuguuaucucauguuguugcucagagugucagcucaaugcuaauguagcgucucuuauucuauuucauuuuauuagaacaggucuccaaauuaaagucuugucucuaaguaaucccguaguuaauaaaguauuauguaagagggugggacaaaauuuucugaucagaaucaccucaccaaauuccuccuccucucugcaaagcauuaagauuugucacgaucaguuguuagaagacaauuuccagcugcugugauggauccugcugagcggugggagggagugugugucuuucacuguagguaacaaugauuuuuuuuuuaaagguugcuuuaaaauccccagguggaauaaauguucaaauguauguuugcuauuuuaaaggacuucuauagugguguaacaucgaacaaugacagcuaaugcaaaugccaaagucucucaguugugacuaacacauagcucaaugcuauucaaaccacucagauuuaauuaucggaaucacuucuaaguuuugaggcuuggcagacuugaaauaaaauuacccuuggaugacaaacacaucaugcaauaaagucauggguaagugucacacaucgagugucacaaagcaucacagacagcagauuuuaaagaucuaccgcuuucaggggacagagacccuuaggccaggcuagauuuggaaagcaauauccuccuccuucaagugcgugccacucgugacuuggaucuccauuuucaaaagccacccccccuuuucuuguuuaguuuuguggugucaugugggggccugagugcauacaccccuggaagccagaagccugcauccauuggaucccauggaaccagaguuacaggggcagggaaccguaaaagaucugaaccccagcaucuccaugacagagggcaacaacaggggauccaagagacaguguagcagaagccagacccacugcaaugaacauuuccaaguaaagcuguguggacagaggguauacacugugggacacucgugacacacugcagcuuccacauugagauguuuuucauguuguuuuguuuuuaauuuucaugucuuuaauuuucucuugggggaaaguugcaaaggcagaaggcagauacaaagaaacagaaaauuggggugcauuauauaaaacucacaaagaaugaauaaaagguuuaaaggggcugaggaguggccaucucucuagcccuggugucuguuaaccuuuuguuauuaugcuuguuggugguuuuccacggaaaaugaagccucauuucucccuggagccauaggcuaaguagaacguggccaagaaaacacaaucuuugugguuuagaacuacagggucaaccuggauaacuaucuuuaccauuugcauauaauuaaucuaaugucuaaagauuucauaggaaaaagcagucccuggaggcuauauuucaccuggagcccauuggaagaacauggcauuggugagcaacugcauuaguagcagcaguagcagcagcagcagcagcaacaguaguaguaguaguaaaaucauccaggggagauauauagaacaaacaaaaguaacauuugacuuuuuuuuuuuuucaaaaaaacuuuugaagauagcaaauacuagugguaccuguggaugacagauacauuuaaauaacuuuuuccugagagauggcgcagcaguaaagaaaauuaguucuugcagaggaucuagguucaaucucuagcacccccacgaugccucacugccaccuguaacucaauagucuccacagguaccaggcacacacggugcacagcauacaugcaagcagaaccaccaugcacuuaaaagauaagcagaucuauuuuuaaaacaaacaaacacccugaugcuuucaggugauaguugaugucaaaaauauaaaguauuaacuggacuggcaagaugacucauggguaacagcuaacugggugacccaaguuuccuucacaucuuuggaacucacauuggaaggugaaaaccaaauuugccaagcugucuucaaacuuccacacacgcuguggcacucauguacauaaguacaugcauacacauacauacugcgaauacaauaaaaaaaauucuaaauucaaaauacuaaguagaacuguuugcuaacagaacauccaccucacccucauuaggcccuaaauucaaccccagcacguuucccgucacacacaguucacaguagguucguucacucaccaccuuccaccacugaaucugauuacauaacaucgauaggaaaaccaucugccauguggcagcuuuaguaaguguacuuaagcacucugucaguguucucugcaaccccaaguguuacuuacauuauaaugcuggagacauaccccauucaccuccugcauccccacucuaaggggccuauccucauuaacuggacaucugaagcucuuuuuaugggacagaauugaguguacuggggaaagagagaagacggguguguguaugugaugcacacacacacaugcucuauaucaaugaaguuuaaaaaugguaauuauuaugagguuuuggccuauuuggcaccaucuaaaacugcaacaaacaguugugcagcggguguuuaguguguaaggcuuagggacacuacacuggaaagcuugaaccauccaaguuguaaaacacuguaauaagcagguaacccugggccuagcaucuaaguuucugcccuaaccuguuccucaugauuaugauuuuaaaauaucucagugucagcaaguucauugugagucagagcagaaauaauaauggcuuauuuuccaucacgauggaggaaauacaucauuguucauugugguucacuugugaggcuguuuucacaggaaaauagaaaaauaacuguguuauucugccucaaauuuaaaaauuuuauuaacacagcucuauagcgauaauccauuaaaaaaaaaacccagcauguuuuuaauauggguuauaagacaauagcucaauaacaccuagaaggaaaaacauaaauaccagaaagcuaaguuuaugacaacaggcagccugggaugcuaagauaaccaaucaagugcauuugcuucauccagauagaguggggcucauguaaaucgccauucaacugguaacccuggcuaaaacagcaggggaccuuuccucggucauuagggucucuggguucuaugcauguguuuuucacacagcacggacauuauagcaaccaaaauguucgcuacuguaaucucucaacaaaauguuagagaaaacaucuuugucaaaaacaaaugcuuccagggcuuggugguacacugcagcaucagcaacacagaagcugaggcaggagguuuagagucagacggcuaacccccauccccaaaagcucacugaauggcaucuuuucugcaaauguaauauaagacuuauguggauuacaauaaucaugguaacugaacaguaguguaucugaagacaguaaguguggguucuugaaaacauuuaugacacauuuuagaauggaaacuuauuucuuacucaaaucauguagggugcuacuacaaugcuuaaaacauuuaauaauauaagauaacccuacaggcaacuuuugguauacaacauauauuuuaauacgauuaauaaauuuccauuuauagaaaaggcucucaguguacaauguguauaaagacaaaucuauagcuuucuugaauuauuacaauaaagaguugagcccuggcugucuuacccuucuacaaaucgacucccacccacucaccuuccccuccucuguacaccucuggcaugauggagcuaaccgagaagaacccguaacacggcaaacagcagaugugccgcggugaggucacaguuuaugaagcagaaaaugcucuucuuaaugaauauggugugcaauguaaaagcaauggugacaagcaugaaccaggagcugcgcaggccucaccccgcaggcuuacaggccugaccaagggcagcacugggucucagaggucugcugggacaggcaguaacaaugucuucagugccccucuuauguuagcugucacuccucagaggucagaggacuugaaucuuccagauaaaaagcuaugguucuugacgaaaucugggguccuauaaacaacagccauauaacauagaacaaaaauauuaaaggaauggaaugugcaaccuaggagggaaaacuguaccaaguucuccaugaaaucugugggaugacaccaggguuucagccugaaugaagaaagccaaacacaccccuuucucccugucccucgcucuguguuacuaugcauucgcauacaugcaaacaugcaagguaguuuaaaauagccuugaaaaaaagaaaaguggcaauacaauaucuauggccaagacagcuaagcaacccagccuccacugcuucucaguuaacucaacuuuuaaaagagcaaugacccacaaagucuaccucucuuguccccguauuucugucaucaagacacagcuucauuucagacacaauuuuaaaaaggcugugacaugaucacaggaccugagccuuggaaucagagcuacagagaagucauccaaccaggccgauacuacuucucugccaguacugccacucauccacacagcacagcacagcacagcacagcccagcccaggaaaacugucuucuuuacaugguagcuagcaugugcucugaagagaacucuaaggagaaaucagagaaaucuaaagaaggaaacugcaaagcacucuggccugucagcacucucgucuucggguaaaaauauggaugacacggaugugugugguuuguaaggggccuccuccugaggauggcucugcaaacagucucucuaaaucaauuuuuauucuguuugacauggaaaggaaaggaaagaaaggaagaaugaagaguuaccacacagacuuuaaucacaccuaggucucaaacaucagaguugcaguucccacagcaagauggacucagcuuccauauacagcgucagugugaccagccacauccucucagacgcucucauuaagggcaugcuaugugcauggguagcagagccaggucacagacgcugaaucugacuuucuagacucucauuaauugagacuagcauggcugugagccauuagggccguguuuaagacaggcgcuccaugagggaacaagucaggucaccagagugacuggcuaccuucucaguggcaucgucuuccaccagaacccagggcagcuuccccaagauuuaaaccuggaccccggaggugggugacauuuuucuaggagcccaugaaaugcuuucagugacagaagagaaaguaaagugaccucucuaaagggaaaagccaccgcacugcagccuuuucauuggcaggcacccuuccucuaccuuguaguguuaaguucccaaaaguauuuucuagcaauuucaguuccugaugucaguggcuucucuuucagaaggaagaacaaaauucaacacagcaagaagcccuauggccaacuuguucuauacaagcccacccggccgagauacucagaagccaaauuaccucuuauaugauugguucucacuuucuucaccucuucaaagagcuugaauuugaagguuaaccugucugcccgucgggguaugugcugaccaugaguccugucuacuugggaaaggcauggacaaugcagacaacuggaccucacagcguuucugaaugagguccugcaggacagucaauccucacagcagcuuuacugcacagagagagugaccuacacaacucaaggucaccgggacuguaaaagcugugaauuuuuacaggagcgccauuucacuuuauaaacagacccgguagaaagaggacaucagaucucccugugaugucauuugguugugacaguggcuacaaacuccugagcagguagucagggugccuggcccccagccugcaaagagcaaggcagcacaauagcagcucucacucacaucugcuggccagccuuccuuccaccaaccucggcaggccaccacugucaacaacaaacugaggagaguccagugagcuagcuaccagagaccuccaacccuccccaucccugcugccuuccuacugugcaggaaaugagagccaguaacuuuaccuaguucagcuuccuuucugaaaccccucccccucucagcuggagagccacagauaaguagcugggagaccuacuuggcagugugaagaagugucuucaauaugcuagaaaacacucucuauaugugguaacuaaauaagacaauguucuccugacccuuuccaguuaacccagugaggcagaggcucaacagaguauagaacugaguuucugcgacaguaccuggccaguacccacuacauccuaaguaaaggaauauauagagcagagaagaugcguguucuugggaagauucugcuguggcaaggucccaccuccuaugaaaaauaaaaauaacacuccccccucccccaaauggauggaacacggagcacaaacguugggaagacugcacgaauggugagguguaugccgaugggcuacgggaaaggcagacaccauguuccagacagacagaagacccgggaaagccccaagucguggggaagccuggccugacaaguaagcacagaauaugcgggggguugggggggaaaccucugcagucaggccccagagaaaggauggagcaaggucccuuugguccagugaggggauggcauagugaguacugcuggcaaguaagguggcauggagcagggguagccauggacaggaugagaguccaaagggauguguaugcauagucaggugcuacccagcacagcugcagugaacaccggagcacacgcauggcacugacucacugugacagccuuaugacaucacagcagugccagcugcuucuccaaugacaaaaucaacauccguuucucauaaccuauccuacuguugggcaacguauagccaagauaagaucauagaauuuucugacaauuaccauaugccuagucuuccuuuggaaagauuaguaagugcuuuuagguaucugaaauauuugcucuaacuccacaaaacaaguacguuuaguucauccaauacugcacacucaguaaaaacaaaacaaaacaaacacacggaaagggacagaagcaccgcugcuuacaggaaucacaaagaaaaagacaagacgugucaugacaaaugggcuugagguauaacucaaugacagacugcugccaaccacauacaagaccaagguuuaacuccuagcaccaaaagaugaacaaaacuaagcaguuaaggaaaccgugaggaccacagagggugucuauacugaguucuauggaggaaagaugcaaagucuaaugaaagacaggaaaagaaacucaagaaguauagauagagaacaaaaugcacggagguugcgggaucaggacacucagggagaaacagaaacggugguguccauucaagggccacacugggcagcugaaccuacugcagauggagauaaacaaggcuggaacgcaggaagaggaagacgcaucucagagcuguaaggcagcguggcaggaagaaagcacagcagaaguaagacuuggaaguagauccaaguaacaaaaacaacaaacacuacaagguggucuacacuaggagcccgaaagaggaggacagauaaagauggggcagauaaguagucugugccguguguagucuuaggccagugggauuagugggcagugggcaguucucauagcaaauaggcacguccauacuugauuuuauuuuggcacaaauuugcucacuuuacuacaucucucuuaacauucaagcacauaugucuauccccauaccauccugcuuuacaaguaacugagcagguauuuuuagaugcuuuucaaaucaaacauacucuggcacguagggaaauaauccaucccuagugacucagagggguaaacaguuacuaaggcuguuucagagcucaagcuugugcaaugaaggagguuacuugucugcaguugcuagaaaacgaaucuacagccacaucaggaugcacggccacaaggcuggaggugccgagaucccgccucuccuaacuucuguuugugaaagggaacaaguuguuggagagugcgagaucuggagagagaucacacacacacacacacacgaacacacacgggcaggggggugugugucaagugacagcacugcacacuaagaaugaaguggaaggguaccaccccuggguaccuguuaaaaccacuugugaaaagaagccauucugcgggcucaguguucagaccaggcggccaccagaagggcuguaaguauggcgucuugugcugauggcacacagcuugagggacugaaaggugugggcauccacguuccucguguuuuaccuuucuucucaguugauugaaccuggugccggcaugguuuguuuaccagcaguguguguuuaaggaucuggauuugauuaagauguuacagaaacagcaaugaaggguauuucaucagggcagggggagggaaugaaguagcaaccagguauuucuguuuaaacuagaggguuuccuuugaaauuccagccuaacucccuauacaauauguaagaauaacaagcgaaauugaacacuuguggcauccucuggaggggaggcucuagagcgcauagcuaaguucacaaagaacaaaaaggguagcucacacacaccaggccucgcuucuucagaggcaaaacaaucaguauauaacauuccugcuaagauggcagcgacugguguugcagguaaacuuuucgaaguauuuccaggcuuagaguaagccacacagcagacacacuaaacacaccgcucgcucaaccacucccucacgcucaccuucacucacuccagcuccuacgggcugucaucuaugcuguaaagcagaauuuagugguugauuacguaacgcuuaacaaagaugaacacaaggagaagacugucaucucacuaauagcagggagagcaaaagacuugaaucugauuuuuaacuuguacuuuuuaacuacuccauguucugcccguuaucuaagaagcaacuaccagagagcuucuccaaaucaaggguaucucaaagauguaagccuauaccaaccaccuuaucacauuaccacugcuaucacgccuauguggacaaaugaucgacugcaagauuaccacuaauucaaaccaaaucuccuagggcuggaagaguacaagccgguggugagucaggauaaagaacaaugggaacagaaagcaguguuguggccucugacuacauugaucaaguacggcauucaggucauaggaccuuacagcccuuaugcuguaaacugcuuaguaauuuaacugguuucugucuacagaacuauguaacagacacauaacaauggcuugcuacauaacgaauaacaaaccucacaaagacauuaacaaaugaacggucacauucaauaaacuaaaauauaaaccuacauagcugagggaaaaacaagccacauggucagcacuaaguccgcuggcuccuuaguagacuuuacggguuaugguucuuaguucucgauauacaacuaaucugauaugcaaagaaauuauuaguaaguaccaaauguguuaucauugcaaaaccccuuaauccaagguaucucuaucuaaauaaaaauaagauggcaaauuacacugcugguaauauccaauggcaguucuuuaccugcagauucuaagcacugcucugugaagauuucagacacucaaagcagagaacagaagcaguacaucugcaugugacucagcagaaaaugcagagcucaaacagagcuuuuuauaacacucaaauuuccauugguuuaaauacagcccaaaacucuaauuuccaugaacaggaaaguggugcuaugauuuuguggucauuuuacauaaggcaauacuaauuuaaaauauuuuaagggaaaauuaaugccaaguaugguguuugacgguguagaaaccacucuuucuagugccauuaaagaccugccuagggcagggagggacagggacaaggcaguaaaauggcagaaccacuuugcagcagaugauuaaacacguaucagcauuucccagagaaaguaccuggagaagucaauucaccaaccaaccccacaaaggucacuggcgaagcugggaagaaguguucaaugggcacaaagcuugggaaaacaagauaaaaagagaucugacaaaagaugguacugacagucucaaaccgauacgaaaaguacuuaacucuagugcacaguacaacucaaaauggcugaugguguauuuuuuguggcuauuaccacauuuucuaaagaaaccccagucaggcccuacagcacaggacuguaacacuuaggggcugaggcagagauggcuaccaagccagaccccauuucaaacaauccaaaaaaaaacaaaaaacaaaaaaaaaaacaaaccaaacaaaaacaaaaacaaaaaacaaacaaaaauacaaaggaacuacuguaauaaagaaauaaaguacuuacuguggaagugcuagauacuuaguucugagggguucgcuuagucuuauaaacuauucagaaucuaagacuuagcaaguuaacccucggucuacauuacagguaucugacaagucuagaaaguguggcuccacaguucugugauuuacaguuaaggaagcuucaguuuccugucaaguuguccuagguaaaacucacuuuagaacguuucuagugacaccagcuacacggagcucagcaauuuaagugguuucugucuagagaauuauguaacugacagguaauaauggcucgcuacauaacuaauaucaaaccucacaaagacauuaauaaaugaacagugccauauucaauaaaguaaagauacaaaccuaagaagcugaaggaaaaacaaguaugucauuuuaaacauaaaaacaaaggugguuuuggucccaauaaacacacacauacacacacacacauacacacaaacccucccuuuauggauucaauguccauucaacguuugcuaaaacccaagccucuacacccaacucauaccauuuaugacucuuaaccaauuggacaucuuccuugaugagcauguggcauuauucuggcauacaccagggcuuagcagugaagagcuccugcucuucuuucagaggacuggagugaaguuuuguuuccagcacaaggaggcagugcacaagcacucucaaacuccaaauucagggggcuacaaugcucucagcaggcuucuggggauagauacaucacagacuucacuucccgcucaggguggcuaacagugcuaaacgccaauccgauccugaguggucaggaggacucccaggcugagacccugcaugaccuaagugcagagagggagcugagcagcuacucggccucccucccucucugcugaaccacaaugcuaccagguccccuaagcuccuguugugauuuccccgccuugauggaacugugaaccaaacaaaccauccaguaagggccgugucaagguuacuguuguuaaacagggucucacaucaucauccugccuggccuggaacucacuauguagaccacgccggucuagaacucagaggucagccugccucugucucugagauuauuaaucaguguuagagggcagugcccugcuauuuuaugacagcaagaaaacagcaaacagacaaugagaaaaaugcuguuuccaauacugacuccuugguucuuccuucaaaaaaaaaaaaaaauagccauguuaacugaagauaaaauguuucacaggcuacuacgucaucagcagcuuugcaggaccaacaaugccagcucauguaauaggaaaucaauggcguguuucuaguuagagccaugacguguagugcacuacuacaguccacugggggaggagaggaggaugcaugaccacacugucucggaaaccuuucagaaaacacacgacggcucaagcuugcagucccagggcucagcucaaaaucugacugucaaacacuccugaaacggugacaaauacugucugcugugacaauagugaaaacucuucacagaaauccuggcacaguauuuuacagggaaaaaacaucuggauaaugugauggucuaagcaacccuuuaaucuagacaucugaccucuaaucacugccuucuacaguggggucagcuggucacuucugaggaagggcucugagcacagccugucaggagugaugcuucagugaaucccucaccacgacccuugcagccgcacgagcagcccacagucacugcugcccucccuguccuggguacccaaggaugcaugccccagcagcacgggagaagcaggggcuccagcuaaucucugccacacaaggcacacaaccuuggcaagaaccagguuugcuaucacgcucccuuccguaaccuggcagaugacggugguacaagucugcugugaggaucaucugcauagagccccaguacacuggcuggccucagaagcugagcauuacaacaauguucagacacugucuuaagcacgagauauggaucagugcacacgugagaccacacgagccucccucguuguuagcccaccuuaggagaaaacugaagcauaaagaacagagcuuugggccagcgagauggcuuggcagauaaaggcccucacugucaagucuuaguucaacccccaguggugaccugguuggagagaacaaccccuccaaguugccccacuccacacaaacacuguggacacacacacaugcacacacauguggacgaacugacacacaacugaguuaaucuaacuuauaaacguuuaaaagacagaaucucaagcacaagcagagggcaucuggauucaaaacucaaacgcaaaggcaacagcucguauuggccccaguguacaauucuaaaacagugccuucacugggguuucacccucaaccuucuaucaaacauuaaccaacucaaaccccccccccaccaccaccaccccacacacacugucucauguucagugauaaaaauagcuuccacauagaaaacucgucuuacacacuauagaacacauuuagcacuuuauucgauucuaacugaaacccgcugguuguucccacuuuucacugagaaaagcaauguagcuggagucugaguaacacagcugcuaagugcuaugacgacccauucguugugacuuacaaaaccccaaacugacuguaacagcuuuacagggagaacuuugaauguguaguuaaaaaucaaaacuaagacgucuacgugugcaguggacauuacaaagagagagcaguuuagaagccccgggcggaggacauauaggggacagcuccuauuuuaccaccaguagucuaccgaccaaagauucugucuacccacuuuacucuggauuuugagaaaauucuuaaaaaucagguccaacugcucagguuguaaucucaguacuaaaaaugcugaggcaggaggaugccaaaucccaagccagagagacggaaguauauaauauucagacuaaaacacuaugcauagagaaaaucugccaguuuaaaccuuaaacaagagagaccuuugaaaaagugggaaagggguaaauauaacaagaagauauuaaaaaaaaaguuuagaaaguaauaaauugguuuaaacaguuccauucuacucucucuuauuuggggcuugagggcuaggaaaggaauuaggcagcgcaaacaaauccaaagcaggagucuggacaaaggaagauucagaaaguggggacggcagagacuucagcucucugacccucuguggcagucuacccuucauggcucugucuggaguuuaagaucuaggguucuacuuacuccucuaguuuuaggugaugagauuagagaacaaaccugcaggagucaaaccucaagucauauuugggcuugguggcaagccccccucaccugcuaagccagcucccucuucucucuccugcccccaaagaacagacuuuacuucagaaaaaauugaguuauuuuaccugaagcagaguuuagauaacuccuaauuguaggaggcuggcucuguggaauucaacagcaucuuuuguucaugucacuagaugccaauaccaaacaacauccucccaagaagcuaagacaaaccaaagacucaugcaccagguagaggaacacaaaaccuaauuggaaacuacucaccuacucuucuguagacugagaacauagacauacuuaaagagguuuuguuuuuucauuuuucccuucuauuugaaaagucuacaauuaaaauaauaaggacaagagcaacagcagccuccauccuccgugggaagcccaugugauaacuuucugcaaucccacaaguguucucauuuuagacagagaccaagaguugaauguuaacugguucaagcuuaagcuuaucaauuuuggcuagauuuugugacaaugcuuaagguucuaaccaucacaggacuucuguaaacagagcucuugagcuuaaauaaacagaaauccuacuacuuuacaauuaaaaccacaucaauaaacaucuagaaauguguaugccaaagguacaaauuguguacuucuauuaaucauuagcucaagaaaaggcagugaagcacacacacauuuaaccccagacucaggaggcagaagcagguggauuucugugaggucaaggccagccugguuauauaaggaaaguccaccaggcaaguuccaggucagccaggguuauauaaggcaaaucugucucaacaaaacaaccugcgaggagaugguggcgcacaccuuuagguccagcacucagaggcaggcacaucucuguguguuugaguccagacugagaguucaaggacagccagggcuacacaaagaaucacugucucaaaacaaauaaacaacucaacaaccuucacaaaacaaaacauaaaggguaagguucgugccgggcugugguggcgcacaccuuuaaucccagcacuugggaggcagaggcaggcagauuucugaguucgaggccagccuggaauacaaagugagcuccaggacagucaggacuauacagagaaacccugucucagggaaaaaaaaaaaaaaaaaaaaaaaaaaaaccaaaaacagguaagguacauaaaguggauacuucauauaagcaauguucuguaggaugacccaaaagaaugaacuacugaguccugaauuuuagaagucuagucaggaaaaauggugcuugggcagggcucagagacaggguccuacacacauccagaugagacugugacaccaagcagucacuugccccagaacccccacccccccaacacacacacagcuuucaaagcaaaaccaauaaacuuuuuaaucuagggagacucccacccaguauauagaccacaccuuauucuaauacaaggugacucuggaaccucccaaccccacccaggaccagcccaagcgcaagucacuuagaauaucuugacccugacuuccuauccaugcaaaaggagacaggaccgauggauaaagaagaaaucaguacucaaauggcaaggaaagccaauaccuguagaacgcuagacauggaugucagcuguauucugcccuuaucccuuagaagggauggucuucccaaaguuaaguucauuccaagaacaacgcucucucucucaucucuaugggcuaauguuuguuaccaucugccaauccuacagcaucagaaggaauaagcccaucagugagggaauuacucuugcccuacauuugagcaguauccaucuggugguauagaaaccaugaguguccuugaaccaugacuuuauuaccaucaccacagaugaguauuucuccucaaagaaaagucagcaauccagagcuuauuauaucaaagcacuuuuucaucuuuuggcaucuaguuaaugguuuggaauauagcucagggccacaguaucuacacaccaagcaucaaguccuguacucaaucuuuagcaccaauaaggaaaacaaaguaagcaaaaaacaaacaaacaaaaaaccaacaacaaacucuaguuauuuagcuggagaauccaacgaauuucuauuaucggguccaacuguaaugcccaggccuggaaucacugcuacugggaaggcuaagacaggacaauaaucaaaacccaaggccagucugggguacagaggacagcuagucuggguguucacugauuaucuauacuuuauuaugaucuuucuuuuaacauuaaguucuagccuuuucucuaaaauuccaaagauaauuugucuuucugauacagcaaccaaguggucacaguacugcauaccacuacaguuuacauggucugucuugcucgcuuacuaggcugcagauugaaccuagggccuucccaugguaggcaagcucuccacuacugaacuacauacaucucuagccccuaacuccacccacugguugagauuagaucucagcacacugcccagguuggucucaaacuccuguguucaagugauauuccugccucagccucaggaaggcaggacuauacaggcauaaauaaucuuccuuuuuuuauacuuucagauauuccucaacccaacaaaaauuccuguaaaacauaaaauccaagaaacagguguagugaacaagcaacuccucaggagacagaggcaguuauaccugugaggucaagaacaaccuggacuacagagcugaguuccaaaccaggcuggcccacacacuaagacccuguauaaaaacccaaccaacaaauagcaacaacaaaacccucaggggugcaacaguacccuuacgcuacuuguacagaauugagaagguuaaucuguguggucuugguuauucuuuugguucugauuuguuuauaucugaaaauguugcacaaaaucaggaagccaguagacucuuaguuccuuugaacucuaugccccaaaauuuuggcuaaugcuaaaacgcaugauacauccacacagccucuuggaauaucucaacuuguccuacaauauuucucaguauuaacccacuuuacagauuaggauguuccugcugcuacugcugcugcugcuaacugacugucaaaacauaaauccagaaacagagaccaagacuucuaauauuuacacaaaauuacagcucugagggaaauugagaguauuacaaaaagcaaaugcuagaguggauucugguaguucuguagugacccuaacauagguuuuggaacaccccagcaccuuugguccaaacaccuccaagcaugcuuuggagaugcugacacuggcuagccaauuaucauugcucaaaauuauaugcaggaaaaggcagaaggcaggaaucugaaaugcacaccccagccaucaaagcucccagguggagugaagacugcugccucaaacagaaagaacaaagggccucagagugaaccacaggcugacaaaaggcagagugagcgagaaagcaggauccacauggaaguagaggaaaccucaggcaacaaagcucuggauggcucaaguagggugguacaugcugugauccagcacucaagagacagaggcaggagaguucuaaguuuaagaacacaaauacagcagaggguggguggguaagaagaaagaugugcacuuguccugccugacacaccagguuacacagaccaugcagcucagggggaguccugagcgguuuacagggacagagaccucuaggcacugcagaucccguacauacagccaggcaagcuucaggcaaaccuuugucuucucgucauauaaauuaucuguggacuuguucacccaccccaaacaaaggcaguacuaucucccgugacggucaagcacagaaaacaaacucccugcacagugugccuucuuuugcuaacguaagaaauuucccaaguccauggccucauaauuuuauaguguagagguuaaaacuauaaacuucaaaaugugaaggcagacaacacaauccaucucaaaguguucucuguauuucacuuugaauaauaaaaaaaaucuguuugggguccuacauuuggacaacaauauucaaguguucucaaagaaaugugugggacuccaaacuagucagccgagagcagaaaguccaggcugucucacugaacuuaacggaaccagccaagcaaacucaaugucgcuuccuauuccaaagcaggcuguguggaaggggcaacccacagagaaacaagccaauggauuaagacacuuuuuuuuuuuuuuggcuuggcugguauuuugaacaauuucaucugcauauuuauauaucuugaucacauucauauaccuauuaccuacacaaacccuccuuccuucagcuaacccucucuuccuuucaucaacagaguggggucucacuuacuagcaugcaggcaucguaccagucccuacaccacugaagaaaaugucucccaugguguuuguuuucauugcuuuucuuguuaauacaguguaguuagguuauuuucaaaauucuccaaguggucaaccaagcaaaagauauacugcaucaaaugauuaaaaaucuauucaaaaaugaaugaaaaggaccacacauaaaaacaacaaggagucggagagguggcccagcgguuuacagcucuuguuccuuacaggggacccagguucucaggaccucuaaugggguuaacaacagucuacaacaauuucaggggacccaaugucuucuggccucuguggcacgagacacacauagugcacaggcaaaguaggcaugcacauaaaaaauacaacuaauucauaaaaaaauacaauaaaauaaauccugcucaagccaaguaugauggcucacaucaguaauaaauaaguaggcuggugcuggagggucccccagauucccaagacagccaaugagacccuacugauaaagugaaaaucuauuccagucaucacaguggaccaugcuuguuauccuagcccuuucaagguggaggcaggggcucauggucaugcuccacuaccaugaucuacacgagaacaugucuuuaagaaaagaaaaaaaaaaucaggaggcagaggcaggcggaccucugagaguuugaggccagccugguguacagagcaaguuauaggacagccauggcuacacagagaaauccuaucucaaacaaaacaaaacauucuguuaaaauugacuccaugacauuguacuuuguauuacaaagcugaguaaguuuaaaaguccuggcacccaaacccuaggaaccaggaacaaguggcacccacaagaaugcccagucagucugucaaagugaaucuuuacuuguauuaaugauagacggcagugguguuagagcauaaacucacauuagcaaccugcaaugggaaaauuuaaaaccacagagccagcaaagugggggaaaacugcacugacuacaaauccacccagaugcuacuucccgaagaagcccagaggcuggcuacagacaggcauuccacaccaagcaggcagcuaaaaacaaaacggaugagcuuguccgacccuuguggucaccaggugugaccuggagcaucagucugagaugagaaauggagaaucagcaaaaagcagcccagggaugcccacuguagacuggaugcacaagaaccacaccuucugcuccaagcaaaagucggcuuugacuuaaaaaaaaaaagacaguaauuuuagaacucuagcuuaccaacuugccuccacuucuggauauuugaauuuuaagaaaauuuuaaaagaguaauuauuucuggugcuucugauuaauuuaggaagcagacguaguucugagguguagcagcaaaauagcccuugcucggcucuuuccccucugacaguaggcaaaggucugguacaacuaccagccaaaagacuagugucaguccauaccaccauaugugcguauguguguagaugcaggacugcaaagcaauucaagaacuuuaaaagucuaaccaguuaaagauagcauuccaaaucaaagaaaauaugaccaaacauaauuacggaauuuuuaaauucuucacuuaaccaaauacuuuccuugugcugcguuggugguagaguggugagcauagcugccuuccaaauacuuuucuugucucaaacuucuguaauguaugcuaauuuaccacacccaguaaugucauuaauaccuuccuuauacaauccacauuuaugcccgcaucccugucuuuuuccaccucugguugaaaaaccaaaguauauauuucccccuugcuaaaacaggagacaaacaaagggaaucccacuuaaauugaagaacguuagacccccaggcagcauaccaaauacugugcccuguauuuggucaaaacucuaccaauguauuuauaaaugggugugaaacuguaaauccaaaagcuuuaagcuuaagaagaccugaaagauuaauuauauuuuugcagccuauuucaguaugcuguccuaggauuacucaaguucauuugcuugcuaucauuuaacuaggcagucugcuuggguacugugggcuuuuuaauaugaugugcucgaagaaccuuucacagacagguaacugcagcuugcuugaggccacagcaaagguaaggaugucuguucccuaccaaaguaagcuuuuucucagagcucccuaagcauacagucaccaagcagaacccucgggaagcaacgcagagccuccagaguacccucugacuaacgagcuccauuccuacugagaucauuuuuacuagcugaguccugaaaucaccucaacaagccacaaacgaguaagcucaacacaacuuacuugacauuuauucuugacaugacaaaggaaaguagagguaccuucaugugcacucaguuaccagggacagccaggaguggugcuccaagucuguaaucccagcuagucugggcuauauaauaaacagcaagcagcaggccuaccagaacugcagagaggcccugucucaaaaugggagacaaaacagaaagcagcucaagacugcauccuggaucacugagggagagaccuacagaagcuaugagcacugcugucaagaacaaaacaaaugaaaaggccacacugcccugacugcuacacacacacacacacacacacacacacacacacacagagggggagggagggggagggagacugggaaagacagaaaaggaaugaaugagaaguacaagauuuuucacauuugauguaugcaaauaccguaacuguccgucuacucaaucaugaauuaugggggaggggcuguaagaugggacauggggcuuuuuuuauucauugcauguagauuuuauauguugauuuuuuuauuuaccuauucagagaguaauauuuucuuuuuauuuuauuuuauuuuauuauuauuauuagguuuuuucgagacaggguuucucuguguagcucuggcuguccuggaacucacucuguagaccaggcuggccucgaacucagaaauccuccugccucugccuccccagugcugggauuaaaggcaugugccaccaccucccagcuuuucuuuaaaaaaaaaaaaaaaagauuuauuuauuguuauuuguaacuacacuguagcugucuucagacacacuagaagagggcgucagaucucauuacggacgguugugagucaccaugugguugcugagauuugaacucaggacuuuugggagagcagccagugcucuuaaccacugagccaucucuccagcccgagaguaauauuuucuauuaaauuuagagauacaggcagcuagcaaccaacccaguccacaaaccaccucaguagacagcugcgaguucugccagcaucucuccuuggcauguuugccuucagucccaggaaugagccuuguagaaauacacgcaggaguaaguguuguaacuugucuugaaguuguugggcuuuugugauaagugcacaguaaggaggacugaagcccggccggcacugcacucucacuucugccacagccuguugcaagagccaaaaagcuacaucugguaaaagccucggagucugaacacacacccuucucugcagugaacacacacuucuccaugcaacccuauacuugggucaugggauaguaaaauccaaauuuugaucauuacuaacucaagaaucugccaaaaacuaagaccucuaguuaaaccauauccuuugaucuugacaccaagccaccaaacugucucaaguaucugacacuuuuguuuguuuucaaaagcuuucaaggacacaauauuuguaacguuggaaauugaguguuucuauaauuucuuucccgaauuagagaucucaaugcagugcuccucggaugcagaaugcagugucuucuaaguccugcuuuugccaccuugcaaagacccuuuacguguguuuagauuucucacucaggcaaggcuuuuccccuuguccacgugcauggcagacgucuaguggaaagcacugaggggaaagacaacaguuuuccagauuuaaaaagggaaaacagagaagagagauggcucaguagcuaagagcaccagcugcuccugcagacaaccugaguucaauucccagcacacacgguagcuuagaaccaucuguaacucuaguccccggggacccaugcccucucuggccucugaaggcacugaguaguauguguaaaauacuacacacaaaguauuuaaacaaaaaacagauauaaaaaggaaggaaguggccggagagauggcucagugguugagagcucuuccagagguccuaaguucaauucccagcaaccacaugguggcucacaaccaucuguauugggaucugaugcccucuucuggugugucugaaggcagcuacaguguacuuauaaaucuuaaaacaaucaaggggggguggggggagagaagcuaauaaagaggaaaaacuaucuccaggccucagcuaacuccuuggaauguggggccacugaaaagauagucuuuauuuucccacauaauuuaaaccaguuucccuuucccugucucccuccuuaucuucucuccuuaggcuccuccccagcucaagacuggaauuugacuucaaggaagucuuuucuacaacaguuacaacagggagccuguuguaugagagaccagaugucaggcucacuuaauuguuucuguguuaacugggauacucaauaacgacgguaccucacaaagccaaacaagaaacaugguuggaaacagaaauaacagguuuuuuuuuccuccaacugaauauuucaaguuucuggucugaugcagguaguaauucacaaaaccaguacccgcuguuuuccagcuuugugaggaauaguaccugggaaaaccugguggucaagaacucucuuuauucccaggagacagacaccuggaagcagaccccucccuucccuccccuucccucuccuccccacagcuucacuuagaugaguugugcuguuaagguccugcacaugucauuagacucaggucuuacgccgcacagaaugacacacuguaauuaagacaaauaucucaucagggcagagagucuugauccccagagaucuaaagcaguugaaacuaaaucacuaugagaaaaggggcaaucucaaaguuuccauggguggccaaguugggcuuccugcacauaugagcacuucucaugagaauucuguuguagacaggacaccagcgguaccacucucuacaaagguaggugugucuuuaucccagcaauuaaagaacucaccuaaaaauggcaggcgugcagggaucucgguagaaaauguccuccucccccuagcucuacaagggacuuccaccuccccucccugaggcagguaauagccuauacuuuuucccauugcagaucacaaucaaggagacacaacuuaaaggucaaagauaccugagggagcucucuacuuagagugaaggaaugggugggguacgggaacaggaugaaauccagaacugcacuggaaauaaaaacaaauacugauucaaaauuuuaaaucagcagguccccccaccccauuggccugguguaauaaaccaccaugcaagugcggugaacuaauguguucuaaaagcuacuuucucagccgggcagugguggcgcacaccuuuaauuccagcacuugggaugcagaggcaggcggauuucugaguucgaggccagccuggucuacaaaagugaguuccaggacagccagggcuacacagagaaaccgucucucgaagaaagcucuuuucucuauguagaagguaauauacacauaaaacgucccaguggugaguuuaguguguuuaacugucucccauucccagcaggguaucuuucaaacaaaauacuaucucccaguacugcuauaaacacacuacuaaaguaucuucauugugucuaaaauggcugcuuuguuuuaauaaucuguauauaugccuuuugugaugccacaauaaaguuuuacuguggacagaccugauggcacacugcuauaugugacuccaggcaucaucagggaggcugaaggaggucuuaaguucaaugucagcuuuggccacaaacuugagaccguuuuaaaaaaaaaaagaaaagaaaagaaaagaaaauucaaggacugggauauagcaaugguaaagugcuugcccaguauaagcaaacuaauugguuaaucacaaacuagucagacuuacucugguauucugagcacauuuacuauagucaacuggcaucauucugggucauuuggcacugcucugagguuugccuaaccacaucuaacagcuucaguaucaacugaaacaucucauuccuacaaucaggcuaguggauaaaauaauacacaauaauaagaaagguaucaaagccagcuaacuuaucacuagugcaauuacagcucacauuuaaauuauaaggcauuuuauuaauccaugcagaauuguaaauuccacauaacugccacaaacuuauuuugugguugcaaacuucaacucagaaugucucuucuucacacagguacggcaggcagcacagcuaucagacucagccuguggaggcugaugucagaaagucggggguuugaggccacgcucagcuacauacugacuuugaggacagcguggccuacauagacccaaucuaaaggaauaaaaaauaaaauaaaauaaaauaggaagaaauagggggaagaagggaagagaggaggaguaagaggagaaagaagaaaugucucauuuuuuaaaagaacaaacauuugucaggcacaguuguuuaaucccagcacucaggaggcagaagcaggcagauuucuucagaucaagaccacccuguaguacagaacacccggggcuacacagagaaacccugucucaaaaaaacagaaccaaagccaaaaccaaaaaaaaaaaaaaaaaaaaagcaaacaacaaaaccaauaaucuuuaacauaucuucuccaaaauguaugaguccuuaguaauggcuuacaaugaagaaccacguggaagaacugcagaagaauuuaagaaaugauucuaacuauguucaaacaacucaaagaagauguguguaguccaagacaaccugggacagaggagugagaaggacgggaaagcacaguuagaccagaaggcccacacugaauuuaugcugaaaccaaaacaaaccaggaagccaaauaaaccugugaguggaaagagccucaaucaaauggaugguguggaaaacagaguccugaacuaggaaaggaagugaagcaauuggcucacucaguaagucaaugagaaaugugcaaacaauuuguaagauauggagagaacaugggaaggcuuugggauaccacaaaagugccuaaccuucacauuacaggcggagaaaauaguuccaauaaaaucauaggagaaacuuucccaacucuagcgagaugcccguucugguagagaacaccaauggacagcaccauugugaaaagaaacucccagacauccuuuaacacacggaaggcacagauugaagaacagguaguacaagcugcagcagagacagguuaagucacacgacuacugguccaucaggguaacaccugguucuaugacagaaacuuaaagccagaagagccuggaacgaugucuucuaaguucugaagaagauccuaaccgucagccuagaguguuacacucagcaaaacuaucuuuuaaaauggaagaaaaauugaaaauuuccaugcuaaaagugggcugaaggaaucuguaaacacuaaagccagcuccacagaggguacuuaggucugaagagaacgaauacauccaagaacucacaaggaacaaacaaugccaagacacuuacuuagucaggaggucugagaaaacacaagaccaucaaaaugacagggauuaacacacaucucucaaugacaacucuucauauuaauugucccaauucuccaacaaaagauauagacuguaagauuggauuagaauacuuuuuugcugucuccaagaaacacaccucaauaccaacuuaaauucaaaggaugaaaaggggcauuccaagcaaagagaacuaaaaaauaaggagguguuaacuacuuuaauaccugacaaaacagauuuccaauaagaacuagucaguaagcagggagaaggaugaucccuucauagucauggaagaaacaauuaccaagacgauacuacaauucuagccauguguggacuaauuccugcacacuccacaaaagaccuaaaacuugaccuaaaacaugcuaacuguugacuucacuauccuacucacgccaauaaaaaggucacccagugggcuggagaaauggcucaguggcuaagagcacaggcugcaccucuagauaaccuggguucaauucccgcacccacacagcagcuuacaacugccuguaacuccaguuccaggggacccaaggcagacacauguacaugguguauuuaucagugcaugcaggcaaaauacccauacacguaaauaaaauaaucucagcaaacaaacaaacaaacaaacaaagaggucauuuagacaaaaacuaaacagagacaauaaguuacauaacaucacauggcauuuacagaccacuccacccaaacacuaaugaguaauugugguuucugaguaagacaugucucugaauuuaaacacuuggccccuguggugaguuaaggaaaauggccccuaaacacauauauuucaccaggaaguacaacuguuuggaaaguuuagaaggauuaaagaguauacauauccuuuugccagaacagguguggccuuauuggaagaacugggucaacggaggugggcuuugagguuucaaagccucugccugccugucugucugucugucugucugucucucccuccuuggucauggggucucuucacaacaguuccccagcuggugguuuguggagguaauggaaccggaaggagauaggagucuuucuggaggaaggacaugagcaggcaugugcuuugaagguuuauagccuuacucccgccaccuucuguuuucucucuuccuguuugcagaugaaauguccgccaucuuccugcucacuccugcaacacuuuuuccuaacacuguuuucccugcagccauuucuccccacgaucagcuuacucuccugccaguguaggcaaacacaaaccuaccuuaguucucuuuuaucacugauaaaagacugacagaaaccaacacaugaagccaaccgagggaagacaaggcagggacugcagacaaaaaccuggagaaaggaacugaaguggagucaauggauggauguugcuuacugguuugcucagcuugcuuucaacaccaggaccacccaccuggccgaguguggcugcaccuacagugggcaggacccaccacauuaaucacuacauaagaaaaugccccacugaguggcucacagcuagcaugauggaggcauuuucuugagguucaguguuuccaggugaccuuauuuuguaccaugcuggcaaaaacccuaacagcacgaacccguuucuuccuuaacucccucucuccgugcacuuucccagcagcagagauguaaccaacaggaauauguauuccucugcagccacggaacucccuccaaaaucaaucaccuaucaguacauuaaggaacucuuaaacauaggaaaagcuaaaaauaacauacuguagucagucuaucagacuucacuggaaucaacagcaaaagcaacugcagaaaccauccaagcuuaggaaaacuaaaugacaacugggucaaggaaaaccucugagauuccaagaacugaaugaaaaucuaaauacaucauaacagaaucuaugacauacaacgaugauagaacuaaaaaugccuucauaaaacaacaagagaugccaagauaguugauaugauaucaauaucugcucacuccugcaacacuuuuuccuaacacuguuuucccugcagccauuucuccccacgaucagcuuacucuccugccaguguaggcaaacacaaaccuaccuuaguucucuuuuaucacugauaaaagacugacagaaaccaacacaugaagccaaccgagggaagacaaggcagggacugcagacaaaaaccuggagaaaggaacugaaguggagucauugauauugauaugccagaagaucaaucaggcugagaucaaugauagaaauuaaaaaucaauaggaagaaucaaaugaagauuaacaaauccuuagcccaacuagucgaaauucuaaaagacccaaauuaauacaauuaaagaugaaaagggacacuuuauaaggaaauggaugaaucucuagcugcauaggaucaaaguuaauccaagauaagguaaauaauuuaaacagagccauagcaaugagacccauaacagaacagacucccauagucacagauuaggaaaaguaaugugaaaauggcuacugugcccaaagcaaucuacugauuaauauaauucccaucaaaauuucaaauuaacccaacaaaaagaugagaaauaauaaucucaaaacucguaaagaaacacaaagaacccaagauagcaaaaacaauccucaauaauaaaaaacauagaagguuucaccaucucugauuccaaguuauaauauagagcuauaguaauaaacagcauggugcucacacaaagacagacagacagacagacagacagacagacucaucaguacaacacaacguucccacagccaaaugauuuuagacaagaaguucaaaauuacacauuggagaaaagacagcaacuucaacaaauggugcugguuaaacuggcuagcuaauguagaagaaaaaccagacccuuagccggaacaaaacucaauccccaaugaucaaggaccucuaaauuagaccagauucccugaaccugguaggagaaguaggacuguuucaacuuauaggcccggaaaggauuauaggcauuaagaucaacaauuaauuaaaaaaaaaaaaaaaaaaaaaaaaaaacccuucaugaacuaaaaacauucuguucggcaaagggcaccaacaauccagaagaggaaaugggaaaacauuuuuaacaacuacuagacugacauaagguuaguguuuagaauauacaaagaacucaaaaaauaaaauauaaaucaacaaccccccccccaagaaaagcccuaaacauacacacacacacaaaaaaaaaaaaaaaaccaagaacaaguaaaaauuggagcaugaaacuacacagaguucucaaaagaauacagauggcugagaaauaguuuuuaaaugugugacauccuuagcaaucaggaaaugcaaauuaaaacuacucugagauuucaucuuacuccaaucggaaugaccauaauaaaaacauauacauauaaauuuuauuaugcauauugacaagaaugcaaauuacaguugggugguaggguauacagcuuuaauccugguacuugggaggcagaagcagguguaguuuugaguuagaaaccaaccuggucuauauagucaauuccaggccagccugggauacguacugagacacugucauaacaaaaagaaaaacugcaaacugggacauccacuacagcuaagugugguuuccucaaacagaucuaccaugucaucuugcuaucccaggucuggccuuauucucaagcagucucuaucccacuagagacaucuguccauccacguucacugcggcuaauccacaaugccugggaaaugcaacggccuuaauauccaucccugacgaacaaugcaaauacacaguggaaaaacauucagcuauaaagaaaaauuaaauuacaaaacucacagcuagauggauggaccuggaaguaaucguucugaaugaggcaacaggcacagagagacaaacaggauguucucucacaugugauggcuggcugugaaucucuagaugcguguguguauuaaauuggaaauuacagaaaucagaaaauuagcaaggggccacagaggauuuagcgcucagagaagggaauggauggagcucagguguaugaaggcugacagggaaguaacaggaaggauaaacgcgguggugggaggagggcaggguagaggggggggacacagggaaggaugggaacacaggagacauuugaaaagucuguacagaaaccuacuacugcagaugccuccuacaagcacacauauacacauauaaaagacauuuaaaugauacuauccuaaaacagcagaggguggcacaaugccuuuccuagauaacuaggcuaucaaauaaguugccagguaccaacuaccucacaucaaauuguugucagcaggguuccauuaaugccccuuucccuacaacaaugagacuacagcucuugccauugcuuuuaacuaccauccagaacuugacaguaagacucuauugcuaaagccacuacauaucuaggucacaggauaugaagaaaucaaaccagacacuucauuccuacuggcuagcuucagugcuggaagguucuaugcacacacaccauuaggagagaaaggucuuauacauccauaccuagcugugaauccugaaagcuaaagcaaugaccagccuggcaagcaguagcaugaauaguacuggggcagcuaaucacuuucuaacuggauuuaaagccugcuucucaaaauggaacuccugccugguacuacuuagugggccaaccccguggccgccuaggcuacguagccucuaggaaagacucugguauuaccaugcuaaacgaacauacuaaugaacuguccucuaaguuaucuuaauaaccguagauucgcucaucucucaacacucaccacaauagcuucucuucucagaagaggggacaggcaguagccagcuacagcaaaauggcuauuugcugggcaugacagaaccacuguacacaugaacucauaguggcuaugacugcaugcguaagaccaacacaaggucagcugaaaccccaucaugguugugggaggggcucaucaagucccacucuuagcugagaggguacugacagccuuccugcaaggggaaggagaaucaguuuucuucaaggaugagaggucuuaaggcgcuaccaaugcuggaguggacaguccuacacccaggcacauacagacagcauugaguagacaaagugccuuuaccaccacagcacaugaagggggcagaggaaguacuggggaaauagggagggaaugagagguagauuugauuuaucaaaaccuacauauacaaagugcaacuaaaaaacaauaaacauggaugguccuucccgcugagaaaaaguucauaggugaagaaaauaacauucuuauacguuccagauuuggugucucuuuucaguugggggugguagggugagcuugcuaucuaugguguuccuguuagugggguuaaguacaugacuccaauuucugaaaugguuuauuauuuaacaaguaagauacacacccucagcuagcucauccuuucuucaucucccugucccuauguaguuaguauauugccguucugaggguucugacugacuaguaaaaugguuuuaaggcaauuugugaccaggaagagaaaaagcaacagacacuagaaaugggcuggagagguggcucagagguuacaagcacuuacugcucuuguagaggaccaagguuggcuuagcaguaccuacaucauggcucacaaucauuuauaacucuaguuccaggggacccaacaccucuucuggacuccauggcugcauacacacagguggcacacuuacaguaagguaaccauuuuaaaaauaauaaacuagaaguaggaaagauaccauaaaguccuccaacccaccucagaaggggucucuuaauucaauggucuguguguacaauauaguagccauccucccaaucagauuucuguggcuauacuuaaagcacugaauugaagacuaaagacaaauuuaaagauaaagaaaauauacuagcacuaucauuugauugauuaaaaaagaaauuucuccccaaaugaacaaguaucugaccguuuuaaauaaauaauuuuguuguugcugaagcaaagucucaaguagcccagggcauguauggccaagagugaccuuaaacgucuuacccuccugccucgacuucccacaggcuaggaucaccagcauucacuuggcacagaggaauaaaacccaggacauccugcaugcuagcuaggcaagcacacuaccaacuacuagcccuaaaacauucuuuuagguagucuaucaaaacaauaaacaagagucaacucaaaaccacuacuuaaaaaaagaaaaaagaaaaaagaaaaaagugcuacuucccaagcuucagaaaguuuucuguguguguguguguggggggggggggggugucggaagguggcaccggucauggaaaugagguuucauuguuuacaaacacugggcuguuuaaaagagccuggguuuuccaguguuaaguaccgcuuuaugucuuacuuaugaccauuguagccaaaaucaaacuaaaauuaggagaccagagugacggcucagucaggaagcauuugccucagaugcuugagagccugaguucugguuucaggcaccgacacacaagccuguaugcauuacagggggcagauccccggaguucaucucaaaccgagucugaccaaaucugucacaguaagagacccagaaacuaagaaugagacccgcuagacccccaacacauaugcaugcauaccaguugacaaaugugugcucgcacuaucaauuuaagauaaauguuacuuagauaccauguccaaaaacaagaaaaagacaacacuucuuuaaacauugaaagguuuuguuuuuuucuuucauuuucuugucuuuuguuugcucuuguuuuugucucaagagcucauguagcccgaaguagcccaggacagacaucuuugggaugccguuuaacuuacaauccuccagccuccaauuccaacguuuuauaauaauucuccauaauguuuaaccuguguauacaaguauacaaguauacaagucauuucccuguauaucuaucuaugcuacaacugauggcauggaccacaacgcccuguugauuauacagugucagggagugaacccugcauguuaggaaaccauccuaccauugaacuacaucccacuuucuaaaaauaaauuuuggacacuaacagcuucccaguuacuauguccuucaaauucucaggcaagcccuuaagaagaccaccaugaagcacaguuaauuaauaauucucaauagcugauuacaggaaauaaagccuaccccaaagcugucacuccuuaauacucaaacagucaagcucugguugcuuugcacuguaggauuucaaguguaagucaugauacaguuucuuccuuuaugaauucucagaccugagagugaaacuuagcuuuaacaagucucagaacucauucuuaugaaacguuaaccagaagccuaguuaugaguuacaaccguucagguuucuucuuaaaauaccccuuuacucaaacugaaaacacacuugccgugguucagcuuacgccgacagacuuuacugucaagcaucuaucuacuccucugaaaacacagugaccugcucccuaguccaaagcucacuugcuguucaggcaauggcuggcugggucuucacuucuccaaagccugagcuucuagguucuuggugccaaggagaaaaacaauuuaauacauaaaucauuaaacucacauuauuaagaaaucagaagaauggaguaaaauaacuaaaaagauauugugacauaaccuauuuuucuaagaacuaauuuuaaaaaucaaguuauaguucucaagagcaucuucacaaugccgccugaaaggcaaaaccaaaaacucccgcaaacaucaccuuauucuuaaagcaaggcacggcuauaaacugagaacaggaaagaauggguuaacuacacacugugcuuugggugcccaaaacguuuaagagguuuucuguuuuguuguuuuguuuucaauagcaaaugcuuuauguaacaguugaagcucccacgaucaaguaaagcacuggaguacuuaaaagucacuguuaaguaaaauuggauuuuaaagucaaucacuaucuugugaauuagaauuugaaaaauagguauuuugcauuuuggaacacuugguaauauugcacguaaggguaaggucuuguauguaucuuuaaaacucacugugggaaaaauaaaaccaccccucuggcucuuucugcaagaacuuucgucugaggugaguaaguugaccuuuuagagacuuuaaccacagggaugacagaguaugugaaaccaccuugcuauuacaaucaugccgugaaggcuaaucucugcucugcugcacagccaaggccaggagggggaaaaaacuggauauucuuaagacauaugucccaccugugauucugagaaacugucagccacagguggccacaccucgagagggacuucuagguaagauucucuccuccccaaaggccccagcccuuauaccaccccaaccuccacugguagggaugccacaguccacacugagucaccuguccucucccucccaccggaaagguaaacaaaggccuuaaacaccuaauuuauaagucuccaauccuccuucgaggcaaaaaggucuuccguaauuccccaagugagcacuuaagacuuccaccaaauacucacuucagggcucccagacuugcccggucguggguagcugcaugcuuuacgguaaaucacuccccaacacucacgcauaaucuggucacacacagcagccucucggcuuucaauuaaaugcauaccuccccaagccagcccaacuguggaagccuuucucugagugcaaaaaguguggccucccagccuggaggcacuggcccuuuaaagguucuagcuuccuguacacccggucccucccuccucgccugcucccgccccggccaagggucacacuugaacuuuagauugcccagagccuaaaagccuuggccacccacuugcgcgcguccgaaaccguacccagugagugggaacgcucgaccaccugcucagugcccaggccacuuugguuaaaaccaaauuugccccggccuccgcaacuuucugcaaccgcuggcccgcacacggcucagccagcugcgcguuuggcuaucccaaaagcugcgggagccccgcgccugcgugcgcgcgcgugggggugggggaugucuccagugcgccccgcaccuccgcggucgggucccggggaaaccuuggcggccgagggucgggagagugggugcgcguguggguggaggagucgcccgacccccucgcaggaggucuggagugucaaauggagagggaccuuggaagcgaaccccucgcuccaacaacuaagcuaacuuucacgccugcucugccauuucacuuaaguucccaaacgagcccugcccgggucucucuagaagucccucgccugcaccugguccaaauuuggcucugggucuccgggaagcccccgccacaccugccauuucucgccccgcucucuccgugcgcccaucauuuccgggccccgaacacccacacugccgacccuccgccggccccaacacauccccaccccaccccccagggccgcccagaggccguucaccuuccagcccgccgagcuguugcugucgcccuuauccuugaaguagggcacgcucuucaccauccacucguagaucugcgacagggugagccucuucucggcugagcucucgauggccuuggugaugaggucggcguacgacagguugccccacgcguugcggcgcgacgagcuggucuugcgcggcugucccgcgaguggccccgcggcggcggcagcggagggaggcacgggugggggcugcgacagcggcccggucggugggggcuguggcggcgcugggugcacgcagcccgccucggggcccuggaaguccccgcacaggccccugcuggccgcagccgccgccgccacggccacgcagccuggcgcccgcgcgaaguccucacucuccuccagcaggcucagguugcucauaaagucggugcugacagcggacgccgaggccaggcucgccgcggcgucgggguuggcggccgcgccgcccgacggcgccggacuggagguggucgaguuggacugguuaaacuccggccugggcagcggccagguacaggagcgcugccggggcagcggcucgaaguccgggucggucuccaccaccuggggcgcuucggccauggugcccccgccccucccccaccagcagagaaguaccgggagacgcggccaccgggggcgcggagcgggcgacccgagugucgcuccgagauuggggggccgcggacggcggacgcacgccggagucaggcgcggcggggcgcagcggacggacgcgcccagaacuuaacuucgcugggucaccggugucuaaggagccuccgaguucgugccuaggacggggcaccgaccaggccgcggagcccggcagcucgggcaccgcgcucccgcugacaagggccgcggacgccaaggcagacgggcggacgcugcgggccgcucuagcucuccgcggccgcgcgacagcggcgcugcugccuguugaauguggcggcggcggggacugaagcgacuccgcagacucccgucuuacgggaucugcagcgggcu

SEQ ID NO: 12308 - RNA, 238480 nt, Mus musculus
gggagaggcaggcagagccugccggcggcuccgcacccaucgugcugcguuucccagcucggugucccccugccuuugcccaggcaccggcaaaacuuuuauuguuucggggacccccccuggaugugugacgaaaucgcaacgcuccgcugucucgucccccaagcucgccugcagcggcgaucgagggaacgugcaacccucgccgccgggcucuugcgcccugcgcuuccucaccugccgaucgcucccgggaaccgcgaggggggaccccuaaagggaccgcgcgggcaucggcaccccgaaauccucuucaccguugcggaccggcucggcgcaacuuuaacuugauuccugucgcccacccggggcacccgcggcggccgccgccgccgccgucgcugcggucucacaaagagcgcggggagggaaggcggcgcaggcggcaggcacgggccuucgggcugcccagacaaaagggaaacugccaucguucuggacgacuguuccgagcggccguggguucguucacccugucggcccgggcugccucuccgccuugguccccgcgggcagugcccgcaguacucggaccccgcgaguugcggggcacgcgucgcugcugcugguccgggcucuagggauaauaaaugauagaggauacaaugacuuugcugucucugcugggucgcaucaugcgcuacuucuuacugagacccgagacgcuuuuccugcugugcaucagcuuggcucucuggaguuacuucuuccacacggacgaagugaagaccaucguuaagucuagccgggacgcggugaagauggugaagggcaagguggccgagauuaugcagaacgaucgucuuggaggacuugaugugcuggaggccgaguuuuccaagaccugggaauucaagagccauaauguggcgguguacuccauccagggccggagagaccacauggaagaucgcuucgaaguucucaccgaucuagccaacaagacgcacccguccaucuucggaaucuuugaugggcacggcggcgagguaggaguucucugggucuauguguguguaaauaaccgggcgucucgugcuuggcggggucggaucggggugagaggggcgugguaaugaccuggugaugacaaggugagucaaguucccaagacccugccaaggagaucuuggguaugagagcguucacuuuagcugagagacacgagagacacuggauauuccgugccauuuuaauauaaaguucccaaggucagaagccaguuaauaacugcuaguuuucugggaagaaugaauaguauaugcagugaacuuugucaccaggccucagugucccgguucuagaguuugaggcaguuaaggaacgucgugucuuucguguaccccuaaaagaagaagccugcaccaguuggauagacugggugaaggugaaggaagcuccgacuucuauucgcuucgcgcuagggaaggacucccagcugcaacgcuucgcuucuucccaacucugccaacuuugcuagagccauaggacgugggacagggugccucgcuggugguggguuuuggcugccuggccuuugcagagguggcagugcgcucagagccggcguuaggcacaccugaccucuaugcaguggccagcuuggggaugcugauguccucuucuuucuauaagccuuugcuugggguugaucugggagcaggaaauagacuaaagccugcuauaggucuuucuggcauauuucugugacauuggacacucugggcguguggagucucagguuuccuggagguccugcccuuggcccugugcccagacguagggcguguuaaaauguggcuccguagcaaguucugacaucugccucagcuggacacuuguaacuuacauugcuucaggcuuccccaccucuuucuuggcggcauuccuuucccggguugguuguccugucuuccucuuccccuuuccuugcauucuuauccgucuuccuccucccggugggccccagggcaccguugcuuguuuuuggucugaggaagcuuucaguugguuaucuuauaggcgcucuccacucuccacucaccguuugcaaauguugcccagguuacagugccucccuguuaacuuuguagagaacaccaaacauuuggagcauuuaggugauaagacuggaauuaguauuuaaacaaacauuuuuucccacccccuuugccuguuuauaguaugaccuucagaaugaaaguuucucauucaucauacuuuuguaguuuuggggcaguucggaguucuccucccauuggccacaggguagcugaaagacaggagguuaguugagauaggagacacagccuagugagcaaaaagauaccaacaaccaaggguagcuguuuagugauggagucauaauguuguuuuaugugccuggacugacucagugggggugaagcaagcuucgagucucuccccuguaaauaauuuaagaaacuuauauuuauuauaagucugcaguagaacaguugcugauaaucugauucugggguuugaaagcacuuuagaaguuuugaugacuuaucagugugguagaaagaacaccuggcgguggugucuaaugugacauauuguacuugugauuggaugauuaaauuugucuucagagacagaaguuucaguugaaagguuucuagcagugucugagcaaauacgccacccaggaaaggaugcgauggaugcuuuauuuaguucaaaguauuuuaggugcaccccacuuucacgaugcacaucuaaacaaguacuaaaggaaaaggugaccacugguagacaaaccgugaaaugccuuuuacugcgccuaguguuuaaauacuugcuguuugcaaaguaguuaacauuaucaguucucacaaaaauggagugacuggcuucaccucugaccaggugcggucagguuagucuccuugccuuuguuuuaccuuaggaaagaaaacccaggaguguuauaaaugagcuaucgggguggugauuguaacagauacugcuggugacuucucucuugcuuuuauuauuguuauuauuuaaaaaacuuuaucugcauuuauuuuaugcugaauuuauucccaggccaugaguuuuuguuucuucaguuucuucugggauaucuuuuucuccuccucuucuggcuuuggaaggaucuguucccucucagugaggaucaucacuguggcagggggagcucauguauggguuaauccggccaugagcucuguagguuugucagugcaucuuaggugccuuguucaccuggauguguucagugacuagagaaucuacaucuaaacccuuaaguucagcauuccucucugcauuuuuaagcaugugcagcaaaaauucagcacucuuuuuuggccaccgacccuguguccagccccacuguuuggccugggcgcaccuaccgacuccaccauuauaccucuggaauggcacacauugcuucuuuaaagugucguccuucagacacuucguggcuuugcggauaugcauacacuugauggccggggcaguuucccagguguucuuaaagugaacacgaagguuuggaccucuugauuugcaugauuuugugggguuuucugggucaagagaguauugaaccauauucgcaggucaccucuggccgauuacaggaagagcuuauuauuauuaugauuuuuuaauaucuuguuauaucauuuuaagacaaucccagcaucuaguuccuguccuguguguucuuggcuucccaccagaggagggugccagugugguuuuuuuuuuuuuuugguugaugguuacaaccucucagaaaaggugccuuuucugaauauaggugcacacacuuggccauacacaacagagagguuaaaugaguucaauguuauuugugauaauucauacugauaaaauaagccacccagauuuagauucaaaaggaaacuuuacuugcacuuguauaguucguccuuacuuauugauuucauccggcuuuuuagacgaggugcaguuagagaaauugugcucuuccuaagcuaucuaagguagucggagacuuuggguuuguuggucucuucaccagauaauaggcuugcauauuuaccuaauacguagcacucuagggauacaagggugacugaacgugacuucugcccgccagagaagcuucagucuaauaaagagcaacuguuagacccaaagcgauggcaccgggugcuuguggugaucuaggaacugaagaacaaucauuucaagcagacugagaggucggugaggugaaaugccaagaaggcaccauugacuguaagaugaagagggaggcuuugcuugccuauuugugguuaaaacuagggucuggcuguggagcgaaggcggucaggagcucacaauccuccugcuuuaaucugcccagugcugugcccaugccucuaggcauguuccacacggugccccaaagagugugugcuuugacuuagguucuggcuuugaaccucugugacuucauaucugcugugaccuuaggccauuugcuuaagcagcuuuaucugggagacguuuaucuaaaaaaaggugggggugggguggggauaaugaugaaugugaggugaaugcucuucagucauaccuuguuggaaggaaucaauggagugaaagcuaccgaagaccgcucgagcagcuggaagucugccauguuguggcgaugauaacccagggagggaugguuuaccugugggaguuucaacuugcgucacuagaaagauguuuauggggcccccguaacuaacuuauuucccaaauucucugcgccuucuuucuaacaucugguaaacgaauguuuauuagcuaaggguucgauggacauugagaaaguggcacucuggucucaggcucgugguuucugauuacugagaaggacuauucucuguagcuaauuuauacauugguaggaauucugacuuuuacuucagccuccuaugaauugaguuagcauauucagcaaguguccccaccccgacccccaacauaucucaggacuuguguugaacacuagacuggauggccaugacuuuauuuagauguauaaaguguaaaauccaguagagcugguccuuuccuugauucucuuggacccuuuaaacauccucuccaccacauuaugggcagaugcuuggcugcuuguguauguaucugaagcuacgacagugaauuucuuacguagccuaagaucaagacaaucaaagguuauaaacgaagcucagguuguugcaauagagagagaaagguugcucuuuuuaaacuucagucagcuaaggggcugggcuuaguggcccaagucuuguuucaagcccauaggaggcaaaggcgggcggaucucugugaguucaaaaccaaucuggucuacauagugaguuucagaacagcuagaacuauguagugagacccugucucgaaaaaacaacaagcuaaaccaaacaaauaaacaacccccuacccacuaugucaucuaggaaaaugauuggcaccuauaauuuacccacaggcaaaaggcauuuugucauuuguuuguuuguguguuuguuuguuuauuuauuuaguuuuuuugagauaggguuucucuguguagcccuggcuguccuggaacucacucuguagaccaggguggccucuaacucagaaauucgccugccucugccucccaagugcugggauuaaaggcgugcgccaccacgcccagcuguuuguuuguuuguuuauuuauuuauuuaaaguacuguacagaagaaaaauccaauccuuugcagguuuggcugacaucuauccaggugacuggauuuuuuuuuuuuaaugcucacaugcuaauaggcauuccuauauauuauaacauacauuuuugaaaguucguauuccauaucagagaagaacauacgucaggugcuuguuggggauuucagucuugaagcccagaugcgaaacuguguggaggcuugccugcaggauccaggcacacagguuccugaccugagcggugguacuuguucugaggcaggcuuuccucugagaauguuacaaaagcccagacauauauauauacuccagagcaaacaggaucaugagauuuggcuuguugucaaaaguaagugguguaugaagccucuguuuuaggcuaguuuaaacagaaggaaauuuagagccaaaggagcgccauccccgggucccugccgggaccgcccgccuucuccagccugugugccugucucugugcgauguugucuugccggugaggguuguucugaggcauggucuuccgaagccccgacaaacggacugcaaagacauuauugaggguucucgugcauauauagcguacauagcauauauagugugcauagcauauauagcgugcauagcauauauagcguacauagcauauauagugugcauagcauauauagcguacauagcauauauagcgugcauagcauauauagugugcauagcauauauaguguacauagcauauauagugugcauagcaacauagaaugcuuuucaugaagaccaagggagagguaguucccuaaugcguuuccguuuucaucuuaagucugucggaucauacaacugagucauccgguggguuuuuguuuguuuguuuugcugcuauaaaguguuguguaaauguguagaaugucacaggauacauucauuuggccuguuaaccccacucccaggauagcucaucuuuucuacauucaguuucccuuugucccacuucccucucccuuuguaugcaucauuuaccuugugguauaaauauguauuuauggacauuucauugggucucucugaaauaagguccaguucuaacuagauaaacuacaaguacagucaauggucugcuuuucaggcauuacaacugaguaaaugauuaacucucacaucaugguguacaagagaccuagagguuuacugaggagaaaugcuuuauggcuuuagagaaaauauuauucuuauuuuguuuaaaaugguacauuaauacuuucccaaaaagaaaggucuuuuuuuccccccuuucucccuucuucgaagucuuucuuguuuuuccuuucucuuguucuuggcaaccucuuggcaagugaguguaggaggcuggcugugaccuugugcaucuuuuaacaaacugguaagagggccaggagauggugccaacugcgcuuaucuguguggugugccuccuguggaaacaggguuaagcugugugcuguccaaagaugagucagugcauucuuugccccaggaagcgugugugugugugugugugugugugugugugugugugugugugugugaugugcauguauacuuucaaguguguguauguacuugcauauguguguaugcaucugaaggcuagaaauugguaccgcguggacuauucuccacugaauuacugagguagggucucucacugacccugguccuugccacuuuggccaauauagcuagccaucuugcccguagggcugccuguccuugcuuccaagguacucagauuacagaugggacaccacaccuccuaggugguggggauccauauuccggucgccaggccuauguggcaagcacuucuucauccagugagcuauagcccuagcucuucaggaagcuucugucuaacucuggggaagugaaauguuuuagaaucuuagaacugcugggcauccaucauucuuaaguauguggcggccugucugagccagcuuguugagucuggguacuuguaagaagaaacugacaucccaugcuauccuagcauuuuaggaaagggaagauaacauuucuuccccuucaauggauuagagagagcaaaaugcagacuuagcuggacgaguagguguccuauugcuuagaguagacuuuugucaauagcugucauucuggaaacccuucauuguguuuucuauauuugaauacuguccauucugaucuacaugguggucuuagaugauuuauuuuauguuaagugcauuuauuuggaaaguaaacuuaucaucagcacugggaacagauaauccgucaaauaaaauucucagccuucaacuuucuacggagcugucagcauccugguggggugggaugaaucugugauggcuccccgaaguuucuggcucuguuagagucccuuugucuucccgccuacccaccuuauuuauuuacuuauuuacuuauuuauuucuuuagauaggaucuugcuauauagguuggccccuugcuccaaaucuuccugccucuuuuucuuuuuuugauuuuucaagacaggguuuuucuucguagcccugucuguccuggaacuugaauucagaaauccacaugcuucuaccucgaaaucgcugagauuaagggcaaucuucgcuccacccucuuuugcuuuuuaagaucagaaaaguagcuuagacuguuuaacugcggugcauaauuugaagcauagcaaguugcucaacacggguggauccugcagggaugcugcuuucggaagaaccuggugggggauguuagucccugaaaaaacaaacaaacaaacaaacaaacaaacaaaaucaacuuuagaggaagaaagcucuauuuccgcucaugucucacaggucucagccuggcaucacugccuucagucuguagcagacaggacacaucacauggcacaggaugugucaugguggaagggcaaggcagaagacaccugcguuccucagggcagccgauaaguggagaauacggagauaagauauacccuuaacucaucuagguccucagagcaacccgaucagcugugaacucaccgaugguuaauuagugccuucaugguccagucaccuccucaccacaucaccacgugaggacuaagccaccagcacaugagccuucaggggacauuucauuugggugaaacacacacacacacacacacuuuuucucccauguguuggggauugaacccaggacuuuguguuugguaacuguguacuucacuacuaagcccuaucuuuaguccucuguccaauuucuagugcaaguauguggauauuaucggaaguccuuccaagguuuugugguugcauuuuuguuuaguucuuugaggguggaucuguuccccaugcuuacucuaacaaugaaugaccuugaccuuggaaacucaaguuauccuccugucucagcuucuucaauaacagaggcuauaggcaccaaucacuacacauagcuagaccuagcuaguuuaucuuuucuuuccuucuuaaaaagauuuauuuauuuuuauguguaugcguguuuugacugcaugaguguguguguaccauauacaugccugguacuuagaggccagaagagggaaccagaugcccuggaacugaaguucaugagcuguuguguaggugcuggaaauugaacucugacccucuguaggagcaguaagugcucuuaacuacugagcugucucuccaacccugcuaguuuaguuuuuaaaaguaaguagcacauuuugauauuugaacaauuacgagucacaguugcuuaugacauacagugacaagauguacccagugucuuaggacccaagguggaugagucuaggcguggggguuaggguguacagaagcaaggagaacaggagacugccgaaguguuggcauugccuuggacccuggcugaggaucggggcugucucuauggguauuugaaggcaugguguguuguugagcaagacaaaccauccuugcuuuagcaguccugugucaucccuguuggagaagauuugccuugaguggcaggugaagagggagagucagaugcugagccuggaccaaugcagaguggugugggcuaucacugaaagaggagcccggagcgccuccuuggugggcaggagagcaucacucagacaguggugagucuggcuaggaauuugcuccaucccuccuuugauggcggaguuucuggcauucauaaaacgugugcugauugugugcucgcugaacuuucagaacaucauugcuguuauguuccuauguggaugcauuuugaaacaaugaaaauaaugcauuacuuaccagaucugguuuagucaagcgggaaggccuuuguuuccuguagacagggucuuguugugaggccuaggcugaccuggaagccaucuuguccuccugccucagcucucggugcuguggagaucacaggcagugcgcuagucccaucuuugauuaucauuuuguuucugcagaugacuuagcuuuuauuacagagcacagccucuucaggauucaggaacucuacaaugucuuacuuuuauuuuuguuuugugcgacaguguaguguuggcuggccuggaaugcuguagguagcccaggcuggccucauacucaaaggagagcugccugccucugcuucccaagugcuggcauuagagaagugcaccaccguaccuagcuguccuuaguucuuaaaaagugauuuaacuuuuauuggcugugaucauucgaucucauauuuaagugauccuggggauagggacucaguucugaacaaaaaaaaaucauguuuuuaacuugaaguuaauaucugauuuguuuuauucuuaauuuccauugugaucuuuaguuauuuuaaggacauacuuuuguguuuuaauuuuaauauugcuuuacuaggugcucuaacauaauauuguaguguucuuaauauuaaauauuaauauaaauaaauauuaaguagcaugaaauauucaaauaaagcugcaagaaauauauuuaaaaacaacugaauuuugaaaucaugagaguauaauaauauaacaccaugauaguguagagaaaaagccacuucgggucucagccuggcacauucacucuugccauguuaguguguggcuuguuggucuuagugggcuuuucaaauaugguuuugcauaauccugucaguguacauacauacaguuuuacauuauacagacguuacaacacuuuaugcuauuuguaaacacacuaaacaugcugccauuuugcacuauaauucucuauauuuuuauuucuuauuugcuauaugacuaggggggagguaaacaccuguggaagucagaagacaacuugcaguaaaugguucugcuuuucuaccaugugguccugggaauugaacucaggucaugagguuuggcagcaggcaccuuuacccauguagucagccccuauguuuuuaugucuaacaaacaguuuuuagugauaggauaauauuuuacuuaauuuauaacuguuaaauuacacggcuauuuccugauacauuuaguuuauucuaacuuuucaacauuguaauuaauguaauaaauauuuuaguguuucuacuaugcuuuggaauuuguuuuuguuuguuguuuuuuguuuuuuaagauguuuuguguucuguuuucuuuggaagagcagucagugcucuuaaccacugagccaucucuccaggcuguucuuuuuuuuuuauuuuuuauuuuuuuauuuuuauuuuauuuuuuuuaaauuuuuuauuagguauuuagcucauuuacauuuccaaugcuauaccaaaagucccccauacccacccacccccacuccccuacccacccacucccccuuuuuggcccuggcguuccccuguacuggggcauacaaauuuugcguguucuccaggcuguucuauguuaucuuuauugguguuuauuuucugacugaaguaauggcuugguuguuaaaagugcuugcugcucuugcagaggacccagguucaguucccagcaccuccguggcaucucacagcaaucuggaacuccaguucgaggaguccugacugguuuuugaucucugaaggcuccugcaugcaugugguguacauacauacacauaaaauuaaauaaagaggaagggauaauuucauggaugucaugugcucugacuauauuacucccucauacacuccuuuuuccgucuucccaugagcuuugaauuccuuucuuauucuagucucuuuuuggcuuuuauaugauauaugcauuucucacacauauauguguguauuuauguguguguguauguauauauuuguuuaauauaucuacacaugauaugcuauauauaucuacaugugauauuugauaucuguagcuauguaugauauauauguguguguauauaucugguuuuagguagucacagaaaaucuaggguacaaaugagaaaugacaugcaguauucaucuuucugaguuuauuucauuuaagaugaaggucucuagaugcauucuaauuuuccagacaaagacguaauuucguccuuauggcaguaaaaacucuguuaugccuauacacuguguuuucuuuaucuguucaucucuugauggcuaccuaagcugauuccgaagcuugacuguuacaaauagugcugcgcgugcgcaguaggacgugcagguguggcugagauggugagagccccucagcuguaaaccagaagcauaaaccugcugaggaugacggagcccguggucguucuggguuguucugauuuuauuuuucacgaagccuucacaauggcuguacauauuuuauauccccaugagcuguauguaaggagucccgcacuuugcauuauugggaauauuugucuuuucuuuucucuucaugauagccauucuuuuagauagacugugaguagaguuauagguuuuuuuuuuuguuuuuuuuuuuuuuucgguuuuagguuuuagguuuugaaguuauucauguauucuggauguuaaguuaccaccgacuguguagcuagcagaguuuucucccaaucugugagccaucucucuauguagaugcuuuuuauccucacaugaugucuaucccauuucucaguucuugguaugcuuuucagaacuacugaaguccuuugcaggaaauuucugcuuguaucuuguagugucuucuuauagcgauuucaguauuccaggacuuguaguaagggcuuuaaucaauuucaguugauuuuguacagaggcaggcagagggucuaguuuguuuuuucugcauguggcuauccuguuuccucagcaccauuuaaugaggugugaggaacagccgaguaagccaggggagggaggcaggaagcagggcgacucggugccuuggucaauguuuuaucacagcaacagaaagcaaaccaggauaguggugcucaaaguacuucugcguguuaccuaauuuuaguuuucacaagaguguaucagauaguaaauuucugccauuuuauaaaaguacacauuaaggcaauaagaaaugaaguaauuuacucaguuccucauagcuuuaaguaauaaaacuagaauuggaagcugagagugggacuuuugugucucuuagggcuggagagaugcucaguggguagggggaacuggccucuuagauauagauauauauauagccccaaagcuguguuacuaguuucugguugaaguuccauagggugguaaaacacagacaguuguuaguguguagacaucaccuuuguuuuuuuacuuugcucagaaggacuccagguuucucccgugauugugauguuccugugauaugugauuuugcaaaccuugguagaugaaucuuugguagguaauuguguaggagaguccccuuguuauggaaguaauggugucugaagucagcaagugagccucacauucaggcagguuucgagacaccccauuuauugcugacacagucucuugucucauuauagagaauccuccaccucccccuugcugggcaguuacggggccaucgguguagacaguccugacaguaagaaagauugagguuuuauuuccuuugggauacuacaggcuuuaggauaaauauaugggauuuaugaaugauugcacaguuucuccggguaccaguguacugauaguuuauuauuuuggaagaccaaaacaguugguauuuucuuguucacuuuaaccagcaaaauaucauuuucucauuuguuguaauaccaguggcaugcuuguuugauaaaaugcuuguuuuguguuuucauuccaaaaaguuggaauacauuauucucuuagucaacauuaagccauauucugguuuauuuauuauaaaccuucaaacccagucucagucuuugaguagggagagacuugacaugacagaguuguguguagaccucugcguguacacuuuccgucucaugcacacauaauaacauuagccagaacacuucuauagcuuuucuccuuggcaaaguaccaaacacuuuuaaaauauucauggagauuaagauuauacauauugauaaaaugauguuuuccuugaaguagaggucugugcuaugauaaaguugggauugagauaugaagagauaauacuccacuuaaagugaaugaaacucaaaggcuuuuucugauaauauuuuauauuuucugauaauauuuuauauuugugcugacuuuuguuuguuucugucaacuugacacaagcuugggucaucugggaagaggaaacuucacugacgugauguuuuccuucaucagauuggccaguagagaucucuggggggcguuuucuugauaaaugauugguaugggagggcucagcccacugugggaggggccacccccgggcaggugauucuaggguagauaagaaagcaaacugaacaggagcaucccuccagggccucugcuucuguuucugcacucagguuccugcccugccuccaugacugacuaugaacuguaagcugaaauaacucauugauuauaaacugcgugcugaacaaauuuccccagcuugcuucuggucauggcguguuaucacagcgauagagaucuaaccagaacaauauuuuuccauuucucugcuuuggaaauagaagccaacggaaugaaaucuuagcagccuccaccguuucuaggaugacugaggacuuugguaguugagcauguuaugaaugagacguacuucccuguuccugggggcaggggagucacugggcacagggcuccugaagguuauuuaggaaccauuuguguggcuccugcacugcacagcagcaccagcgagacaccccauuuccaguggcaugaaaaccaucugcucccagcuagucucuacaaauccacacugacucggaaaacucucuggcuuguuuggagguucagucccuuucagaccacauuguucaugucggugcccuccucuuccggcuucuguaugauguauaggauccuguaugaugucucuuccggcuucuguaugauguauaggauccuguaugaugucuguguccccauugcugggucagagacuaccugugcauuuuucaagucagaacaacuauggcuucgcuggaggagaaaucagcacuugugugcaugcgcuuuucagugcuagcauucuagauuuuggcaauuauaaaugccacugagcaauaaaaucuuaauaggccacuuuacuuuuaauaaugggggagacuauacucgacaucacuuuuagacagacagcaaagguguuaaucugaaaccugccgcuuaaaaauuauucccuuaguuauugggugugaugguacacaccuuugauccuaccguuuggcaggcagagacuggcagaucucugaguuugaaggcuguauagugagagagaccuuaucucaaaaauaaaacaaguucucuugaaagauuagucaaauugcucauaaagaacagcauacauagcuuagauaauaaauagcuuauauaauauauaguuauaaauguguauuauccaaaguaaaggcuaguaaagaauaaacuauauauauaugcaaaacauaacuuuauaguguuuuagaugacauaaaagaguaccuugaacuugugaagguuggugaaugguaccacuuuucuguacuuucagcaugauaacccaguaaauaaguauuagccugaggguucccggcauauuuuuuuuuuuuuuuuuaaagaagaacgucuuaugucuuucuguauauguucacugugaggaaauuuauucuggaaguuucaaagauacaaagcagaauaaauaggagcuuuuggagcugauaguaaguugaauuugccugaugguuuuaaaagucaguuuugggaagauaaugauaaugccauauuagaggcauuauuucuaaccuacgugccaggcaucacugaggauauauagaagggaauacagagauaggcacaagccugguagcuuuuccuuauaguacauagaaauuuauauuugccuguguuuccucccuguggcucgaggacccagggggauuucuuuucuuguguuuuuagaagagagcccgaccggucagcagucuuccuaugugcuguccugguggcugcuggcauuuguacagugcaucccggccuaaccuguuuugguaaaagucuuguucuggguuuguucaagugugagacucaagaggcagcuacuacuucuagaaaaggaaacuacuguuuuuagcagagggauccaaaggaacuccugagggcaaagaccagagagccuaccagcugcccgagagcugcucccgggccuccccuuagagucacaggcccuccugugguucgcagugcugcauagagacagaaguuguuuauucccaaggcuguuguagugcaaacagauuuagacaugaaaagucgcaggcaagcaugcauuuuggaauauugcuuaagaggaaauucuuugaaaagacaaauaauguuuuguuuuguuucguuguccccucugaaaaaggguuccucugcacagagaaacccugucucaaagaaccaaagucggauaagaguguuugugcuuugccagagagauguccucaccccaggugcaaguagggauagagacaauuguucucuucauuaaaaagcaaucaccauugauaucauuuagucagaguccacaauccggucucggcagguuccacugaggcgcgguugacacacugugaguuccuuauuuaaucgugccguucgaucagcuuugugcagaguuguggaaccaucacuacagccagauaaccucugcccuccucugcugcccucugccacgggacagccuuuagucugccuuucacuacuacagcuggcguggauucuauaauaauuucuguucauguaagcacacaguguguguuuuuuuaauuucauuuugagaucccuguuguuucaccuuucaguaauucacucucuugaaaaugaugcacuaguuuauaguucaucauuaaaauuaaaaggagauuuauuuuuauuuuauguguguugccuguauguauguauguacguauguauauauguacauauguauauaugucuuauauaugaaugugcaccauaugugugccuggggcccuuggaggucagaagaaggugacauagccccuggaacuggaguucuauauagauuuguguggaccgccacauuggcucugggaauugaagcugggcuuguuguaagggcagcaagugcucuuaaccacaggaacaacucucuccagcccagccaauccauauuuauuccugaguuguguucuaguauauggaaacuucagauuuuguaaaaaauaugaugggugauggcagcccacaccuuuagucccagcacucuagggcagaggaaggcggaucucugaguuugaggccagucuggucuguaguacacuuuagguuauaccuuuagguuuuuacccacauauauaccuguaguacacuuuagguuauaccuuuagguuuuuacccacauauauaauaguaaaaugcaaacauuucucauauuucuaauauauauuguauaacuuuaaaauuugaaauuauaguuucaaauuuacagagagguuaugugggcauuuaggaugaaaaaucccucacccagaauacuucagacagaaguauuuaugauuauuagauuuugagauauugauacaggcucuccccaugaagccuugcuaaucuggacgucucagaucuaaaacuaagcuucgagcuacugcuuuuagggcuguggaugcucagaugagggauguccagccuggguaagaaccucccacgugcuccuuauucagcuucggcccuguucguuuagagugcauugucgguugaccuuguguuggaccaauccaacacagagaauuagcugagguauggggagauaaaauaaggacauagcacuuuauuuuaugcugaauuuauucccgggccaugaguuuuuguuucuucaguuucuucugggauaucuuuuucuccuccucuucuggcuuuggaaagaucuguucccucucagugaggaucaucucacuguggcagggggagcucauguauggguuaauccggccaugagcucuguagguuugucagugcaucuuaggugccuuguucaccuggauguguuuaaugacuagagaaucuacgucuaaacccuuaaguucggcauuccucucugcauuuuuaagcaugugcagcaaaaauucagcacucuuuuuuuuuuggccacugucccuguguccagcccuacuguuuggccugggcgcaccuaccgacuccaccauuauaccuccggaauggcacacauugcuucuuuaaagugacauccuucagauacuugguggcuuuguggauaugcauacccuugauggccugggcaguuuccuagguguucuaaaagugaacacgaagguuuggaccucuugauuugcaugauuuugugggguuuucugggucaagagaguagcgaaccaucuucgcaggugaccucuggcugcuuacaggaagagcccgucaccuuuacaaaaagaagaagaaaagaaaaaaaagaaagaaccuauuaccacgaccgacccccagcuuccauccuuguucuucucugcaaauuauguuuugguuuuuuagggguaaauauuuuccuuuauuaugguguagaccaucgccucgugcucugugcaagcccuuaacagcuguggaagacaggugggacauuaaguguggccuuaguggaauuuuuuucccccuugcuuucaaaucacgucuuuugggaagggauuucccggggcuguuagguuuggacauggagaaccugagcggcccugcccaucuucugcaaauaggugaugugcucucugcuuuuguuuauccgagcuacagaaguccacugagcacaaaguacucaguauuguacuaaaagaaaaggaaaauaauugcuccagccucacaggcuucuuagcuguccccuguaaaaagcauuucacauucaaaacagcccagcacaggagagagccagcuggggaggaggcugcacaaugccugccaggugacaucuccuggguggaaggagguccuuaggcugagcacaggcacuuucuagaagccagggccggccgccauguguuuacccgguuucugucuggacguguucaagaaaacuggaggaaaguuuucaaaaggcggcuucucaggagaagacuaaagauugggagcugaauucgaggcccuuucuauacuuccuuccagaaucaaggccgcgcgcgcgcacacagauucugaaaacccugggaacucgcucaccugcgugugccucuuaccuugacggugcuaaaucuucacauguguuugccagaacuccacugcucauuuuugggcuguuauuuuauuuaugaggacuuauuuucuuuuucuagaaagucccuccucuucccucaagauggggucucccuguguaagccagguuggucugaaacucauucugucauccaagcggccccaaacucaaaauaacucucccaccuccuccuccuccugagcaccaggaucaccaaagugugcacucugcugcggcuuagguuuucuuccacaaaacugagaucugguagcuggggaacuggcagagacggugaugugccugccgugcaaacgugagaaccagaguucacacuaccagcacccacagaaaaucaggguaugggggaugugucuacagcccugcuguuggaggcugguagagacgacugguaaagauggccgcucuauccuguccacaucacagacaucuuuguuucagagcgucacuacugccauucugaccuuuugcagagagguuugucccauccauuguauguugaaaauuaguuaggagggcgugucuuuagcgccaucacagacccacuauaugcuaguugcagcuaggucuuucccuguacagagggcaccaguguggccugcgcagaacucugaccaaggccagaguuggcauguguguuaaaaggguuucaggauugagaguccggaucccucuggucuguaggaaaagguuuauaaacuagcuguugagaaacauaagcuaugcuuuuauuuaauugauuucuaaagcacuagaguuguuucugaacuguuuuaacuauugacuuuuuaacaaaccauauuuagauuuuaaaaagguuuuggacauguguuuuuauuauuucaaaaguaacaucuauauuauuugaagauuucaaagucauagagcugagaagccuuguugguaggcguuccuccuugucugccauuuaccucugauucacaaguguuuuuauaauucauccuaaauaauuugcuuaaccuguacuuaauuuuuaagugcacuucagaaaugcuugguuauugaauuguguuauuuugugauauagcucuguuuauaagugauggaaaguuuaaaguauuuugcuuccuaaaauagcaauuguggagaagaaaaagugccuuuucugaaaccucccuguggccuccaugugggucagugggacuucugggcagugguguaaauguguaauguguaaauguguucaagaacuagguuucuuaucaaugaaggcauaugaguccaaggggucucuucugucagagcaugcuugugugugugucugugugugcgcauguaugugccuucagacaggguccuccucucaccgacuccagccagacuggcagccagcaggacccagugacccuccugucucugucuccugcagccgggccagccuggcuucuuacguagaugcugaggauccaaacgcagggccucuuccuugcacagugagugcucuuagcugcugagcuaucuucccaacuuuuauaaaacuccagaccaaauggcuucuaaguucaugucugcaacuuucagaaguaggggagcuacaauagaaacgagacagcacauagaaaacagcagugagaaggccacacaguguagaugacagaggccagguuaacaucugcuguguccccgccuggaauaucuauaguaggaucucaagcauaaucuagagcauaaccuuucaaaaacccacaaaaggguggaccuaauaacuauuuaauuaaaaauuagcacucuuuuccuuuuccauuuauguauuuauguauguauguauguauguauguauguauguauguauagaaucaccugaccaguuuaucuaguaggaccuuguuaugguaaacaucaccuuguguagaccuggggucuggagacaggucgagaggcucucuccagcaagguggaaggcaagaacacgugucccagguuguccucugaccuccacauacgugacauggugcacacaaaugcccuggcccugcucaccauggucacucaugcaugugcagguacacacacauaaauaagcccauuuagguuacaguccuaaugugugugugccucugagacgccucaccuggagacugaccgaggacggugaggaaaggcgugcgugccuacaggucgggacuggaaagacagaauggugacuguuugggaaagugaccuucaagaaacuccucugaccagucugucugccucugggcuuguucugauggucacuggauacuuucgcagccuuugguuaaguuguuucucauaucugaaacaccuaguucuggggaaugugcuauguuuuaccccauucucucaucuucaucacaucuaaccaggacucagaaagugugcucugccuccagucgucuggggguuuaaagccuguggcuaagcuccugugauuaaugguugaauuaacugcaguguuagagggaaaaacacuuagaaauuugcuucugagaacaccuugaagguucuguaaaauuuuaaaauuuguauaagaaauaauaauuauuuuauauauuuguaaaacauuuauauguguucagguaugcacuuauuucugugugugccugugugcauguaugugaccucggugagcaugcuccgugucauuugcaugcgcuguggcauguauguggaggucagaggacaaccuuggauguguggucuugccuuccaccuuguuugcugcuggguaccucagguuaguuggucugugaagucccaguguucccccugucucugcuuccuguccugccucaggagacugguauuucagaccgaucuuauccugcuguauuuugguucuggccaucuaacacaggcccucacacuugggugguaagccccuuugacccauggaaccaucuucaaagacuaagaaaacaaccacuuuaaaagaaaagucuuuugcuucauaaccuuguaagucugacaguaaugggaaaggaguauuccuuuauauaacacaaaccacuaaaagcuaaacauuugagacaacaugaaaguaugcucaauaaaaaaaaauuaaguucuuggugcuggagagaugguuaaguuguuaagagcauuggcugcucuuccagaggacuuggcuucugccuggcauagccaucuguaacucuagucccagggguucugaugcugucuucugacgucccugaaguggugcauagagagguaugcaggcagaacauguauagcauaaaauaaaaauacuaacaaugauuauuuuuacucuagaucuccagccuuccuucuuguggggccaccaucaccaguuuccaguugccucuugagugauauuuuaagugugugcaaaugcaccugcucgauucuagaucuccuuuuaaauaaacagcagcguggaagcuuccgugcccuguguuucucacucgauguuuugaggauuaacucagacagaucuguuggguuccucuuccuggcuauucaguauuucauuacacagacgaucucuuguuuaaccacccauugcugauggacauccacacuucccacagucuuugccuuuacagacaguccuacauacucgaugcucuuuagguuggccuuucccacauggaucuuguaguaggaauucccagaaguuuaauuaaugugucaaagaguauguaugguuccaauuuugaugcuucuugccaaauggaguuccacagagggcgacuaauuuauauuucguuagugcugaucucaaaagaugagugcuuucauacacaagaauguaaugccgaacuccagaagcugacccgcccuucucugucuagaauaaaauauguucauugcaccccugcgcuagcuggccccccaagccggggguguucuuccuccacaucuuaauauagucaagcucuugugauuuaagucucaguaaaaugaugagaacagaucaggauucaguuuuuuagcauuuggaguuugaggacagucuggguuauauaucuugauuaacuccaaggccagcauaaggugugugaaacccuaucucaaaaaacagacagacaaacacagacacacagaccaacagacaucuggaugugugccuauguuagcuuugugguggagggcucagggccccagguucggucacuggcacuggaaaaggaaguucccaaggcccuuuucacuuucucucuagauagaguacuguaguuucuaauguuuacuuuuggcuuuugagaugagucuuguauaguuaaggcuggccucaaacuucccacauugcuggccuuccugcuucuaccuccuauguguuagaaaugcaagccuggcuuauuugggcagaucucuguauauuuuaacuuuggucuuugcuggcuggauaacuguaaacacuuuucuuuccuuuucuuuucuucucuuuucuuuucuuuucuuuucuuuucuuuucuuuucuuuucuuuucuuuccucuucuuuucuuuuuucuuuuuuuuaguugugagucuggguaucuucuggaaagucacuugcuaguguucuuaucugaauagccuguagaacccacauuuaauuucuauagcauguuuuuuucugaucaaacuguaagaauuguugcucugggaaggaacucuuugcuacacauguuacuaaguauggauguucauuauucauaguuugacuucaacuuuuguuuuuguuuuuccuuuuuuuuucuuuguaccuaacacucaagcuaucagacuuaguaauugauuguccucaggcuuauuuagaaagcaguauccuauuuagagauaauaaugaccuguugcauuucuaguauuuuaaugcauuaauuauuuuuaccucugauccaucagaaauaugagugugcaguaguucagucuuaguucucuaguuuaccacaagagcuuaguuucccaccucuggggugcgguagcauugguuggggcugccugucuucuauguacugccuuucaugcagccagcauaagcagugucguuuuaaaucuucauacucacaggcauuuaaagaccaguggaacugcccauuuccauaaaguggugguggaguccgccuguguagcuuccuggcugagacccuuugugagacagaguuccgaugccuguuuaauugcaccagcuguuaucgcuguauuuugguggcacuuacacucaugagugaugugcuguuugcguuguuuggcauuacguuugcuuguaugaauuuagaugaucaauuuuagcauucagaguuuuauuaaucuucucaucucauucagcaccacagaaauuaagcaugcgucuuuaacuguagccugcaaacaucuuagcuggguaaaaauacagcacaguucuuggcaaacguguugauuguaaauauguaacaagaggaaguaaguugggaaggcaaauuggccugguagggaagcagcuaaugucaggggucugagcacuuggggggaggggucucuguuagauuagagcagugguucucaaccguccuaaugcuaugaccuuuuaacacaguuucucauauuauggugacucccccaucaauaaauuauucucauugcuacuucauaucuguaauuuugcuacuguuaagaaucauagugcaaauaucugaugugcaggcuuucugauaugugguuccucuaggggucgugaggcacagguugagaaccacugagagcacagacuucggagaguaagaagacacgagggagggccugugaggugguggcugugggcgagagguauugcugccagaaaaacuugcuaagguucuguucuugugacugcucugguagguugguucuguacuuuagaguggcagagucaagauggagggaggacacagaggaauggcggaugcuauucuugggagaccagcugcaucuggaucacucaagggucagcauugaggguucuauauauaacaacuugcauauuuucucauccacguuggaaaggaaauuguguaggauaauguuacucagguugaagccgcucuguugaguuauuuuuaagcagucuuuguagacuguucagggagggcuccaggcaguuucuuugaaguccucuuucauuuuccuuagaacuaagugcuuuggccacuagagaggcuuaagggccuugaacuuguaaacauuuucaucaggugacagugucacuggcaguaggaaaugccaacagagcagccugaggugccuucacagagccuggaggccguagaaaaggguucccucagcucagaggaugcaggauugguaaguuuauugacugaacagggagacaagacagcuggagagccaagugcuguguuaggaguggugaguguaacguucccggccuggaaagcuacuuacgaugcaacaacgcuuauauauuacggcagguuugugaugcuauacuuguucuuacuuaaugaacuuuuccuugaacagaagccuuuuuaaaggcugugcaggguaggaaggaagugccaggagacauucaaaacacugaucaaagggauucuugccuaaacguagguaguucacagccaucuuuacagucucauuugugacguuucuuagaaaugaggguacaguuguucucuuggugaccuugaugguuaugcguuaauuuuugaaugucggccaucagagcgagaaagcugaggggagcccuuucucccgcgucucccauguuccccccuagacaucuggcaccgauaccauuuuaucuauuaucuccagcgcugcuagcuucagggcuucuugauuauuugauuuaggcuacagucacauugaaagucauggcuuuugccuuuugcuagacuuccaaugguccugagcucauuuaaagacagccaugaagugaauaaacaggaccugcuugcguagcucaguguagagcaguugucuaacaugagcaguguugcccguuugaucccagcacagcaaaaaacgcauaccaagacagaauaccgguuauacaacccaaagcaagacaugagcaaaacgucaguuacugaagagugaugcugugaacacaugauagcuggagacguagcucaaugguagagugcuugccuagcgugcacaaaaaaggcucucuggguuccagacacaguaccaccaaaacggcaguaacaacaacagaauaaaaagaagccaccaccugugugugugugugcaugcguguguguguguaugugugugugugugugcaugcgugugugugugguuuguaauaaauaauugaauuuauguauucaaaagggugggaaaagaauagucuuagcaucaguguaauguaagccauguaauuuuugccauugaacuaauuauaagaucucucccaacaccauuugagaauaauaaauagacauaauaagcacauuguaggguuuugugacauuuuaaaugagacuguguauuugaauuaccuggaacauaauuagcacuuaccauauuucuuuuuuaaauuaauuauuuuauuuauuuacauuccaaauguugcccccuccauaccuccucccagaauucaccagauuucuuaauggugguucaaucccuagcaugucaguuucuuuuccuaaaauuuccuuuaguagcuuucauuucagucuuauuguacaguuuuaaguuuuguuuuaucaucaauccauuaaucaaucccucccacugaucuauccauccauuauucauccacccaucauccauucaucauccauucauccauccaucauccauucaucauccauucauccauccaucauccauucauccacccaccauccauucauccacccaccauccauucauccacccaucauccauucauccacccaucauccauucaucauccauucauccauccaucauccauucauccacccaucauccauucauccacccaucauccauccaucauccauucauccauccaucauccauucauccauucauccacccaucauccauucauccacccaucauccauucauccacccaucauccauucauccacccaucauccauucauccacccaucauccauucauccacccaucauccauucauccacccaucauccauucauccacccaucauccauccauccauccaucauccaucacccauuuaacccauccauuuaucuauccauuauccaucuauccauugaucaucauccauccauuauccauccauccauccauccauuauccaaccauccaucaucuauauacaucagccauucauccuauccauccaucauccauccauccauccauccauccaucauccauuuaucuaucaaucauccauccaucuauccauccauccaucaaucauccauccauuauccauccauccuauccauccaucauccauccauuaaucuaucaaucaucuauccauccauccauccauccauccaucaucugucuauacaucagccauccauccuauccauccauuauccaucuauccaucaucaaccaucaucaucugucuauacaucagccauucauccuauccauccaucauccauccaucauccaaccauccaucauccauuuaucuaucaaucauccauccauccaucauccauccauuauccaucuauccaucauccaacaauccaucauuugucuauacaucagccauucauucuauccauccaucaucuauccauccaucauccaaccauccaucacccauccauuauccauccauccaucauccaaccauucaucaucugucuauacaucagccauucauccuauccauccauccauccauccauccauccauccaucauccauccauccaucccuccauccauccaucauccaaccauccaucguccauuuaucuaucaaucauccauccauccaucauccauccauuuaucuaucaaucauccauccaucuauccauccaucaaucauccauccaucauccauccauccauccauccauccaucauccauuuaucuaucaaucaucuauccauccauccaucaucugucuauacaucagccauccauccuauccauccauuauccaucuauccaucauccaaccaucaucaucugucuauacaucagccauucauccuauccauccaucauccauccaucauccaaccauccaucauccauuuaucuaucaaucauccauccauccaucauccauccauuauccaucuauccaucauccaacaauccaucauuugucuauacaucagccauucauucuauccauccaucaucuauccauccaucauccaaccauccaucacccauccauuauccauccauccaucauucaaccauuuaucaucugucuauacaucagccauucauccuauccauccauccauccauccauccauucauccauccaucauccauccauccaucccuccauccauccaucauccaaccauccaucauccauuuaucuaucaaucauccauccaaccaucuaucauccauuuaucuaucaauuauccauccauccauccauccaucaucuauccaucuagacaucauccauccauccauccaucauccauccauccauccaucuguccaucuauccauucaucauuuacccuuucagucacacauuccaaaccccuucauuaagcacuauuuuuugcaagacaugguucaaggggcuggaauuagaguagcccccaggguggacaugaucugacuuuugguuuuuguuuguuucuuuugagacauugucucaucauuuaaccuaggccagucugaaaccagcuauccuccugccccaguuuucuaacugcuggaauuauagguguucauacacuauacccagauuaugaaauuugcauuucaguaggaaaauagauauuuuguuaaaaauuagaaaauaucaaauggugauuagcaaugcaauuaaacauacaauuaggcacaggacuuugagugugcuucuuuuaguugcguagacaggaagggcuucuugauacaagagcucagcuauauuaagaucuggaggaagaacauuccugguauagggccaguuagugcagggguacagugagcgugcuuuauucuagacagggaaggaugggccagcuucuggaguucggcacuaaguuauugugcuuggaccuucucauguugagaaagauguguggguacguguuauuucacagcuaugacugugaauauuguauaauauucuugugucagcaugcacucaacaacacucauuauauucuccuuuggagaagaugaaaggaaaagccuuauuuuaauauuuagugaagucaguggcuuaaaauccaagguuuagguggcuuacugcacauaacuaauuuuuguguuagcuaaugagagguaauuagaguaauaagcuuauauaauuaacuuuuaauuauuuuuucuuagugccauuuaguuuaugauaauucuucaaauacuguaguauaacacuagaagaaaagccugacagguuuuuacuaaacgucacucauuugaugcaucuuagaauuaagauaaaaguguauuuuguaauauauauauauauaaauuuuauaauuuuauuuaucuaguuuauguguauggauguuuucuuugcauguaucucucugcacuguauacgugucuggugccuucagagaucagaagguauugaauuccugggauuggaguuauggauggaugugagcugccugugggcuaugguaaucaaacucuaguccuuuggaggaauagccagcucuuaaccucugagcuagcuuuccagcucucacuucuaauuuuagaauaauacuggauuuguagaagagcuagaaacaugguagagugcuaauaguaguguauacccagauuucccuauuaauaucuuauguguuuguguaauucauauuugcauauguauuauauauguaucuacaaauaugaauaauauguaauacagcuaauuaaccauuauauauacaguauuuuuuaaaaacggaaguccauacuugcaauauaaguuugauguuaacugccugguguuaauacagauuucauaaguuguuagagagaauaugugcugagaaguccuuugugugugacagggugucuuuguucacuuauccaguucagaagaauucucuauggucauuugagcaaaauauaauucuuccauggauugacacuuagaagcugaacuguagauccccucccuccaaagaauauucagcuuuugugaagauuguuucaauauauuauauauguuguauauguauacauaugcacauauauguauauacaacauguguauguauagacauacauacuuagaggaaugacuuaggaaaauauaaucacuguauuaaauuucaccguugguaagugggagacagugcuccuuuuggguaguagggacugauugacucuagggccugugccugugaaggaagcauuuugccauugagcuagagucacccuggggacaaguguauucugaguuagcuuuacccuccugugacuguguccgagcgccagugggacaugacggccauauucaaauucuuugaaaccuugggucuggauauucacuggaccacagcuggcguaaggggaaagguaggugguuuauguccaccuucuuacuccuguuucuucaagugcuccgagcagggaauuuguaacaucuaaaaccacuuugccccguugaccuccucgugaagcccgaagcucuuguugggcuggguaauccaggcugcgagccugggcagcagggcugucuucacucuggaagggagauguagagucugccugagaacagccugaccugaggcccugggggauugggagaugagacugagucagcucugcugggugcacaagaaggaaaugaaggcuuacugguucagcacuggcaggcgaauucauccgcuugccaguuaagcagacuuucauggacguagaaauauuacuuguggaugugaaaaucagauagaaauggcaacauaccaccuacagggcaguuugggcaaugcauuuuuugaaaaaaaauuuuuuucuuuacaauuuuagucugucaguauuuuuuucucauaagucagaagaguauuucugauucuuucaguuuauuuauuuucagagauacuacucuguuuuucguaguuucgcuagacuaggguuucucaacuuuaacacuauugacauuggggguggauuucucucugucucuauaaaccaauagaguuucuuucauuuuucccucccuuccucuccucuuuucauuugucuuucucaucuuuugugguauuggggacagaaccuagggccugugcaugcuaaguaaggggucuccuguggcugguccuuugguucuuuauugugcggcuguucugugugcuugacuacuagaucccagcaguggccuucaccugcuccggacauggccaguuuauugcauggcaggcagaacccaaggcagguuuaucuuggguuacccguguugacuguaacuuggcauuggcauacaucacuaccagagucguguuuuguuuuguuuuguuuucugguuguaaaacaggguaauuauuuauguuccuuuaucauauuucaacaucuaguuuagaguaacacacuaacaaauggcuauguagcaaucuaucuuggugcaguauuguacaauuuacaaguuaaacugaagcuaaauagcucaguacugccuaguuuuauucuugcuuaucuuuuuaguuuuagaggauugaaaauauuugcucacuuaucucuacucuaagccucacagggcuucccucacggcuuucaucugcaguucuugggucucagagaauucuugcuaaaauagcacuacagaucugaggggaaaacuguugcauggcccccauaagucucuaaacccgaacuccucucggaggaaagaaauaacuuucuuccaagcagggaaccagucagcuccagggaauaccugcucuuaaccugcgccuucaaccccaagcugggaacauaggagaacccuguuuugggagcauuggaauguguaccugugggcuugcuuuccuuuuucuguguguuguaggguaaaggugugcgcugucucugccuuuauguaaaaaugaugugagccuaaggagaccuagggaacaucucuugccuccauugccguccuuugaauuccuccugugugggaauacuuuuuuuuuuuuuguagcuggcauuuuuggagaggccgccuugaacuuuagagucggaaggaugugcauuuaaauuuuguguugcccuuuacuggcugggugucucauccauaaaagagcuaguauauacgcugccccccuccacuuuuuaggauggagugugguuaaauuagauaguguucuuuguuggguacuuggcugcgugauagguaguuucuguucucuaaagccagucaguugcaaaagcacugacagucuacgauucccccugagguccucucccauggcucccacaggcucacucugaggacagccuuuugcagcaucucagcauguucaugcucugggacuuugcgugcgcugauccguuugccugguuugggcagcuguccaccuggcuugcuccuucagguaccacuguguauccuucagguaggccaucugaccacugaauacacaguaggauuuguguuauuugcuggcauuccuuauucuccugacccaaugccuuugcuuucccuauaccaccuggcuugaugguccauuauuuaugugugcgauguuuuucuugucuaccagcauccgagccugacaagaacagggguuucuuagcuacuacaucuucagugucuagauagcacuuggcuugcccuugguacucaggaaaccccugguaccuggccagguacauuaaugagugaaauuauuugcucaucacaacacauuuuccuugagguuuucaagaagaagaugcacguauggauuuuaaaaauaguuauuuaaguagccucagaugauauugguuuauaggugaccacuuuggucuuuaguguuauauaugaaaauacaguuucuucugauccuuuuuccuuuaggcaguuuuaauuuuggagagcuuuuaauugcaucguuaacauuccugccuguaggucacuguugggugguggauugggaacaccaaccugggcucuaucuguaucacuucucugugaccuucagcugauugucaaaguccuuaguaccuucucaauggaaaacuugaaaaugcacggcagguuuguuuauuuauuuaucuauuagguaaauuuccuuacuagccuaauauaguaucaauauauauuucacagcugauuaucagcuggcuggcaugggaaacuuacucuucccaaguguaugucauuuucguuuuuauuuaaaauuacucuuauuugaacagaauagcauucagcaucuaaacagcuggaguuuuaaaaaauaaguuacaucuauuuacucuggggcgaauguguguguguguguguguguguguauacauggcucacacccuauuugguguauggaagaggucacgagacaacuugcgggcauugcucuuucuccuucuaccauggggauucugaggauggaacucagauuuuccagguuuggaggcaaguccccuuauuagcugagcucacuggucccuaguguuuuuuaauugagcauuugcgauaaguuacacugugcuagcugggugggcuguaauacaucuuuaaagcgcuugccuaagaugcucuucuaaccugucuuagguucuuccccugauuauggggcaguguucccuuggcuuaauuuagugcugaagaagucuuaagaacgaggggagagggagauagcucaguaaaaagcuuugcaagcaugaaggccugcgugagauucccagaacccauucacaaaaagcucuaugugguggagugugcuuuuaagcccaucacuggagagguggagacagguggauucgugggacccauuggucagcaagccuaguuguccuggugaauuccaggccagugagagaccuuguguuaaaaacaagaaguggguuggagagauggcugaucauugaagagcuugugcagcucuugcaaaggacugggguuaaugucccagcguccacaugauagauaguucacaaccacccauaacucuaguuccagaggaucugauacccuuuccuuacuucugugggcaccaggcgugcaugcggugcacagacauauaccagacacacauacacaaauacacacaggcacacacagagguaugcacacauaugcauauguacacacacacacacacacacacacacacaccccaacaccaaaaccagaagguguaguauccuuuuccuugaugccuaugaacagugcuuuaauuuuuauuacucccauguauaaaguuugaaaacuugaugcuuugcucugaguaaguguucacaguuuauuuaagaaaacauagacuuauaguaaauaggucuaauuuccaguucaggacugaugcucaaaaucuccucccccccuucugauccuuauaguaauaauaagagaaaaagcaaaaagauuuuuccaguuauuuucuauaccuucuugcuuuuaauauuucuuuaauuuuuauguauguguaccauuuguauacagaaagcccccagagacuaaaagaggucauuuggagcccugaaacuggaguugugaaugguuuuaaguugcugugugaaaacuugccaaaaccacuugaagauaagaagcagagccagugagaaccccugauagcuacacccaagcuuccuggcuuacaaccuugucuuugaagcagugcugaccagucaugagaaaaugcccaagacccaaugaguugucuuuacuuuuuuaauucugaaaagcagcuuaagauuuuguuuuagcuuggaugagcaccgugagcaucugagauaccuugaaauaagaaaccuugccuaaggaugcuugagcugcacuuggaauggaaucguaguggaaggcagauggagggaaagaacugggugggagaggguggucaggggaguagugggggguuugggggucaggugugugugggggacugggugauggccaggagaaugaauggaaaucugcaacagaggaaggggguaggaggucuagaaagaggcagagacuugagagaggggaggcacccaagaaucaaugcagguauccuaaccuguggccagacaggaaccccuggggauugauaggacaccaaccuacccacaaaacuuuucacccaaaauuuauccugucuacauaaaaugcagggaugggagauggaguagagacugagagaauggccaaccaguaacugggccaacuagagacccaucccaugggcaagcaccaaucucugacacuauuaaugauagucuguuaugcuugcagacaggagucuagcauggcuguccucugagaggcucuagccaguagcugacuaaaaauaccuuuucuauauccauuuggaagaucguaugauucgacauuuguuuacuugauauacccaacugauugauuuguauguguuaaacugccaauauucaccacagugaauuguuuguuaauaauuaaucaauaauuaauaguuauuaauuaauaauaagaauuaauacauuuuuugauuaguuugaugaggguuuuugccucugcucaucaguaaugcugaucugugguuuucuuuuuugcuuuuccuucucugguuuugguguuccaauaaagcuggccucuugcaugcauuuagaauuauccccuugaauacuugaaggcgaauugguaucauuaguccacagaucuucucuuucuuccuccugcuuugagauggccucucacugucugggccaaaggagccccaagcuuuugacucuccugccucggccuccugacugcagagauugcaggccugugcuaccuuuggcuguuugcuucuguucuugcucucaggccuguggcaguucagcugacagcuaucuucagguagagcucuggagugcaucagucucccgcugggcuuuuccccaugggcgacuguuuuacugauucgguaacuuuauguuacuacuggucuuuucagguuguguuucuucaggauugaaucuuggugauggguuuuggccugugaguccauuucuuccagguuuuccaauuaguuggcuugugguaguuaauauuacucucuaaagaucuuuuguacuuuauacuuuugauuucuuggaacugaguccucucucucucucucucucucucucucucucucucucucucucucucucucucucucucaucuaauuaaggaucugucugcuuuaucuuuuuaaagaaguagcugguuguuucuugguuuuguucuucaaagucucuguuucacuucuguccugauuuucuucuuucuuuaccuuguaguuuuccuggugcccugagaugcagcacuggguuuuuaucagggcggauccugcuuuucggugcaggugugggaugcugcccuuuccccugggcucugauaccugccugugauaccagccuucgcugauguccauaggguuugaugugccucaucuccauuuuuacauaaacauuuccucugugcucauugguuguuuaaaagcagguuguuacagggcugcuugcacaucuuuaugaucacuguagccacauugacaucccuaaguugugaaaccacccuaggaggcuguugacaaaggaugcagaaaauguacuuugguuaacucuagagaaggaugaaacuaugucauuugaggggaaauggccgcaacuggagagcaucagauugcgugaagugagucagucacagaaagucaaauauuguuauuauuucucauuugcggauuuuggauuuucuguggaucaugaaaccauuccuucguauuugucaaaguagaaauagacugcccaggggaacaauguggcauuggagggcaucucuguguacaguggauaugcaauaaaagaguagguugcaaauuuccauguauuuguuaaauagcucuuuaaaacauaugaacauagcauuuuagggccaaucagcccuuaaugaacaugaucauuaaaccuuugcuuagaaggacuuuuugcacuuggaguaaagaaaaaaaaaauguguguauuuuacaaguuguaagggccaagagauagugauaguuuauuucuggcuauccagaguagagaacugccaauuuaacaccauuggccugugucaagucaugugacaaggaaagucucuucucgcucugauagauuccacaauguuccagaaagcuagagugaucuccuaaccacaccuuccugguuuucccuuuccugcucucaccuuugaccuuuaccuccaccgccaggcaggcacuaccaucagcaccagcaccaguguguguguguguguguguguguguguguguguguguguguauguguguguguguguguguguguguguguaugugugugugugucuguguguguaugugugugugugucuguguguguauguguguguguguaugugugugucuguguguguguguguguguguguauguguaugugugucuguguguguguguguguguauguguguguguguguguguguguguguguguguguguguguagaacugagauuucaggaugcugggugugaacccacgcuggcauuaggauuucuuuaauauuuaaaauagggaagaggcucucaucgggucagggcauuaggaagaacacuaguuugcuaauggaguccugaguuggcuccauuauuucuuuacauuuauucauucucugcucucuaucccccgcccccaaucucccccaccuccagacucucacauuugagacuggcuggucucaaaugugcuaugauauuugcacauguucaagaccaugcuggccuugaacucaacagagauccgucucugccaacuaaaugcugggaucagagguaugcacugucacgccuagcaaauucaugucuguauuaagcucuuagaguguuauuaugguagagcaagcgcaugguaagcagaucuguucagaaaagcauacacaugggcacacaugugcgugcgcauuaugcuguaaguuauaaacaucuucgguaaggcuacauuagaagacagggugauaugauggaaaaagaacauggacuuuggaaagucacaaagaucugaguuucgauauuuuugcuauggcaagagcagugguucucuuggggcaguguauuuuauuucuaagaucucauauuuuuauugucuuuaauuaugugcaugucuguguguaagaaugugcaucugagagcucauauacacacagagggcacauuuggaucccuugggagcuagacuuacagaucguguacaaugggguguacaagugagccauccgacaacaggacugggaauggagcccccguuuucuggaugaggaauacaugcucuuaacugcugagccauuucucaagccccagaaaauguauuuuuauaaaguuaauuuucuugaaagaaggaaauaaaacguaguagagcauaagaauucggcaaaucagagucucgguaugcugcucagccuagccucagacuuaacgaccuuccugccuucauuuccucugcuggauuuauaggcauguaccaccaugcuuguuuuaauuuaaaauaaaaacaaaacaaaaaaaauuauuacucauaccacuggugugaguaauccagacucauuggaaggagaacagaggcacagccucuacauagggacuggggaaauuucccuucauggauuugcuguaagacuccugaguuucccgggagggggagguuggucagcuggacuggcugcgguuaagagagcccugaggauaagggagcacagccugugaaagccuggggaggacucaggguguggcucugccagggggaggagugcuggccccucuaggcacugagcacaguuccuccugcauuaauuaauuaauugucauuaauccagcgcccuuggaaggccaacccccuucuggcuucugaccguuuguuuaauaauuuaaccaaauuuaugcccaucuugaguaagacaucccaaccuuccauguuuugaagaaacuaccgauaacuuuuuuuaaaaaaagaaugcuaaugucuacgucaagaaaaaaauauuaaaugcuagaacggcaagucuguguuccugucauucuagagaugaggcaggaguuugaggggaacuugggccacacagugagaccuugucaacccuaaaaacaaagaaaaugacuguuaucugucaugcaaauuuaaauaagaucuaaugagaaaugaaaugucagcguuuagauggacagauacaugcacgugcucuguggugacuguuuccugcccgagaacagucuuccuaagucauuuuuaccacgguuacuuuuuauuuagcacuuugaugguguguaacaacucagagauggagaacaguuuuccaugcuagucuuugaacuuucauauucaaauacauuucccuccacugccuuuauuggucuuaaauuuuuuccuagguaguauuuaaucuuuaaaaaauauuagaagguuguuuuuaaaagucucuuccuugcuaaaggaccacugugucugcuagauuauaagcguuguuggauaauuucaagcuuccagagauuuugauauuccaaaguucaacagugcagcuuucaaaguaagaaugccugagaaaauuccacuuccacaccuaaaauuagauaugacagcagagaccacaggcaggcauuuuaccagacgcgguaauugcauguuuucuuuuugagaaaacuugaagacagaaaaaaaacccacaaacaaaaaaccaagcaguuagcucuuuauuaaacaaacucuauggcugucuuuuuuuuuuuuuuccuuuuuucuuuuuuugacaguccuucugucuacuuauuugguuugagaaucaguuguagccaguuaucuacgauggaccucccauggugcagauuuugaugguuuuaauaaauagaugagauuuguuguuuuauacuuuggaucuuauuuuuccuuaaucaaaucuaugagguaucauaaauaaucuccucgcccagcuuuguguguagauagcuguguuugcaacauagaccuuugucaaguucaagacagacguguuuuuagagguuuuuguuuuuguuuuuguuuuuagagauauuuggagugucuugcaagugcucuguuuaccucuccagguuuauuuccccggugacuuuaaaaacacacucaacuguuagugugaaaaaauucacauuuacaguuggccccaauaguaacuggcaguaugucauguggaaagaacuuggugcucuuccuucacauuuggcaaauugacuggagguaggguggugguuggaaacacacgggacucgaguaggcacagccuucuuuggguacagggugacuuucuugugacaccugggucacccuccacuccauuguccugugggacucuuggcuaugcucccagcagagaggauugcucuggccccgcuuggcagagcaucugggaucuugauuaccaccuuuguaaaccagaagcuuguggaauuuagaacuugcucugacuuccaucaggucggaggcuaauacgugugaccgucaccugcagucugaguguuugcgaguuuuagaaauaagaagguucuguauuaaguuuggcaaaugaagcauuagggaguuaguuucagaaagguggucuccucgcuaacauggaaaagcccugcaccguuggacuugucugauugcugccugcaacacugcaguggaaugcacuuuaaacuguauuaauguugaaauuggacaccaccucgauugccuauaaagccuugcaucaauuuucuaggaagaguguagccugugccugcaguuuacgggcagaaucuggcccgcagacccauuuauuagcccuggucagauuuaaaaaccuguaauuucacucaaggacuagauucugaguauccuuuggaaaucuggagauugugucaguauugagcauuucguugacuggaccuaagaaagcaacagacaucagccuggcccccaccccaacccugcgcgcucaccuccccagcuaccuucccccgaccccuuaaaacugcuuuagcuugggcaagccauaccaacugaugccuuaugcccagccuucuuguccugcuuccauuaccagucucugaacacuugagagccuggaucauuuccacagcgcucucuauccaugcucacccucgccuuacgugaaggaacaccuugcugggcucugaaccuucgcccauucuaauccuuuugagguuccuuucccugcuuguccauuugaucacugucuuuggggugccauccccggcacaucuugucgcugcccuguuagauggugcccagcaacgugcccuucauugcuuugacucuuagcaugcuguacucagguugaguuccauguccuuucccuguggauggaggaccuuugaggacaaggccugccuuccuacacuuggauuuaugcaaauccucacaguucuugcuacaaaagaggguugagagauauuauuuuugauugacauauuuuaauguugcuaaaggcaauauuuucugcuuuagcuaccugugagaaucgccugggacccugcuggggccaguugugcccuuugaugguaggacuugggaguuggagguuuaaagaucucuaggaaugcuacuguguacccagggcugcaagucauuaacaguauuuaaguaauuccaagaaaggugauuguccguaacuuauucuauuugucccauuuuguugagacaggaucuuauguagccaggcuagccucaaauuauguaguauauccagaauaacuuugagcuccugauccuccuucagcuaccucccagacucuaggaucacauucauuugcuaccacaucuggcuagaugaccacgauuuuauuuaagauuugucauaguuagcuucgguugucacccugacacaccuggaaagagggauccucacacaaagaauugccuccaucagauuggccuuuuucuugauuucuaauugauaugggagggucuaggccacuauaggcggugucauucccgggggugggagggcuggcuuguagaagaaaggaugucaaagaaagcaagccagaggcaguguucuuuuauggucucugcuuuaguuucugucuccaaauuccuggcuggaguuaauagacuguuuucccuugaugguggacuauaaacugcaagccaaacaaacgcuuuccucccaaguugcuuuugggcaguuuuagcacacaaacagcgaagcaaauaagagaaggauuaaaacauuggauuauuauuuuaggaaaaaccuuccucguaugaacauuuucguuacccccccccccccggcagcacauggguguuugaacaaguaagcauaugucuuaaagagcuccgucucuuucacaauagccagugagucugcuguugcuauuggucagcgagcucaugagcagagcuccgcacugcacauccagagcuaccacaacacugguaguuuaugauguguagccacugucugcuguuccgugcugcgauuuaaauuuccaguggauucucuuccaggcacucuacaaacuagcuaaggcauuuauugacuuucuaacacuaauugccucuuuucuugcguauguguuuauccuucucuguuuuauauugggacugcuagcuagaauaaagaugacuaaaaacaaacauuagcugcagucugguguggcgcacacuggggauaaagucguuugaacuuggugaaagcuauugccagccacauugucuaaugguuaccaugaucaguccuaaccucaugauuugcuuggagauggggugggggugggagacaaugaaacaguuaaaaauguuuucaugaaagauaacuggguuaucuuuauuuugaaguagucugaggugaaaaaguucuauaugcccaccccccaucccaccccaccccugccuccaugggguggguacaugagcuaugguguguguggaggucaaaggacaacuuuguggagucugucuuaucuuccaccucuauaugggcucuggggaucaaauguaggucgccagacuugcaugacaaacaccuuuaccugcugagccagcucaucugaccuuuuuauuucucucucucucuccucucucucucuuucucucucccuccccccucccccucccccuccccaucucucugucucugucucccucucucucucagacagggucuccauuguccaggcuaacuugcauuuugcuaacauagccuaaaaugaccuugaaguuccaaguuccaugcccagucuaugugaugucaaucaagcuggcuucuccacuaguaggcaaacacucuaucaacugaguuagaacuccagccuccuucccacccauccucuuugugggugggaacuugauuuuguuuccaccgagaaugcaguaguaagcauuugguuuaaaaugaagaguuucagagacuuacaaccgaaggcucguuucuuauuccuaaagacugcuggguagccguauuagcugugauuucuuccugagaguuuuaugaagagccuugaaggcagaugacuggaaagcuccuugagauuuucuuuauuucuuugauuggaaaaucucauccaauuaaucuuuguaucugaagcaaaugaucuuuuccacugugucuguuugucucacagauaaaacuguuuuaucuccaucagauccgggaagaguguuaucuacaccaaauccagccgcaguagccucuugauuuagauuuucuaagaguugucugcuuucuuaguuuuguuucuuucuuugugcuaacugaagcuaggaaggaggcgucugcgaccuccccucucagcugaguucucauaggaaggagggaguucucacaaguucagcccuuagguaccucaguggccccugacuccaucuggcucauucccaggcuggacucaguaacaccacuugaccaggaaggaaaugcagucagcccagaagagcuggauuugaaucucugucaggccuggcugucacuuucagucaccuguagacacucaauuauguggccuugagaugguggcuucuaucagaguggagaagagacuugauuaaucaggcaaccugguacgcucagcuggaucuccuucacagccuacugaauuaggguuugauuuggcauguccguuccccucucagagcuguacagcaguccuuccuggauuggagaggaagguugucaaugggccauucuagccuucuggacacugguuuccuugcuuccugccucugcugccagcuuccuucccuucaucaggaaacuggcuucauauauauauauauauauauguauauauauauauauauauauaaucagaugaccuagguaaagaugcagcagcggggaagagugcgggcgggcgggagggaggaagggagggagggauggcagcugccagugucagcgugccuggcaccagcccucgucccucaaucugcucucucggcucucggaucugcuugcuugaggcugcuguuuggaaauacaaaguuccagucuaauuguggcacgcuccuuuuuuuuuucuuuccuggaauuauuuggauugcuauucugauuccaucuguucuucugcuuguagaaauuugaccuucugugaaggucguuaccaaugcugugauugcaguugguagacaaagacuuggaaauaagaauugacuguguuugucaugacuccguagugaaaaaaaaaagaauguagcuccuaucucguagcccugaccucuaauucccucuccuccacacugagccucucaccugaaggcugggccaagaguuuucaggcccaucuggaggccaaacagauaguauuugaugaaacagcuuuuaccagugguagccaggcuccuuuuccagacagcugaugucucagacuccugccuugugacuucagcucucucuaggccugacugugaguucggguauguagcaucguauugauaauaguagccccugagggcugauuuucugaagacuguugcugauguaugacauuuuuaacaacugugccaucugugucuggucacucuuccaggagacaacagagcccuggucuaagccuaggguccuuuugcuuaccaacaccacuugaauaucugacuucugaauguugacuauuccaugcugcauuuuucuuugaaggaugcaaccccauggagugaauaaggcaggcuugaucuaacugccugggaccagaugcuggaucugguccuucuuaugugugugauuuaggaaguuguuuuaucuugagccguagcucuuuaucuguaagauaaggggugcuauuacaagcuauuuauaagcuuguaaugauuauaugauccacuguauauaacaucucuagcauacuaccaaguccaagucauauuccuuucuuugcuuggucucuuacauugugacugaggucaccauguccuguguacacaggggaaaagaaacagcuugccuugcuucccguacauguuuaauuggcuuugcauuuggucgcuuucuauaguuucucuuuaguguguguucguggguguuagggcaggccuucuuaacuguccaagguuucuucaagaagggauuauaacauuggacaaaagggucaaaauccaauaauagcuucuguuguucucgguuucaacuuucuagcuguucuugugaauaaaaucagcccguauuuauugaccucugggccauacggugucacauauagccuugugaaauaaguuaguggccuuuggaaucuucuguuuccauuuuguuuagcucagcaaugaaaauaacauuuguugcuauuaaauuggucccugggggcuguugucuucuccuacuauguagcugggaagcaucgaggcauagaucagcagagccacacauauuuucaccagagacucuuagaccugguaccaaagccaacugaugggucacgugacaaauacuugcuuaugguuggcccacauggaaaugcuggguuacagguucaguauccgaagauacuaaauuguggaugauuuggucuugcagagcaauauuugaaugucacugaaaaugcaucucauaagcacuuugcuauugaugaguuggauccaguuugccacaucuccuacuggacuugaugguucucccaaguuucagggaguguucaaagacaguuuuacaaaugccauaaagugaauggaaaauauuucuauaaucucaaauaauagcucccuggaggcuuuugaucaucuugaaagagccucuggucggcuuaaaccgccccggguuucuguucauuccguuauggcccucugaaauaguagucuuaauuagauugaggggagcauugauuuuuagugacacauuaauauuaauauuccaaguugaaauaugcaaaggauggaaauaaagaaaagauguggccaauagcuucuaggacuaucuuaaugaggacccgaguggggcagccucuguucuucacaccauacuuagugacagagcacacugaaugucugugucauauggaaggaaggcugaucuccccgcuccccuccugcugggaugcugagcuccuguccccaccccuaaguguaauaaauuauuacaguucucaucagaucagaaccauugagcuugcuuggaccguguuuccaacacagaggucagggagcuguggcccgaagccagcuuuugggcagccuugggagccaagagugguuuuuauguuuuuaaaggacgaaaacugaauauucaacaaaauaagcccguguuuuuuaaagaagccucaaauauuuaguauuuggucuuuuauagaaaaggaagagguguaucagaauauugagcacacgcucguucccucugagagcuucauuugaccaugcuaagucaugucgaggaaggccagcccaggggaagagcaggacagcugugggguucagagcuggacagggcacucugcacccugccucccugacuucugcagaacgcaggggauuaaagacuuccucugaacgccagcuuccuuaggguuguugugacccaguuacuugugcuuaguaugagcaaaaauuuuuucaguuaaaaauuaguaagcaaggacuggggauauauguuaagucagugacaugccugccuagccugcccaaaaaccacuggauuuuguccccggaaccacauaaaaccacauaagaauuaaccccagcauuuaggaggucaagacaggaggaaccgaaguucaagguuguccucaacucucucuauauauuuuaaaaagcaguaagcugccuauaaagcccuugcuucauggguagcuguacaaagaguguagcugguuugucugugaccgggccucugugagccccaggacuugcuaggggcuuggcauggcacuaaguggccaucagccuaaagucccaaaccccagugcugucucagcggacagugcugcugguuuuccuccaaagcuggugccugccucagaccuuggcuggggcaggacucucuggucacugucccgaugccucucauuucccucagcugucugcacuuuacacuggaugccuacgcuaauguauauaggcaucugggccuuugagggugaucuuaugucucuuaugucuucaugcuuucccccuuuaguuuuaagagaccauguguauaauuaauuagguaaaaaacaauucgguccuuuguuuaggggugggcuuucccugucuugucuaggcuggcuuugacuggacucaagcagucccaucuuagcuucccagagagccuugauuccuccugugagcuccuauucucugcuggauuugagucuucugaaacagccccucugcuagacugucacucucaucuccagguagcgugguuaagggauguuccccuuuauuuccguauagagugacaucacacagucuuucugcuccauaccgacaucucucagaugccugggaucuggguucuuuucaguggaggcgauggcuguggguggguguggcuucaggaaaagcccuuccauuugcuccucagaaaccuggguuagggaguccacucuauccuacgcuaugcucacagcgaugcuuugccuggcuucucaaggacccuuguccaguugucucuuuagagcagcguuauagaugagguuuugagaaggugugcagauguguugagagggaguguaggucaugcuuauuucuggagccccuuccuuugcaggguaguuugccucuuuuaauauguuauuuacaugcccuguaaggaucuguuuuauuuuuguuuuuuguccucuuagcuacuguuaauaaauagcuuucuuguuuaugggcaaaauggcauuuuuuuuuuucugaguuguuugauaaacuaaaguuuucuguauauuagcuaucucuuuuauuaaugccauugagacuuugaaaugcuaaggggacauaaaguuuuauguuauuguauuucaucaugauuaaauauucuuauuuauuuauuuauuuauuuauuuauuuauuuauuuauuuaauguauaugacuguacuguagcugucuucagacacacaagaagagggcaucagaucccauuacauaugguugugagccaccaugugguugcuuggcauugaacucaggaccucuggaggagcagucagugcucuuagugcucuuaaacacugagccaucucuccagcccaugauuaaauauuuuauuacauuuuuuguagugugcgugcauguaugagagagagagaugagagagagagagagagagagagagagagagagagauauggaugguggggguggucagaaauugagucuguucuguccuuccacaauguagauucuggggauugaacuuaggucuucaguguaggcaggaagcacuuuuacccacugcccacugagauaucucacuggcccacaaauauucuccaaaccacggagcagcaacagacuuguagcuuuaaagaaauuauuuaacagcaguugucuuggcgguuccuuuguuuaugaacuaagauagaugcaauuuucgcauuguucuacaaauauagaaagaauacucugcauccugucauaaauccagggcaaacuaagcuauugauuuagcuucacaggucuggggagcacgccucgaccacucgccugccugcacccguauaaucgcaaacaagggacccggggcagcagcguccuuauagacaaaugggaaaaaggagguuuuuaagggcauuagauuaguauuauuuuucuaaaccaacuaggaagauguuuuagcuugcauagaucacaaaaguaaaguaaaggagccauuccgaaggaagacacggggcugcgaugauagcucaguagaggagcccgugcuggcuugucccacgugcacggacggggcuccgaguuagauccccagcaccacaaaacaaaaaagcagaauaaaacaagaaaagccacaaaacaaaacaguagcccacagcagaugcuguuggacagagcucaaccuucugccuccaagggcugccucuuuccucccugccuagacuucaucuccugggcuccccucuggaggggcuguguagcugggcagcuggguccugcacaguggguucugcacagaccacgcacacaggcacaguggacuagcuucagcuucagcgaaacaggaggaggaugcagcagaacgaaggcuccgucuaggaccuaacccagcagcagcccgaguccucuucacagucaugguacuuagcucuaggaucugacucagaugcuuguccgugaccgucuuccauuucagcagaauguucgucaaguauaacuuuuuuuuuuuuuuccggagccuauauuuucugcuggcaaauaugacugggaaaugcuugcacauugcagcuaacuuucagagccccgggcccucacuggcauguuaaaggcugugggaaaccuguuucauccagggcuaaaacauuuuugcucaguggauacucuugcaggguauaacuguucuuaugggcucgaaauaucuggcaucccacagggagaaauucuucccagaagcccgagcagagcucaagagaaggggagagguggagaaaugaagagaaaguuaucauuugcuaaaacaaaccgagcguuugaccuguugccuagggcagggcucugaauaagggcacucugucgauuccguggauagagaccaggaugagaaugcugagucauuuuccccaggcucagaugccucaaaccaaaaggauaagacaucuuacugaaauacguaccauucagguaaccaagaucauuuuccccacaucccuucucugcuuucuguguucucacaaaaauacgcugucggaauauaaagccucugcuuugcauagagcuccccguuucgcuucagucaaggaagagauggaauuguucuguaacaccuagauuuccauuaaacaacucugcuuucuugcuuggcagcucagauuggucugugcuguaagccucuccugccuuugcugucccaguucuggggucuuuuguuuuaagacucaggaaucuugggcgaugggagaugggucgugugcagacgugagcgugucagugaccagcagcgauuuugaugguggcuguuaaggugaggucuuugugacaagggugaggauuauuuacuacacccuguuuuucuuuggggagagaaaaaaaaaaucauguaaugaaaugugaaagaaaacucauuuucuuuugaagacauaaauauagccugagaaaauauaguuaaaaugugagacuugaagucacggaaucuaauuuuuuuuuuagaccgacuaaauucaggcuguguagugaugggauauuuuugguuugaguuaaaaauguccccaaauucuuuaauuuuauaucaaggguagaguucuuuccugucuagaggaaaacccaagccccccaauucgagcuugggauaagagagguggggcugggagcaucacaggugaugucauggcucuguauugcugcaucagugggcagcaggaaggcagcuuuguccauucaugaggcccuguuauccgaucugagagcugccuuggccuuucuuuugaccuuauuuugcccuuacagugaggaccuuggcuacguaguuauuccacagcuaguucuccuuccuuuuucucuccauucuauuauguccgagucuuuuaaaauuaauaauauuagauuagaauagcuaucagcaaaaucagcauagcuacuagugauuauaaguucuuguuggugauauuggcauagaguacaauguagaaugaccguaaucugauagaaaaauggcgacaggcuuauuguaagagaaagaauuuaaauguauaucucuaucuaucuaucuaucuaucuaucuaucuaucuaucuaucuauguauauauauguauacacacauacauacauauguauaugaugaguuuuggguucuuaucucuugaucucauaauuacuugaauacuuuaagacaacuguguuaucacugaugggagaagcuuuuaaggggaguuggaugugauugaggcucguugguuuauggaaauucucuuguggauauauuuugauggaagagauagugaccagugaguaucuuuucuugauggaagccuggaguagaugguagaaacagagacagaaguggagacccaagaaugaauugcggagcuguuaauacauuacauagaguguaguuacccauuacuauaauauguagaccugcaguuagcagauggaaagaaagggcuuuaaagaauuuuuaaaaaaauuuuaauuuugcuuaugugauugggugugugcaugugacagcagguggcuacagaggccagaagagggcgcuauaucuucuagagcuguccuuacagauaguuggccaaacuuggguucuuugcaaaaucaguacaugcucuugauugaaggaaucauaguaugggaagagcagagacguaggugccagggauucucaaagaggggagagucagcuuuaauagugccagaugcucggaagauagcaaagaggaggaaggacacuggguuuggcaggauguauggacaugucaagagcagcguuggacacgaagcaaagguuugauuagagcagagacagcugcaucuuaggaguuaguauggaacaugaaaccauguaaacuaugaaaagaacagucccaggcauguuuuauguaaaauuagcacaucagucagauggggcaguagacuuguuugcaagccucuauguaguguugagaaauccugguuaacugaaaugccuucccugagguauugagcuccuuuuagccaacuuuugucuucccuucugucuuggugcccauuaucaaauauaguuucuccuuggugcccuuuugagugguuguugaguuccauucuacacauuuacaagauuaacaucacuggcuacaaacauacuacuuuugucuuucuguuagcucauuuauuuucccuuugaaggcagggucucauucuaugccuaguuuggccugggaauuguuauguggcccaagauggccuuguacaugcguauaugacuuuuguccuaccucagccucucugagauagcauuaugggugugagcccauaccaucacuuugucaggauuucagugaaaguauaaaauagugucuucuuauuugagauuucacuuaacuguuuucaacugugguuugagaaauguuaaguggaaaaauuucagaaauagcaaucuaaaauuuagaaguaauuuuaugguauuuuaauaacaauucuguuuuauuauuucuauaaauucucuucaguuauugucaaucuuugauccuaauuuauaaauuaaacuucuucauaauuuguauauuuaggacaguauacaguauacauaggguucauuacuguacuugguuguaggcaccuagauaaagguaggguuuuaagcucugcguuaauaauguggcagaguucuucaccaacacuucacguguauuuagauaaagguugcaaaauaaucuuuguuuucuuucaugcuuuuaacauuaaaugacacacagcuagcgaauuucagauaucaagucuuuaucuuagauuuaccauaauggaugagucugacuuuuuuuucauuuauuuauuuuuuuaauuagguauuuucuucauuuacauuuccaaugcuaucccaaaagucccccauaccccucccccccaacuuuccuacccacccacucccacuucuuggcccuggcguucccuuguacugaggcauauaaaguuugcaugaccuaugggccucucuuuccagugauggccgacuaggccaucuucugauacauaugccgcuagagacacgagcucugggaggguacugguuaguucauauuguuguuccaccuauaggguugcagaucccuucagcuccuuggguacuuucucuagcuccuccauugggggcccuguauuccaucccauagcugccugugagcauccacuucuguguuugccaggccccggcauagucucacaagagacagccauaucuggguccuuucagcaaaaucuugcuaguguaugcaauggggucagcguuuggaggcugauuaugggauggauccccggguauggcagucucuagaugguccauccuucgucucagcuccaaacuuugagucuguuuuucugauaauggaugugucaguaguuuuccuguuuguugcugucacugauguugcugcgaguguuuuuguauugacuucuugaguauaaaugaaagagauauuagggauauauuuguauggaugaaguuaucagccaguaauauaugcauacuuuaagcuuaacuagcuaucacuaaauuguuccccacauugauugaauuaaauuaucauuccauuacaguguaucacagguauugggcugagguauugugugagaggugacauugccaguaccuuguuccucucuaaguuuugaacccuugguauguaaguguuggugauacugagaucugaaccagggaauuuaaccguaggaagucuuggugaaccuggcuuguucuuugagagccuaccugucaguguuaguugguuuaauggcauguugcuauuccugaaagcuguacccuuugauuuguuuuguugcugcuucuaaccaguccgaaucauuuuauuuuucauuuauugcuacaacuaaaaacaaauaaaugaaaauaaaaaauguaaaggagaaaacccaacacacugaaacccuuguccacaggguccuggcugcauuggcagaagcagugaauugcaauuuuguauguaauuaaaaauugccccgugucguucuagagauggggaugcuuggaaauaacccuguaagucgugaguaggucccucuggggaacuuuagauugcagcagugcagcucugaguccgguacuggaccugagauccacuuucucugcagugccagcuuacuuaggacucuuccauaugucuuccacucuccaaaaguuuauuccugacuuuucuuuguauuugugcguuucucuggaaucucauugcauuccaguagagucuuggcagaugacaagauaaaugcguauucaauauuccuucuauuaauagcaaugcgaucuuuauugagcucuuauuagugaaguguugcaauaaauaacauuaccuacauaguuucauaucauccuuuucucagagucuuaggauucagagacaagggcagggucagaacccaugucaucuggcugcaaagccugucuuccccucacuguacaaaagccuuacagaguuuuauaaagaauaauuugagggggcaugguggccugugccuccaguugcagugaucaccagucagagaucagugucagcgacauccugucucaacuaauggacaaaggaaauaaagaaaacaaaaacaaacaacagaaaagagaauuauccuauuguuauguauuuuauuuuacuuucuauaccacuguuuguuaaauauaagcuaauuauaauuaacgauaaaccaucuaacucaguugucauuguuugaaaccuaucucuuuuggauucucuuucugaaagcaacuaaucaaauaagauguuccuuguaugaagaaauguuaucguaaaagaaaaugauucuguuuuguuucauguguguguguguguguuuugucugcaugugugucugcagcauguucaugccucaugcucucagaggccagaagagggcgccagagccccuagaacugguguugcagaugcuugguucugggaaccaaacauggguccuuuggaagagcaguugguuuuaacugcuaagccguuucucuagcuucuaaaaaguaaauguguuguuuaaaugaaaauaugagauuucaggauucugaugcugaaggaagacucaggagauccaucuggcugcaaagccugucuuccccucacuguacaaaagccuuacagaguuuuauaaagaauaauuugagggggcaugguggccugugccuccaguugcagugaucaccagucagagaucagugucagugacauccugucucaacuaauggcaaaccuucuacggauauuuuguguaauuaagguaaaaaaaaaauagaacaagaguguuuuuugcauauuuuuauuugugucuuagguauuuaauagugugcuaugcuauagguucuuucaaacaccuguguuuuuuaaaaaaaaauaccuauuuuaaguaagcuaucuaacuuuacugggcauauugauaguaauuuuucaugaguaguauugauuagaagguauauuucaauuuuggagaguugugagauacaaauugcuguauuauagugauaauaaagucugacggugguaauaauacuguauuuaaacaaaacaaguagaaagcuauaggaaaacacgagauaggaaaaggaacaagaaaaaaaucuuagaagacagugaaaagucacacucauaaaguaagauggagccaucuucuguuaucuccaggggaaaaggagagccugcuuugcauaaauuagcaugcauaauguguguaggcagcggacuccuggacgguugccagagaggcuuuugguaagaugaaauucaugggagucuuauucacaagacuccagugaaucuuguuuugucuucugcuuguuuacuucuuuugguuuuucuuaaaguuguucuugauuacaggugacuggagcaauggggaaauucucagaauuaguuauuuugaaauguuaaugcaaagugaaguugaggcucuuagauggccacgcagauuauaaacaguuguacuuuaagggccagugccaggguauuggacaagggagaugacuaggucaugaaggugauacccagauaaacaggauuguucucuugugaggagagcugagugagguaacccgcuucuucugcaguggcgggguaaaaaggcugucugcgacauggaggggccagagccugacugcugucaccaguacuuccucuuuuacuuucuagaacaaugguaaauacauuucuagucuuacgagcuaguuaguuccugguauuugauacagcaacugcaaacuaagaaaauacuuaaaaguaccgaaucauauagcugauaguauuuuuaauuuauuuauuaucgugucaggacaggaaauuuucucucucuguauauuuguauauguguauaucaagauuagaggacgauuuugggugucauucccccaccccguuuuuuauuaaauuuguucuuugacaauuuuauauguggauauaacacauucugauuacucucucccgugucaucuccacccaccaaauccuuuccuguuauguugauuccuuuuuuuuuuuuuuuuaaauauguauggcuauuuggcugcaugugcuugugugucuguguaccacauguucaucuggugccuguggaggccagagaggacaucaguuacagaucggugugagccaccacguaggguugggaacugaaccagggucugcuggaggagcagccucucagcugcugaggcuccucuccagccuggguuguuuucugaggcaggcucuccccuugacuuggggcucacugauuaggcugagauggcuggccagugagacccgagaucugucugcaucugccuucccagcccaagcucaugccgcgaggcccagcuuuuugguguagggcaagcaccaacugacugagcugagaauuuuuuuuuuuuuuuuuaauguagaaaaucccauggauuggagcguuauacaagccagcuuguucauucuguagccagccguccaguuuaaacucugcuccccaccugccaaaaguaaaccccgugauauuuggaguucuagaugagacaguguggcugggccaguguaacuccaccacugggaucguggccacaaucaggcucugucacugaaagccugguggguggcugcauauagagcuauguccuucaaagaggacggaggggcagagagaacagcuucauggucaagugcuugcuuaagguguggagaccugaaugccaucucaaacacugagaaaaaccaaaccagguggaccuguucuagugccacgaacagcccaauucaggacuaauuauagcucacauuuuaaacauguauuuuuauauuuuccuuuuuuuguaacuguugcaugaaaguuguguauauuaauguuaccauauaaugucuaauauguguacauacuguauaauguguuuucuuaagcauucaccauauuuuuauagugacaaccuucauaauguuguaguuuuugaagugugcaucacaccauuguucccuuguuccuugugcugugcacacagaacuugccuuuaacgauaacuuaguguucccugaccacucuuccucacucuccuccauuacccuacuguucaaauucucaccuuccaugagauugacuuuuaaacguuucuacccaggauugaggucccuugcuacuuggcuuuguguggcuggcucauuacuuuuaguuuguuuuauuauuuuauuauuuuuuauuauuuacaugcauuuuauaaucuaacacauuaauaauauugaguauuuugagaaucaaauaaaaaauaaaaauuguucaacuuuuauauucauacccuuuuauacccuaaaaauaucauuaaugaacuucuaaugcuacccauaacugaggcuccuauaucuaauguugaauacuaaauuguuucaaaauauacaaaauauucuuuaagaauuaaucauaguaaaagaucauaaaauauuaaaaaugaauuauuaagaaauauauucaaaagcccuuauaugauaccaccugacaugagagaguauuuaaaaugcauuauauaucuguguacauugucuaacuaucaguuuauuuaaaaaacauuaucaguguuucuaggagagauaugauuuuaucagggaguauauuuuaaaauuuucaaaacagcaaaaacucuuugaaguuaaacauuaagaaaaugcuaauuuaaaauacagugagaaaaauuaacaauaauauuuccaugauguuuguagaacaugauuuuaauauuuucaacuguuaauauucaagaaauagaauaauuauuuuaagauauauuucauuguuauaucucccuuuucauuucugauuuuauuaauuuggauacugucucugugcccucugguuagucuggcuaaggguuuaucuaucuuguagauuuuucucaaagaaccagcucuugguuuuguugauucuuuguauaguucuuuuuguuucuauuugguugauuucagcccuaaguuugauuauuucccgccaucuacuccucuuggguguagggauuaaaggcguacaccaccauugccuggcuccuauaauucuuuaaggaauuuuuguguuuccucuuuaagggcuucuaguuuuuuaccuguguucucuuguauuucuuuaagggacuuauuuauguccuucuuaaauuccucucucaucaucaugagaugugauuuuaaaucagaggcuugcuuuucugguguguugggguaaccagggcucacuguggugggagaacuggguucugacgauuucaacuagccuugguuucuguugcuuaugguuuuuguuguugguggugguuuguuggugguuuucuuucuuuuuuuuuuuuggugacaggguuucucuguacagccguggcuguccuugaacucacuuuguagaccagauuggccucagaaaucugccugccucugccucccgagugcugggauuaaaggcgugagccaccaugcccggcuuguugcuuauguucuugcccuugccuuucaccauuugguuaucucugguguuaccuggucuuaaugucucugacaguggcuuguccuuccugcacaccugugugucaguacuccugggagaccagcucucuccuggcaguauuuguguauguaguucugugguacagaaugagcucugggcgcagacagaaacuggaaggcuccagucccaggccaccccuguguccugaggguucugggaguguuccucugagcagcaaugguggcccuaccugugcaaccugcccuugcuauaucugacuggagccuguccuuccugugauccugcuugaacuccucagaguucagcuaggcuauuuaaauuuugcuauuaagauuuugauguucuuugcauauuuggggcagcuacccgaaucuauauccugcgauuguuuucucucguucugcagauugucuuugcccuuuccagcauugacuuugugguguggaguccuuuagugugagguaaccccauuugucaaguuuugccuuuguuuccugugccuuuaaggaugagcgcauaugcuccauccuguuuugagacucguuuuauuucaaguauagccuuuuauuuuugaaucucuuuuuuuauggaauguguaaacauccauauuuuaauuuaacuuuccuucauuuggaauuccauuuuauguuccacaguuagaacaacaucuuaaauaugguaaaggcucagcuuguuaauuguauggcaaaccacacacacacacacacacacacacacacacacacacacacacacaucacacuuguacuuagcucaucuaucuauugcauucuuguauccugauauuguagguuggcuuuccuuauuucuaacacaucuuugaguauuuauuugugguauauguuuuuguggguauacaugcaaguguguguguguaugcauauguauauacacacacuauauauacauauauauauauauguauauauauauauauauguagauauaugccaucaaaacaguugguaaauugaauauaguaaaugaaguaagaugugaaauuaaugacuauggagaugcauuaauaguaaaauuuauggaugacuuucuucaguaauuuuguauaguuauugcuaaaaauagcuaagcacacuuuaugugauugcauuuacuagguacagaugaauucccuuuugauagauucauuauucaaagucuauuuagauuuauucuaucauuuugccauucagaguucucuguuuuuuaauaagaucuuagaauaggauuugaaacacacuacagaaacauuaucucuggacacuacucagucugauuuguuuguuuguuuuuuuuuaauuuaaaaagcaucauuuuaaaagaaugcauauuuauagcauccauugaaacaaauauauucaguaaugguagcaguccuugggugggaaacagcauuggauaauuuggcaaaguuuuaucacucaggaauuuucauuagaucuccuguacagauccuccuuauuaucagcuauaaauagagaucagcuaauuugaugaagagcuuguaagucuacagauaauugagcaaauacaucaugguuuaaaaaaaaaacucacaagagaugacaugacagucauaguuagcaaagcugagaaguggagaggaggggguguguggaggaacagugauggggaugugugacacagcaguuccaaagccagccugaggagccccuggucccuccucacauucuucugcuugccugccuuccuuucccaucuuuuagcuccccucccuccauuugcuucuugaccauagaguacuuuugcugacauuuagacugguguggaaaucccaguguagcccaggcuagccucagguuugugguucuuugcucucagcuuuugagugcaauuggcuucguugucuuuuacaucucaaggguaggaguugaaacccugggggaaaucugugccuucauaccuagggagccauauucuuacgguugcacagaaaguguaaauguauguguuacgucucaauguugacaaagggaugccuauuaggcuguguucccuuuaggccucuguacucuuuauccuggauaucaaggcuauguguguagaacuagccaguggguuaaugcuucuugaugugaauguggcacucagugucucccagacuuccacaccguagguuauuuugcccaccugugcacauguauuccaugccuugcuugacuauuuggcuaugcgacuguaagccaugacaugugaucuaauuaggggaacguuaauggggacaguacagcagaauauuuuaauuuggaacaauguccugcaugaacucuaaaagcccuuagucaggcgugguggcacacgucuuuaaucccagcacucggaggcaggcggauuucugaguuugaggccagccuggucuacagagugauuuccaggacagccagggcaacacagagaaauccugucucgaaaaaccaaaaaaaaaaguaaaagcccuuauagaauccuucucugugccagacauuguuauaaacggggaggaacaauggugacaaaacuuaaaaagaaauucuuguucccuagauaggggagauagggacaauagauuauugacagaucagguagacaauaggugauagaucagguagacaguggaugauugauaaaucagguagacaguggaugauugaccgauuagguagacaguggaugauugacagauuagguagacaguggaugauugacagaucagguagacaguggaugauugacagaucagguagacaguggaugauugacagauuagguagacaguggaugauugacagauuagguagacaguggaugauugacagaucagguagacaguggaugauugacagaucagguagacaguggaugauugacaucagguaggcuugaugaggauggguaguaggaagaaagcaaagcauggagagggguuagcgaguguuucuuaguggguggagagcauaguucuuggugggugagccauguuaucugagacagaguauaugcuguauagcggauuuugagucuucuacacgguuuccuuagauucuauaaccugcucagacuguaagaauaaaagggaacuuuuaguauacgggguggguagaaucacuaaaaauuaauuuauacccaaacaucccaaagaccuuugguuguaguaggucacuugaaaucaacagacacagccaaggagcagucaaagauccggacacaggugcauaaguaaacacggcaaagcgagcuccugauuucuagcugauucuggaucucuccgcccccagcacaguuguccuuuuuuuaaaaaauuuauuuauuauuauauguaaguagcugucuucagacacaccagaagagggcgucggaucucauuauggaugguugugagccaccaugugguugcugggaauugaacucaagaccuucggaagagcagucagugcucuuaaccacugagccaucucaccagccccacgguugucauuuuuaauguaggcaaggauaaucgugaugaggaagaagcaguaacacaccagagcauagaggucacacugggagcacgaggcaugccauucacagauucaaggagaggcaguggaaggcccuggguucuguuucagccccugguuugagcuucuuugaucugaacugccuuccccuuccuguuuuuacuuaucaaaacaccacuguagucauccuggagucccuaagguuuuaccuuucugucuugcaccccuaaaugaucaaugauugugugauacccgaaaugaauggagugugugugagugugugugugugugugaguguguguguguguguguguguguguguguguguguguguaaguggcauacaccgccuccacuuuucuguguggaaauuccuaaauuccuguggaugucauagaugcucuccagacaacggagccaucccacaggagaagaggcuuccccucgugucagaggaaccaacauagagaguucaccucuucucauccccuucuuuucuuaaacaacugcugucccagcccugcccccuuccagggcuuucucuuuuauucuugacucuccgguccuuucuccucccgcaggugggcagggacagacuggaguaggauuucaguuguagccugucaguuugccuugucaccuggcagagaugcgguugagcauugggaaggguuugggaggcagaguuauuaauggagaagcugcuuuaguugaucaagggauggggaauaaaggaagaacauacagacauuucccaguucauugcagagagcuuuggucccauuggcaugcccuuccuggccuuucccaguccaucagcuuccgucacacacacacacacacacacacacacacacacacacacacacacacacacugcaacuuagccuacauagguagaaucuggcagccgccucuaauccuggaaaacacaucggguuggccugucauaaaaacaguccuucuggccauugagcaaacaagaaauccucaauucggggcacagugaaucuuggccuugugagcacacuugcuuuagguauguauuuuggcuuuuauucugacuuaaaaacaaaaaacaaacaaacaaaaacaccuaaguauuuucuggcauugccaucaauguucuuaguggcuuuaauuaacaucauuuuaucugcuguuucugaaagccacauggaucuuacauuuauguuugucagcucauuuaaucccuuaguauuauuaccaagaaagauauuaccuaagcuaauuuagaaaaaaaaaaaaauccuggcagaagcuuaaacuuugagggagcauaacccugugaagggagccauuuguaggcguuuguaaaggccaugguuuuguguucuucucuucccacccugaauaguuugggauguuuaaaccuuuuauuuuuauuuuuauuuuuuuaaagacagguccuaauuuaucuuaggcugaccccaaccaucugugugguuuaaaaugaccuugaacuuccaggccccucuacguccuaagugcugggauuauaggccuaugccacaaaacccuucuuaugugguucaaggggcaaauucucuccaaacuaagcgacauccacagaccaauuugcagguuuugaaauggauuagagaagcuuggguucacauagaagacgaaugagucaaagucacaguuguacuuuguugcucuaaaaaugagauucuaaggaauuucuacugacggugaauguuauggauuuccacaugaaaugguaggacaaauucugcuuuaugcuacaauugcaugugcugugguggggguacauuagacauuaaaauggaguucuaagccuuccacuucucucucccucccucccugucuuccuucucucuguccuuccccccgccugacauaacuaaauauuucauuuuucucaugaaauucuaagacuauuuuaaauaguuuaaaaauagccauugaauuccccacuuguaagcauggguacaacuguagcagcaguagacuugauuauuuaagaaccauaugaagcagguuucuaauugcccacuuuagcauagauuauaaaucaacacuuucugaauuucuguuuuguaccgggaguguuguuagguacugggcacagaacucagcuacauacuaccuacuucagccuuggacagcaccugcccaaguggguuuacuggaggauauauuggagugcucuugcuuaaaugaguuccauauguugcucuggagaacccaaguuucucaucaguagcggcaggauuaaaaaguaauuucugauucugacgagggaagcaggucuacuaacugcagaucuuuggcucccccuccucuccccuaaaucuaauccccuggucucauccccagcucuucagcagaauacuuaaugaagcccccuccccccuugcuugaucacacagaucuucucccucuuauccccucccugucauugguuuguccagccuccaacuccagcaggugcucccugagagcucacuggccacucccaccaauaccuagaaacucauuuuaccuggaacccccaguggccacacuuaucagaaccccagaagaaugucuuacuaggcaacacacaacugacacccucuucuaagaaccagagaagaaacagaaaacaaggcacaaaacaccuaccuaacgaagacaagaacagcuauuauuagcaacuagaauuauacucauuucaaucccagaugauuagacaccagcauaaaaacacaaucaaaaguacauaggacuuuacuagaaguaaaaguacaugccuuuacuagagccuggcaacccuacaacaguaggcccugagcacugcaaaacaacugaagcacaagaaaagaccuuaagacaaccuuuaaggacuuuuccuuaaaagaggaaaugaauaaaucccuuaaagaaauccaggaacacacaagcaaacaguggaaggaaugaauaaaacaguuaaacaccugaauguggaaauagaaucaacaaagaaaacucaaacugaggaaaguauugaaauuuaggaacuugaacagguaccauagaggcaagccucaccaacagaauaaaagagauggaacagagaaucucaggcauugaagacacaauagaagauauggauaccuggucaaagaagauguuaauuaauguaaaaaaaaaaaacaaaaaauacaaaaaccuggcacaaagcauucaggaaaucugggacacuaucacaagaccaaaucuaaaaauaauaggaauagauaaaggaaaagaaacccaggucaaaggcacagaaaguaucuuaaaggaaaucauagaacagaacuucccuaaccuaaggaaggagaugcccaccaagauacaagaaacauacagaacggaguuggagagauugcucagugguuaagagcacugacugcucuuccaaagauccugaguucaauucccagcaaccucaugguggcucacaaccaucuguaaugaaaucugaugcucucuucuggugugucugaagacagcuacaguguacucauauaaaauaaaauaaauauaucuaaaagaaaaaaagagagagagauaaauuuuaaaaaagauucuucaaaaagaaagaaagaaagagagagagaaagaaaagaaaugaagagaaaagaaaagaagagagaaaagagaaacauacagaacaucaaauagacuggagcagaaaagaaaguccuaucacauguacuggcugguuuugugugucaacuugacacuggcugaaguuaucacaaagagcuccaguugaggaaaugccuccaugggauccgacuguggggcauuuucucaauuagugaucaaugugggagggccccuuguggguaguaccaucccugggcugguagucuuggguuguauaagaaagcaagcugagcaaguccgggaaagccaauaacuaacaucccuccauggccucugccucagcuccuguuuccugaccugcuugaguuccaguccugccuuccuuuggugaucaacaacagugugggaaguguaaaaugaauaaacccuuuccuccccaacuugcuucuuggucaugauguuuugugcaggaauagaaauccucacuaagacaucagauaauaaaacauuaaagauacugaagaaagaaaaaauauuaaagacuccaaggguaaaagaccaaguaauauccaaaggaagaccuauuagaauuaacaccugacuucccaguggagacucuaaaagccggaagcacagaugugcuacagagucuaagagaccacagaugccagcccagacuaugauacccagcaaaacuuucaaucacaauagguggagaaaauaagacauuccauaauauaaccaaauuuaaguaauaucucucuacaaauccagccccacagaaugugccagaaggaaaacuucaaccuaaggauguuaacuacauccaagaaaacauaggaaauaaauuaucucagacaagcaaaucaaaagaggaaaacgcacaugcagaaaugcacacacauaugcaaauguucccgaaaacaaaauaacaggaauuagugauaacuacacaaugauaacauuaagcaucuguugucucaauuuccuaauaagaagauaaauauuaacaaaauaaaugcaaaacaagaucucuccuucuacugcacccaagaaacauaccuuaauauuaaggauagauguuaccuaaagguaaaggauuugaaaaagauauucuaagcaaagagaccuaagagguuuauccauuucaauauuugacaaaagagacuucaaaccaaaacuaaugggaaggaugcuacgugcucaucauaggaaagguccaccaagagugcauuucaauucuuaacaucugugcaacaaucuacuagagcacccaaguuugugaaaacacuacuauggcugggcagugguggcacaugccuuuaaucccagcacuugggaggcagaggcagaggcaggcggauuucagaguucgaggccagccuggucuacagagugaguuccaggaaagccagggcuacacagaggaacccugucucaaacaaaaaacaaaacaaaacaaaacaaaacaaaacaaaacacuacuacuaugguuuaaaucaaaucaauaccucagucucaacaauagacaggucauccagacacaaacuaagcaggaaauacuagagcuaacagacuuuacauggacuuaauagguaguuacaggacauuucacccaaacacaaaaggaaauaccuucucugcaccucauagaacuuucucugaaauuggccacaugcucgaacacaaacuaauucucaauagauacaagaacauugaaauaacacccugcauuuuuaucuuuaaaauugauuaaagcuagaauucaauaacaaacaauagaaagcuuacaaacucaaggaaacugaacaccucacuacugaaugaaaaguaggucaagacaaauuaaaaaguuaaagauuuucuaaaauugaaugaaaauuaaugcacaacauacccaagcuuauaaaggcaguucuaagaggcaaguucauagcauuugugccuauauaaaaacaagaacaaaacaaaacaaagcaacagcagcaaacuggagagaucucauacuaacuuaauagcauaccugaaagcuguagaacaaaaugaaaucacacccaaagcaugccaagaaauaaucaaacgugaggcuuaaaaucaacaaaauagaaacaaauauacaauacaaagaaugaaauaaaacaaacuugguucuuugagacaaucaauaugauugacaaacccuuaucuaaaugaacuaaaaggcccugagagaagauccaacuuaacaaaauuagaaauaaaaaggggagcauaacuacagauacccaggaaauccauagaaucauaaguauacaguuuauaaaccuguacuccaacaaacuggaaaaucuaaagaaauggauaauuuuuuggcuacguaccacuuaccaaaguuaucaagaucagauaagcaauuaauagaccuaucaccccuaguagaauagaagcaaaagucucccaaccaaauaaaacacaacaaaacaaaaaccaaaaaaccaaaccaaacuaaaacaaaccaaaacaaacuuuccaaggcaagaugguuuuagcacagaauucagacuuucaaugaguuaaagcuaguaccccucaaauuauuccacaaaauagaaagagaacaaccauuuuuccaaauaauuuuaugaggccacugacaccccaguacccaaaccacauaaacacacaacaaagaaagcgaauuacagaccaauuuucccuaugaacaucggugcaaaacuucucaauaaaaugccgguaaacugaauccaagaagaaauaaaaaagauaauccacuaugaucaaguuggcuucaucccagagaugcaaggauggcucaauauaccuaaaucaauaaagguaauccaccauauaaacaaauugaaagaaaacacacacacacacacacacacacacacacacacacacacacaggauccucucauuugauacagaaaaagcccuugacuaaauccaacauaugguacuugaagauuuagcuagaacacuaagacaauggaaaaagaucaaagggauacaaauugaaaaggaagacaucaaaguauuguuauuugcaggugauaugauaguauaugaaagugacccuaaaaauucuaccagggaacuuguacaaaugauaaacauuuucagcaaaguagcuggauacaagauuaauuaaaaaaaaaaaucuguagcucgccuauguacaauuggcaaauggacugagaaagaaaccaugggaacaccaccuuucacaauguccucaucauauaaauauacuuuggggcuaacucuaaaccaaacaugugaaagacucauaugauuaaaaacuuccauucaugaagaugauaucagaagagaaaaaguagcccaggcucauacauugauaugaguaauauaguaaaaauggccucuaccaaaagcagucuacagauacaaugaaauacccaucagauuucuaguacaguucuucacagauauugaaaggacaacuuucagcuucagauggaaacacaaaacccucaggauaacuaaaacaauccugaauaauaaagaacagcgguggguaucacuauccccaucuuccaguuacauuacaaaaguaaugauaaagacacugcggaucaaugggaucaaacugaagacacggaaauaaacuuacacacuuagggucaccugauauuuugguaaagaagccagaaauacacaauggaaaaagacagcaucauugacaaauggugcuggucaaacugaaugucugcauguagaagaauccaaauagauccauacuuaucaaaucguacaaaacucaauucaucauggacuaaauaccucaacacagaaccaggcacacuuaaccuggcagaagagaaaaugggggauaaccuugaccucauugguacaggagacaacuuccugaacggaacacugguagcacaggcaccaagaucaacaauuacucaguaggacccgaggagcuucugugaggcaacggacaccaucaucauucaggcagagcuguuaaaucagugagaaucauaguacaaugcauagaacacagagcuuccguguagagcaaggagcuaggggauauagauaguucuuguuaggaaagugaaauagaauagauaguuauggaugaguggggcgaggaaaggaggaccaaguggggaaggagaugggagagggagguggggaauacaggggcagauagcuaaaaguaagggccauugggguguuguacaaaaaccuauuacagcagaagccucuuaaaauaucugcacagauguagaugaucauaacgaaacuuccaaaacaggagggagacagagucccaacuggccaucucuuguuaccaaaugaagcuucuagcccccaauauugcguuacauaguuacaucuaauugacuuguuggccaaaaugaccccaugggauucccaaacaacccagacuauagauuggcuauagguugcucuccacaaacugacagcaaggccuucuugcugaagauaauaccugucuauauaacuuaugaacaaagaaauugaguuggugccuaaauagagccuucaccccuauauucuagcaucuuugguacaagacugugcucuguaugcuaccaaaggaaaauguaaauaccaacccaccugaacacccuuaaauuauguuggcuuuuuuuuuuccuuccgucuuuuugaggcaggguuucaaugcccacgcugaccuugaacucacagagauucaaacaccucugacuccagagugcugguauuaaaagugugggccacuguaccuagcuugguuaggaguuuauaauuucuuuauaugucaucuuuuaggggcugggaugugguugaguuggcagagugcuuucuuagcauccuuaaaacccuggcuucuaccuguagcaccugcaucauccaggcacagaggugcacagcugcagucccggcacuagggaagacagaggcaagaagaugggagcaagguauaggccagccgacucagcuggucacaccagucacaaguacacaaugagauuuuugccucaaaacaaaguaaagagaaggaaaaaaaaaaaaaccauacaacaaacuaaaaccagaacccuuuucagaggcaagcucuuugauacauccacacuguuugguuuaucucuggcuuugcuccgaaucacagugagacuggccuggaagggccccuggaagagaacucaauuuggcuuucuaaaguacaucccuugacuuauucuucucuguuugagccagaaaucaaugugucuugucuuuucuagggcagcuaccacuugaggacucccaucucucuccugauggcuuauuacuuaggaaaaccuaauuggcucugauuucuuacagcuaggccgucuguugcucacaggcaguucucccaaggaaaccaagcccugaaaaguucugcugguugugcucuuaggaagcaaggagcugcacuugaauguguugcuugucuuuaggacgaaaugaagguccagugcagcugccugagugcaagggcagggcgcucagccgccgucugcgcugggacuggcucaugguuuuuuacugaggaccuuacgcccuugaauaagcccuugaacccgauugucaucucugagaugcaggggcuguguuggauguuuucacacugaaaaauucugcuguccgguccacagaugcagaacaucuaaaugauucucccucuacacagccagcccucauauccagaguaucccaucucuuccuuaaucuggguccccauccuguucaccuugugcauggucuaaccaugcacgcggauagguggguaccaucuguguuuaccgaauagacucgccagucuaacuguagcuaacaagugcuaagcuaguuguaauuaacaagugcuuuugcauuaccaugaacguacuaagcauuuaaaggccuuuguccuuuuaaaaaucaaaccacaguuucagguaauaauaucuguggaagcuguagacaguguuuuauaaaaccccggugcagguugguauuucgcuuguuaaagaaacaccauuugccuuggagaaaaaaagucauaaauguuucuugaaagccagaagcaguauuucagcaucaaaucgaugcagaaacaugcccgaagcccuuucuggacauauuuucuuaauaaucuucuuaaaauuuucuuaauuuuacuucaggcuuuaacacucgguaacugaacugcuaaaguggaucuaugauguuguuaccacuucauuuuaaaauaaaguaauucugaacagaaauaaaaagcccugcuuuguaccgucugaaccuuuucccauguguuaucaucuggggagccuugagaccagccagaucgauugauugaaugccaagagaagaagagaggauuaaaaacaaagacaagaaacagaaaggacgcuguuacaagaguauguacuagggaggugauaaaugaggauagaaacaugagucuguaaagacaaaugaguuuccuuggccuuaagcccccauugcuguuaaagugaaacugugcguguuuagaaggaaaucuaaacaaacaaauauuccauccuggucucuaaauacuuacacuacuuucuuuuuguaaugccccuugcuugguugaauagccccagggucauagcuccagccugauggaaaugcucugucaucuuaucaggaaggcuggccagccuuugugucagggaagacacuucuugaccuuguuguuguagaaagguugacacaggcagaagcaaugccaucacacucagauugccagguaaggcccuuggagcuagcagauggaacagaagagaggaggacuugguuaugaggcaaagagucggggguggaggagauggcccaggggguuaaaugcuuacuacauaauagauacuagggugugaguuuggaucccuagcacccauguuaaaaggugcauguagcggugccaccuguaaccccaagaagugaggcauguaauguagggcaggauaaucccauggaaauaggaucugggaaaagcuggcuaaaguggaagcaaacugauuucuuuguaagacuuucauagacucuuuacuuuuggaacuaugguaaggaggacucccuacuucauuggcugauggcacccuuaacguguuccuucuuaaugcuuugcagaaaugcuuuuuacaaauccaaaucccugucugugguaggaaugcacuugagguguucgcggcagucuccccgggggagagguauggguccaguccguuuggggagcuuuugcugaaucccaguuugccuuggguuucauaagacacaccugaguccacaagaaagccaggcccuacagucagugcauuagauccccccagagauccagacugcuagcuagguuacaugacuacagaggcugaggaauuaccuagcacaccaucuggacauuugagaacaagacaaccauggcucgguccaaguucaaaggccugaggaccagaagagcuaacuguuucucaugcugugucugauggcuaaggauccgggcguggggguggggguggggguggggugggaguggggcguucucuucuacauccugaagugaaguucaagggugggagaacuugggguacuguugugaaaagaagaugaacgucauaauuccagaagacggggucuuugugcucugccuuuuuguucugucuggacccuuaaccaauuguaugacaucuacguauagagggaggggggcucuucuguuucaugguuccacugauuguaauaugaaucguucccccaaauuccuaugaaaggaauacugagcacucaugcccuaaccugcuaccugagcacacuaguccagucacgcugaugccugggguuagccaucguugagcccaagucugcccaggcaaaggcagagacggaacuucaggaauuuaaggcagagacggaacuucaggaauuuaaggcagagacggaacuucaggaauuuaaggcagagacggaacuucaggaauuuaaggcagagacggaacuucaggaauuuaaggcagagacggaacuucaggaauuucauuuggugacuuggauaacuuauugugagucugcaaucuccagaauccaagauucccuuuaucuccauucuuuucuccugauagucucccuucucaccugaaagagaaaauggaagccgugugugauggagcacaccugaaauccugaugcagaggcauaguggacuugcguccagcuugcugggucagggaguggauggaacagguagaacucagugaacacagggguuaaguccuuaucuuuguagagauuuuaggguuuuuuuuuuuugguggaagaucaaaggucacugcauagaguaauagggcuuuauaaacacgguuuucuuugacugagaacaaguaggauacaugcagaacuauguuucaaaaauaaaaaaaaaaaugguguuugccugcaaagcucgacuuuguauucucggggcagagugacagcauugagaggaacauugauuaguauuuuuauaacagcaggaaaauaauuucugcccaaacauugauuugucuuugaaugggcuuucuggaaauccuuuccuuccccagcgcugcacccugccacauuucauguggcgucaagcaaggagaucucgcugcuauucaacguauuguuccugguuucugcaucagucguuacaguugccuggcugcaaacacacccggcccccucuuguuguauuuugauuaaugagauuaaagaggcucuugucuuauauauuaauacaaugcucagauucuuuguggauguauaccaccuccuguuggcguagacacagccauuuagucagcaucuucaugggagagcuuuuaaguccuguuagcugaagcucauaacaugaauuugucaggucauguguguuuuuuuuucgugcacuuggguaaagacuguggagguccuugcucuggagaacucguccauuucagcagagacauggaaaugaauuuaguacgagaguuagaaugaaaggugguuaaggucucagugcaaaauauccagcacacaugugaccgaucacguugucuccagaugguggagguauuuuggcaggcccaggaaccuucuggauguggcugagcugggagaaguaggccgaagggcagggcuugcaaguuagaggcuagcucuguuuggcuaagcucccugcuuccuucccaguugugaugguacagacacaccggagccaacguacuuuuaaagcuggaugaaguguaucuauccugaaccaugagccgcacuaaagccucucucuuucaagggacauuugugacagcgaugaaagauacagcuaacaucauggcuuagcauccuguguaacugacaugcgacuucagagagggaggcauuccuugcuucuugagauacuuguacccaguucuugcagaaguggagucucuagcuggucccaagaucggaaggccuuagggaggaugggaaggugggaugcugguggcauuaguaaugguggcuaggacaaagugucauuuucccaugagcucuuuugacucuaauggaggcggaggcggaggcggaggcggaggaggaggaggaggaggaggaggaagaggaggaggaggaggaggaggaggaggaagaggaggaggaggaagaggaggaggaggaggaggaggaggaggaggaagaggaggaggaggaggaggaggaggaggaagaggaggaggaggaggaggaggaggaggaggaggaggcggaggaggaggaggaggaggcggaggcggaggcggaggcggaggcggaggcggaggcggaggcggaggcggaggcggaggcggaggcggaggaggaggaggagggaaaaauaggaaauaaagccacagcugcaguguuuuccuuuucuuucugcugugacagaaaaccugacagaggcaaucggaggaagaaagguuugcuuuggcugcaguuggaggguacuuccaucaagggagagaagucuggugucagcagaagcagucaugugccaccuguagucuggaagcagagagugauaaaugguggccuucagccagcugucuccuguuuauucagcccaggagcucugcccagcaaacaguggugcucucguuuagagugggucaugcuaccccagcuuaacccagucuaggaaacuccucauaagcaugauggagcuuuguccccaaggugauucuagaucaugccaaguugacagucaaauuacacuaaacaaggacauuccgauuuguuuuucuguggucaauggauuagcagcgaagguucuugaacaaagaauaaguagacaauuuaauggauuugcaguuuaguuagagcggaaacagcucauagcuugguacccaagagccuuuggaagcaugguaaggggauagugagcucaugcaggcucuguccccugcucuggagagcagcucacugcugauacccauuccucaauuucucucuccuuuccucuucucagacuggaguuuucuucaguuccccaaugcauuaauucaaagaugaccuuucuuuuaccgagugaguuugaauacccaaagcuauuuucauuuguuccagauugucacaaaagcuugauguccaggugccaacuggaagggccagaccuggccuguggaggauuguuuuaaaguugaguucuaaauuaagcacguugggacagaaaugagacguggccuaguucuaacuuaccaguuagcuauaaaagcuauguauguucucccucuuugcuuaaauccuuaccugucugacuccuuuagagacaaaagacacccaacucagcaccagcaacaucuggaucccucugcucucauuucugauuuccuucugaauaguuuuugucuugcugcauacuuuuagaaagucagacugcaaagaauuucuccagauaucuggcacuauauuauuaauuuguuucaaaugucuaucuccuaucuuauaaaguuaucaaaaugguauuucuaaaugaguucucgauaugauuuagaccuuccaagaaggauuuauucuuacuuuaccuaugugugcacaucugaguguaugcuacuugugcgcuggugccccuggaguccagaagagggcgcuggauccccucaagcuggaguuguggcaucacaacaggagauugggauccauccaaugaaaguucugggaaugaacaagugcucccaacugcugagccaucuccccaagcgccagaaccucuaaguucuaagcagcacugccuggauuagcaguagcauauucagugugcaguaggggucguguauauagggaaacaaaacaugcauaguacaagcuucagggccagaagagccugguuccaaaugcuucuucugcccuuaaucuuuggugacaggagaguauugugcacugcucaguuaugcuuugaguacguggguagaacuuauaauagguuuguucuuuucaugucagugaacuuugagacuuagaguaguagaauccuggagaacuuacagguaaggggauuacagagaugcuugguugagcugccuuugcauagaaugcaaguucagcucccaucacccacccugggcagcucacaaccuccugcgacuuuggcuccaggagaccccaauucuccagccugggcagguacugcagucaugugcacacacucuuagucacgugcacauaacuaaaauaacaauucugagagaauuacccauagaacuuuagucuacagaccucuugagacuguugaggcacagggaaguuaggaaggaguugagugugauguucccccagguccuuagcucuguucugucuuagcauuggcuucuucaucuccuuuuuagaggaucacauuuacaugcaggacugcuaagaauauaaaaauaggcaaagcacagcagcaggccucuuccaggacgucuguaaaauugugacuguugcuauuaagugcagaaaauuuggauuuuuuaaaaaaguuguguuacuuucugucuuugauuuccuuuuguaccacaguagagacuguuuuuauuagcauauauuaauuaaaacaauauuggauuuuaugaugacauuaucuguacaugauauauucuggucauauuuacacuauguuacccuguccugucaccucccacugaucccaugcuccucauaacuaguccuaaauaguccuccucuacuuuaguguaugucuaaauuaucaucaccaucauuaugguugucuucagcaagugauuuaguagguugcuuaugugagcaugugaggguuguuugcagggcaugcacaucucaucuguggcucugccacugaagaaaaugucuggccuuuuuccagcaaccauucucguuccucgggguuggguaagggcaucaagagcuccuuuccacugagcucaggauaaagaaaacaaaauaaccuaaagaaaguguaucauagggucucuagaaacugcucucugucugguuagguaauccugccaucccuuggcugcagcucagccacacgacugcaguagaggcugggaaagauggccuccucuauagaagagaagaaaaucagauuuugguggauaaccauuaguuucuacaaagccauuuaauaucauccugguguaggcagaugacccuguggaaacccaaccuaauaugauaccuucccucaaggauuuguggucaucuuaaacauuuucuugguguuucauauuuuaccuucauucuagaagaauuauaaagcaucuauuaugcuuuccuguuaaaagagauaaagauuuaauuugagacgcaaugcuuaccauaaacagguggccuggagaacgauuuuauuuuggcucacaguucagaggacucugguugucucaguccuuugccccugggucugcugaggcagggcaucauagcagggaggguggagagguguagaguuacaggaaacagagggaaagaaaacccacuguagggaaagccuacauuccccuguauuuaaaauaacaaaaacaaaacaauucagaaaccauuuguuuagguucuuacacugaauuacacuuuugaaaauucauuuugguauaauuguagcuucacauguauuuaacaccaauaacacacagagaucccaagagcgccuccuguuuuuuuucuuuuuuuuuuuuuugaugaaaccaucuuucaugagcauacaggaucaggagaguagcacaaacuacagcccguuuugagauugcacguauguauucuuaagcaguuuagucaucuguacacacagacuacugcuauagucaagauuuagaaucauucugcuuacagaugacuccuaccuucucccucccuaaccucuggagagcacugacugaccucugucuuugcuauuuuaagaacauucuaucacuccguuggcaguauauauaucuucauauaucuuguguucuucuucccccccuucccuucccucuguuccccuccccucccuuccccucccaccuccccuccucucuucuguuuucccugcuccuccauucucuagcuuucuuuucuggcuagcauuugggccuaggaagcaguuuuaagcccuagugguucaucacaaacaaccaggcucuggaugcuguccugugucauagagggguuuacgggacuggcaucugauauucauaaccaaugguuucuuuuaaggauuuauuuauucauuuuuauuuuacuuacuauauguuggcauauuuugcuuccauguauuuauuuguguacacugcaugcaugcagugcccgaggaggccagaagagggcgucggauccucugcaccuggagucacaggugcuguaggccacuggagugcuugggaacuuaacaacagugcuucacuguugugcuucguuggauaacacaaguuauuucuuuuuauauagagauuguucuuccauucucuuucccuggucuuuuccaaagaggguuuaauuuuucugaggucugauuucagccuucccuccugugagucagccucagugucagcucggagaaccacagaggcugugauguucucccccccccccccccccguuccgcgccccccccccccccccgccuguguuuguuguuuuucucccugugauuuuuaagagcggcuucguugaaauaggauacagaugcaacacucauguaaaggauacaacacuuaauggaauuguauggcugaugcuuuuauuaacgugggcauuuuugucaccugauaaaaggagccuggacccacuguuguccauucuccauuucuuccuccauaagccacuugcugguccaccgugcuuccugguuugcugguuugcacguguuagguaauggaaccauacagcagccgccucugggacuggcuucuuuugcuugggugguuuucagugucucacauugaaugagccauggaaauaguuaauauaguacauauucuuuggaguaauguuuaccaccuuugugcauuugaaaacugaagauuuauuuggcacgaguguguguguguuguguaauuugcaugugcggaggcaggguaccacuucugaaaaugguucuggccuuuacccuuggugaggcauggucugcuuuguuucuguugauggacuguguauggcaggcugcucaugugcagagauuauagguacuugccccuacacaucccaugguaugugccccccaccccaccccccgacccucacauucaacucacuuuggcaggccugcgccuuuacccgcugaaccacccuccugacccuaaacugacuuuuaaucuuuuuauuauugagguuuaagagggguuuuuauagaguacauucuagauguaagucuuuggugagaucucuucuuugcaaacauuguuuuucucauuccuugagguguuuucuaauuucugguuacugauguuuguaauauuuauaauuucaacagacccaauuuguuguuugcugauugaauuauuuuugguuaugugcuuuugaugguuuaucgaagucuagcccacagcugcaaauuuauuucaguguuuucuugugaguguuuuggggauaagugcgucgcccagggguagugccugcaugaggggcuaguauuacuuuuaaaacgcacauuuugguuuugaauucacgcuuguugucuuaguuagggcuuccauggcugugaagagacaccaugaccaaggcagcucuuauaaaggacagcguuuaauuggggcuggcuuacaggcucugaggaucaguccauuaucuucauggcuggaagcauggcagccugcaggcagacguggugcuggaggaguggagaguuagguaggcaggaagcagcuucuuuuccacccugggcagagcuuaagcacaggaccucaaagccuaacccacagugacacacuuccucccaggccacaccuauuccaacaaggacacgccuccgaauagugucauuuccaagcacucaaacacaugagucuauagggccaaagcuauucaaaccaccacagugcugauccacuuggagcugauuuuuuuuuaugcaauuauaaagaauuuuuauacuccacggcauuuuauugccuuacgcuuuacauuuaauuccacgauccauuuugaguugguuuccguagaaagugccagaagugucaauacaauuugcugaacuugaauccaguaauuaaauaaaaacuuuuagguuaaaaauguaagugccacagaugcaguaguuagacuuugugggaggaaaguuuuccuucuggggaggaauugcauuugagaagcaaucuucugcuuuauuagcuuuuaaagaagaaaaauaagcacaauggagagagcggagcugggaaggcuguguaacaacgucauuuccccaguugcgaaaggcaaagaacccucuugccaaaaggaaagaaaagaccauugaaaaccaaacuaccauuuuacccucuguguguguguguguguguguguguguguguguguguggcucgggaggcaguguuuagcaggugugaggcccuaggcccaguccucagcacccacagacagaaggaaugaaaugagucuugauauaaaggugucucccagcaucguuagaagauuuugaauagacuagcaucuaaugggagucuuguaauaaacaaaacguuucuccuuggagguaaaaccaauuuugguggguugguugguugaugguuuucaagacaggguuucucuguguagaccaggauggccucuaacuggagauccaccugccucuguuucugaaugcugcgauuacaagugugugccaccaccgcccggcuacauguuuuguuauaaaagguuaaaaguuacaggugaacacaaugagccacaguucuaaacaguuaugcuuucaugacuuaagucuuuuuggaacucugugugcucugcaaugguuuugucagcaccagcauggcaugagguuuuugggaauccuguuuccuccacucaguucuucuuuaaggaaaccuuuguugauaaggguaggcuuucuguccugagaagccaggggacuguugggucuuaauucuuucuugcagacacagcauuccuccugguguuguguuaaaauuauguaucauuaccuuucuuacuuugaagauaacauuuucaaaacaguuguuaaacauccauuaaaaugcuaccguagggcuggagauuggcucacccaaagacgucugccugguuccgucccagcgucccaugugauggaaagaaaggaccaacuccuacacgugauucucugaccugcacaugugugcuguggcacaugugcacaggaguguacacacacacacgcucacauacaacaaauguauacuuaccaugacaauuaaaagaauugaaaaaagugccauaauuccuguccucaagaggcgcuaaguaacuuaaaaucauuauuuacaucgcagaagagacuccaguaaaauuaguugguuauauauuuagaugaugugcauaguauuuuguaguguuuuaaaguuuuucuagaaguggcuuuuaacuuuauaauuuccauguacagugcaguauaccauauaauucagccuuuagaguguauaguguagugguuuuuaguguguucagaaagcuguccggauaacacugcucauuccagaaguuaauggcccaccuuugauuuguguucacuguugaauguguauggugcacuucagauagaugugaaaaagcuuacauuguaaccaauaauuacacgaaggccaaugugaugcagaaaucaaagaugcuuguaggagccaguugugugugugccagaaaacgcugcacuugggaacuagagguuccuaaguuugaggcuauccuggucuacauagcaaguuccaggucggccaggucuauacaacgaaacuaacacacacacaaucccaaacugacaccaauauaauuuuguuagaaaggaaaacacucuacccuaaaccugagucugguagugccuacuuguguaucuaauggccuaaccuguuuuccucuaaaacuucuuuuccugaagauaaguuagaucacucugcuucccucuugacgcuccucugcuucuuuucgacuagaagccaugcuccacauuagauaggagacucaugcgggguguauaucugaaggggcaugaugagggauaaacauguucacaugacauugauuuuaucuaagcagagagacaaacaguauugcaugcucauugcaaagcauugcuuaguauaaaaagauagauuguuuaggacacagcguuugcaugaccggucaaagaagacuuaaaaauaaaggcuuagucuuggacagugagaagugugaucuuacgaauuuucuauuucuccuagccuguuccaccucugccacuugaauuauuuuauuuuaugugucuggguguuuauuaucugcauggauguuugugcauuuuaugccugguaaccauagaagccagaagagggcaucagacucccuggaccuggaguuauauauaggguguugugagcugaccugaggugcugggaagagaaccaggguccucuagaagaagagcugugcucuaagccccgagccaccucugcagucuuacuccgucccugagccaccucuccagucuuacuccgucccugagccgccucuccagucuuacgccgucccugagccaccucuccagucuuacuccgucccuuuuguccaucagugauucugcuucgaaaugaacacgaaguucuggcauaugaaagcaaaacauagucacggacaaaguaacccaucaaagcgggaacuccacccaaacccacagacagguuccuauaaacccuuugugagaugcucaaguucucacgaauccgggccaguccccacccccacucacuauuagauccuccgacuucaagucucagcucaugugagauuucuauacaggcguccuugcgacucuucacucuuuuuccugccuguggugcugugaugaccuuagcucuucauuuuguaacggggugucuggugagguagagacagagagguggugauauaucugucuuccuccacagccguaaguuccccagaucagggcuuaccucuuacuaucuuuguaucccugguacuuuguauugcgucugaaccauauuagagacuugacagauguuuucuugaucacauggauauuuuucugagugacaguuuguggaauauagugguuguagguaguacauaauuucacuuauuugaguuuagggaauuuucuucccuccuccucucccucccucaugucucucccucccaucuucuuucucugcccccuucucccauuccucuuuucuuauuucaggguaaauggaggguuuauuguuguaguacugugcauuauuuccaguacucugcagaugcuggauuuagcacccaucagaguacggacauugcuucacuuggccaaugacccagucuccaaauccagggauuauuuuacccauugcaguuuuucuugaacuuucuguuauauuugaaagaaucauaacccuucuauuccugaagcucgucccucccauuucuggaaugguacaguuccacaucguacgucagcaccacaucacagacuuuccuugcuagcaugcaucuugguauuagcgucuccagggcuuucggguccugccucucucuacacagcaugguuguguggguucucagccaccacagcugcccuuugaccuuauaccagaauaguccucuuucacccacuuuauauaggcaacuauuuauugauuuaauauucugucauucugaucucuugccagcucaguuucugaagccagaaaucugucuggaagucaauucucugggucauacuuaaacucugggucacgaccccauauuaggucacauaacugaaugggcauguccaaaaguuacucaaauguguuaugaaucuaaggugcuuuaagcuuugauugcuuguguggcauaauggaauuuuacuauauagucuggagucuuagcauacaacacauggcauuuugcacugcacaucguuaagcuacagggccugaaacaccucagucagcuuugagaauauaguauauuuauagaaauauaaugcuuuaauuaugcaagacuuuaaauaugucuuauuuaguuuuaauuauucauauuugaaauuuuaauuuaguuauacaguguacuuucauaccugccuccauuugaccccuccaauuuccuuuggaacucuuucccaacaccaacacacccuuccucaacuuuaucuccucaucuuccucuuuuuuuuuuuuaaagaaauaauccagucagugcuuccuguauacacauggggauggagccaucugccugaguaugggucaucuccaaguggccacacuauucaggaaaaaccagcucccucucugacaccaacuacugaaggccagagaugaggccuucugacuccuccccagauuugugcugcaauuuugacugacuugauccucucucuauacaggaccucgcagguaaucagagcugaugugaaaccaugacugcaagggucaugucauaugcaaagggccuugcauagccucuccuuauccaacccgacauuguuucucccuccucaucugcaggguuccuugagagucuuguuccccacccccaccuccuccuccaccccuaccccauuccugugugugugugagagucccccuccugugugugugugagucccuccuccugugugugugaaagcccccuacugugugugggagagucccccuacuguguguguauguauuauucccuggaugugucacauuaguguauccuuggcuuguguuguauuagaauguuugauuuaaaaaauugcuauuugaguuucugacuugaccuucauuuaaaagaaaaaaaaccaucaagugaauuucagcuugggauuaggacagacuauuucugauaagcucuuaaacauaacucuuccauuuuguucuguguguuuaugcaaauuaguguucuuaggauugacuauuauggaauuaauauauugaucuacucugauaaacauagaagauacucugugucaugcuguaucaaguguugagccaagagguaauuccuuauauaagaauaaauaagagcauucauauauuuagugugcaaacuuauuucauauuuaauaaauauauaaucaaauaguuauuuuaaaauaaauuuauucaugauuuaucacuaguauucaaucuuauucaggcaaaauucucaggcaagaaacugguccuaacuggaagguuuagaaauuuauccugagaucuuucuuccuaucaaauuugucacgaagaucuuaauuuuuuuuccccuaccuuuucugcauuugauucuguuuuuccaaagucacugccuucuuucuuuaguccuguuuguugcagaugacaaagucaccucccuuggagucccaggucccuaauuuaggacuugccacguauauaaguauguaucaaaugcuaagucuguuugcuauuucuuuccagucuugcuauuugcacaaccacuguuuuucuuaaccacacacacaccauuguacuaaugcuucauagcaucccacugaccugaguuauccacuaguuguuuugauuaccuuacacccagaaagauuugggcccucuuuagagccacacaacgggauuguguggcuaugauauguguacauuuucugccuugucucagaaguaaacucgggcuggaaucagggucugauaacagaacaaacuuucuuuucaucuguagacucauaccccuaugaccucagagucucucuuggucaccagagcacucaguauuuucuccacagcaaccgacucucugacaucgguuagaugucuuacaauguugaucaguccugacacugucuuccugcagauaucuucagaucucgagaguaaggugucaguucacagacugcucucaugacaccaauccuaaguccagagagacaauugugcuucugacuggcuguguaacucacaggcccaugugggccugagaaauggaagaugcucauaguguagggucucaggcaguggaggggcucccgggcucuccagggacacucccuucucagcaucucuauguguucuucagggcgcaugcucucuacaacccuguccuuuagggguuuuuggcaugguguauuaaaugguuauccauuggugacuguacccauugauuuuaagugucaacuugcugcaacccagaaucacaugggaacugagccacaaugaaggaguuguguauaucaagcugccccgugaauguguuugugggggaaucaucuagauuguuagugauguaggaaaucuuaguggaccccaagucauguaggagaggagaaagcuagauuagagccaaagcagguagcauggaugccucuguuucucucugcucuugacgguagauguugugugaguagcaguuugauaacccugaaaugauagaccuggaacugaaauccaaauaaaaccuuucucccuuaaguugcuuuuggucacagccacagaaacaaacuagaagaguuaggucaacauccagcauuuucugucucugccucccuugacuuugggagcuggcaaagauggaaagucccaguuugccaaucaggguugguugcccugacaaccagcccccuuacagaggcuaugcaggaccccucagccaccagucaucucauuagcauaccaaaagaaacucauaacuguuggggauuccaagggaguuagaagcuuugugccaagcaacuggggcaaagagcaagcaagaucccauuguuccugccaugucuuggcugcaguugccauccucccaccccagggcuccacagggagcauguccauugagcugacccuuagcugacucuaggucacugcagaacccacagaaggaagaugcucacuuuaagcaaugguguuucuguuauuguucuuggucccccaccccaccccccaucuacugguuggggagacuaauugugcccgucacuucugcaagggcuggccuuucuagucuguguccuaugcacgacacacccgagacuaucaucaucucacaacauuuaauugcguucucuuccuccugucccaaaggacuugagauguaguacagugguaauguggcaagcaauugggauggcaagggugacgucaagauuaacaugugaugccucaguggguaaaggcucuuguugccaaaccugagcaucugaguucaauuccugggacccacaggagaggcugaugcagugcaaacagccagucaugaggcucaaggccuuuugcuuuagaguacgggccauuuuguugcucacuaguccauucuuggucuuggguguguugguuucuuucuuuaaaaauggucucuauuacuauuacuaguuguguguucugaguuuuggggcauaagguggcaagagaggagugugugugugggggucugugugggucuguguaugagugugugguauggguguguguguauggguauguguguguauggguguguguguguguauguguguaugugaguguguuuuuauggguguguguaugaguguguguguaugggucugugagugcauguguauggagguguguguaugggugugugugugugugugugagugcuuguaugcaaaauggaggguaggacaaaggaaucuuuguuuagaaaggcacagggacagcuucuuguaugagagaugauuaaaaauuaaaggcaguguuugcucugguuaaucuguaguuauuuauuuagaugccuuuuugauuaucuaucuagagcuaaaaaaggggggcaucaaagccuuuauucccuucucuucuugaaaaucaagggcuuuguccaaccuugaggccaaauauggugaaaauaggaaauuuaaaugaguucuuuaaaaaagaauuaccuuugccaguagauuccaauuuacagugguuuccaaacugagguaacuuaucccuuagggaaguagaucuuccuggaagaaguaaccaugucauucuuagaauagcguagucaaauauuagaagcaucucuuuuguucagugucugagcaggaugcucugguggaggaacugaaaugcauuuuagagaaggaaacuugcaguaagagugcacugggccacuugcaugccuaguaagaaacuuagauggcaguggggaaaaggguccagccuugaaugaagagacaaaccgggaaguguggaaaaccucggcuaauuaagguugaaguccaccauguccagcuagccaauaugggagacccccuucauuagcagaucugcuucuucucugacccugucuggggaauucuaagcccacacauaugccucugccugaggaauagcauguagccucacuuagauuauaggaucaaucuccuuucuucugauaagaugguuucagccagcaccugagauuccugaagugcuuccccaugcuaaugacgcauuccagguacccuccagccccagccaaugacauuugcccauccuggauguucccacccucaguccucccaaacuuuagaagccuugagucacccuauguaaaguugaucugcccacugagagcugcccccuguggucauucaugggauguacuccgagagcuucaggugaagaacuaugagagucccauaguugguacccaaagcucacugucucugcucccucugccuucauggauugaauugaccagagaucaggaagacccacagggaagugcaaaccaggaagugaaagggacgaugaaggugugugccugccccaagacuuucuuauuacccaggccauugcugcuggagcuuacacucugagccaagacuuuccguucucuuucaaauuaaguccuagguuugcucucaacugccugcauuguuguucuuaacaucacgcccuuuuccccuucacguaagggauagaugauuagagcucucugaugaagaaaagguccuaucuguucuauagauaaaaaucauuuucagaaucaucaaguguaauucagcuucagucuucggggaaaaugaagauuagaauguauugaacucugaauuuaaugugcuucauaaaggaggaugccagcuauuauccuuccucagaaggaaauuguugauaagaaaccauuuggagcagugagguuuaugaugaugucaggagcuaaagaaaugugggcagcugagcggccagggcaacaggaauacccgaguuuuccucgugccaccuugugacuuaugaggacauaacacugcccauuuuggggguggggguuauaauucuuccccaaaauuaaagaagaauauucauuaaaagcauuuuacuuuaaugaacauguccaccaccacccccaaccccccugcacgcacacacgcgagccuguaaaaccuacacuuuucagucacugauucaggauggaguggcuugcuaauuccuacucgacuucauuguucugaagaagcauuuggcuggaaugcagacagacucuucugcugaauaaggagguccuuuccuuacucagccccuucccuucacaaagccuccagaagggacccagcccuccggugaccggagucagcaacagugauuucauauugcgcuuuuccaauaggauucuacagaaguuuggucauguguacuucaggugguuuacugcagcauucuguuuauaauacaauaccaugcaaacugaauguaugcccuucagagcuccccagaagcagugccgucucuccaguuaagugaaaacagauaccugacaggguacugcauugguuuccuguugcugcuguuacggaucaccauaaacggggaggcuugaagcaguaggaagagauucuccccugguuuuggaggccagaugucugaaacaaugggguuugcugucuuugaaauuuucuggugagcacgcuucagcuucuggggucuccuggcuccaaccucugucuccuuuugucagaacgggaucugguugcucaugggguccacuuggauaaugggggcaguguguguguguguguguguguguguguguguguguguguguguguguguguggugaguaccuuuucucaagaggcuuacuucagucacuucuccccacauagggaaauaguaauagguucuggggcauagcauggauccuucucaggacugccacucacuuaucuacaggcacuugaccuguuuuuacuggucccugagccuuauuauauguucagugugccuagucuauauuuacucagaacguacuauucuaaaauuauaauuuaaauuaaguuaaaaaugaaaacauaaccuuuauauuucucaguaacaaaccuaaucuugacgauuugugccgugauuacaccauuagauaaaagguagaggguuggggauuuagcucagugguggagcgcuugccuagcccuggguucggucuaauaaauaaauaaauaaauaaauaaauaaauaaauaaauaaaugaaugguaggcuugaaaaacagcacaaucccaguguuauuucuaguugacaucaaaguccauagauauuaaaacccauaaaauaguuaaaaacuauuguauuuuuuuauaccuagaaacuguguaauuaggauacauuuggguuauguagaauagauguuuaaacuaauugagaauucuugacauaauugaaaauaauuuauuugggauugaaauucggucaaugccaugauccauaagccacauacguuaugaucauguuuacaaaguguuuguagaacuagagguuauuugggguagauuuguuucuaauuucauuuuuauagaggccuacacugucuuuccccuuuucauaguauucagaaaggagcaugcacugucagacuuuaauuaaccuuucucuauaaaaacgaauacuuccaaauacaacucccacguacuaacugcaccaaagggucccagggcaucugugcugcccucacagguugcuugguuugccggguguugcggguguggcaggguuggugcuggguuacugggagagaucucucuagcagcuguggaagcgcuuggcuggcuuggcccucuuacuugaaucaguuuaaaagugaagccaggaaugcccgcacuucccaagagucaaaguuuucugcucaaagcgccagaaccauuugaugugcuccugccugccugcagauucucuuuggauuccuaguugggaagugguuuccccauccuggaaagagguaaaacugauaagacaagauuauccgugacaagauaguguuagggugugcccaccugggcgcucccaaggcauugccuucugcucugaagugucaggcccugaacacugggcuagggacacuggguuuuuuuucacccuguuuucuuuuccuucuccuucuccuccuuccucuuccuccuccuccucccccccuuuuccccccauuuucuucaucuucuuccuccuucuuuuucuucuucaucuuuuuucuucucccccucuucuucuacaauagaauuagucagaacauuuuuacaguuggccugucaaacacuauuuugugaagcuucugucuaaaacuguauuuugacauuuuauuucauauuuucuauccuguuuuagucaaaaacagcaaagaaaagcuaccagguuuuauauuuaaggcucuggcacuuuagagagagaagcugaauccaccacuacuacauagcauucugaaagugccuuuuguucccaggcaaaauauggaaauguuucagaaaggucaugcuuucuucuuuucuaauuccauucuugggaguucugacagcgugggccugaaaugugagccaucccacuccucaaggcacuuuucuuaaaauuccucauguugcaucuuuacccugagcagagugaaggauuucagccauugcugauagaagacuagaggcacaucucucugcccauagauuagugugccuugcaacccccauuagaaaagucucugugcaguagaugauauuaaacacagugucagaaaugagcacaaugcagacauuugguguccguggcaugcucagccacaaacaggacaucuagagaccauccgggaaggggagggaagauuauaagagcuggaggcuggggagagcugagcaagacagugucuucuggauccgacaggaccaccacaguuaugaacugccagcagaagcucggggcaaggcuaaugcagccaacguuccagcauggcggggcgaagcgucuagcagugaccgaggagcugcggccagcucagcccugcuaggggaggagaguccguuuucuugguggccuggccccugguggguggacugugcucuagaggauggccccacaucugugaguguauggccagcacacauaucaccaaaagacauuguuugaaauucucaaagaauaaauaaaaacaacaaaagaccacgggcuuagcauaaacacccagaauucugcuuugguaugcaacugaaauguuuggguauguugcugguuagaucaaccaggucacacucugggacucagaggugguauugaaaugcuucucuucaaacaggauuccaaaagcauccauaaauaaaucaauaaagacagacagacagccgugcauacauacaaaauaaaagcccacgugucuccugccuuuucucuuauggcuggaccauguauuuuuuugaaaauuauuugcagcuguccucuuccugugcaguccauuuauaggacaccguugguucacucuuccauaccagucuuagcauggagaaaugugaggaaugguucccgaccuuaaagagaaagcuuuuggagcgccagaaggcagcugugagagaaauaauugcagucuaaaguaauaaaugcugucguaguggugacaaagugggucuuguggucuaaacccucuugccugcauucuccaacugagaguguguguguguguguguguguguguguguuuguauguguguguguguuuguauguguguguguguguuuguauguguguguguguguuuguauguguguguguuuguauguguguguguuuguauguguguguguguguuuguauguguguguguguuuguauguguauguguguguguguuuguauguguguguauguguguguguguguguguguguuuguauguguguguauguguguguuuguauguguguguguauguguguguguguguguuuguguguguguuuguauguguguguguguuuguauguguguguguguuuguguguguguguuuguauguguguguguauguguguguauguguguauguguguaugugugugcguguguauguguguguguguuuguauguguguguguguguuuguauguguguguguguuuguauguguguguguuuguauguguguguguguguuuguauguguguguguguauguguguguguauguguguguguguaugugugugugugugugugugugugugugugugugguuaggggcagaggacaaccuugggagcaguugcuuaggaagucuuuguuguuucugaaaugggaucugucauuagccugggucuugcagaggaggcuuguuuagccaaauuaggauccucugagauccuccuguuucugccucccugggauuauaagcauacagcauaugcuuauaugccuguuuguuuguuuguuuguuuuguuguuauuguggucuaacauaggucuuggggaaucaaagucaguuguucauguuugcacagcaagcucuuuccugacggagucaucuuucuaaccccuggucuuuuuuuuuuuguggaauuuucuccucugucuguuagucucccuuucagauagccacauguguugcuuccuaacucuuuugugcguacauguauauaugaaggaauacauugccuguauuuuaggacagauagcaaauguucaaagcaguuuuaaauguaaugagcucccuccauccuucugagaucuucuuuccuuuguuuuauuuauuuauuuauuuauuuauuuauuuauuuauuuauugagauugagccuggcagccuaacccaggcuggucucaaccugaugcccuccugucucagcguucauguucugggaugacaggccccuauuaccauguccacugguauuguuguauugauuauaauguuuuguacuguuacuuaacaaaaaaaucacuggcuugaaaugccacaagcuuguuguuacaguuuugcagaucacacuucugaaaacggcccucaaaaaugugaucguaguccuuuuggaagcucuagaagggauucacuccuugcuuuucagccuuuagcagcugccugcacuccuugcuuagcucauagcauccuucaguaauggcauagcuacauuuuauguuuccauuccuuugaaguugauauuccuuuuguuuuguuuuguuuuguuuuguuuuguuuuguuuuguuuuguuuuguuuuguuuuguugagacacagguuugcuuuauaggccaggcuagcuuacaaccucuuauguaguccaggcuggccugcaaguuguuaaauagucgaggcuugcaacucuaaauucucuugcuuuagccuuccaaauacuaggauuauaggugaaggaauugaaauacaggauuauaugugccccaacaucauaauucuugucucuggaguauuugggcccugugaccacauggguaccuugggcccaucuagaugauccagggagagaaucuuuugauuuaucacaucuucuguaucccgucuccgugccaaaucauacucacagcaguuagggacuagguuguggcuucugugggguguuacucuuuacucugcuuacuccugugaugaugaugauggugguggugaugguggugauggugauagaaaugaagaugaugaagaagaaucccuauuaguauuuuacaugccaagugcuuuuaauaguuuauuuuuuaaaauauaaauagggcuggagagauggcucagccguuaaaggcuaggcucacaaccaaaaauauaaauaaaaccgaauucuuuugucucagagcauguuaagaaacaguagcaucaagccgaccuuccuuaccacaguugaaguugacuuccucauccagcugccuggaaccuucuggaauguuuacacuaagcccccuuugauucaggcacugaaaggcuagcaaaaugcacaugaucaacuauuauaacuggccuggcagaaaucaagauauucucaaaggacacuuaugucucccugugugacugucagaugauuggaacaacggaccccaaguaaauggcagugucccccagaauauucugcucugggaggggaaaagcacuagucagaggggaacucucuaggaaggagaucucacacaauucuuacaacuccucagaccacuuuacaggaugaggcugaagccccaacaaggauggguucuuaggggcggggccacacuggauugaucacaagugcauaucccuggccugcugguuaaacuugaaucucacuucagaagcccagcaugaggacagaugugggcguuacuggaucucuccgggccuaccccaugcccugcauucaauaagucucuuucaccugcuucucacuacugaguuggcuuuucaguggcuuagauggcuggcugaaccuggcuugggugagccucacauucugagacaauauuaguggagcacaagugcuuacuguaauacaagaagcugaagcugugugaagacagguggguuuugauuuggcgauaaggagggaaguuuagcaggagucaguuugcauauuugaaauagccaaucaccucuuuggguccuguguaguggguauugauacccagaagauucacagcaaguuugaccuccaucccagaucauuccugagugugcuggugcccaugagcaugcgugcucgcacacacacacaaaagcaugcccauguacaugcacccacacacauguaugcacccauacaugcaugaacacauggaauuuugaaauccuaauacugccaaauucacaaacaagucuuaauucuuggggacaauuauggaccaaaaugaucauauucaggaaaguggugaugaaaaccagacaagagaaauagcaacagaauaaaaugaccaucugcucuuaaagccuauugggaaaaaguccucuugcuuuaauuuuucuuccaauuuauuacaaauuguaggucugcuuaauagaaaaaaugaggacagguuguugcuuucuuagaaacacaaaucagacagauuaucacccugcaggaggacagucaacuaauuuugagagacaguauauccacuuacuaguuuuucuuagacacucuccaauacuaaauacuuuagugacuuuuauuuuuccacuuuccccuucuguauuuccaagcauuagguguuuugucaguuuaugaugagcauaaauuauaaacugucuuauuuuaagcaaaacacuacacauuaaaguaguauguguguguguguucacacuuggccagaggaggcugucuggugugucugcugcugucccuuauuuccuugaguuggagucuaucacagaauccggagcuugcugacuuugcaguuauguuaccuggcuaacaaguccuggaagaccguccaucucuccacccucugcugcccacgccaggaggugcagguucuggcccgcaguccuagcgcuuacauguguccugggcaucuaaucuuagguuuccacuugcuucuguagcuagugcucuuacccauugacccaacuuccuggcccauguagagcuuuuuaaaugcaggcuagaaaacgacauuaaaauauugauaccaaaauaagagucuccaggucucugauaauacuuuagcuucuucaccuuccucuucagcccugaguugcucuguauugucuacuagucaggggaguuuauucuucucugcuuaguguguguauguccucuccccaacaccagcaaaugccuguuguuguuaacugcuugauuguuguuguuaagugcugguuuccuaacgacuauuuaacuugccuucucuucugcucucaucacccaguggugaaacacauugacauuuuccacuaaagcuccagcgucagaguuaguuuuaaaauuuuccuuccugugcaugugugugcgucuacauguaugugcgugcaccccuugaauauacugguaccuggggaggccagaaggcagcaucagauccccuggaacuggaguuacagggcaaugccccugcugugggugcugggaagagcagcaagugcccuuaacccuuggccauauguccagcccuucuagucuagcuuaaaguugucugcuaugugugagaggugacucauaucuguagagaguguaacugcaguuggagaagaggcucaguugguaaaauauucguuuugcaagcaugagguccuaacguaacccccagcauccuugccuggucuguuaguucuuggucaacuugauauaaguaggaguuaucuaggaagagagccucaguugagaaauugccuccaucaaauuguggacagucugugagguguuuccuucacuggugauccaugugcaagggcccaacccauugccaauggugccgccccuggguagauggucgugcaucauauaagaaaccaugcugcgcaugcuauaaagggagccaggaagcauuguuuuucuguuucugcuuccauuuuugccuccagguuacugcccuguuugaguuccugccuuggcuucccucagugauagacuguggugaccaggacauaaaccacuccucugccccgcagguagcuuuuugcucauagucuuuaacacagcacuaggaagcaaacuaggacaggccaaacaucuggacaguauuugaguacgcuugugauccugcugcuggagagauagagacaagccgguucuuggcgguggaaggaggugucacuugcuggccggucuauuugcagguuucaggacaaugagagaacccgguuuuacuuuaugggggaaaaaaagaaagaaaaagaaagaaaagaaagaaagcuauaugauguguguguguaauaauaucuaagguuuuccucuggcuuacacacacacacacacaaacucacacacaagcacacacgcagcauggacacucacauuacaaaaagugugacucuaaaauuacugggcugugaaugggucacucacgcagacaguuaucaaguauguugcugcaguuugaaaaaauuuuuaaauuuauuuauuuguguguguugcuaaagagugaagcaggagucuuguucaugccaaguacucugccuuuaagcagaaacccagccucuaucgauugauauuuuauaauuugugcucagcaguugguucaauguucauauauaagccuaauacuuuaauugugugugcgcgaguguguguguguguguguguguguguguguguguguguguaugcacgugugugcaugugugucuugugcaaaugcuugcaugccugggaucaaaggucaauuucgggggucuucuaucacucuucacauuauucauuccucucacugaaccuggagcccaccaauuggcuaguacuauuagccagugaauucccagaguccuuccaucucagacuccuagaguuucgaagcaugacuuucuauaugaguacugaagagccaaacucaggucucgaugcuugcgccaucucccuagcucaggcucgauuuuaagugcuggcucugccugagauccgcaugacucgcugcuuuggauaccugcauucgagauuuuaaccaugcagcucugggggauucccagcccucugcaaagcccccuuugggucugugaaccugguuaagaacaccucuuugagaguaaguuaacuaauuuaaccuacuagcugagauggauaaaccagccuggagaaugcagcuagaugagggaaucuugagucaagaaacugguuccaucagaguccaaggaucucacuucccuaauucagagcauuugguuacauuugcuaccauccucacuucacugccaggcccugcuugacucucuuuaaauauucacaucccaaagagagcuuggagucucaugcuccucuguccuucugaccacugugugaaaggcuauuuagaucgaaggcagacuucucuccagcagucccuuuaccuccauuagagguagccgauuucacaucuguaucaguucuuucugcagauguguuuucuggagcauguaauuuugguuaggugcuaaacauaaggacaaguaaguuaaaaaggaggguuccauaacuauauuuccccagaagagcucaggcuugguuuuguggaggauuagacagagugcauuauuucuacgagggaacaaaacauagaagguuguugaaaucuuuaaagugucaaauccguugauuuuuuuuuuuuuaaguuuuuaguuuuucaggggguguguuuugggguuuuauuuguuuguuguagcuuaggcugaucucagauucgguguuuuaucucagucuccucagaacacaggagagcccgucuaugauaugaauaggaaucuagaguuuacagaagguagaaaaacuggccauggauccaaguugcaaguagaaauacuaaaaguccaauuauauuuauaaaaauagggaaguagaaauacuaaaaaucuaauuauauuuaugcagauauggauuugagugucuaggaagaugagguggaguuggugagcucugguugggugagagcagaccucaggacagauacagugauuguggaagacagcagauaccaaccucuggccuccacaggcacccaacacacauaaacaaaccaacaaaugaacaaauaaauaccugggccugaaucuagcaggugcccaagcuugaggagaaaggccagcagucguggauguagcucagugguagagugcuuugucaccuguggguuuuguccccaacaucauguggagaacaacacuacaaucugccagauagugucugcagauggagacagcucaugggguuuaaacagguuuaacugaaaccaagccaaacaaggaagggucuuugaacaccaaaacuuuaaaagguguuuuuuuuuuuaauguucauuauugguaucauuuguuucaauguauccagacuugaugccaagugucagaaaaugggagccaagcuccucugaaaagacuguaaggggcucuaauguggcuuuaguauaauggcugaugaggaagacugcuuuguagaaagcaaacagagguaugacuccuuuggaaggaccauaaaauguggguuggagaggcacccgaacaaacgggugcauccagcccuagagggcacuuugcaguagugauagaccagguggaaaauccaaggguccuuuauuguugaccuuaaggacagcaauacaagauugccuaguaugaagccauuuuagaaucaacacccuuggcugguguaauaauuagccuccuucaguuaguucugaaaucccaauuuaguuaugucaaauguguccuuuaucggauuuccagauuuaaguaguaaguucaagugagugauauagaccuaucaauuaauacauuuuagcuaauucuuuauuucagugauguguguguauagagagagagagagagagagagagagagagagagcgcuguggcaauauuaaacugucucucaaagcaaauaacucgcucauuuuagauucuaaguuccuuuucugugagauauucugaacaauuaauaugacccuugguuaccucucuuuuucugauuuauagccaaucagaguaacuuuucuuguuuggagauucaaacaaaagccuucuuuuaguaccucuuauguucuuuagagucaauuugcaacuugauaaaaaaauaaaaggggaaggcaaucagcaaauacuacgcaguuacuggaagcuggcucuuuuugaauuuuuaaugaucacuuaaaaguaccuacaaccuuauaauugacauagcaggaauuuuaaagucagacucucaacugauauuuuggucuaaaauugggucuauauuucugccuuugcaucagggcagaugaacuugcuaagucguuuuuauuucuguccuuuuaucucagacuuaaggguaacauaccuaaaugcugauuuggguuuucucucuccuguacuguuaaaaugcuacuaaaagauuauuacucuccagauagguuuucuugacauuucuuauuucuugacuuuuucuuuuccauuuuucuucccuaugaguugaaucuagaagaaaauuuugucauauaaauauagauauguaacauauauauauauauauauauauauauauauauauauauauauauaaauaaauaauuuaacuuaaguggucuaaaccauuugacuucauacuggaucacauuuugcucauugaggggaagggguggucgguaaaagaggauaaaagaggaggcuggccugugagcagaccaugaagaagcaagcucauuucauggcagcuagguguaugaccuaagcuguggcacugaagaauagcuucccuugcaggauauuugaugacacccugaaccccgagaugguauacuggggaaaccugugucuaguugugguguggcucagcucuuagcacacaccuuuaaucccucuuucuggaauucagacacaccauuaguauauaccuuuaaucccaaacaaugaggguaaaguuaguuuguagaaagaagcacuggaguuucaaagugaugucuaauuguugaguggcagacagauuuacaaaucagagaaagauuugacagaauaugcccaacucucacuagaagagaagaaagggcauggcagagagaaaggggcacuuuacugggacagugauagagaacagcuugcaaagagagaacaagcuagacacaggcaaagagaacgagccagagaaugagaaggagccagaagauuaggacauuuugccaaaguuagcaugaaaccaagcaaagcaauuaguaagaaacugagagaaggcagauugaaucagucagcuuggagaggaguuugagccagaacagcugaguuaaaccagccaggcagccagaguucagaaagaacuagaaagggugagcuuauucagcagcaagucucagaggcagaaaacacucuaggccuaauuguauggagacuagaagcuuccagguccaggccuaguuuagcagacagaaacaauacgccucagagaugacaucacaucaggugaauaaauguuacauuuauaggcguccaaucugaggaacuugaggcacccuauuuuaacccucuguagccuggccaugugugucaaagugaaugacuucguuaggguuucuguuaugaugaaacaccacaaaagagcaaguuggagaagaaaggguuuacuuagcuuauuauuccauaucacgguucaucucugaaggaaaucaggacaggaacucaaacagagcaggaaccugaaggcaggagcugaugcagaggccauggagggugcugcuuacuggcuugcuccccauggcuuacucagccugcuuuuguauauaacccagggccaccaguuuaggagagguccuaaccacacuguguugugcccuccgucagcaaucacuaaucaagaaaaugcccucuaggccugcugucuugggguuuuacugcuuugaagagauaccaugaccaaggcaacucuuacaaaggcaaacauuugaguggagcuggcuuauaguuuuagagguuugauccauugucaucauggugggaagcauggcagcauguggcagacauggugcaggaguucuccaucuugauccaaaggcagucaggaggaggcucuggaucacacugcccguucuugacauccgugugugugugugugugugagaccucaaagccccaccuccacaguaacacacuuccucuaacaaggcuacacauccuucaauaaggccacaccuccuaauaaugccacuccccaugggccaaccauauucaaaccaccacaccuaccuaccaccagauaucaugaggacauuuucucgauugagguucccucugcucagugucaaguugacacaaaacuauccaggacagugaguaugcuuccuaucugauacuuucaaagggugugagaccagacuuuuuuuuuucucugccucagcauugaggaaagauguuuauccccugguaagggagaugucuggcagcagauacaaccguagcaauuuucaagacuuuggcuugucuucaagauccccugccaagauuucagugcuuaagggaaccuagagauugagacgagacuucagggccucacaugacauuugggagaacggggauuuacuuuauuuugguggagauacuguuaggaaaguggacaaagcuuagcugaauauuucaaagcagagauuuuugcuuuuuagucauguugcaucaggaguaccaugguuucugugcuuugaaucgaacauacucaauaugacaguugacguuugccuuuccagaagagaaguuugcacacagcacugagaaaucaccuguagagcaggagacaaacacaggucucaugaagugggggucccacuuucucaccagguuuauaacaccauagccuugcucccuguacuuggcccuuacgucuuuuaucugacuaguuguagacaugugauuugaucagaagccguacagggcuuuacacuuggaaucugagcuugaucucaguugcuuuauucacucuuuaccaggccuguccguuuuaacauugcagcaggacgccaccugcaaacccaagcuaguuacaaacaccagcagcagugauuguauuuuaaggaauuugauggcuuugugcugggccgccuucacagcuguuccaggccaccuguguaugcccaugauuuccucaucaaauagaacaaagugugugagaggcuuuaacaagcucaugcugguaaaauguagacccgugguaugugggucagagaugcuguuucuucagcauaaaucacuaagugcauuagcaggagcacuaggguagaggcagaacuauagaauuacaauguaacaauaguguaacuauaaacaagagaguuuccaugucuguucagccugauuuguaaaagcuuuuagugauuaaggauaggaaguguauguugggugcauuuuaaacauuuuuaagccuugucuuuuuaacaguauauaugguguucugugucauauccaagucucaaauuuugcuucuuucuuucuuucuuucuuucuuucuuucuuucuuucuuucuuucuuucuuucuuucuuucuuucuuucuuucuuucuuucauguauaugaguacacuguaguugucuuuagacacaccagaagagggcauuagaucccguuacagaugguugugaaccaccaugugguugcugggaauugaacucgggaccucuggaagagcaguuagugcucuuaaccgaugagcaucucuccagcccaucaaauuuuguuuucaaguccucagaucuccuguguuuuaagaucuauugguuauaugcucugugaucucagagacaccagaccucgaugaaaccguguuagggucauuuaaauagaauuucauuuuuugauaguucugucucugucucugucucucucucucugugugugugugugugugugugugugugugugugugaaaauugguaucauuuucugcacuuaaaggaaagauguuaagcuagcgugguagcaugcaucuauaacccuaaaaucagaagacugaagcagggcagucagaaguuuaaggucauccucugcuauguagccagugugaagccaucuggggauaugugagaucccgugucaaaaauuaauaagaauaagugaauagcauucgaauaaguguaaauaugacugacuguggaaacauuuuguucuaagacaacucuggaagaauguaguugacuagaaccugggauucuccacguguaccacagacauggaggggcuuggcucgugcguaguuggaaucgcaugcuguccugacugcuggaagcucucaaccaccuguggcuaacuuaguccuccuucaugcccuguucuguaucagcacaauuuaggauugccucucggacagggcuaauaguuuuuccuccugccucuccuucuagaugauaccaaaucuuguaaggcagaccucaaagaugaagguggcggcagcagcagcaguucuaggaacaggaagggaugcuguagcagcagcagcucugguccuagcaacagcagcagcagcagcucugguccuagcaacagcagcagcagcagcucugguccuagcaacagcagcagcuggagcugcugcuccuccugguccuguucuggucuagaaaacucauccucccucccucccucccucccucccucccucccucccucccucccuuccuuccuuccuuccuuccaaaagaaugaaggaaaugauugaccccuaacagccuccaagaauguaacaccaccauacaagauuguuuauuucacagucgagacagaagucgagcauagaagaugguuuuuauuuuuacauuugcaaaauaugucauuauguuaagagcucuugcuucgggggggggggaugguaauuauaaggcuaguaaucacuaguaaaucaagaauugaaggugucacaguaagcuaagacccagaagugguggggacaugacugugccucugugguaaauaaugaacuucagccguuaauggucauucauugcuuuuuguacagaaggcuuuaaaaacauugaaucugaagccuuauuauaauuguaauuagcaauucugaauuugauaauuguacuuacugaaggcuuccuacauaggagaggucuuuacauauaauuuuuaaaaacagaguaauuaauagaagauuauuuaaauuccucuucuguaacauuucacuuaaauguggaagcaugguuuuagccuuuggcaaaucaugaauuaauaauucuagaaaagcgagagugccugugggaaagauuucuuuuuuaaauuuugcuugagaaaugggacuuuccuagucuauugagcauguauccauaauuucucagaaauuaaauagcaugacccuuugauuggauccaaaaaucuagauauuuaaauacacaacuucaaagcaauuggcuugaaauccaaggauccauuuuaggaugcucugaaaauuuuguucccuuuccaguccagcucaugcaugcauauauucaucuuuauuauuuauuaaauguauuacagauauucauuuuuagagucugcuguuacaccucugcaaaaaaaaaaauucuuauauuuggcccugcuugaaucuauuuuggguaggauuugaacuuaaguaggaggagaaucuaguuuggaagaaucagaaaucauguaacaguaggaccuaaaaacuaaagccaaaauuggcugaagggaccuagcugagcucuugugaagaacaagcauggaaggccgcaguguuucccagaggucuucaugcacaggacauauuccacuccacuauucuucauccugcuaagggaccaaggguggcagcagugcugauacucagcauuaaaggcaaagguggaagaaggaucauuagaacauguuuggagggugaacugagaacucaccaucuaaagucuaaauaaacuaacaguucuacccuguucgguugcuugcggauuuucuuuucagcugggcacaguuuggucuucauuuuuccauguucgcuguuguacaguuaggggaccagccgguugggugaugucauuccccucuuccccucccuucguuccuuucuguucaucuguguguaacacuuagcccuucauuuuagcaggcucuguagcccuuagguguuuauuuucuuguccccuucccacacaaguccccaguuuuccuuauaauauugagaagcauuuuacauauaguugucagagcaugacugcugauuagaaagugccuaccuugguguuggaguugaagcaucccucuccuccagcacaguuguuuucaucuuacccuuaguacugaagcuguguccugugccacacaugucuuuuaccauuaugcucaguacagucuuccuagagaaauaaguucuuguccaaauugaggguccccuucaguguuaaaagaugauaaggacuuuuagugugcacuaaagccaacagucagcaggcacucggugauguaagacguguguguguguguguguguguguguguguguguguguguuggccauuugccgucagccuuaggggcaaguuuugaagcaucuucauuuuaaagagggauauagagaguauagugauuguauccagauacccagagcaaaacuccuugaauauauaugauucgucuuuuuuccccugaaauuauauuaccuuuuuuuuuuaauuuagaaaauauguuuugagacagaaucucauauagcccaggguggccucagacuugacauauagcugagggugaccuugaacuccuaucuugccucagccucccaaauacugggguuauaggcaucagccgccaugccuggccuaguuuuuucuacgucuuucuccagggacuggagagagggcccacugguucagagucacugagacucuuucagaggaucuggguucaauuuccaguacccacauugggcaucuccaggaaucuggcaggccuggucucccauggcacugaaugccuguguacauaauuaaaaauaaagcaaaucuuaaacacgugacagguacugucauugauguguauugagcuccugccauuuccugucuagcaggaauaggguaugcggcagugagcauggcacaccagccaaguccccugaucucaugaaaacuauuuuuaucugacccuuugggcucacuuauaugacaaggaacagaagcagaauuaaugccaagaaguagcaacaggaaaaagaaaugaccgcaucucaauucauucuuaauaucagaaaaucacuaaauugcuacuaguccacacaucuaaaauuuuguauaaagauaucuaguuguaguguuuugggauugucuaucagcauuuauauucacauuuuuaggaugaguuuacauaguaucuuuaucuuaagguguugguauugauuaaggugauuuuuaaaagaaaauuaguguagcauuuccuuccacacagcuaccuuucaugugaucuuuacuucccacuaauacuuagcauuucccgauaaagcaagacaagagagucugucgccagggugcuguaagguguggugggugucugucucccauguuagaaugaccaguucuguccugugagugguuuuuuucugcuguagucagccacauaaaucauccaagacuucagaugcuaugugacaaacuggaaauuaagccagcacuuagauuuucuuaauugcaaacagcucaaggcugaugcugacugccaccuguccuucacccguuauaugaaccccauccucuguggagacagcaagcacccuguguuuguggggaguccguaggcuuagaauuggaucucauuccagaacaauucugaucuuagugagcuugauaaacguggcucugaagacaagagcuugcaucacagauucaggauuugauuuacaucccaggcuaaagccugcuuacuaaccagacucuguuauuguccuggguugccaggagauggugucuuucauaggaaaauauccuauuauuugcuagcuguauacacuggaccuuugcuggacugccgaccaccaaccaucugccucucuguucuuauuugaaguaaagccuuuguucagggagucaggccuucuaaagggggucacacugggucccuggaagucagaacucacaugugugacuugagaccuuggcucaugugugaggacguggcucaaaggcagagugacagagucugagugguacugagagucugggacguggcuguacagucacagcagugaugacaaaggugugcugaccucuccucccaaccucccuucagccucucagaagccugguucacuuucagguuagccuuccaccuuuuccuucagcuuuuagaguucucaacacauuaccaaaaaaaaaaaaaaaaaaaaaaaaaaucccuguuagcugacaaaauuuaaugagaacccccaacaguaaguacacugagugaaaaggaagguaaaugaggccaauauuuuccaacauuggucccauauacuguuuuuccuguaaguucuucuugcagucugcccucagacucuuccaugagagaugggaguuuguguucccaguccuuaagcaggcguaaaucaacagacuguaguaggguagaaauaaugugaguuauuaagcuaugccguacaaggcaugccaugaccucuugggacucauuucuauuauguuuguuuuuuuguuuuaaauaaguguccccugaagagcugugucuuaguuaggguuuuagugcuguggacagacaccaugaccaaggcaagucuuauaaaggcaaacauuuaauuggggcuggcugacagguucagggggucagucuguugucgucaaggugggaacauggcagcauccaggcaggcaugguacaggaggagcagagaguucuacgucuucaucugaaggcuguuagcagaauacugacuucuaggcagcuuggaguagagucuuacagaccacaccuacagugacacaccuacucuaacaaggccacacccacuccaacauggccacaccuucuaauacuaccacuuccugggcaaaccaucccaagccaugugagacagacuguuuugcccaucugugaugagguggaagcuuuaagagguugugaugggaagaagccaggucacugugugugugcgcacgcgcuuuaaggggcccucaggaccacaacuucuuccuuguuucaccacccaccaauucugugaaguaacagcuuccgcuggccucaccuccuccaugagcugcauugucacaguccagcauuguuaucagcucagugggccgugggcucaaagcucuaaaaccaugaacaaaaauaaagguuugcuuugagaaaccauuacauguagcuauuucauagggggagggacaggcuuaccacagagcauacaccucaucagagcugucucuccuuccagguagggcuccaggauugaauucgggucuucaggcauggugagcugaaucucgcugagacaucuuauugcccuauucccauaguacucauugugucuuagguaccuuuuauaacaauggaaaacuaccaaggagucccggguucaggugccuugugucugucguauaggagagaucacaugaagagaucacagguaaagaaggaugccagagagccucagcuguuccagcccccagauguuuuccugguuuaggugacaggacagaugugugaauaagcaagcucucgcgugacuucucaguugcagcucaagagcaggcccagcugauuuucaguggaacagacauaaacuguuuggagucccuguccagacugcagauucaugaacacaauaaacacugucguuauuuuaagucacuuuggguucauuuauuuuuuuggacaauguacacuuuuauuaaugaauuguguguuaaauagugauguauuuuuuuuaaaaacagccauguuuuaaacuugugcauauuggccucuguggcaauguaaauaaauacaugagaauauuuccaauuuucaugcaugaauauuaagcuauaauaugguuuacuaguuauuauggacaaguuaaauucugcaauaguuaaugcacauuuaaauagccacaauuauauaaguuguaaugaaaaaaaaaaacagccaguguuugauauacuuuagaugccagguuguaauuuuuaauguucuuaauucuucauuuccauucauggaugcaguucuauacauguggaugcuaaaaugcaagcugaggaaauucccuuugaccacaauaacaaucucacacaaaagcguuuguccugcuuuagugagacaaugcauuuguucauaaucuuucucuccaggugugguugcucauucuauuaaugaaaacucuuaccagcgcuaccucaaaguucagucuucaagagaauuuuauaaaguuaaagagaguuauucauuuucuauauauuuuagcauuagcaacacuaaugcuaaaaaugacaucaauugcauuucuuuucuuggguguccuuuuggccucaucuuccuugaucuucaauuaaauucuuuaguauucauaaaguauauuauuucugugguauuuuaugugcagauuucuuuucuguaaguaaaaugagguuuacacaguacagucuggugugguaaugucagcgacagccaguucuuguccaucgaugaguccuaguucuuuuaacaacuugcagagauuuagucuucuuuguucuucaguagauauuacugacuguaugcaaaguguccauuguuuucucucuacugugccugugagagcagcuggagcguucauuugcagagaagcacuauugguuagauaguccaaaaccucuuguaguuuaguucacagggaacgaauacuggaauguuuugaggaagccgauuauaagugggacaguuuuccuguuuuucuguuuccaauguguauguguacaguccaucuacaucacuggauacaaaauaauuuauuaaggggaauguaugcaccugugguuaucuuuaaagccucagccgcaguggcugcauuugugggcgcugcugcaggaaugauuuauucuacuaccccuggaaagagccaguagguaaucccucuuauaugauauuagcaugacacuuucuuucagacuuuugggaaauccacugacuuuauguuaagggucaucuccaucuaauggaaccccaucuacaaaaggcuguucuuugggccacugccacauucugacacacucgauacagugucccaguggccugggcagggaugcagugguucauauggagaacuggccugugguagagaaaguuucagugugcacucgguacacacagucauaaaaaucaccugggcauuuccuuuaaagucucuguuccccaccuagcaaagggacaauggagcuuggauccaacguaccaucuucauaauauagaggugauauuagcauuccauugcucuguccucuggcuaggacagagcccgggccacguacaauaauaagagauugucugugggaaguaucauuaagaugcuuguugaaaugugggacucuguugcaguuaggaacgcugucauuuagggacccugcaacaacuucagccuugggucucucaucaucuuuaggccuaaauaaaaacuguauuuagacuaaaaacauauauagugccuauccaugucuauaacgugaauguaucuaaagccagacaaggccagguuuuacaggauauuaccuacuaaguuaccagcuccaguggcuagaacuucacaaguaucuauuaaaaacugaaaugauucagggcuuguuucaaaaucagggucuuugugggguccagaucacccaaggaacuucuuuuccuggucucaauggccuucucaggcuccggugucuccauagccacgaucaccagccaucgucucagccagcagcucuccuauucuccucucuucuccagcuccuugccacccuccauauuguccacucuggguuuaugauguaguauuauguaucuagaaugaugauguuauaaacauucaagcgagaauaccugaauuagacccuuuaguagaagcaggccuguuuuacagacaggauuguugauacggggguggacuuaguugaucuaguccucccaguucuguuuuguaauuucaugcaccuuuuaccgauacuguaaaauuauuuguugagaguaaaguuacagaguuuuacuaucucuauuagucccaauucccuaggggaacaggguugauagaagggugugugugugugugugugugugugugugugugugucuguauguuauaggcuaugggccagcuaguccagcuccaugccaugcacugcgccaaguguuuaaugagaaggccuacaugugccuggcacggaguuagaggcuuccucugcucccuacaaagugaaacucauccgggucauguaguuagugucugggauuccaauacagggcuaagggucaguccagggucucuguguuuguaauggccaugcuguauaugugcaauggcugagugaggguucuucauuugucuucuugcuuccuucuucuugacacuguuuuuuguguguuuguuuguuuguuuguuuuuaagcauucuccacaguaaauauucccccucuacauucauuuuucccuuggaaaggacacacuuucuauaccuuccauuugccaugaggccugguccuggguacuguuaaggugaguuguuuacccucuuagggaaagugugaaaacauaaguuguuugauugguacacauguguguaugcauguucacauguaugucgauguauucauauguguuuaugugcuuggagagacuugaaauuugcaccaggaaucugccuuuauuacucucuaccuuaauuauugaggcaaaugcccuuggaucaaacgcuuguggguacagcuugccugucuagccagcuuuaagugcugagauuacaggcagucugccacaccuaucaagcaucuuaccugguuuugggggaucuggucugguccucaacacugacagagcaucuucccagcucugaaguuguccguaguauauauguuguacccaaaggacacaacaaucuuaauaccaguuguugaguauuuaacauucuugcuuucaggacuucucauucaaaugauuuguaaaaguaacuugaguuugagggcuucugagggaagaauguggggccauuccgguuucgaguauguugauggugcauuuucuguuacacuugcuagcauggacugagggcaagcugugcuggccacggguggauugagaacuggaggccuguauugguacuuagugagagucugauuacuucaguguucccguaugugcaucaugccccauuucaggagcugagaugauuuauagccgaacauuggcaaauaaaaugugaggagaauucaaucucucugugccucucaccggagcccgaagcuguucucugaaagugcucugcacauuacugcagacgcugcguuauuccucuaugcagguaccgcugaauccuuuauuuagaugaauugauuucccagcaaacagcagggucucugaaaaauugguaacccggcaucaaguuaugagaagcccaccacuuaaugugggcacaacuguagugguuggagcaccauguagggaggcuguggucccguuuucccuacuaacacaggggaaugagaaaagacuucacagugguuuugaguguagcagccugagccuggccgugacagaaagccauugcuauuuuuguaugguucaggaaugacuucugcacggaggcagguaaucguaauaugagcgcugcagaggaaaagcauaguuucgcuaacugaccacagagaacgcgguaccacugccacuuucuagaaguuguagcuuugcaggaaccugcacagagacaaagccuuacuucuuuuaugccagucugaaauuuuuuauuccuggaauuuugcugcagagaccuagaucugagugcuaccccagaaguuauaauuuguaugcgggccaagaguuuaaacaugucuucagacaagucuguaaaaauucauuuacaauuaaaaguuguuggggaagcuuaauugccaacagagaaccuucuccauccucaccaggucagagagacauuuaacauuugccaccuuuagagauuuucccaccccaggcuccaggcaagcugugaaugccauccuguucagcggaggcuuuuguucagugugcaauuccagucuaacagcuuccugucuccugccaugucauccagaacacacaugaucuuauccaaucuaagagguuucuguuguuuucaauuauaucugguucaugaauguagacaugauguuuuugugcacuguuuaaacuuuaucuuugggcuauucaaaugcugauuucucugcccucauaucuuguugcaauccagacacggcuuuguaaugcuuauaccaagaaucuccugucucaaguuuguauaaacaauucuuaccauuuauucucuguuuugucaauaaaugcugagcacccaguggguuggcagaauagagaauagggcaggauguucacagccagagaaaggagggaaggagagagugaaauucaggucagccuggaggauagaggauuuggagcuaugaagaaguucuggagagaaaucaugaaaacauacccgaagcccaaagaacccgaucacugauaguaugcaaguauccugagaugggacagggaggcagccagauuagcauaggagguuaagguagaucuuuaacugcucagcaauugaggugcagguuaaaauaaaucuugauuucuccgugugguuauuggggacuagccaccagauuaauuuacugcuacauuuauauuaaagauagucuacaugugaaaaugaccuuuacucuugaauguugaucaucaauugcuucuauaggcuaucacugugguccaaguggauggcauauagauaguucaguccacacaugcauuggcaugcucauacaugcaaaccaaagacuuagcucuagcaaguauuugcacuaagaguucugguaagagaucauuguugaguucaggauugagauuuggguuugucuccuuggacugcuguaacaaaguaucggacacugacauuuucccaugguuguagaagcuagggagucugggaccaaaguaugggguucuuagugugcuucuucucuguguaccaauggcugucuucugucuauguagcugcugaagagaggaagagaaagaaagagaaaaagagagagagcuaucuggugagguuuuuguuguuguggugguuuuguuguuuuuaaauaaggccacacauagcauuaggaagccgggaccuuucugaucuuuuuacacucaaaggccuuguauuucaguaccaucucacuggggcuuaaggguuuuuuccauaugcauuuugguagagccuggcuccucucagauugacuuucaaacauauagauauguguauuggagaaguaaacaagaagaagaaagacccuggggugccuuauuuauacaugugcagccccuccccccuuucagcacuagguucagaagacagaggcccuuggugaucucugucaucauauggacaacuuagcacauuuaguucauuuaugcccaggaaccauuaccaagccuccaacaggaaacccagaacuguucucauuagccaaggaacugauuacauauuguucaagaauagugaggaaucuuguguaaggggaaauauuugcuuuuauuucuugaauggaacaagcagaaggcaaacaaaaaaaaguuuuuuuuuucauauuaaaagagauggcacaguuauauccugccacagcuaagcaagagccucauucgacuccuguuccuucugacaggguaaugcugccccuccucaccuuccaggccucuggggaauaauuuuuguaaauuuuguguuccauucuaaagcugagcgguuccaucccugaagaggaggaguccuucuuagugaccccagacuguagauuauggagaauggaaaucccagguggaugggagugucacacuuaaacaagagcucugcccaaugguuccaguuccugucaucaauaauggauggucauuauauuuccucuugcuuguuaacucuaugaagauuaggcacuccuggauacaggauaagacgagggaaaauaauuuuuuuuguccccaaagaucuuauaaauaaaucagaaauguauuuugauggaucuucuuaguugccaacuugauuauaucuggaauuaacaaaagcccugugagggauuuuuauaaauuaaauuauuugacauggaaagaccuaccucuaauccagaucuuuugagaugggaagauccaccuauaaucuggaccacaccuucucugauggcagccuauauaaaaggcauagcagauggaggcuugcucuacuuuugccuguuugcccuugcucucaaugccaaguccaucccuucacuaacacuggagccuacuucuaggauucuaguauauacugaagaccaacugagacauccagccucauggacugaagaacuagauucuuggacuuucuuuugguagacagccauucuuggcauucuaauaagucuccccccccccauauucccaaucuguguguguguguguguguguguguguguguguguguguguguguguuugaacccugacuacuacauguauacacuucaaaugcuuagcaacaacuugaguggcauaugguucaaaggcagaaugaauagauaaauaguacauaaaaccgaaaaucccacagaauugaagacauuggcuuccaagucuuuauucuacaguuuugaauucugaaggucaaagguuauuuggauuucuaaugagcucuaaguggugcugaugguacuuuucuggugaccccaguuugagaagcagugcuugggggaggggagaugagaggaagagagagcacaacagagggagagaagauggugugcacagagguggaccucuguaaguaccuaucuguuggaguuagcccucacucuucuguguggcucugacuuuuaggagacagugugcaacaagccccugaaauaccuccuuugauauaaaagggggacaugcuuuuuccagcaaugugcaauuccuugcauggagaagaaauuuggccaucuugcagcagcaggagaggagcaaugcucuuguuuuuuuguuuguuuguuuguuuuguuuuguuuuuuguuuuuuucugagugaaauacuuuccuuuugccauucucccucccucccuccauucaccccuguguucuaugauguauauuagucauuuuggcuuuaucugaaagcaaauaggaaauacgaauuuucagauuuaugacugauuacaguaaaucuagaaaaauggaaaugagagcuauuaggaaauuucuaaaggugaaggguuuggcaagcuagcuacuuagguaagggcuguuuugugcuuuggagaagaacuugugcugacuggaugcauguuucuggaaaauaaaugcagcaacauuuuccaaaccucuggauggagcuuuaucauaaaauuuuacugcuguggagaaggagguuucauugcuauuagauuaacaauaguccaaacuguacuguucccaaauaugucuuccaacuacuucauauuccugaggaaauaaugucuuguggauuuauuuauuuauuuuccuaagcacagaaucugcacuuaaauucguguuauuuaaauuuucuaucaaaugccccuuugagcaguauaaaaaccucuccuaaacaguuuccguuuuuaacugaaagcaacucccaaggagccaguaucaacucuugagucagucagauugacuuugagcauuuugaguauggcgaagucaacacucucuuuucuuccucuugccuguuccuacccccuacccccaccccagcccaucugcuucaguccguguccagagaucccuuucucugucuucuuagucauauucaacauccuuucaaauccauugacaguaggguauggguguaguaaaauucagugucccuucacaguaggauaccaugccuuuggcuuacuucaugguaauuguugaauuguugaacacuugauugcaucuguuucuuaaugaagagggcagcuuaguguuccuccaacuauucagaagcuuuuaaaaauaggcuucucugagguaauguuuucucucuuaaaauaugacugcauacucauuaacuagguauuaacgaauacugugcuuuuaugcugcaaauuauaggaaucagacaacaaagguuuuauuuuuaauaugaagaaacgugauaagugauaucuguuacuuuuguuguauuuuacuucuaauaaggcucugacuccaagagaugguacuggacuuuuggguuuuguuauuguuguuuucuuccuuucuucccccucucguucucucucauuuccaaguauggucauccacagacauucguccagaacuauagcaguagaaucugaacaugccucucugggaaggaacgugguucuaucugcuguagauaaaaguguguaaagagcccacgucauugcuguccccagcuuacuuugaugcacgcucgaagguuacuuuaaauaacuacaauuaguuuaaaaaugacaacgggggugggggugggaguucauuuuguccugcaagagucugucauguucuugucuguuucauucaucaaaacuuugugaucuuuagccuucagauuuauacuauguccucagcaggguucagggauggagggaaaggaggggaaauguucaaacagaaacuaaauauagggauccuauauuaaucauggugugaagcacauucuacuuuuuugugacuuccucauugaaugucagacgccguguggguugcugcacuuaaucaccgugcgcuggcacagaguaggcugcugccagcuguaauccuaguaaugguagaucuuagagcauuuggcuuggcaauuuauuuaaaugcaugcuuaagacuuuagguuuacuuuauugaauuauaauuuacauacaauaaagggcaagcauuugacaaguuacgugaguuuugguauauacauuuaugcacugccauaagcaagcuaccaaaagggauagaagaggauugacggggaaagaaaugcuggcaauaaacgcggguuuguuuuuuucauggcuuugaagucaguuacuguauguguuguacugugaaaugcuacuguuaaagcuccuugcuacaagauacucuccuagugaauuaugugaaauucaugaaggauaguuguauuucaugauauguaacaagaaauguuaauguccuaugucuuuuaaaauaugaaacauauacacucagaacuccaugcaccacaguauaggguugugcuaaaugaucucacguguccugaauaaagcugccaguauccaucuaacuuuuucaaguuuccuuuccuuucccauuaaaaaaccuuuguuugagaccggcuuuuauguaucccaagccggacuugaacucacucuacagacaaggauggccaggaauuaugaucuucuugcuuccaaccccugagugcuaagaguacugaugucugccacccuggcuagcuauuaacaugguggggauugaacccagaguucuguacauauuaggcaaacacucugucaacugaguuacaucuccacucucauaaguuuuaaaagauaaaaauaauggcccccaaauucaguuacuugugguguugcuauugcuguuguucccccagaguaugauuggaggaaugguggcccaucaggagaacaucacuuuaauguuucccaccuccaacuggcagugugcuguguuccuguuuugcuaaaggaacugcuaacuugcugucuaaggaaggguucagggauauagaggauaaggggaggaacuagccugagccuagaguuacucagagcuggcgugaguccccacguugccacuugcuaucauuugacaaguuguuccacuuucuaaagccucaauuuauucaucuaaauagagggaugacacaauuccgauccaucaagaauuuaccauccaaaugcgggaugaaauuggaagaaaaugacuguugucuaaagagaaauucaaagugauggggcguuuuaaaaaagagagggagaaaccaggcaguugcagacaauuaaagggcuucauagcaaagcuauguucaguaguggggagcucuguaugauuaauuagacuuuacaauugaaaccuucucagugggcuacagcuuuaaguagaacaagcaguagaugccacacuugcugaccugacagcauaacgcaguggucuacaaauguagugggcagaaacucauggcucuccugggaccuggggugcagggauuuguagcugcugaaaccuacuacaaaggacagaggauuggaaagcaaugacacugaagaaaugacaaggggccucauuucuccauagacaguagagauuagccagauguuugagcucugccccugugguucgaggaaccccgcggagcugaugaugcuaacguuguucauagugacucuucagugacuaaugcgcuuacuaaccacugugaagccacuuccuaguaaacagggguugaguaggugagcuuuagcugaauggucucuaaaagcugaucacugcagcagagcacuagugccagggauuuaauccagcccagagccuccauaccauggaacagggccauuuucaugcuguuuuaggguuuccugaaguacuagggaaagaaagugugacagauaagaucuuguauaccauuaaaccaagugacaacccgguaucguuauuaaaaacuuuccagaaguuuauugagcuaagaaguaguguuaagucucagagaagcaauucagugugugguaguucugauuucuggaccucagcuuccagagcaugacuugacaccucccaaaaagacacucucuuuccaugagcaagguacugguggucuguuccucucagucaccuuuaccuuauccuuuugaaucaaccuguagauggguggggauggcaggucugggggaggauaggaguaguguaggccccuuggcaauucuggugggcuucaggaugcccagaaacccuucucagcccuucuccagccucuucuuuccugucccaccuccuuuaccggccugaccuaagguauuagaaauccuucuuuaucacuuguaugaacaguuaauuaaggucuacucuccuauucccuacuggcuaaauuuuuguuaauaaaagauuuuauaaaaagccaugaagaaaaacauacauauaaacguguuagcaaaguguaaguaggcuauggauuuuguagacugauaguguuaguguuaggaaugaucuucgcuguggcuaauaguauaucugucccacuguguauguguguuucucagacucaacccuuaagaggccagaggcaagauaaaagucacauuuuuacacacugucuucucuaagagugaagaagguugcaauuagucauuggauuccuugcaguucauugaaaaggguacaaaucauuauuguuuuagacauaacucuuuuuuuuuucuuuuuucauuuuugguuugucaagacaggguuugucuguaggccuggcuguccuggaacuggcucuguagaccaggcuggccuugaacucagggauccuccugucucugccuccuaagugcugggauuaaagaugugcaguaccacaccuggcuuagagauaacuguuuuucuuuuaaaagucuaaaugucugaguuuugcuuuucuaguuuucagauagaaugauagagcuguagcucaugugucucuguuauauguaugccuuuauauuguugccauaaaaugaguucuuaucugaucauugcauguuaaauguagcaucauagcaucauagauggcucucuguaacucagaagcaaacauccuaauuuccugaccaagauccucagaguauucugagcuugccuuccucucaucaagauccaugugcuuccuauuugaaauaacaucuucccuuccuuuugugauggacaaauauuuuaucucuauagaagaccgagucagcauaggaaagugccuguaggaauauguauaggcugagauacuuauuuuuuacuuauuuguuuguuuguuuauuuauuuauuauauauaaguacacuguagcugucuucagacacuccagaagagggcgucagaucuuguuacagaugguugugagccaccaugugguugcugggauuugaacuccggaccuucggaagagcagucgggugcucuuacccacugagccaucucaccagcccggcugagauacuucuaagcacaucauagauggcacacagugggugccuuuccuccagcuaggcucugggacugcucacucagcacuguguucaguugugucccugggacaugagcaaacagaauuggcuguuaggucucauccgccauuuuccugaugcugggaaccaggcucuagaugucauaauaugaaggugaacagccgugcugcuuuucugucagagugccugcaucaaaaagaccaaggucacuccucccugauggccagguuagauucaucuguggccccagaguagaaacaaccuuguaugucucuaaaucauuuucugccuucagugcuguuuaaaacaaaacaaaauauaaaucugugagacuuaaagaccauuuuaguaaguuguguaaauggcuauuggaucauguaguugcagacagaugugagcugccaugugggugcuugggacuugaacuccaguccucugggagagcucagaaccauggagcuaucucuccagccuggaauuugcuucuauaauuaauuuuucagagcaaagugagggucuauggcuaguuaugaacagauacuuuguaacaucuguuuuauauaugugugaugucugugggugugcacaugucacagugugguaguggaggccagagggacaacuuauggaaguuggcucucuuccccaaccauaugacucccugggauggaacucagaucaucaguaucagcaacagggugcuuuucccuacugagccaucuugccagccguguaacgaauacuucugcaaccguuauaaacacuacccugaaagucugacacuccaacauuauacucucacaacuuaauuuacacuaauuuggggcuuuuuguuugcuuuguaacacuacuuauuuauuucacauauagccaccaggguauacagaaaaaggcuaagagugugccgugaaacaccugucauuggcuuuuugggggcuuugguggcuuuuuguuugcuugguuugguuuuguuuugagacagggucucucuauguagcucugaccuggaauuugcucuauagaccaggcuagacucaacucacagagauccuccuacgucugucuccccuugcuaggauuaaaugugugugcuacaauugccugcccccuaugugaugugcaaguguuaacuuuaucuacugguuuggggggacuucaccuagcacugugugucagaugcucaagugugugagguuuauucuagucucugagggaagaacagcucaugugaucuuuugaguugcaagauauguaccccauaccuugagaauaaauagauuucaguagcuuuagggaggaaagauguguuuccuuugucggaugagaaguccagcaaggcuccucacuuucucgguacuaagaucacaauaccaguucauaguggagcugagaugagagggcugcagggcgagcccuggcuucuuacugacuccucaguucugaagaccuuauuacuaacuuagcaacaauauuagccccagaagugugucugcuuugcccgucuuguuaaauauaagcucuuuuagguuuuucuuuuguaaguauaaaauauaugaaauauggagcuugccuuuagcuuuuuuuucauaagaaaaugauugugggcacagccugccacuuaagugaccccaaaaauuccaccagagaacuccuacaacugauaggaaacuucagcaaaguagcuggauauaaaauuaacucaaacaaaucagcuuuccucuacucaaaggauaaacggggugagaaagaaaauagggaaacaacauccuucaauaauuacauuuccuucuuccccuucuccccucucucaacugccccauuuaccccuccccucuuuccuucaaauucuuaauuaccauaucggacuuugguauguuguggcccagccuguuguacaauuacauuucaccuuauuaaacaaaacucauguuaaucaugaugguauuauuugcucauuaacuucaucacuuaauguuuccacaagguuguaguagaggaaacccaacagucaauucucagcuuaugcuggccagugaaaaaugccccaagcucuuccagcaaaccgauggucuuaugucuuaucauugacacccgugucgaaaauuaccagucucucuaacaacucgacaaagccugcccagaauucuuuagucuccuuucuuuccucuucucuuccuccaauaugggcaaaacuucccuuaacuacuuucagcaggaauuacaggagcaguucuguucuggaaaacuaugauuauugccuccgaagcuugucguucugaacauagaguuacaguaggaacuugacagucauauuucaggcugugagacuagagaaggccaucugaaagcuucagauaaccaagugguucuguaaugaguuggaagacuugcuucacuuccuggugugcucugaacuuugaguauucccacuaaguguagguuugaugcucauccucucugacugugagcguccuuuauagaaaaugauuucuagucugguuauaagaaguggcuggcauuuccauugcuguugacauuuaacccccgauggcaacagugcccccaagccugacuggaugguccccuuuauuuucugaggccucugcccaugccccucccuguauacuguggcagaguugguucauaugagcuggcccauccuacuucuaauguaaagaaacaugaauggggcaaagagaccaagaaagcuccauguuagcauugccuuggauagcgaacaagcguuaaagcuucaagcaaaugacuucuguagauauaauggagauacacgccuuauguuaggugaucugagaacuagucccaacugugggacucuguacuugaugaagucccucucccugaauggcacugugauaauuagauagccugauaguugggcacgcucggaaggcgcaacgagaaccacuccagucugugcuguaccuucgacuauucuuuucucauuucuucccuuuuuguuguuuaugauguacaggaucucacucuguagccuaggcuggccucagauucacagcaauccuccugccucagccuccugagugccaggacgacaggugugagcaacuuccuauaacagugagauuagugagugcaccagugagcuucuuaaaaccguauccugugucccgacucuccagucacucacuuggcaagaacacaguauuccccuugaaagcagcucaucaaugcccacaagauggacuagcagcagcguuuuaauaaagggagcauacuuuuaauguaauuaguaguguuugagaaacacaugaagaauuuuaucuuugagggaggaaaaacaaaucagcuguccuauuuaauggagaagcuaaacucuccaguaaaaaguaacggaccagaccugagauucccuucucacugacuccucuuuuacagugcaggcucuuacaugaugccaagcaugaaaugugaaugauacguuaaaugagggccacugugaaaagugaagaaggcaagaagguuacucucaaagguagucgcaaagucagaaucagaauaguagcuuauucauagcugauguuuggaggucagagggaaauccagcaaauaucaacagugucaccuagagagucucgcaucucuuggggaauuuaauuuauauuaaugagcagugagaccugcuuagagcuugcucagugauugcuccggugucagauuuuaaugaucuuacuucaugaaaaggauuuaaaugaauuauccugaaagaaaaccugacaagacacugauucuucauugugaggcuucuauuacccugcccuccugccuaaccauaauugcauaucaggauuuuuuuuuuuugagagcucgccuuaccauguugauaaccugcugucaguguagccuaggaaauugcuugcuguguaggccagguuggcuuugaacaugugauccuucugccacagucucuggagugcaaggauuacaggcgagcaccuccauguggggcccccaccucagcagaccucaugaagaccugcauuugagugguagugauguugcuugcuagcuacuaucuaugagugcucacuguggacugggcucucugugaggugguggucucaaauucuaacuuagcaaguuuacggaauuacaggcguggagagggagacucugaaacauuaauuaacauguugcagguuguauuaaauagugggccagaaugguaagucuguuaggcucccaaguccacuguuuuccacucuagcaaucucaggguguuugcuuugcucgucugacuuugcgguauuuauagaacuuccccuugaucuagcaccaaacuccagaugcugugcuugggguuuuauuuugcaagccuacuuaguagauggugccaguucuauuuauaaaugagaaacgagggguagaggaguaaaccccacuagccccagugccacauaggagcugacagagcugggacccacuucuagaccugcccagccuagaagacaggccccgcagcaagggagccaucuuccuggagugggugugugugugugugugugggggggggucagagugggaacacagcugaagccgaugaucucuuccuucuggaaucuaucaguaucaagcaguugaguggugagagucgggguccuagagccccuucccuauccaugccuggcuguugacggguuccuucuuguacagaccccauugagggauucguagugauuguaaggucaugauugcagugaaugugucuugucuaggagagagcagcucauggccuuuuguauugccuuacuuucuuuccacgcuguccuucgcaacauucuucagaccuuugaggggaugggauacauaucuugguuagugcugagacuaaccugucgcuuacucucagcgccucacacagacgugagauucuguauuugccaguguuggaaagaggagcuacucugauuaaagcugagaguuagugaguauaaacacgaauucuuagaagacucuuuaguacacgucugcuuaacuaaauagugcaaauaguguucuguucuccucuagggccugugaccaaagaguuaauauucuuucucucuuuuuuaucuuaauuauggguaugaguguuugccugcauguaugacuguguaccacacauaugccugguguccacagagguucaagagggcaugggaucaccuagaacuggaguuacaaacgguugugagccgccauaggggugcuaguaacugaaucuggauccucuggaagagcaggaaguguucuucacugcugagcugucucuccagccuugcgaggacuuaacauuauaaugagagagacaauacuucaacagaaauuauugcacuccauuaaauauaaguauaugauguuauuuauuacauacauggaaauauauggauguuuauaucucaauuauaucaucugccugucuaucuaucuguauacccaacuuucuagucaguaggaucuuauuucuauuuuugccucauguugaagggaauacagaaauuaccuugaugauccuacuuugguuaauaucacugugcaaaugucacagaagcaaugaaugaugauggucuuuguauggucuuuggugacauuacuccagguaauaccaagcacuaagcuguggcucagcuguacaguaaaaaauuaagcugcaaaguaacucuacaagaauaauugguauuuuuuguugguaguuuuuuguuuguuugcggagguuuuguuuuuguuguuguuguuuaagacaguuucucuguguauccuucgcuguuguaaaacuugcucuguagagcaggcuggccucaaacucggagauccgccugccucugccucccaagcgcugggauuaaaggugugcgccaccacugccuggcuugauauucuuacaauugguuagcaaggagaaaaugaaugugaaacaauuauugguauaaccuuuauagauauugacaaagaagaaaauacauuagaaguuucauagcuguuugggggcagaaggauuguaguuggacuugacuuccuuuuuaauuuguuucuguauuuauacguuccaauauuaacacguauugcuuuuaugucaggaaagaaacacaagugauugaacaucagccuuaacuuucuuagacacuguguacucacucuuaagcaagauacaaagcugccucuauuuccacaguaacuuagcauggaaacccugcagucaggaucccugccuuuggaagaggacggccgggccccaugcccugacuugcaugagcugugcagggguuacugcauuacuuaccggguggguacacauaugguacaggccccguguggcaggcagaguacaaaaugggagugauucaaagauucucuuuguaagucucuggaauagaacucagguugucagacuuggcagcaaaucccuuuacucucugagccuuccaaaucaacaaaagugugugugugugugugugugugugugugugugugugugugggaggcugccugcaaaaaccucaucagcuuucuuaaaguacccucaaaguuuguaggaaaacuggaccuuguuuucacuguauaaugauaggaucucuagagcauuaaaaauuaauauuuucuaguuaauugacauaaaauguuugcucccuagggaaggguggguggccaugaauagauuggaguuugucuauagcggaugauccacuccuugccugccuucugcuauggagaguggaugcuaugugguacccaccacucuaaaccaucuccuaguguggcuuccuggccagcugcaccagcaucagcauccccgggacacuguagauucugguuugcaaaaggaagggcugugguauuucauagguucuugaaaugaaaacuaaauaacaaauaaggcuuagauggggcaaaaggucaccaugcaggugauucccaugguccuaaaaguugaggacagugcuguucccuaugaggggaugcuagccugugacgucacgacaaauccucgcuuuucuucaauucauucaguuuuuccuguaagcucaguauucgggaggauauuugauagcuuucugggcuuuuccugaucuuugcaauaacuagcagagguucagaaguuacuaaagcacgggcaauggacaugaacauucagguuuaaagucaccauuuguaugcuacacuuuagaagcagggucagaaauagaaugagcucuucagaaucugcuaucagaucucuguccuggcuucaaaauggcgaacuguggaaaguggcucaugggggggcuacauauugaccuuucuguucuguguuuauuucguuauucaguaaguaacuuacacuugugguuuauaauuuugcauuucguugugguuuauauuugguucuaggauucuagaaugcaaaacuuagggcucuugugaguguagaaaaccaaggccauuucucagcaacuuuugaagaaaaccuuuuuuuuuuuuaaccuucagaaacccuaaaaugaguuguuuugagauaucugaagguuuucuuuucuuuuaaaagaacguuuauuuuuuaguaucugugaguggaaugaaggugaacaaccagaucacucgugguguuuggaagcaaaccauugagauugagcacagcauauuaaguaaaguagacaccaaagcgucuuaaggucgacacucauagcuaagacggaacggagcaagcgaagauugucuagaaaucgaaaacccaccagcugaagccacuuaucagcuuacuccauuuucuugcacaaaaugaacaggucaguuuauguacauaagaacaaaguguuuccaggugugguggugcucaccuuugagcccagcacuggggagcagaggcagaaacagaucugugugagcuccaggucagccuggucuacacugaguuccaggcuagccugguucugguguacacaucaagacccugucucaaaacaaaacaaaugaccuuguucugagagaguugaaccccaggagaccaaacuuaacaacagcagcaacacagggcuaauuacaguaucaccaaggugugugcuuucuccauuugaaaugguucugcauuuuagaacugaguugcuuugcucucugaaggacagaggcugacaaaagaaaggugcuaauaauauuuuaaucaccauacauuuucaaguaaauuuaucuucaacucuuauauuuuauguauaugaguacacuguugcugucuuuagacacaccagauaucuucaacucuuauuugacauauaaagucuggccucuaaccuuucuuuaagaauugcaauucucagccuuaccucaccuuugaaucuaccuuuucaauuuuauuuuuaaaauaauuucauuaaacuaggaaguaggaauuggggaauuuuuuuccuucuuucuuccuuccuuccucuuucuuugcuucuuuuuguuuuguugguggugguguuuuguuuguuugguugguuuuugguuuuuauuuuguuuuguuuuguuuuaauuuagggucucacuguauagcucaggcugacuuagaacacauucuguagcccagacugcccucaaauucugcaucauccuuaggccucagcuucugaauacuggauuucaguguguaccaggcuuggccuagcuguuuuaacaacacaaaccucuucaacucgccuugauuguuuucuguuguuucaaguaaagauacuuagccuacuguucauccuuuagaagucuguccuagacugugaagcccagaaaccauugaucauuucaacaggguuuguuuagagaacaucaugauguugagcacaagauguugagcaaggugcuagcuugguauucuagaaccauuucuuccuaugcuuuuguuccauugcagguugaggcccaugguuuuggugcuaaucagacaugaaaugaauuuuaugacaguaacaucaucauuaucauuuauacagagcuugaaggcuaaagcguuggcuuauguguuaagaacacugacuguucuuacaguggucccaggugcaguuucuaguacccuuggauucuggcuaacaaccaucucuaacuggaguucccaggauuuuaaccucuuucuagccuuugcaggcaaucguauacauaacccacaaacacgcgugcaggguaucuguuugucucucugucuucauggcaauacuguugcaggaaggauaucauuuuagaugggagaagggaagcuuagagaaaugaguaacuugcuuauugucacagauagggaaugauggcucuggaauuuaaaccuuagucuguuaggcuugacugcccaggcuuuuaugcaucguggauacuucaagagauucuuuauggugcccccaaacaggcaaacaaacaaacaaaccugguggugggagaaacaguauacagagcuuaacagagggauuaccaugugacgugugcucacauccuuaaaaagagacgauuggagaacacggucuuaaucacacacuaugggggcggagcuuauucgaaccccagcuugccuaugcucagaguaaggcuguuuccaucccucuggggcuuuguaaagaugugacaaaauuaaagauaaacagaggaggauugggccaagcacgucaucauuaacuuuaguccauuuaccuucauuuaacaagcuuuucauugcugcuacaagaguuuuacaagugaagacaauuauaaaagcccaagaguaaugaagcaaucuauguucaagaacugaugguaacaccauuucaaaccuucaugcaguuuuuaugguauguuuuuaaauguaccucauuucucuuaaaugacaauauagcguguuugccucuuggguagaagacuauuucugucaguugcuaagaucuaaugucuuugucauaaacuaucccacuacauuccuuucucaauuauugucacugugucuagcgaaugacuuuauggauguguggcagaguuaaggacaauaguagugcacccuggacuagcaacaaggggaaccuguuaggcccaagccagaagaagcacucggaaagggaaggaaucaaguuaguugcuagaaaccaggaagagcugaagccaggagagaagacagacucagcuggaacagggacugggccacagcuguggcccagcaaggaagacuccauggagagggacuucacacucccccuuccucccuccucuguccucucuccucuugcuuguuguugguggugguggugguggugucaaacucaaugagaguucagaaagcagagaacuuauaugcuggucagccacucaggguaagggcaguggaggaguagagaauaauuuuaggagggcagaggaggauuccuaaaggaaauuuuguguuugauaugaaucugugcaagcgugucuaucgugauugugauuugggucuuaaguucagccccgagacucgugugucgaaggcucagucucucgcucaugguccugugggggcaagagcugcaggcugagucaccuuuacugugaauguuugaucauaauuccuggggaggaauauggauccguguuacauuggcagugauguggaugcaaugcuggccccaaguaauuuguuagauaauuauuuaccuauuuccuugaauccuauuuuacaaauacucagacuugaaggaaaacaucugcaugggaaaagacucuaaucucugccauggcguguuccuuucuuucccuuucccuuucccuuucccuuucccuuucccuuucccuuucccuuucccuuucccuuucccuuuccauuuccuucucucucucucucucucucucucucucucucucucucguuuuauauuuagaaacauuauacagaaggaaacacuguuacaaauuccccagauauuuagagaggcuuguguacucaucguggcagagauggacggcauacggugcucugugggcaguuaacacacagucacuuaacaauagacagcaucuuguaauugucugugguucggacaguggugcaggcaugcaggaagugacccgaggggugcuacuguucaagaugagccuugacuuuaacuaccacacuacugguaaaaaggggagcaacccuuugaggcuuagggaauguuauacacaaaguacaacugaauuaaaauacaaacccaaagagagggcagaggauggcuaaggggaaccuugguguggaugaccaggcguagugcaauggccagcgaaggaggugauggagguuggcuuugagaaggggcucagcugucagucaugcuccugaggacuucacuaagaacuuuguuuuccuacauagcuuauaaagagucucuugagaagagaggcaaauacuugugucguaagggauaaacuuguugaagaggacgaugcagaagggccuuuggcaauauuguaggggugaugagggcaucggggagaaggagggguaacugcuaaaagaugcuaccacuaacugagaggcaauacagagaggagaucugaucuuggaagaaaguuuaaaaguucaguuuuaaacuaaucgaauuugagguuauuagaacuuuugucacauauaggugauuauuuuaaucaggaaugcaagaaguugucugggucuuagaacaggaauccaaaacagacacguccaccugaagguaguuuuuugaagccaggaaguaggauuugcuagugaauguguccccaggaagggaagcacaggagaagccauuaugaccacaaaacccaccagggggcgacaguuggggcuguguugccucuacugccuucugugauggacucuccccagcuaccagggcuucaaguucaugguaaacuugauacagcacuacuuugagauauggaucaucugucagccaggcucuugaacuugugcccauguagguccucagucuugugaucuuuguucugcggcuugugugguggacccaauggcuuggccagugugcgcuaccacaaugugcguugggccuucccaaaggcacuagccacacauaccuauccggacacuaacuuaaacagcgagagaucacagacaugaacaucuguuggaaaggaccaucuaccagggucccucuggaaaugcacucagggaacagacugcauacccguacagagaaggcugcucuuugccaccguggugcacugaaccaaagguaauuuuuaaagcucugaggauaaaugagcucuuuuccaugcagggagcucagagugagaaagagggccaaagcaagaaccauuuaaggagaaguuguauaaaaggccguaaagaaaauagagaucaaagagcuaagaggaaaaucaggacuguaguccucauagaagcuaacgagguuuugagaagucaacaguagagcuguguuuaagcaacuuaagaacuguguuuauagcaacuuguaaauuagucccccugcaggaacuuuaaauucuguuuuuguggguggguuggagaggccacaauguuuacaggaguuacucugaaccuccugagauucugaaggcaaauucguggagccaaggcaaugcugccugccagucaaugcccuggaguccuaggaagaggacugaugcuggggcuaaaggaucccuggugugcugugaugggccuugucacagagugucacacccugucagcaguaguaaccauuugucucuucaagucaagagugguaaaaaaaaaacuggcuacucuuucaaaacauugaaccagugaggugugaggcaggggaauagcuuggugacagagugcaaaaggcccugggcuugaucccuagcaccaccaaaagcaacaagaaaaacccacuguaaguauggccacaacaauaaguguuacuacaguuucucaauuuaaacaugcauucagaggugagacuucuuaucauuuuuauggcuuuuguuauuuuuaaaaguaaauuauuuucuaaguauuuaaucguaaguguguauauuuuuaaauaacuucuugacaacugcauaugcuaagugacuuuuuauggaguuguaguuuuugugauuauauauuuucagaaaaaaaaaugagaaguguuuauuuguauguuucuucaugaguucaagugucugcagaggccagaaguggccguuagauccccuagagcuggaguuauaagcacuugugagccuccugaugugggugcugggaaccgaaccccagucuacugcaagagcagcaagugcucguuaacuguggaguuaaucucuucaacuggaaaagagguauuuuuaaaugugguaguuuguuugcaggcuguaacuggccauuaaauugauauauacuguggcaaguuauuucuuuugaaacuaaaagcaaacuuucucaaucucauucaagaacugagauuuggaaauaccguugugggauaguugcuuguccuuguggcagaacaccaggcagaagcaacuugagagaggcuuuggggcucugagcugggggcccuguccgucaaggcauggcaggugcaguggccuggcccagggccaugggaacuugcaaaucuagaagcagagacuuucagaagccagagcugggcucuuaccaucagaggccuacuaagccacccaucucuuuccaagcagcaugagcagcugggguaagauauucaaacgcacaagccgguguggacguuuuacauaaaaccauaacacugcuccuguaugucucauaacacuggcuuuuucuauccuauuaaaagauuaaaguacacgaccgaguagaacaaguuagcaucuauucccugugcugagagagcacuugaucuucacaucgcuuugugaacaacuuggaauguauugaccuuaguacagugauccccuuccaaaaccaauggcuucauccuggugucagauuuguacgacuacaaguaagaaaucuugcuaaaaaaauaauacuguagaguagacacggcugucagagugacgagaccuagaauagauuaugugucuuggauguagagcuugaaaaaugaccaagcaggacccaaaaccuuacccacagccaucaaacacugccaaaggcuuugcagagaauccuguaggcuggccuuacaucugugcaucucugugguugcuggacugauccuaaagcccucugggaccuagcucuacuaggcugacuugagcuacuuguaaguccuucuccauccuucugauugaugggguagacguuaaguguccuugggccccuuugcuagguccagcccuccauuuuuuauuccugaauuccugacaaaucuuuagcauugcucucuagccuucaccagacuuguuacauguuggaggauuagcuuagauguuaacuagaccugcaucaacuuguguagagggaauccagaagacauauguagaauggacccaagcucucuagccauuccuuuacuaacguguggaacauuguuguuaauccuauagcagacccaauuauucugcuuccagaguguggggguaggggcaguuuguaucuuugcagagaauagagaaacuacaaggaaagacuuccuugguuuauuuuauuaaucuguguuaaaugcaaaacagcagugggugggaaacccucaaugauguugcuagugguguucagaaguuaucuggaauuuucagucaacgaagacccuuccuuccagggcccaggcuaaaccuguuucagugcuuccuaauguuauaauucaggcagguuguuacccagaggaucucacucugccauucccgagcaaauccguggcuucauggcuccgugucucacacaggucaggaaguaauccauuaggcauauuggaguugcauuuacagagcacuugcauagacauuaacccugcccaccaucacauggaauguguucuaugaggaaauccuucagaggugguacaaaauaagcauguguguguguguguguguguguguguguguguguguguggugggguaugugcaccugugcaugcagaggcacaagaacgaugucagguuucaucacacuccucugguuuguuuguuuuuuguuuguuugaggcagggucugucacuaaaccugaaccucaccuguugaguagacugguuggccuguguguccuugggacucccccgccucugccucuaccccacaauccccaacccccagugcugggauuccagccaugugccuccacagcuggcuuaauuuuggauggguugugggaucucuugcuaguacagcaaguauuuugcccaauaagccaucuccucaacucuuuuuuucuccuuuuuaugugagacagaggcuugccauguagcucagguuggccuugaacuuaugauucucuugccucagcgccccuucccccacuuccccaagcugggauuucagaauugaucugccugguuugaacaaugaucuucuucuauaccuauuuggccauaccuacugauguaugcuaaaaggcuucuguauagagagagcaaaguguuuaaaaguaugaaaaaaaaauaccaagaggagccgggcaguggugacgcaugccuuuaauccuagcucuugggaggcagaggcagguggauuucugaguucgaggccagccuggucuacagggugaguuccaggauagccagggauacacagagaaacccugucucaaaaaacaaaaaacaaacaaacaaaaaaccaagaggaagcugucgagggauguuggagacauauuggaggggcugaaaucccaccagugccaggacaucacucuugggcaucuuaggccuucucuuagguuauaaagauccaugcugggagacguuugugaauacugguauaugucacauagaaccgaugggaauuguugguuacaguguggugguaguuuuauguacaaauccacggaacauucacuacacaauuaucaaguuuggagcauugcugucauuacuguggggauggcaaugcccccuggcaaaugucauagaggaaacugaugaaaauauuccuguugucauccguaacuucgacaucuccaauuuuagucaugaugcuugccuaccuagcucuucgcucuguaaucuacuuuaaauucuuuggguuuuuuguuuguuuguuuuagacaucugccaguugaguaccgauuuagauucuaacuaaauguuucccucugcaacccccuugagaagugcgauucuaaguuuagcuacugcucuaccuccauaugcuucuugcuccauuucugagcaacauauguggguugaaaaugugcaugguuaagacaguagagcgucagggucaggccuucaaauaggaaagacagagaccacugucaauuugaaaguaacuuugaaguacauagcaccaaguccuuuucuaagagcaacuuuaauuuauaaaaaaugaguuggcagcuuucucauguuggugcaaagcugugccugccauuuuggcaugggugguucagaggacagucuggguaucuguccucaacuuuuucuugugagacagccucuggcuguugcugcagccugcaaagauuuccucuuuuugccuccuguccucuaggugggcugggauuccagaugugcacuguuguaucuggucucauguggguuccaguaucaggcuuuacccacucggccaccuugaauuugaaagcaauggaaacgacuugcuguucaggcugucuguauagaucccugguagaacacuugcccagcaugcaguaaggcccugaguucaaucccugccauaacaaacaaugagaagcuguuaugugaagcaaaaccacacacagggcuaacacuucagguggggugggggugucccuuggccaugguggaggaagacagggugggagacagagcagcccgagaguagugccaucucugugcauuguuucaagcuaaaguuucucaggaagaaaguaggcacagaagcuuggcgaagagcugcugaaguugacagagagcuaagacuggugaaggucaugugucucuggucugucacaacaucauagaucaguggcuaucacugagggucuuacaagacaguaaguacuugguucggugaagucaggcacacacacaaacaaguugcuuagugggacagguuuggucucacauuccacuguugcuuaaagguaucauaaguauuaaagggauccuggucaaguagcuuuauaaauagccugcucugucugguuguauggaugaauguaccuagaauuaaguuucuguguaacgacgugucagggaaaguguuucuacuuuuagaaauuacuggccuuccuagacuucgcauuuuggcuuuaauuaccuugaauauaacaaaucaaugaacaggaggugaaguuaucccugggugacuaaacagacaacguacaucuuuuucucccuucgucugcuuuagacacaggaggauucuuccagccucaucuagagcuuauguguucuuacauuaaagaccauucccaugaccuucgugauuuuuuuuuuucugugucgaaagcuauuaaacacaaaaaggcagguggagagggacccucaaacacauacgcacugacagcaggcuaccgaagacugccugaaaaaugauguuauuucucagcgaggccaauagaagacccuguaauauagggguagcaagccacagcggacccuagaacauuccucgugacagcgcaucccgacagguaauggccugaaauaugaaguagacaucaccucaccguugcucuguggguucuuuguuuaugauaagauuccagauagauuucaaaccaaaacaaucagaccgaauccauuacaccuugaauauuuggagcaucuggaaaauguugaauuugucuccuuuuaccugcuuauggccaucuuuucacuggaaggcuggcucagcugccuccccucugucaccuucugcuuguauuagcacggcgcucgcaaucauuuggugauuuaaacuaaucccagaguaacucauggcaagccaaugccugugcagcacuuuagaaaaugcagccugcaggaaccuucucagaauuuugggcucuaaucuguauggaaauuuauaucauaaagcaucguggccaauaugaguucagaguagggucaggaauaucuaagguuuggaaaauggaacaaucugaaaaguuuuaaaaacauguuuucuaauauaauagaaaaauaaaugucucucuccuucugcaucuucauuuuguauaaaaauauucacaacaaauguagaauuaaauaggggauagucuuauuaccuaaaaauuauuuuggaaggcuagguauguaguucagguggcagagggcuugucuagcacgaaugaagcucugguuucaguccccagcaugacauaaacccagugugguaguguauuuuuacaacaucaacauucaggagaugaaggcaaagggaguucaaggcugcccugagcuacauggcaaguucaaauccagccuaggcuaggugagacucccuuggaaagugauguuuuagugaaucauuaauaaucacugccaauuugauucuaauaguguggguuauuuaacugaucuaauuacuaauaagacuauguguuucgcagaaaauuuuaauccagaaaauagaaauaguucagugcggacaaaguugguggugauaaaaaauuggcauagaggaaaaugacaugagguaaacuucagagugcugcacucauaucguuuugacuuggaaauccauccaaaugacaggagaccauguuuaguguuuagaagagggaguaaaacacucacaugguuagugaagaacuugcaguaucucagacuaggaugauggcuuuggauuccucuauuugcaugagugccaaucauacgaucaauacuauugguugagguagaucucacuaaacaccacaugaagagucugguugagccaguuucuuuuaggaucugaacucugucgaggcaaaaguuuucuaagcaaaccuuguucuuuucucuaucugaucucauuguauguccaccgauguguuuauguaaagagaaauagggggauauguucuauggggguguggugagguaugggggaaggggaugucucagcagauccaugccaaggcaucccuucccccugagggaccaguacaugacaguauaauauagaauagaguuuauucagggcauggggaggggaguuagaggguaguagaggcagagaacagcagagagagaguagagaaguagaggcuggccaugagcacauggagaggagugggaaggaauggggagagauggggaagggaagagcaagagagcaagagacccagagagcaagaaaggaacaagagagccacucuuaccuggcaagcagccccuuuuauacuggguuaggcuuaccuggcuguugccagguaacuguggagugaagcauaccuggcuguugccagguaacugggguggaguuuaaacagaaugcuaacauccccguacccuucuguuucuucuucauuugaguuccuaaaugagaugcuuaagagcugcucucuuucucucucucucucucucucucucucucucucucucucucucacuacaugguuaaacuguguccauucgaguagcauugccuuaaagcagugguucucagccuguggauuaugucaaacaaccuuuucaggggucaagcaaccuucuuuucacaggggauuuccuaaaaccuucugcauaucagauauuuacauuacaauuuauaacaauggcaaauuacaguuaugaaagagcaaugaaaauaauuuuacaacuaggagucagcacuacacgaagaucugaauuaaagagucacagcauuaggaagguugagaaccuuaaagauaaaaauauacacauaucuuccccaacauuucucaguggugucacaggucugcuuguccuuagccugcugcucacuggaagaagaccuuacacauacuguauugcuuguugaacaaaagcuuagcuuuaagguacuuuucauucacaguguugaaauauauccuguuagaaagagaauacagaucaggaggugggcauggugggcucauggguggcuaagguaggaggcgucccgugaaauccugucucaaaaaggcggggaggggccgugcacuugcccuugccccguuuugcaguggaaagguagcaaguagcuacucuaaauugcucugcgcuaagcacuugucuuuuuuguuguuguugcucaggcuaaaucaacuuuaaagccucucuugcucaugaagaccuaauaucauucauuaucagagucucccaccaccaaacuuccgcuaugacaccugucaggguuuaagugaauugugggaauuuagggagaaggccacuaucaguuauuguaacuuccgauucuuugacaaggccaaaauagcaguguacuuugugaaggugggcagcuucccaaagugccugccccauaguccucgucccagaagguguaucacacaguaccagacucaaguagaauguucuagggccaaccacugcauccauuuguggcuaucuuucucagaaaucuacaguucuaugacaaauaagggccaagaccccaaacucuaagguaccugccucuuucuuucucaucccaggauuucaccuccucaaagugccucuaccuuuaaaacagaguuuaacagugggagcuaaauuagaaaaccccgagaucaaacccuguuugccuuuucugcucaaaaggacuugguuuaugggugcaccgaaagauccccuauccuucaggcuggacugcaugcugccacgagacagcugaacucaccagaugcauuuaugcauuugaucuccauaccuugcugcauuacauucucugucaucuguauugucuuccaaaagcuaucaugacauguucugcaguuuaaggauuuaggauucuauguauucugccagauagacuucacacacacacacauauacacacacacacacauacacacacacacacacacacacacacacacacacacacacacacacacaaguaagaggauguggucagagucucucucacaaaaugcugguucuaaagacugugcccagacuuuucucauaugcuagaaacuuacuauugcaugguccaguuucagcgugaaaaugugcauaccaacccccuguggcauacgggaaggugaccacaccugaaagacauagacugugaucauauugucuugcaucuuuauuccucuuuccagccuuaucuugcuuagucuguaucuaaaaucuaugaagcacuauuuucuucuuccaguguugcuagacacagaaaauuggguucgaucucacuaagcaaaguuuauugaaguuccugauauuuagacaguccauguucuucacuguaguaugugucuaagaaugucaaaaaacaaaagcaacaaaagcugauugcuauuuaaucuuuccuccugcguaauuaugguagagccugcaggcaugccauuaauugauuccagccauacugacugggcaaucagcagacuaaacaugagggugacugagucagagaugggaugaggaaaaacuggagauuuuauuuuuauuuuuaaaggucuuuagguauguguguguuugucuguccgucugucugucuauaugacuuucauugcaaucuucaaagucuagagguuuuuaaaaagcuuuuuuuuaaaaaaaaacuuccaauucuagugacuucucuuuuacuuauagcuagguaaauuuuuaaauuuuuacguguaagcaugauuugccuggguguuugucagugcaccgugugugugcaguauccagagaaguuuaaagaggguaucagauccucugggauuggauuuacagacagcuuugagccacugugugggugcuggggaucaaaccaguacccuuuacaagagcagcauguacucucaaccacugggccaucccuccugccccaaguuuaauauuaauuuuaaguuaucucuggucuuaucuacagagauaauaaagcauuucagcuauuuuuauaaauuuaauaaaucuccauucccuuuuauuuaaauugucugguuuuaaauaucacugguuuguaaaucauaauacauucagaucuaguaaauaacaacaagcaucauuuuuaaacuuaugcuuuaaauaacauaaaaugccagaagugaguagauuacugaaugggaaauuacuuuuuaaaaauguuugucauauuucaaaacuuuuugagcaucuaggauauaaaaauacaaauccauuuaaggaaagcaguugguguuucuguuaauuaagacuugucaugaccaggcaguuuagucaguucuagucuuagagcugcaaagacccagagcauggcgaagcacugucagagaaaguuaucuaauaccauauaauucagagcuauuucugcauauacggaagcuauucaugaccagagauuuccaugugacaucagguagagucuuagcucccuagaugguucucauacagccuguuuuauugugucuucucagucuucuaugacuuaagucuguggauuuacauuuuuccacauuacaaaguucugcuguuuuaggguuuuuauugcugcaacgaaacauugugaccaaaaaucaagcuggggagggaaagguuuguuuggcugacacuucuauaucacuguccucacugaaggaagucaggacaggaagucaaagaggacaggaaccuggaggcaggaggugcuacagaggccauggaggagugcuguuuacugaauugcucuuuguggcuuggucagccugcuuucuuauagaacccaggaccaccagcccaggggcaguaccacccacagugagcugggcccucccauaucaaucagucauuaagaaaaugccagacagcuagaucuuaugaagguauuuccucaacugaggcuccuaccuuucauuugacucuagcuuggaucaauuugacauaaaacuaacccgaacaccugacuaaucacaaaaaccuucauuauccauugaacuuuaacuucuggggccuagcuuuuaucacugaguucccucuaggccgaaaggcuuuuggagcuaggugagcucuuauacuccuccaucuccccugggcuguacaaccccaacauuuacaaugauguaaguaagcuuggucauguucgugauucccacagcaaugcaaucuaaaggauugguguauuuuuggaauugacagcaagcagaauuauguaauaguauuuuuagaacuauccauaugucaggcacugugcaagacaaaaggaaugcaauuuuagccuuaaaagacaggaguccucuccucagagagcaucugauaaagcgagguugaacgcagcccagcagugagauuugggguuauguacuugggugccuaacuauugggcuugguuuuuguugccuaaacuccuaauucuacucaguuucuucucuucuagauauuaaugccacucaaggguugcuauagauuuaacuuagagaugguugguagcaaguuaaguagaguugguggucuacuacauucagccuauuggagucugggaugaugcuugguuuguuaagaucacucacuacucuugcagaggaucagauuugguucuuagcacccauacaagcagcucccuccaucacccuucgucuggccuccacgggcacuggcacugggugugcauggugcacaaauuaagauacaagcagaagaccccccacacacauuaaaauaaaauuuauucauucauuaauuagaaaguaaucacacacaggaaagaaaaaguucaccuaaaagccauuuauucauucugcguccacuggaugcuuauuuuauaacugaagguacugugccuuccaagauuucauguacacaugaaauaacacuugguggugagaguuuggcaguucccuuaaagucagcugggaaacugauucacaguacagaggccauuaggauggguccuuccugcuuacuuccauugaagauaguuucugaauguuuuauucuaagcagccuuccuuaaagucguacuauauuuugugauuuuuugggggggcggugauucagaagcuguucuagugaaggggucugggucgggaaguucuaguucauucaagaugacuuaggaaaugugccugcccuuaguuuagcgagcuuuagguuauuaggcagucuaugagguuggguucuuaaaugggcucacaccaguaaugcuuuggaaauggccuuccuccugcccuacugcuuccacaucaccucagguuggagaauacagagacagugcuagaaagcuaaguaguaaagcggucaacugggaaaauggccguuucuccuucaccgcucacuuuuaaaugcaugugaggcuggccacaaacucaggaacgugggacaggauggcaucugaugacaccuuaggguguccacagaguccuuucugucacaauccauggaagugcauugagacgccaaguagaaaguccucugaguaguucccuccugacaucuucacacggagaacacagauggaucauaccaccuggauggccuaugugcccacaacccaugaagagagcuacugugcagaaggggcccgagguuaucugcaaguguccuacugaaagucuucauuucgagcuuguauuuuguuuguuucuuacccacuggaaugaugaaagacguuuauuuuaggaggacccacguucuucagaacucgcacuuuguuccuacagagcuuggcuguaggcugugagggaaaccaaggaaaaaugacuugaagccugaaaauuuuguagacaucaaguaacguaauauucuggggcgguucaggagcaguguggguaaugcuacauuugauaaggacauuagagcuuuuagaugcucuggaucucuuucuaaugugaaaaucucaggauggaaagggagucuggcccagaaaggaggucauuccuguuugaaggcuccagaucagggagaagaaaguggagccagccaaaucuauccugauaauggugggacaacuuccagauguggaagucacccuaaaccucccauauuuugcuagaaagacauauaauagagcuuauauaaacuggcaugcuacagaaaugcagcguccucagguuaggugguauuuggcaagcgugcuauugcacagccugcucgaguuucugacguauaugccuucagcuaagcgcaacacacagcaauucaugccagguguguucuagcaggguaauguugccaugaguuaacaggucagcugugagguuuuugcaaagugagccuaaaauaugaacuuauaugacuuauaugggugauaggaaacaugucacauuuagacuuccuuuuagaucucuuguucugucagcuuuuuccuggcuuaaagccucguugaggaagggcuguggcuucagauuaccuagcugagcaaagugacuguuugcuccuguuugcuuccauucccuuucauagcagacugcaucugugcaaacagcucgaugcgcaggaaggagaaaaaucaagaagccaucccuggucauugagaucugcucuuaacaauucugaguaugaaaaccacaugcuauuuccaaaugagaagcagucauggccauuuuguuuugcaguggcugcucugcaggucugguuuaccaggcuuacugaaaaccauuacuuaaaagcacuacauuugcauguguuaagccugaacucugaauuccaguucguacucacgcugcggguggguguuggaaauggggauccugaaguuuucaagugaugaaaugauucacuggagucuggcauacugcucuaaauugauccuuaacaguaacguuuguaaccugucauuuccaugcuggcuguaaugcguuuaggaaaugauucuuugcaugcacguauuacugcaaaaauaaucugccgugacuggaagcagaggaccaaguccuuaacuucaucaucucaggaaguccucagaucugugccuuaaugagauaaaaaugaugcuacccuguuuuuagaggacccugagguuuaguuacaccagccaacuucuguaguaaccucaaauguaauuaucagugaaagagaagcaggcacuugagaggaggaaaugacuuacacagaggugucugcuccuggguugaacaguuguuuccggggagagaagacagaacccacucagaccguccacugcccuuuucuggggaggggagggggcuuagaaacacauguccuguaucaaggaccucugaggcaaggccuugacugagagucucguccacugucauaucugguccuauucucucaugcauccuuguuucuuuucucugcagaugcauaacucacacagacaccccccccccccauugcuaggggugugagagguagguccagucaaggaacugccaccagaugucauucugaccuuaaauggggucaucaugauagcagucucuugagccccccccccccccaacuugcacagcuuauuacagauguagggccuggguugguggagggaguuccuuaaggcggcaaagcacuuaugcuuguuuucauuucagauauaauccaaggagcuugguauagcccuauaaauaaucauagaugcucccaggaugccucauagcacauaguaugucugcaaaugaaccaagaaaucaagaaccauuagguauucuaccuaaggucagcggugugcaaauagacacucugacggcugacaaggggaccagggacuuuuugcuguaucucugcuuugccugaagcucuguguacaaggaacaccccaugacugaaagcaaagauaagagccccuagccugugcuacuuuaauacagcaaguuggcagagaccccuaaucaaagcugggcuguguuaucucuucuauccagaagcgcucucaaggaaguaauguuggggaagcaaaggaauuucuacuugugccuuugaaguuguauggucugcuguggcugguguuaagucgugcuuugagggguuuaaaagcagggagcagccauagagugagaauauaaggcaacuguuuguguagcuguguucaaggccuaaauuuagcuucuguaagauauuuguuaaccuccuuucuguaagguacccuccaucugcugccugcucccuccccccccccccccccccgcuugccaccagccucccuucguggcugucugacguccuucuuuacauuguaacuguggcuaugguccaaugccaaugacucugcauggcaaauuagagacaaaccuuuuggcagugaaacccuuacaagcuauaugguuuguuuuuuaugccaaaaaauauuuugggguuuguggcaucuguuauuucuaucauguauauguuagugauuagcaugucuguaagaaaagcuauuugccugucucccccuauagccagucaaacgaaaccagucacugauggucaguuuuaauuggggauuaugugaauuuauuaugcuaauuuccuuuuuuguagguuaccauggggaucaggggguuuguucgguuuagggcucacagacaaggagcaguaguguaagcggaaugagugucaggcacguacuagauaguaguacccagugagggcauauggaacggauuaaacaggaggauggaguggcucuugugaggauccagcucaugaccugcugugcagucaucuaauccauguccucucugaggacagcaaaugaauuacaucccugacccagacaauccuuuaaaagagagauucagggccaaggagaugguugaccugguaaaggugcugucugccuaaccucacaacccgaggcccgacccuggagcccacauggaggaagggcuccacagcguguccucaccuccauaugcaugcgcgcauacacuauguaaauaguauaaacuagcaauuuagagcauuagaaguggcacagauugcaguuagauagaugaucagggcuccagggccagagacgcacuuccaguuuguaugacuuugguuguguuacuugcuuuuuauccucugugguaggaccauggguguagccaggcucacuacuauucugcccgacacccuucuucacgucagacaacagaucacuuacucuccugaacgaaggacuggugcacuggcaucucaccccguuggguagagcuugguucaggagauaugacuagaugaagcagggccaacuagagacucucugugguguuccuucagaccaaaccugacugguguugaggaccugaaucugacucugagaggcugguccucaucgucuucucccguuguugaaaaggaaagacauauaaaggacagugacacuguguuuugaugauugugaccuuuccaagaugggaacuuaauccccaacauagcaguccuagggacuuuagggggugauguagucuugagggcagagcccucacaaauggguuuagugaacuucgaagagcugaaggcaaauagcuaggccucuuuugucccucugucaugguugccuuguguggauaccuacauagcaccauaagagacaaggcuugaucuuggagcuuucuucuucuggaacuauaggaaagugaauuucucuuuauauguuacuuuguccugacuaauuuuaugccaacuggucccaugcuagagucauaugaaaggagggagccucucuugagaaaaaugccuccauaagcuccaccaaaagggcauuuucuuaacuagugaucauguggaggguccagcccacuguggguggugccaucccuggaauagugguucaggguucuauaagaaagcagauugagcaagcuguggggagcuagucaguaagcggcaccccuccaugggcucugcaucagcuccuaccucuggguuccuguccuggcuuccuuugauaauuaaccgugauguagaagugugagcuuuccuucccagcuugcuuuuuaccgugguguucaucacagcagcaauaacccuaacuaagagacuuucuacggcauuuuguuauagcagcagacaaacuacaacggcagcucugagccgagaugcaaggccgauggagucagaguuucucacuucaguccaacccaacacagaccuaacuacuauucuuaaugggguuuucauuguuuuuaaccccaaauccccauuuagguuaaggcaguuugucggguuaaaugaguugguuauuaaaaauaguuucugcugauccagagcaaauagaacucauggcuucucaucugagagggucuuuauuuuuguuuccugacaucuaaucagaauauauucaguagacuaaguuuuucuccagacuaaguauucaucuccaggaugaaaacucaggcaaucuccauaagauuaagcaauauucuucacuguaauaaaguuaaauugcaaaucuaccaagguucaugagguaaucaaagcuugaggcaugaagugagauacccugccuucucuuccccgaagaaauaaguucuuuaccaguugaaauccacuguaaguuucuccuugguagccagggucuggucugccagagccugugcugaaaaaguaaagagaagagagagguuuccagaggggacaccagggaaggggauaacauuugaaauguaaagaaagaaaauaucuaauuucuagagagagagagagagagagagcuauugaauaugccaaacuuucaaaaggagaagaaaggaggaggaggaggggcguggcguggcauugcuuucuucugugcuucugcuguggcuucauguccuuagugcccuucaucacaguggagcaugcggugagagcgccucucaugccugccuucuuugacuuguaagcagcacacuuugcucaucccauggauuguuggcuguuagucccacagagacucugugaugaggucuaggcuguccccuugagcagcuucuaugaggcauccaaacagcuccuucccucugguggccugccucuacccacaggacacccugugguccuuggccagauaauucugggugggcaggccagcccagcagucaccucaccuccagcucuccuuccguucuuguucucugggcuuuucuaggacagacucagacguucuuucagugcagggcguaggauaggccucuguccuuuugaagccccccucuccuaucuugccuguaucucucucucccuucuccuggauaccugggcaaagagauuauccacagcacacugugcguccaggaauucuaacuccugcacucucccuucauuaccauacuuuuggcuuuuuggcuuuggucagggcuuuuuacagucacauagaggauugccaaaauuuuuaguuuucagauuugcauugggucuggaacuucaaguuagcauuucaugacuguauccugcuaccucaguugaacugccaacauaacagaucuuugaagaagcacucuguagagcacucuagaaacagcagggacuuaggucccucuguucuagagagagcaaggcuaggacacaaggaccugguuagaaagaacagaacauaaaaaugccacugccguucacagagcagagauuguaagagcuggauggaggcuuacccaggugccuuggcucugcaucuaguuaaugcauuuuuuauuacuuaguaaacccaaauuauuaauguucagcuucugaucuacacuuuucuccuaacuaaauauguaaguggcaauaauuaagacaguaaguacaauuauuugaaaugaaaaaaugagaguuaccccggagcgagaucuguacagagacgauuaugucugcacucuuaaaguuucuacaguuguggaacugcaccaccugcacaaacugauuuaccaucuuauacccaaagaaauacuuuucuuuacucgagaguuggaggacuugacugaaggugggaaaaguggcgaagggaaagcaagcuccgugugucaccgggagucuagggguauuguuccucuauguaguucaauaagcaauuaucuguugcacacuaagucuguggggcugaaccugagaaacagcuugaucugacacaugcccaguucauaguugugcuaagaaggaaggaaaggaacaggacgggaggacagugcuuuuaaaaggcaguuuugguagaagagucacgauauguugaucccaccauuuguuugcaguucacauauaucccuaacuggaugguacuaguuuauauguaaaugaaauaucucugacacagggauuuuucagacaagccuacacuucccaaaccuuuccuccuugaauugguaucugacucucuccucaagugcagcucaagaucucuuuacaagcucuauguuggaaaacaugucuggugauaaauuucuaaaugcuguucuggaaguggucaccucugcccuguuagagcuuucuguugucacaucucaagagcucuugaaggggaguuauuuuuuguuguuguugggggguggguggguguuuuguuuguuuucuuuuauucucugcucaguucuuuuguuuguuucaaaccaugagacaacaaaggaaggaagauauaagugcgguagucugaauaagaauggcccccacaggcucauacauuugaauguuuagguuccagagaacgaugcuauuugaaaggauuagaaggauuaggggguguggccuuguuggaggaggugagucaguaagggugaucuuaagguuucaaaagcccugccaagccaaaugucucucuuggugguucucagcagucgcuccaacaccacacaugccacucuucuccccacuguaaugacaauuacuaaaccucugaaacuguaagcaaucugaugauuuuuuuuuuuauuuuuuuauaagagaugcuuuggucaugacuacuacacgagcaaaaaccuuucuggcuaagauaguagauaaauugucagaauuugcuuagaauguuuucccuaacaaauuauccaagguguuuuccagaaagcaagaaaaugaaucuuguugaaagaguguuguuauaaauaugaaauaacagguaggcugcacugggacagguuggaaaaaguguauuuccauucgacaaggaaugcuugcucucuguaccuguucagccaugauuuuuagguuuauuuugauaaaaauguuuccuggauucugcaugacacaaaagccaugcuguuccccaccaggagucagugucuuuucaugccuucauuuccuuagcuacaagguaaaggugcugagcaugcaucucauugauuucucaaguauaaugaaggaauaaaugaaauguuauuauacaaucaaggcuuuuauaaaucauaaagacuuacauuuaauacaugauuuuuuuucuugucauuugcuuuugaguguugauauuuaugaguaaucuuagucugucaaacuauucucccucaauacaguaugucuagauccagacucauauguuacugguauaucuggcuagguugaguguguguguguguauguguguccccucgagcaugcacacauguguauuuacauauguagauuuacuuugugguggugagauuugaacccaggaccuugaacauucuagucaggcauuuuaccaccgagcuacauccccaaccuaagguuaggugaaaguuuuaugaugggacucacuaacacagacauuccaggcuguguuuauauuaggaaaacucaucucuuagagcaggagccaccuagguugaguuucugcucugccauucaccacuggauaauuguugggaaauuaauuauuuguucuccaucuccuccucugugaaauagugugaacauagcagagcucaauaccgcuugcugaaugauaugguaagccuuuaagugcugguucucuucacuuugaaagcagacacaauggaaccuagaguuuauuuuagcagguuguuuucuuuauggaagaaacucagcuucuguuuagcuucugcugcgguugugaaagcacaucacaucugucugcacugauucuaauaaaccauauuuuaaaguguuuuaaugguuguaccgaauaccagcuucugcggagauugaggauagcuggucucugauagaaauaacgcaggaaacuuuauuuuguucgugcuguuugaaauucuauaaccugaggagaccauucuugauauguauguuggacuuaguucuauuugauccuagaaauguuuucaaauggcuaacaggauaagguccgacagaaagcaaggcaguggaagugcaguugaggcagagggaacaggaacaggucuguguguccagaugucugacagugauggagauggcccggguugaaagccccgcagagcggggaggagagcuggagcugcuccuuccucggcugccaccauuccucucucagugcucuguguugguggcaccaucuccucuguguuuggaggaccgagaggucgggugcuugguuggaaaugagccacagcugaccaguuuuuacauugugcagauacucaguggauggucuuccugucgccuggacagcuucuccugccuuggaagcgccugccaugugucacagcugcaggucuuugcuucuugccugcaaugucguuuaacuuucucugaauggucccaagccaggaguggcaggaaaaagacugcagacgaucuauauacaaaagaauuugcugcaugacuuuuuuguuuaugauuuguaaauggccuaauuucuuuucguaagugugccucuugaggaauguguuuaauggaagcuuaugcuauuacggauccuucaaccuaaucguguaauuaccauaugccaucaauccugcuccuacaggguccguccuuuuucccuuuuaaagcuggagugcaauaagagcaaauguuuucuccuucagcgcauuauucacaugaaauguguguugacaaguuaaggauaugaagaaugagaaaucuagaugaucauuucuuaaaguagaacccauugauuuccauucucuaggaaugccccugcuauucugguauaaagcuuguugcacuguucguuuuuagacuuacacuuuuagugugguagguuuuuuugguuuuuuggguuuuguuuuguguuuuguuuuuuguuuuguuuuuuguuuuuuuguuuuugccugcccucuucccugugccagagacuuuuuaagguaguuuuucugcuguguccaaagccaaaaucuuggcacaggggagguuaacgcuuaaguggcuaauacaggagaaguuuacauguccaguccuuuccccauuucuucuucucugggagaaaaggauggugggccgauuguucuuuucuugcugccaacaucauguuauuagaaauauaauuuccagugguuguagaaauccuaagaccacaaaaacuuagaggagaaaacaaaauuacccugugauuccucuaaccuggaaagcucugaucuugguggcucugcccagcuccgugcauccucccaccguucagugugcuguagauauuuccugucacuaaaacaucgccugcauccucccuuauucguggcuggugauguguucccugccauauggaugcaugcaugcaaauagagacagaauuaaaauggaauuaccuugagucaaaagccucaaugcccugaccccccgagggcaagucaaagcuguauagccccagcaccagaagaucuguauuuuguccuccaaaugaggaagcucccaggaccacacagagacuugaagaacccugcaaagggaaugcauggccucuuuguuuucccacaguccaucucucugucuagaugucugaggaaagccuuaggggagcacucuuagcucuucuuguugcucaaauggaauacgagaauugauagagaaauuccguuuccauuagagccaaagagcggaucgucugcagggacugcucggccccuuuuaaugauaacaacccccgugacguuuauaucggccaucaguuccuccucucuuucugcaggauggaguugagauucugguucguguggacucuccacucuauuuuccucuucugugaagaguggggugaccacaacagccaagguagacuuucaagaggguagacacugagagagacagguguguauaugugugguauauauauauauauauauauauauauauauauauauauauauauauauaugggauguguguguguguguguguguguguuugcaaacgagcacacucucgccugccuccuuugguuugguuugguguaauuuaagaaguagcgauccaugaguggugagggcaggaaugccccaucgcugcagagacaccaguaaaugaaaaggcagcacauggcuaaacacucagcgagcccugaaaacauagaggauucagcugauuuguccuggggcacaaagcugcgccugucaggagccuuagaagaaaaugagccucagugaugggguccgaaguacaucgaaucaaagcucauugagucagccgggucauuuucuccucuguauuuaauugcugacugcuccauugcuagacccaugugucaaaucugcuccuaaagacugugucucccuuucauugaaagggucuuggguuuuguacugugaaaaacaacagagaaacauugugacaguucuaaagcugguccaggcagcuguugugucccuggcugccauugaucuccagccugcuucccauguuggucaggcccugcagaacaaacccacaagaaacuuggcauugagaagaaucaccugacacaaaucuguggcuuugaaaugauucuaauaugagugcuuuucucuguuuggguuccccuaaguucccaucuucuauauuacagucaacaauauuggggggggcauuuuaauugaauuuuugccauuauuuuagugguccaaaauucauuaaaccuuagguaucaggcuaauaacacauggaaaaguuaagcaguguuuuuuuuagauguucaguguuccuuuauaucugaaguguguuucaguauccauagacucauuuaacauaguggacggaggccugaguaacugugcgaauuacuuaauggucuuauaacagcaaaacacaaaauaugaagcauuaaaaauaauuaagguagccggguggugguggcgcacgccuuuaaucccagcacuugggaggcagagacaggcggauuucugaguucgaggccagcauggucuacaaagugaguuccaggacagccaagacuauacagagaagcccugucucgaaaaaccccccaaaaaaauaaaaaauaaaaaauaaauaauuaaaguucauguuucccaacuggacuuaauaaauaacaagauuaugacacuauguuuccuuuuuaaggaaaacuuaauugauuugucacuuuuaugucauuuuaauuucucucuuaaauuuuuaaaaaucauuucacauagguggcuccuauccuguauguauuucuagcuaugcaacauuugauagcugugcgcgcgcgcgcguguguguguguguguguguguguguguguuuccaguucuggggacugagccuaggugcuugugcucacuaagcaagaccucacucccuugagcugaauccuucauugccucucuucugacuuuagaggacacacacacacacacacacacacacggucuugauuuagugccuggcuucaagucaauguuaauucuuaggaacauucuuaucauguugauuaaaauauuuauauuguuuuauuucgccuccaguaguagccggcaaguuucugcuugaacuaauucccugagaauuuauuuauacagucucuuggaauucaaagagaacuccagguuuaaaauaaguuuuuaguaaaauguuucuaaagaucuaguaaauaacauaaauucacuuuauaguccuuuccaacucaaguccuucucauugucacccacgacaucuagugacgugaagaaugcagaaccuucucugaugcagugggagcagagagccuagucuaguuccaucauuccugcacuuucuaccauuuaaaaacucccagucccaaguguuuugugccccaaagugccacccauuauucaugguuaccagccagucggaacuaugauacuccaacuuugggguacuuucuaagguuauuuuaauauuuagacuguugcucagcauugcuucccaugggucuggucucuaugaaguucagaguacacgguuucugugaaucuuuuuuuuuucccagagugacaucagugcuugcuguaaaguauaaaguauguuaagauuuuuuuuccccccaggaauccccuauaagaaguugguguuuuuuucugcucuggcugcucauugccaggguagucagucugaugcugugacucagucacacuggcugucaucucugcugccucaguuaaggcucugagagagcagcucuguuacuuaaucaguggguuggcucauugccacucaugugacagcaggaguuuguagccaugagacuuuuucaccggcucuguuaauucaguaguggcuucauacugcccauugauagcugcaacaucagcacagcgaauguagacgcuuuagagaaacuucuauuuagaggcauauuuuuagccuucuggauagucagugugccuucuguuuguuaggcucauauaguauaacuugaauucugucauauuaaggauuaccacuuaauaugacagaagcaacgcagucacaccaggacaguauuuuccucugcaaugugucugucagccuucuggcuacagccuagagucuccagaucauguagguucuacacauugucuauaacccgccuggcauugcuuccagcaccucuauuguuggguauggcagaagaaaggauauuucauauaauagauccuaaguuggaggggggcuuugaagaucuucuuccuccacuguuaggccagcagcucacugaacuguugaacuugaagagaccaagggccuucuaauugaggauuauguucaagggcguccgccacagaacuggccaauugcaaugcgacuuggaagccagcucucugcguucagggcuccaugguuuguuuaggaauggagugaugccugcugauagcuugccgagcuuccuucuaagauguuuaaaagaaggaggaugguggggagagacuuguucuuugaguauaugcaaggaaggaacugaagaacguacauagcaggccaggcucugaaaagugggcauggaaacuaguauguauuucuaggacuuggaagaagauaggacauuuaagucuagcacuuugcauauugaaaguuucuauaaauagcagcuguuacuaauaauuauccuuguuaaaauuccugaacauuuuccccugguucccaccugagguuaguuccucggauucuguuucuuucgcaguuucuucucccuccaaaugcccacauccgcuugacugaggcccugugacaccccugucuauaaccccacuucagcucugugcccguaugaauucugucuugggcgauacuccccaauuacaguaguuagcguuuuuguaacauugacaaaguaccugauuuggggcuggaggaguauugagacaaagauccuggcugagguuccaggguucucaguccuuggucaacugguucuaucacuuuggaccugcaaugugacagaauauuguggcacccagagcaaccaguaaaagggcuccuuuuuuuuuuuccuuguggauaggaagccaagagcaagagauaaaggagcaagguccaccuuacagagccuuccucuggugcucaugggcagaggcucaucccuuuacaugcaucaaacacugaggaagccggcaucccugugacccacccacauccaacugagagccaagccugcaacccauggggcauuuggggaaacccuagaaucuaggccacagcacugguucuaccagaaaacuccuuccauuccucaagagcuggcucaaauauccuacuaggcaagugucuuucaagcuucucaauuagauaauugauuacacuugcuuguguuuaucuguuuucagguuauuugcuuucuuaaaucgcaaguucuuugauggcaagaacucuucuuuaguucucuguauucaguaccacccuuggaacaucauacgcauucaagaaauacuaagugaacaugugaaugaauuauaaggcuugcuuuuuauaacccaguucagccaguccccugcuugucauaguucacuauggugccaguuguugguuuagucaacaaaaggaccaccaucaggagcuuucaggcuccauccuggggaguucagaugguagacauuuugcuugauucuucagcgccaucugcuggauaaaaggcuuacuccaggcacacucucaaagcaaaccauuuggaagauuauuucugcucaugaauauaggagucuuuccuguguccuggcauauuucagaugcguucuaaggcaaagcuuccugguaauugcauuuuuuguguuucuuaauauuuuagggagcuggugaaucacgaacaauguuuaaaaacaucaauuuucccaguaacauagaucuuauuagauacugcuguucauuguuuacuauuuaugugauuaauggugaacugauugaaauucuggauauugaaaucuuuauuguucuugauacacuuuugauccguuuaaauugaguuuugaucuguuuauccagaaaacguuguuccuguacuuaaugccuaacacuuuacagacugcuaaaggaccaggaaagacacaggcacagucuuguuccuaaauaacaaauauuuagguuagaggaaaagcauauaaauaccaguuagauuuuuauagagcucccuuauguucaugacccauucaugucccuuagaaacagagugacaaaguuaccgguuuucucaacccauuuggauagauuuucuuagagcacgugaaacugaagggaaauucuuaguauugauagaauauguauaugcauucaaaauuccugguucuuugcauuucacuuugcagucuucugcccuucuuaacugucccucuggcuuuacauuaccaagaggugcucgguuucuuaaaccaaggaagcauacauuuuccuuccaucaaaauucauuuuuaucacaaaugauaaacuaauacagaauucuucuuggccugauagcuuauguacaaugggguagcaugcaguaaagcuacuguuuauagacaccauuuggaaaauauugcaggacuuccacacauauccaaacuugauguucuuuuuaacugaagaacuagaaaagaccuugaaaauuuaucuaguucuuuagaagaagaccuuaaaauacuguguuuuuuuaaaaugugauaucuguguauaaaacuuaguuuucugcacuugaaggaaauauuucagaguucucauguuagcuuguuaauagcuguccagugcucauucuucuucgauaugggugaacaaucuguccuggaaaugaagucauuuguugagugguccacgugucauguucuuuaacugauaaauaaugucugccaugggcauuguuuuuguccuccuauaauuuaaugauacugugauuuguacagaugcuagcuuuuauuucuuuugucuugaaugccaaagaaacucggagucuucuuugauuggucucuaacaaauaaaaagagucuuaaugcacguguucggugugucuacguuuuuuuagcgugugacuucugaaguuuugccuacgcaaaauauuuaugaugguggucuagauuguugcuagaguguucgagggcacaccagugagcguacgugucuggcaggguuguagugaaaguuuaaugagguagucucuagagcaccgagcgucgagcccaugacacagcaagaacucaguacacuagccggcugguuaggagcgcggcuggcccacccaggaggguaagugaaguugcuuccaguuuucccagcucuccuccaaggagggcugguagguggauggacucuggccacuguaaauguucccacuggacuuccucuugggaacugagauucucacagugggaaauauuagcccauucuagauaugagucuauaugucuuucucaaauucucugugauggggaacuuccuucauucaacaagaccugcaugagaggcuagugagguguggggguuuggagaggggagcccguuagaccucuguccugcucaauugaaaaugccacuuuccuaucccacagcggggagcgcucgcacauuuugcaguagagaaacguucauuuuagccugcgucuguugucauugcaaaugagcgguuuaaaacuagaauauuucagauuuguccaauguuuauguguuugauuucucuaccugugaaauuaccaauucuguguucucauggcuccaguuuucccacacuuuaaaaaucacgcugacauagcuggcuguuaccucuuaccccuccuaccccacugccuguccuaaguucuuggcacagccuggcucucuaggcaagccgaaggcuacccuaggcuauuagguuccuugguugucucucuugaaagagcauccuuacgucuguuagcauguggucccucaccucuccccuagccccacagcaugcuuggagcgggcacggcgccccucccccaacauguauccucaacaucuaaaauaguguucccuuggcauguacaauaaaaaugaacagcaaagaggccguccuagcccuggacugugcaccgaccuauccagcuguguuuuuuuggagcuggcaguaggcaucuuuucuuucuauggucuacgaccgauuugccuauugagagcuaaggaucugucacuuuguguuuacauaagcaggugcgcucgcugcugaaauuacagccuuuccaugcaauuagguauccuuuucuucucuuuucuaaaauaagauguccuuuugaguucuguguguaguuacacauuccugccggugauuccagcuucccuuccuucugccugcauccuggugcagugcucuggcugacuuggcugaggugagggugcucuucugaccaugccaggguacauucaagagcaaauuguggugugguuucacacagcuuucuaaggguugcuugacugcccacaagcugccgggaagaaugucagugccgucugguaucuccuaagacagucacuuugcuucagaguggggagggcuccggcucucugaggcucagcaaacugccaauucuaaaugacagaaaaaggagccuguggcaaugucaaugcauauagucaguuuuuuuuuauaagaauuaaaaauauuauagguuagcaggguggcucagugggcuaagucagcccuggcaaagccugauagccugacuucaagccccagaaccacuauaguagcgggaaagaaggaagcuugcaauuuguccucugggcaccccacagacuugcaugcacauacacaaauacgugauacauauaauuuaauaaaauagguuaguaauaguaguaauuaaaacaacaacaucaacaauaacaacaacaaccuuuacaagcuagagaguccugggauaugcacaagggcuguuguaaagggccugguacaacccuaggagucugucagaacuuacuguaaagcuggguagaaauccaugcuacauuguaucaaauucaacuagcaggugcgauccagaguucucccucucaaauacauagcccaaguuaaaacagauuugaaccaaggauagagcaaaccccaugacuaauuuuaaaggaagccaccccccucccuaccccaacaaacugacaguuggaguucuaacccacaaagaugcugaucaaggccagccaccuaauucgguaaagaacacagaggccuuucccuugugugcaucuacugagacuuuccugugaccaugauaucuuucugaguuucagggagacggaucauaaagguacuugcuguccagcuagaugaccugagcugaaugauugggggugaggguggggguucucauugaguuagucaugagacacuaaauaaaauuaucaccaagucacugaguagaaaguucaacccuucuuauuccauuucauauaaaaggacccuaagucuaauacuggccuugaaaauccuucuugaagccacaucagcccgacucaucuggagcuucccugacacucuggccaccccugcuuccuggagguagcuaugggguagcagccaagugaggcccaguaggaguccucuggaauuguuccuguauaaauagcugucucaagccaagaauauuuuauguauguucugacuaagaccuccaggggcagcucuagugucauagccuuggaaugcuaucauuuugauuaauaacucacgagguuuuuguaauucauuuguaacagucccauuggcuuucucaguccucaagggcauuuucaguaagaauuauuuguggaacuuucuagaauacauuugaguaauacuuauggaaguuaauauuuccccaggcuccauagcccaagauucagaaaugggagggaauuuaauaaggaauaaaccauauaauuuuugaaauaauaaaaaaauauuucuccauaaaucaauaucauuggaucuuuuuccuaugccucucaaguguguaaaaugugaaacaauuucuucuuuaugacugcagacgagauaggaacuugcucaucgcaaaacauuagcccaacaacuuuggcugagugcuguuucagugcucauuagauuggugagcguugggcuggucggcuggcuguuuuuaugcugccaccaucgcuuaacaucuaaaaguguaugugugcucugaaaacaaaauucagggaaggaccaucaaaguagugugauauuuacuguugaauuccugaucuuucucuggagugugugugguaauugaggagcaaagaauucguucuucauacccuuggaaguagggaaauaaccucagcuucuuaaucuguaaacagguucuaaaaaaauaagcccggaggcuuaaauguagguuuugaucaaaauaauaagaggagcuaacucacggcuagacaguguuugauacauuggcugauuauaucuuagaauaauuagagaccagaagucuggaaagugggcugguauggguuuuguggauaaggccagccauccuuagcuagaaagacauacuccguugugugagauuagagguauauuuacaugcccuggcaugcuucaugcuaccacaugaacuugaccucauaguaaaugugaguuagcagaaugauaaacuuaguaaaaguucguuuccugaggcaucccagaaggauugucucuagugauguguagcuuagugguuggucaucacguuacugcuuagauuaaaacuugagcuucagcauuaaguauguucuguaauuuucuguccuccacaugcuggguucccccuucgccauaaccauugacacaaccguuggcagccauggcucuccauagcgaucuaaaauugccauagaagugagacuucaugguugugcuucuggugaacaccuggugccaucucuugaagguuccuaguuuguuuuuuugaggcagaauuacgagguuaggaguacaagauggucucucaaggguucuuuccuuaaauaaccucuuuagguuagaaguagcaaagacuaaaaauggcaagaagugacaguguuggcaggcagagaagagaaaucacucuugcucuccugcguccuuguccuggugggcaagggcauucacucugacuuucuucuaaagugccuggagccaaagaacaccugucagaaguuaaugauauguuaccauaagaaagauggauuccaauggggaccucagagaauuaaugugcgggcuaugugcuggcugcugccagaucgacacacacacacacacacacacacacucgugcacuuccauucaagggcagggaaaccuugccugcaaugaaauauugcucauuugcagggagcguggaagcaccaagugugagaaguagauguguguuauuggcaugagccagccaugcaucagucccaaagggaaauaaauggcagcgccucuccaaagggauggcucagagggggacugccaagccuccccuccugguccugaguacacacguugguagugugugcugcaaaugcuuaucauagcuuucuccucaccccagccccuccccauauucauggccuaaagauuucuccccuagagaaacgacucccccaaaauuagcuacccuugccuccgugagcuagcuguagaccauaaaccaccuccaugauuagcuguaggcaccagcuccuccuuuguggucauggguucaaccacccuccucccuguucaacuguauacaauaauaugcaaaacuucugggaugcagcccaggcaaccucagcuuuucugugucuguguguuuccuuucuucauucccugcugcccuagucaggucugccugucccuggaacggggccagauguagcacccuucccucuuucccucuuuguuucggcauagaaucugaaggauuuauuuccaugucacucucugcuuuauccugugccuaccuaaccacccucccuaaguugccauuuucccaaagccaaccccucucagcucaguauuuucagaaucgauuucucuucugaucuuccuaucuuuuuucuuaugucaaacucgggucgcugagagucucacugagcugagggccuugagagugaggguuaacauuugcaugugagaacagugguaaacuuacugucaccuggugcaagaucagcucuuucgcuuaagacucugcucaaguuucccuucugugagugagacgaccgcucugagcaguggcgcaucaguggaagaaaggguucauuucaucuuaagguuuaugguccaucaucaagggaagccaggacagggacuaaagcaggagcucgaagcagccucggggaaaagcugcuugcugacucucucauaggcuagcacuuaacuagcuuuuuaugagaucuuauuuuuuauguagaggaauguuuugugugccugucugucugggcaccacauguguacagugcccacagaagccagauggggucaugggauccccugggguuggaauagagacaguaugagcugccauguagaugcuuagacucaaacccaacccaaguaaguccucuggaagagcagccaguguucuuaacugcagagcuucucuugagccccuucaguagcuuugaucugccucccaggaugaccugccuagggaauagagccacccacagucaaggcaaucccuuacauacauaccaacagcacugucucauuccacagcugacagucucccagaugacuguguccacauaacagcuaaggguagcuagaacagucuugguaugcuaaugcuuuucauccagccuuagauccuauguccauucacagcauauaacagaagccgcugcaguauuugagcuuagauauggagcccaaagauaaaugggaaggacugcuguccauugucacauucuuuuaaaauuauagugauagguguauagacugacaugaucacucuaugguauggcuaaaaggaaagauuuuguuguagauuugaggaagggaaggagagagagagagagagagagagagagagagagagagagagagagagagagagagagagagagagcgcagaagcaucuggagaaguggggaggaaggggaagaggaagggagaaagaaagaaaaggaagcaagagaaaaaacauacugaaacuagccugguuauagccaaggaaaggaagccaguggcucuggugugaguuuaggguagaggaggaggugagaggggcuaggagggcggaauacauacauacucauauacacaaauacacacacauacacacacacauauauagaaaugcacagcaagaacuuggggugcugagggaaggaaccuggaggccagugugauccuugacacgccaauaggcacugcagguagccaugugucccuucaccagugauaagaaaguucccaaggaaugcuggcuucuaucugacuuucagaaaucuuccuauggcuggggcugagcccguuucuagauaucugcacugcuuuuuggauucuggggaaauggaguuuccuguggaccugacagauggcaugugguuucauagcucaguuaaaaauaucugaagccuguuugguuuuguuuaaguccacaaaggauaagaauaggugcccacuugaucuuuguaaauuccaagggaagaaaacaccaagugguuugaagucaggucucacuggagaauaucuugcuaauggggacacuaucgaaauucuaguccuugccauuuuguuccacaccacuuacaguuucuugaaggcagcuuugccauccuugaagcugcagcuacgaucacuucucugccauuuauuuuccugaagagcucuaacauuagucaaagcccuucaguagcuuuuggcaugggagauuuggggaugggagcucggaguugugguuguugguguucgcuaagaugggagauagguggagagguugaagacuuuuaauaguguaguguguagcuucaauuggcucugcucuuucagcacacccaucagcacagccacgucuaauucccugcugcauccgguucugggaaauuaaaauucacuuucaguguuucucuuucccagcuaccaccaugcuuugcucaaguguucucacugacugggucucagugaggagccacuuuaccuuguaacaugaucaccauguagacacugcuuucuguuuuuaaaauggugugagugagagcgugcgugcgugcgugagugugugugugugugugugugugugugugugugugugagaaugugugccugugcaugugugucuguguauaugugugugaguauaugugugugccuguguguguguauguguguguguguaugugcauguguguaugugugugugagaauguuuguguguauguguguguauauguguguguauguguauaugcgugugugugcauauguguguguguguaaaguuuaguuuuagcagcccccuacucaaccagguuuaaauuaauuuguccucuguaagccuguuucccuaucuuuaaaacccauuaaaguucuuguguaggugaaauaauaacauuuaaaauauucaggauauugccgguacagagaaacagucuuauaugaucugaaaauugcagaaaaguaacuauguuuuuaagucauccgaacuuuuacuaauaagauaacugaugaaaacacguuaccguagcucaacccauuuccccucacacauggaauaaauaaacuguuuuucaauuuccacuuacugugaacauuuucucauauagguuauucuuuccuaacauuuuaaugacuguguuauaucugaagggaccagcagugggcacaagacacccaagaccgggcucucaguacaaaggagauuuauguccccagagggacagagggcagggauaagggacaaaccuaggagguagaggaaggggagaagaaagggacaagggagaggggagggacauuugccccaaggaacaaaggacugcaucuggauagagaggagacaggugguuuccagcacccacacagcagcucucagccaccucuaaucuguguuccagggcaucuggugcccuccuggcuacacccauguuaugaucucacagacaagcagccaugcauagggagggagugaaguccugaacaaaugcaguucugggucacggcguuccuuggcaugagccacccaugucaaggagcaaggccuccaaggcacgugacacuggcaaagccuuccuccucuaggaaaggaaagcccuuccccugguccuggucugaggaggagggauuuacuacuguguguaaaaauuagccaaugcagcuaccuccuggguguuugagccugagacugcucauccacagcuacugagacuagcuaauuucuccuccuugguggcuggacauaauaaacaguuugagguuccugguuguuguaauagguauggcuccaucaaaaugggcacauuccacacaacucuagcuuuucuguguacguguguccauccuugcugccccuacucagguuuccauggccaagccaugcuggggauggcagaugugacgcaaugugugugcacauacuugcaugcauaaaaaguaucuuuucaagguaaauguaugcuuaucuuauuuaacuucucuuauguuuaaguaauuuaaaaguaacuaauuuuuuuaaguuacugagcaaagcauuggucucaucauggcauuuuccaaacaagaauuguuuuuccuccucuuccuucuccccagcccuccuccucuagcucacgcacuuccaccucuaguauucucuuuucugcuuucacacaugugaucaacaauugaacuuuaauaaacacguucucacacaaggcuacacagucaucuuugaauguuacuuuuuuuuuuuauuccuagaaaaaacaacuaccaggugugaauagcuuucagcuuuucguugccuuugugcagugucuguccauaaguguggucugguuuacccuucagcugccaguguggaaggcugcccucccauccuucugguuuagugcgugugcagugaccuccauuccuacuggccucucugaacucauacucgcugucuucuagaucccuuuucucauccuccaguaagugcuucuuaccucccaguuuggcuuggcaaaucucagcacacuaguuucugaguauucuucccacauuuccuuccccaucuuaauagcucucccuagagacucagcaccuaccacgacucacguacuaaauaggcauguugcuuuaucucagguucccugacuuuuuaugucgcuuuauaaguguuugcucuuucuuccaauacuuuaugugcaguuugcacacacaccagccuugcagguuccucuauggaagaguuugauguuucuccagcacuaucaaguacaaucgugucuuccuccucugacagcuaaggaauuagagcugccugacuggcaggucuccuuuuaaagaugaguuccuuccauaauaaaacacacuuuacaccuccacauuuuuaaucugugucaauuauuucuuaaagaagauaccacuguaauaguguguggguuuuagcccagugaaugggauuggcgcucuccgggguuuauguccuucgucauucugcacccuuccugucacuguuuuuccacucacuggguuccugguauaccugccuauccuccucuugucuugggugguacagggaggaagcaggccuuuccuggguugcccugaggagucaguucccuucacuccgguucuucuagaagccacugucugcucagguccugucggagggaaucugacuuuccuuccacuuccugcacuaccgcccagacugccugacaaccuacucaagcccaaaccugaaggccuaggaagcccuccagagacagccauagcugggacagucaguccugggggggcaccuucugacuccaaaaagggucccuagcagauccaagcuaagggccgaaaagggaaacgagacaguagagagcaaauggugauggagaggaaggcguggaggaaaguauuguaaacagauuugugaaacguuucaucugcugcuuggauggugugggacuggaugugaacuguuacucuuccaaacaaaggcaauagugacaacugaagacuaggcguauugugguucccaggagaaaagcagaccccuuccuaaucuguaucuagaacugugagcaggaaaucuggaggcaguggaucaucaccauccaagaguucuuccccaaagcuaucucagaguccccagugcaugcauacugucaagguguuaagcuucuguuguacaaauucugaagcagaugcugugagggccuggcaguguguaagagccaauacugagucccaccaugcuaaguggcuaagcucccugcaucaagacaaaaguuggaaagcuggaggguacucugaguagaacccauggaaauuacauuggacagcacuaacugugaggagcaucuggaaugacaggcagagccucaccaaacccauggcuaucuacuugcccuugguguuuuuaugaaggaagaaugaccgaggcaggggucgcuugggaaaguacuauaugaaugagaggagcuauuuuauugucuuauuuauugguuaaaguuguaagagugggcaaguuagggucuagaccuccaagaacgucugucauugauuaaagacagguaaguggggccagagagauggcucaggguuaaggguacucacugaucucauaggcucaguucucagcacucacguggugacucacagucauccauagguccaguucccgggcaucaacugcuuucuugugaccuccuugggcacuaaguaugcauggugcacauacauacgagcaggcagaguaccuauccacauaaaauaaaucuaaaaugaaaauuuaaaaaaaaguaauuccaaauuuuaauuuugccaguaaaauuuuuuaauuuaaauuagucuuugaauuuucucuuauuucugagaucauuccagucucauuuaaaaauaugcuuugaacauaagcuccugcuugaacauaaggguuagcugccauuuggauccauuuaaagugucacucuguguaaaggggguucuugaaauaucauaacagaaucuaauauuugccaagaguugucuccuucuguuuccccugugauucuucagcaagagcucugugugcgaaguuacagaauugaaauugccaaaguguagcccugauaccauagacacagaaauucuugagaccugcaguaugauuguaauuaggaaaguaaauuucacuuuaaacaccauccggaggcacaacugggaagaaauaauguaguguguuuucaguaacaaagaauagaucaauauuuuaaaaugugauaaauuauagagcccuucccugugucucauaaauauuccaacaagcacauuguuaaagacagaugcugcccugacucgcaggguaguguguuuaaauauaguuauucugcagugucagcacguugcugucuaaugucaggagaagcuuguuauuaaacucuagaauucaauguguuaugcuaaugugcugcugaguccauuuacauuuuauggaacaauuuuauuuguucugcacuugcuggcugccagagaaagugagcucuaguuggugauauuuugaagcuguaacaucagcauccaauuucaggaauucaacuuguaaaucuggaaguugguguuagaugcuaucguuagccacucugugggcccaaaucauagcuugcacgccauuccccaguguaccuucuggaaagccaguuguccucauccaagguuaaguugugacauuuaaguuaagacauuugagaaggaagcuaugaaggcuacaaggaagugcauuuuaaaugacaauagugaugaaaaugcaaacccuccugaaugcagacagcaagaagcaucuuuuauaguugggauguauccuuucuguguccucauccucaguaugugugugcacgugugugugcuuuacaugggugggaugggcugugucugguaguucacagcuuugcuuguaacuucagcacucugugauuucuuccuugcccauauagcaccugcuauucucuuauucugugaagaaacacccuggccuucuucugauucacagcauacacacacacacacauacacacacaccauacacacacacacaccacacaggcgcacgugcacacgcacgcgcacacacacacaugugccgucuuauuuuaaaguacacauauuuuguuucuguuuucaguuaacaggaaguauaugcacuaugggaugguuaaauuuaacuaaaugaagcugcaucagccacugcguaugguggcacacaccuuugaucccagagcuuacaaggcagagaucucgugaauuuaaggauagccuugucuacacagcaaguaauguccaggccagccaguaaugccugggacgacccugucucaaaagaaaugaaccaagaucaccucccaugguuauccuuuuagugaugacaucaucacacacggcauccgugcucugcaguuuucagaauacagugcaccauuauuacuguggucaccauucuugauuagaucuauugauaugcauccuuccaaacuaguaggaaaauaaucuuuaaaaacagccgcacccugacuacccagccucugguaaguguaugcucugguucuaggaaaucuacuucuucuucuuuuuuuuuuaagguuuauuuauuuauuuucuguacaugagugagcugaaaaucuacuucuuaauguuauauauuugauauuguguuucauaugaauuuuaggaucuuuuucuauugcggugaaaaaugucuuugguacuuuggguagggcuugcauugaaccuauggaucacugaugguagagauuguauugaaucuauagaucacuguggguagggcuugcauugaaucuauggaucaugucggguugggguuguauugaaucuauggaucacauuguguagggauugcacguuggguaauaaucuucuaauccaugaacaugagggacuuucauuuauuuguagcccauaccuuaaaaaacucacaauuaauaguuauaugagucuauguagaugggacuuuucuuuguucuggccccaaaccaaguugaucucauuagcaguguccuugaaauucuuuaguggcuacagauauaauuuuuggcauauuuuuuuaaaucuuuuuuguuuuugauucaguuuuauguaccccaaacuggccuugagcucacuguugcagccagaugugaaccgccaagcauaucccacguuugaacaguauauguccacccucauuuauuagauuguuaccuuuagacaguauguggaggaaacaggagugaaaugcaagauaucagaccugacacucuccagaguuuaggagugauagaauuccucugauugacacauaucacugugccauuuaaugucccccaugucguaugguuuaacugucauacugagucucaccugggagggagaagaguauucagccacacauucuaccagaggaacccaucagaaucuucaggaaggccuucaucaaaauaugucagcccuccaguccccagguggagugugccuaacuggcugagauucucugcauguaauuucagauguaacuaguuggaaauaugucauacgcaggauguagaagcaaacuccaagcaaacagacaaaaggaacaaauugauauaauaaugauaauaaugauaaugauaauaaugauaauagaaccaauaauacaaaguccguucauuccucucucucucucucuuucucucucucucucucucucucucucucucucucuuucuuucuuucuuucuuucuuauuucuuucuugugggaauugaaccuaggaccuagagagcaacugcuccaccgucccucuuucuaugugugccagagcuccaauaucggaguuagcauaagcuucuuuccacccacuucacaggacuucuuuuggacauugguggguggagacuagcaaagcucaguugugaggcauggaccacacaggauggaagugucuucuguggguggagaccagcaauguacaguggaggugugggcuucagaggacgggaaugucuuuugcagaugugugccagacaaauuaucaugauucagccucucugaacucauuggaauugaaagccuggguacuaacucugaguacacauaacugucaucuuccaugccuuuaaacuagauggaaggcuucugggguucugacaguuugaagauucaucuuccugcaugcauuggaaucuaaaagucacaaugacaaagacaggugugccuggagguuggauccacaguacucugagaacucuauagccucugggguaaaugagaagccuacgaugaguacuaaggggguucucuguuuauguacagacugcagcggaauauguaaaaucucgacucccagaggcucuuaagcagcaccuucaggauuaugagaaggacaaagaaaacaguguucugaccuaccagaccauccucgagcagcagaucuugucaauugaccgggaaaugcuggaaaaguugacagucuccuaugaugaagcagguacguuacugauacacuccggcccuaccccucccacccccccccaccccccgcagaacucccagaccugggcuaaaucugggcuuuucugaaguagcugauuaaggacaaacaggacucuacgcucuaucagugguuggugagugaaucaaaucccuuuaagcuuuugcucacuguaaauggaguguuucuggcuguugaucagcugcgcugcuauugaucuaaccuucaaaaggcacuucgauuuugaauacuagaugaagaucuuuaccucuagucaucucacagcuauaucugauuuggguaauuuuuuuucuaauaucagagauuguauuuucucaagugguucuugcccagcuccuugagacuuuagcuggaucugggcuuucuuuuccucaacaacuccaauggcaucuguucucuaacaccaccucagacauuugguugacuuuguacucuucaucugguccaaaccacacuucucagggaagccauacucagacuuccuucuuaugccauuauuaucuguuguauagcccaugagcuguagccaauuuuauugaaacugagugcaguauuauuuagacucauugaaaccuuuaguaagaugaaauuuaaggcuggcauguggcucaggugucugguguccugguuuguuuucuaucggugugauaaaauacugaccagaaacugcuugagaaggaaagacuguauuucaucuuacauucccaaguaacaguccaucacugacggcugucuaggcugaggcguggauggaugcugcuuacuggcuugcacaccauggcuugcccagcccgcuguggguuuaguccccagcaccacauaaagcucagagccuuguucaacaaaccagccuguagcauguucagacauguucauaugcuuggccuugaacuuuagagacaaauccucccgugcagaauuaaucagcaagcaguagaaauaaagacaggcuugaggguucuaggguccagguucccagccucuauuuggguggacacucugcuuuucauuucauauaauugagcuaauauuccauuggguuguucuaauaauaaaguaugugauauuugguacugagguccuuagaaaacauaaugaaugccgcaaaugcuuaaggauauauuuggaucuuuccaucucuacagacaaugugaggaguucuuagguccuuuuuauggugggcgggcagguagggcuugggagacagaaaaauuuucaggcucuuuggaaaccuugagaaacugagcaacaucuaugucagucacagcaugaaaucggcuuggcuuuggucauugcugucugucugaacaggguggcaggucugguggagacuggauggacacacauggaugaauaaaugauacugcauuguaaaaccagaaggucacuaccuccuccucuagagcaaaguaagacaggaaaaauaggaaaaaauguugcugcacaguaguaaacuauuacauuguaauaugaaccauccugaauggacgcuaaaggcauccaaaacugugagaucagcaccccacaccgagagccucaucagcaucccacaccgagacccucagcaccccacaccgagacccucagugccccacaccgagacccucagugccccacuggccucugugucucaccuuucuccccaagcugucugagcuuccgcuuucucacaucuuaaauuccacuaucccguaguuaggaagggguggguuauugguuagggauacccuggucucuggagaggucauugcucauccacugcagagcaagcccaagugacuuaguggcacuuaucaccaucuauggcuucuaaacgucuagaauauaauuaauagggggaaauccuucaucauugucuacagcguuggcucagaaccuuucccucuccccugcuccucccuuaaaaaaaaaaucaaagacaaaaaaacugcuuuuccucucauuuaaauacagcaaaauuaaaaccuguuuacuuaaucuaaauauccagcagcuugaaauucagcaaaaaaaaaaaaaaaggcaauaagcaagaacuccgugugcaaauccauacucuacaaguggagacgagggucagucagcucaagguuaucuccggcaacauagggaauuugacacuuagccugagcuauaagauaccuuguuucauaaacgggauaaaaagaaaugcguccauaccaugccacagaacuuagagacaugacaaacacagcagcagcuguccagccucaccuggaaccuaccugucuucagugauguagcccuaaagucaucucuuaucguauuggacaacggcagguccaagcugaagguaucagggcaggaacuguuucacuguaaaauaguugccuguagcugccuaugccagaagggaugggcaaaucuuucugcagccccuauuauaaggauucuagccccacucaagaaggcccugcccuccuggccuggucaccuuacaaguggcaucacugugggaacaguuauucagacucccauggccgucacaggagggcagcuguuucccaauaggcaagcuuuagccucacucuugcugagguuucugcugcgguugucuuuaggcguggcugcaggucugccauaucacgacagcaaaagcacauagcagagugacguugcucucuucauggugcccaggaagcaaagggagacaagauggguccuuagacaaggcauagccccaagguguggccucucauuuucccuggccuucagacaaagccaugaauccauuguuggaucauugcauugauugggucagagccacuauggcccaguuauaaucaucagauacaucagcugaggaccaagcuuucuacacuaaagacaacuucauauccaggucaccacaggauacagaugaagauaagaaaacaacacgugacuguaggacugguuuaggguuguuauuugauaaaaacguggccuucgaaacaaaagauacagauucuguuccuaacucugcugccaagcagauauauggcuucaaguaacuacaccuucauaaaggccacuugccuauagauggacggcaugaauauagucucauggacaccgucuaaguccgacaugauuucucuggucuccucagacugcagaguuuggguagcgguauguucugaggcugcaugugacucgagcuuucuguuugcccucuugccucucccugccgcugucauuugugcugaauaacugaguaaaaggugacauuuccucauggugucuccucaguguuugcccaugaaaaugcagaugauuggugauggacaggaagugacccuggcugcaaguaguaccgauuggggguguggacaggugaaggcgggaggaucggaaggccagccuggacuacuagagacugucucaaaacagcaaaucaaauacugcaagccucuaagcuuuugaaagaaaauguccugagcuccgucauuggugggcgcucacuaaggugguuuagacucuuucauuagcauuugucaaugcuaagcaaaaugcagacuaggaagugaggugugguuuauauuuaaucuaaugcuguguuuauuuaagucagagcacacauccaaguuagcguagagagauuuccaaggaagcaaugacauuaucugugaaaacaauugaaacagcauuuccgacaaucugagaaagcagucggucugcugcugcuccuuaccacaacagucagggcagagaaccuuucugcauauuguuuauuucuaugcuuuauguauuuauguugauugcuuuauugugauuuauguuuauuuacuaugauuuauucucuaugucccuguaugugaccuuacauucuguuuuuaauuguccugugugcuugugcaugaauaaauaaccuauggcucuuugcuaaaaagauacauuaguauggcuuugagugggagggaugguggggagagcagacccauuucuacuugagaguuacugagccuguggcccuaagccuuggggccagagucuggaaacaggaacagagaugacuucuuauccuucaugccugcaggaugccaucuugucccagguuaccuugagacaguuucccagacugcugcuuagaucugcauuucugggcucuguucucagaccagcaaggaccauuauuucuauucuuaguagaucacuagcaaggcagccucgcagugagcccaaggaucagcugcggagcuaagggagucacguggugcaggccaggcaaggcaagaguugagcaggcugugaauuguguuaaccugagcccucugguacacccgggaccugcagauccauuuccaggcagucacucagcuuccgccugggaggugaggacaaagcagccacaauguuucagcgauucuggauggagcugagagcugaccugaagugaaauuacagagaagucucaucaaacacuggugugauuuuuagagaaauagcuuuuaaagggggaggagaaaugugcuguuagcaauuuagaaagucgcugaagggucccccccuguugagacuacuuuacucccuuugaaauggaugauaccugagaguuccuucccugguuuaauugagccauuagugucagaauuaucaguuguccaaaacggaaagccauuuacugucacgggaaggaacugacugcacuuccagaaaaccagacucaggagagugggaauuauuuagggccuuccagguuuucucucagagcauuuuagagagugcaguagcaucccuucacgggaaguuuuucccucugacagacuggcuuucuccauguguuucucaaacagcuccuaagggagggggaaaccauaaggcuuccuuacuuuuaucuuccaucaaucugucucugaguuuaaaagcuuucuucuccucaacuugcugacaggaacuaggggaccuggaaggaaaagaaaaacggagacccauaggggaugcucagaccugacuguacauguguuaccagcuucugauugucugucagugauuuaaaaucugauuuauuuuccuauuuaugauacacuuggguacuauuuuucagucaggcuagcuguacuacuaggaacauucagaggaccauguggcccuucauucaggagauagaguauuugccugugugugugugugugugugugugugugugcgcgcgcgcgcaugcauacgcauguguacaugcaugcaugugugaguguguauuuguguguauguaugugaguguauaugugugugcacucaggguauagaguauuugccugugugugugugugugagugugcaugugugugaguuugugugugagugugcaugugcccucacauguacgauuuucuaugauuguggcaguaggaugccccagaacaccagcuggaagaaacagacaacuaagagaguagaacucuggaggccaguagaugggcagaggaagacgaaauuaaucagaaaaucaugagaacccauaagucuuuugaacuggucagccugaacccugguguaggcugcaucuuauagugggcuuugagcccuacuugcauccucuucgcuucugugauuaggagccauuuccucgcacauacacucuugcccccggccgggccaccaccucccacauuaagcacugcucuccaucuaauuuuaaugaguuugauuagacuguauuaauaugugagcagcauugccucuucgcuuaugaaauucccaaaguagggaaaaaauguaauuucaauugaaucucguuaggaaaaaguggucugauuagggaguuauuaaaagaagaaaaucaauucauauuucucaauuaccuuguaaaaauagaaggcuucaaauccacucugaaaauaugugagugcagauuucauggaaggcaagacaaaaaucuaaaauuucaacagauucugcugagucuaucggaaaccacacguuaacacugaaauuuagaaugucaggaugugacugucaccuccagugauugggacacucgagccacaacucuguuuuucuuucuaaucagguugccauuguuugccacagggaauuagagccgcucccugucucugaagcaguguuugauuagaacuaaggaaaacacauacacaccaaggaaaacacuugcacccugggauuaugucugaguggcugcuaggcagggaugccuuguucgcccucuccuccucucugugccgcugagcuucuguaaccaacauuucauggucuugcugcaaugcuuaggauaaacuucaagguaguccagguuaauagugagcccuuuuucuuuuuaagauuuguuuauuuauuguauguaugugaguacacucuggcucucuucagacacaccagaagaagacauuggauccuauuacagaugguuguaagccaccguaugguugcugagaauagaacccaggaccucuaguagagcggucagugcuaugaauccacuaagccaucucuucagccccaaacacuuuucuuuauagagaaaaacaagauaauuuuuuuuaaaugauaggauuucucauguauggacuguccucuugcuguauggaaggcaaacgaguacucccuuggcugacuuuuaggcucagaaggucuguaaccacaggacuguauugcuguuaaagucaucuguaggaugucgaggucaguccuugggaucuacuuaacgcucgagauuucauuugguaaauugccuugugcggugcacuguuuuccagccaccuucuagugcccagaguaauccaucguguugacuucauuaauuaauguccuuggugcugggcugugcagcuuaggccguuucugguaggauggagagcuuuuauagugcgcauccuugaggaaccccugagugugcucuuaggauuccguagucaucagucugaggggaacuggccaacgaacgacacagagaaauugcuagaagccacuguucaugcaacacaaacauugacuauguagcagucugagcaguggggaaggacaggagagguagaagaauuuugucuaaauggauuacuaaucuuugcggcagugugcaucauuuuuuacaauggccucuucuuugccagagcucaguucauuucauuuaaaaaaaagaaaagaaaagugccacagauuaccuuuuuauuacuuauaacugauguguuuccuagaaguaugauuuuccauaguuaacaauagcaauauuguaaaacagcaaaaucaaagccauaaaaaaaugaaguaaaugugcuaaccacagcgagccgugcauggcggauggcggacuauaccauaacgacuuguuuacuuucuccucagcucuuugucagcgaggguaaaagaggaaccucacaaaucaccaagcucugcuuaauacacaggcuaaagcugguuccugauagagcagcuuuucucucagcaccacacacauucugucacacggucccuuguauguggaacacugagccuguuuucaccugggggucccagaaaaagccuuaaacaaaagaccuuagaguugucuuagugugaucuaggggacaagaguggggacauugccaccaaagcaggaaauggggagcaccugugcaguuggguucccuugacagcggcugccaaagcagggcuacauucuuuggaagcuuauggaucgcacccagggccauugagcuacuuucccacccccacacuggucaagggccacacaugucacucaugucccuuugcucguggcuuggcuaugcuccugugccagguaggucccuuggguuucaguaauuccuaaggaaaaaaagcaaaugauaaugggcucuagaccaauccaaugcaggcccaaaugguucuggugcuauacaguuaauuaaaggucagacaaaaagaaugugagaccauggauaagaagugugccagaccaggacagcagguggagucuuaaaguuucauguaccgaaugcaaaugaauucaucuuauacucauuuccuacuucaaccaucuauaaguuagauagauagaaaacuguuaaguugcaguuuucuuagauuguguguguguguguauaacauguagauauauacaauaaagugcucagugaacgauuaucccgauucccacaugaugaccuaauucagccuuuaaaagccagauagauuguugaaccugcuuccuaggguagugagggcuccuccaggggcagccacgaugaagacaagagguggcaauuuggagcuagggaccucaaucuauguccuuggccauaaaucagaaacacccaaaauguuugggagcuauuauuaaucccaaagaugggaagagagagaccauggaccaaaucaucauggcugaugcuucaucaaggcaagccauuaauauaagccagcaauuuuuauucaugcacacaggcugccgaugccucccauugcguugggguucaagaggucagcaauggauaugaggaagacaaggauuuuuauagcucagggguagggaauuuccaaaucggggauuuggugggcaaaauagcugggauuacaggaguagaacguaagcaugacaagugagucauacugaccuccugaaacaaagucaggauugcaagaugguggcaacaagguagucauagcaacagguagucauagcaacaaaggugcuuauaacagccuuugaaacaaagauuagauuguccuuuccugaaacaggcaguacagaaccauuguaguuaagacuacagguggggcauagcacaaucauaaacaggaaugaaccuagauuuucuuuacuauaagauaacuuuuaagccuaaaauggaagcaggcugguucaucucuauaaucccuagucaaguuucuaaaugauuuuagggcuuccucuuuagauaggguaauguuauaguagcuuugaucagggcucuguagaguuccauuagggaaagcuauuucucuggccuuggugaguggggguagcauuccaaguuagccaagcauaugaguuaauccaggugggccgccccuggaaaggcagauuuugauguuuuaaauggaucagagaguaucuccaugaacucugggugcaacuuucaguauuugacccugcaggugccuuaguggaaguuuuccugcuuucuuuuuuuuggggugggggguuugggguuuuuggguuuuuuuggggggggggguuugagacaggguuucucuguguaguccuggcuguccuggaacucacuuuguagaccaggcuggccucgaacucagaaauccgccugccucugccucccaagugcugggauuaaaggcgugcaccaccacugcccggcucuucuuucuuuuuuuaauuaauuaauugacuuauucacauuacaucccaauaugaaguguucugcuuuuuuucugggcuccuuuugcuguuuuggagggggugaaaaaaaaaagucugacugugugugcuguacuuuucaccccagugcagcugccuguccucauggucaccugcuugucaccaguucccugcagaagcuuuuucuuuaaggagagagcaaggacaguucccaccugcgggaugacagcaagaggcggcggcggcuggggguuacacagagccuucccuaccuucuagaaacugcucgguccguugcuagguuuaaacaguuguuuugaggaagacaccucuugagagaaugcguguggguuuuacuuucaggauuugcuuucccaacgguaagaaaugcaaccugagauuuagcacaaaaaagcaagagaaaaaggaaauggcuugccgggguugagacuugagcuuugcgcucaguggccagcguuugaggaucuugacccacacugaguagaaccccauccccuugccuuugcagaccagguuugugccuucaacucacaccugagcaugcaugggggcguuuagacaaaacaacuuaguccguggcugcaucacuagaaugacucucccucucucccccaguaaucuuuacuuaacugccuguaacuucucagggaggggugaggcuuugugaacccuuccccauuccugagcgauuccccacaccagcucuugugaaggcaaguucacauaacugccaaguucgugaucgcaacaguugucuagucaagauuuaagacaguggacccuuuucccccuaagugucggggcucacuucuucauccucucaucuuccucuacccaccucccuuacauuccuucggcuuuugggaauggugcagaugucuccuguagggcuaagcaccgaauaaucauuuaaucucaucucccauuaugggucucugcauuuacuaccacuuauuacaaaaagaaauuucucaauucaaagcugaggacaucacuaaucuuaaagguaagaacauaaauauuagaaaaugauuugacaacauagccauucagcaaaccccacuuugucccuacugcaggucccuagccacagucuuuugauccaaguuuauggugccaggcaugaugucccucugggacaguccacucaaguccaauugaaaagugguuggcuaucccauagcagucgcuaacuucugugccauuggacacaaccuggcuguuagguuggcauuguauguccacagcugguaagguuuuaguuggccuuucucccccagagcuaugaaagauuagccaacagggaggaagcuucaagcucaguucuaacuuagcuuaugucaaauguacacauacacuuacacacacagacacacacacacacacacacacagagauagacaagccauaaaaguuggagcugaguuguuagggaagggaguucagugguaguacaagcgacuaagaacaaugagguaaauauaaucaaauuguuauguaugagacuguggaagaauaaauaaguagauuuuuuaaagucacaucugaaagaguaugacccagauagagugcacacaguuccaaggucagccucagaauacaauuagaugugugcauguuuucucuauuuucuggaaugcuuugcuaguaacuuccaaccucuuugguugacucugcuuccuuauaagccugccccuggagggaaaucagucuuacacagccaccaaagaagaugcacuuagcuaaaaauaguugccuuuugacaagguuuugggagauuuucuuuuaauaugaaaguuacauaaaauggaacgaggucagauaugacagcuguggucagagcauccucucuggaaaugccugacuagcucacuaugcugaucacuaguucacaauggcugcuuugaagcugugcugaacuuggggccuuuccuaugucuaaguagguggguacccggggcauucugugcauuggugaucaagccucugcccacuggagagccaucuggagccuacugccucccacuggcuagagacucuguuggccuggguuucaguuaggaguuguuuucuaaccaugacuaauaaaguagauuuacucuacaacagccuuuccuuuauaaaauggcugcuuuagcaagggaaauuuccauaggacaucucauaguaucugaggcaucuguacugugggagugggagggaaguuggugguaucugacuggcagaaucucaggaugccacuaaacacuguaaaauguacagguuagcuccucccucaccuucccccagcaaaauuuaucugaccaaaaugucauggucacuaagauugaaaaccuacauuagagccacaguuccguguggcauauuggagucaccuuggaggagcaucgguugcugaucuuagacagcacugagaacaacuaagucauuucugagcagugggaccccagcagcuguagucuuccaucuucccacaucuucagccaagaauaagauaugcuauuuuaagacauccuuuuuugucuuaaagaaaaggcuaguuuggacaucaccacaaauacuucugcucacuaaagcauguggaaaaacucgauauggaggggcuuggccuguugggaggugucccaucaccauggugaaaucacauaaauuguaggagucauuucugccuuuugaaggcugugcucacagccuuaaaacagccauucuuggugcuguauugagaauuuguuccccuuaguucgugcuuucucccuccaauaaauagagacagcaaguauuuauuaguagcugucuucaguaaaguuuccccacaaaugguugguguauuggaacacugguaauuuguuucccuugaagguuuguaaaguaucauuaucacuuggugaugaagugucauuauuugucuacuuaucuguauugcuaugccuugcaaaaugccuaacacauucucacuaagauuuuagucaauguuuucccccauaaguuccuuuaucaacuauucccucacucuaaaaaaaucagcucuuaaaacucagucaaucugaacuccaaauucuccagguguuauugauauaucauuuuaauguuuuguuuuuguuuuuauuuuggguuuuggguuuuuuuggauguugaugugcaugguacagauucucagagagaucagaaaaccuaugacauacucaauccuucugauaggguuaaaggaacaauauuuaaugaaaagucuuccaucuauaagaccagagcaugccuauuuuguaccaugagcugcccuccccugugucugccucaaagcaucacuguaaagcagguugucccauccucgaagccaucuaagucuuugaagacacugagugagauggagccagacacuguguggcucaucagccugcuuguaugacuggugcucacaggccucucuggggaugugauaguuuagauauagucgggccuucaaagguuuccauccuggaagcuugcuuuccaguaugacuguguucaaaugguagaaccuuuaagagguggggccuacuugaaaauaacugaucaguuaucuucaccgacuaugaaauuacucaaaaaaaaaaaaaaacaaaacccugcugaugugacaaggccggcucauacagagagaacagucauuauggcugacugugcaucucugccauagucauuacugcuguaggacugaggcacuguggcaugggagaggaccaauuccauaccaccauccuggcaucccuuaggcaacuuaagaaugggcagguuugguugcaguaggaaacagcacucaaguuguguacagucaugugaugguuauaugaccccuuagaauauaccugaucauagggaugacacccaucaaauuaucagcagauuuuuuuuuagaagagcugaauaaacaauucaaggaaaggcugaacuugauaaggaucuaaucaggucauccuuggaaacauacaaacuuguaggggucuucauucugccauuuaugggauuuaauguuccagucacuaccaugucacaaacgaccccagagggguagccauuuucucauguugcauguggauucuguaagucuugguuauccuucuugggccucuucuaggaagaccaguucauauuaacaccuuggcuagaagggugaaacaaacuggacuucacagugucucuuggucagagcugccugcacauggucuguuagcagagacaccaaaugacagaugcugugugugaggaaaugguguuuugagaagcacuguccuaauccuaacugguaaaaaucacauggcaguuucagacagggccuaggagugccuucuguccaguguuacuguuagaaauggucacaguccugccuagacuugaggagagggaacugaggcugcaucucuuugaaggaggagugucaaagaauuuguagcuacuuuuuaaaaguuguuacaguaaguagccuaucugcuucucuucuuaaagcagaaucuagucugcucagcguccucccuggcuggucccucugauccuuaccugucauguccagggaaaagauaacaaacucaguagaauguuccugucuuuacucuggaaaagucagauccucagaggucaugcauggcgaagaaucaaugugaccuccagugucgacccugaggagugggaucucagucacugucuuccucaaaugguucugugagcaaccugggccagagagaggggguggggaggugauggaaacacacgggcaggcucuaaagcacagaugcugccgagagccuggcauuugucuuacugacauuucuaugucauccacaggaaguggggacguccacagaggagcaggaguacucagguuagggagcuacugaaugauuucagaaaauacacuuuguucuuaaaaugagaccaguuuugaccuugcgcagagcgugugugugugugugugugugugugugugugugugugagagagagagagagagagagagagagagagagagagagaaagagagagggagggagaagagagagagagagggagggauaggagagagagagggagggagagggagagacagagagagagggagaggagagagagagggagaggagagagagagggagggagggagagggagagacagagagagagacagagagagagagagagagagagagagagagagagaaccccugcacagcugcagauuugcaccucuccaagcagauuuuaaaccucggcuuuccuuggccuccagucugucgauccuggucaauaaaucaccauguugaauaaagcaccuuuuccucucugaguucugcagcugcuugacugauccgcucagcuuugcugagcauccugaggcagcaagcaaugggaaaacacgguucugcuaagagugggauugcuccuagaccaaaggcaagaaagaaauggaauguuuucuucucuucccuuucugcucggggcacucauucacggugaaguuacgugacuuucucggggucucagagaacuugcuaggaugggauaaccugcuuugacucucaaagcuuuccugggagccgaugcuccaggcacugcucggguuggauguaacacugcaguuagccaaagaugucucuaugauugguuuuguuuuuuuuuuccugccugagaagagaagagaccagcgagcgugugaucuuaugagcagguucugcgugugucacucaggagcagcagagguucagggcugugacgcuucagaaaucaggaccuuccauuagaagaagcagggaaggggcuggugagauggcucaguggguguucuuccaaagguccagaguucaaaucccagcaaccacaugguggcuuacaaccauccauaaugagaucugacgcccucuucuggugugucugaagauagcuacaguguacuuacauauaauaaauaauaaaaaaaaaaaaagaagaagaagcagggaaggcgugacucuguggcaagauggcacuauagccauuugauaugagacccaguguguugauuaaagugaauguuguuacucccuggccagaaaagaaaucaggaagcagacugaaacaaacccuagaaucccuuggaaaguugggcagccaaaguauaaggauguucugacacccacccauuuucccuuuccugucuuuaauuuuuacaguagcauguccuauaaaagcacacgggauacuugcccuauauuaacuuccuuugcauuggaaaguuuucaggaaaaaaaucuugugcuucucuuugcucugucaauaaccuaaugccauaauucugaccuguauauaaucaucacucucuuaaaauuuauuuuuuacauauucacuuuaaauccugcucacugcccccucccacaauucuucccccauccuccuucuccuucucuucugagcaguuggggacccaccugggugucuuccuacccuaacacaucacgucucuguggggcuaggagaguccucucccacuaaggccagauaaggcagcccagcuagaagaacauacccuacaaacugggaagagcuugugggacaacccuugcuccaguuguucaggacccacaugaagaccaaggagcacaucugcuacauguggacagggaagccuagguauguuuuuuggucgguccccuucgaggcugagauccuucccccaacucuuccauaagauugucaggcuccauccacucuuuggcugugagucucugcauucuucucaacacuuuuguuuuuaauaauauuuuuacauaacauccauacacacagagagacacagagagauugagacacacagacagagagagaaacagaaacagagacucuaacauaggauuacaucaacaacaguguggacuagguuacuggcauuggccuuccuggaaagcgacucguauaaccacuccuuaagaacuuuaccaucccuagaacuuucugccauuuucucugaguuuagaacuugggauaaggugagcuaauuagcaaggucauagaccacauccuaacuggcagggaagcugagaaggugaguauguagacuugucagugucugucgaaggagguguauucugccuccuccuaguuauuaagaugguaagaacugucccuccccagugugcugucuggccacuggaggugacgucagguuucuuaccugguggaaggguacagauggugcugcugcaggugacuguggacuguaacguggaaagcugugugcugggccccuagccagugcuggauaugccuguugaaaugugucauaaagaaugcugguguuucuaguguuucuacuuaccagguaccaagugggcuagccucaugacuuacugucuucauaaggguagccucaggucuaggcaagaccuaaaacacuggauguugguagcuggguucauccuggcuuuaaaauucuuuugaagggaaaacaucaguugaaugagcaggaagguuaucuugcugguuucuuuuucuauauuauauauugcuuguuugcuucuaggcuaagaagaaugcccuguuguugacaaucucaaaauaaaauugugugugugucauaaagagccuaccagcacuuagagcagccaagaaccgugccaagcagaaaucagguuuucaaaguauauuacagaauguauuugcaaacuagaaggcagguaauuuguagcugaacggcccuguuauacaaauuccuuuguagcucuuccauucaaaacaaguaaccguuauugggaaaaugucucugucauaaaaacauuuccacauuacaguuucuaccuugcaaacagcagaagggaaagugcuucaaacagccagaccccgugguugagcacgcuggaccgauuuucaccugagacucgcuauuccaguuguuuauagauaacaucuguucuaauuauucagcaucugugccuugcuaguugauaauauuuuuauuaucaccucgacuagaguguguauuuauuugccaaauaccaaaaaaguauauucaagauaauagaacaagaacaaaaaccuggaagugcuuuccucucgccuggcuguucgcauucucuccgucgugucucucuuccucuuggcuccuuuuuuuccccccccuuuuguagcaaaucauaaaggugacuguugucaccuucaucagggucauugaauucaaaggaaacuuucugaaggagauuucuuuugacaagcuucuuucaagagaugucuggggaggcuugaaaaaccggccugacuucucaggaaauugaaauaaauagagacauuaacagucugagaaagucugcucaaagucauucgcuuaaugucaauuuuugugaaacaagaauuaguauuggccauuaagcgaucacacuacaaggcagguguuguguauaacuguuaggaaggacaguaauaugauacuagcacagcccaguaucugaccggaaagucaccuuacaauugucuagauuuacauugagcuaggaagaaagaauagcuucuuaauaaagagcucaaguagugaauuaauggauucugguuuuguauuaguugcacauggaggaacagaugccaugguguacgugccagagucagaggaccacggcugggagcuggugcucuccugcaccacguggguggguucccgggauuaacucaggucaacggguuguugccgugccuuugcccucugagucaccuugucaguccacaaaguucugcuuuuauaaguugcaaaggcugcuugugaaagccaccaugucucucaggaaaggccucaccaauguagguucagcgugugggaacgcuaacgaugguuuguuucuaagcacaugccacguuccacgugacugcucuucccugaguccuuacagccacccuguggagaaggaucagcaaguccaccuuuguaguugaggagacuggggcauggaaaaguuuggugacccucucaaggccaugauacaugaaaauaggcaaaccgguuuccacaacaguuggccugguucuagaguguguaaucuccaaaggcugaaagccagcuugugauuguacuuggugaaccacggcucacugugcuaaucugccuuggccuuguaacguguuugugaaucugaguaacugaagcaugaggagaaggaccccugaaaccagcccuugcuccccgcuucacguguguuggacuuugcucuccagugucuucccuuugcuguguccauggucucugcuucugcuucugaggagaccgcugccugggugggccuaaucauuugcuuagaagcaucuaccguaagguucccacucugauuacaaaugaaauaccagccuauaauucccugaguucagcugagaucacuuagugaccuuuauaagccccguuuacaauaccagccucuccgcagaagcagauguaucuugaaucaguuuuguuguguucaacuucaaaaacaaacaggaggacauaccuuuggcucccuagaaguaccauucccagaauccagugacggugugcaguggcuuccauagcuugccuauuuguauuuauggacuggcugacagguauuuuuccugccgagacuaaaauauuccaaaauaggaacugucacgccccuucccauccaagguucuggcacauuccgcagauccagcaagugcuugcuaucugagcagaugguugaauaaacagguugcagaaaggaauggcuuuuugcaaguucuguuuggacuccaccauuuuaugaugcuggagagacacuggaaugcacaugcgcuuucuguagugaaugagaagucaagauucagaaacuggagcucagaccugcagcuacuuauucccagugacgaauucgaagucgacgacguaauucaagauaggucuuaaagagaagcagcguugaaagacagaagccaagcaugagccuaaaggacacacacaaagcacaagaaccugguuccgcaaaggcgggcagggcggagcuagagacacaauccggcagcauuccggacguggagaagaaagugcaguuuuauguuacuaaaaugacaaacaaagcacacacuuguaagcaaggucaaauaucagaguguccaaagauaauaagggggaaagccaaagaauugggaggggacaguuuuuaugugguuugguuucguuugguuuggagacagguucucacuauguagcucugacuggccugggacuccgagaugccucugccuccugacugugagaucaaaggcgugugccacuagagcuguccucuuaggcuuggccucuuaaaauuacguuuuugguggagugauucuuuuuuuuuuuuuuuuucguguaugacuuauuuguauugauguuuuccuaauuauugaagcuaccugggucauucucccaauauccacgccuguaucuugaguugauuuucccaugguuugcuuguuuguuuuuuacuuauuuuuauguaugcgaguauacuauugcuucuuaaaacacuccagaagagggcaucggaucccauuacaaaugguugugagccaccauguaguugcugggaauugaacucaggaccacuuggagagcagucagugcucuuaaccacugagccaucucuccagcccaacuuuccccauguucucgucuaacaguuucagagugcugggucuuagguaaagucuguggugccuuuugaauucauuucaugcaggguaagggauagggauacagccuuguacacgugaauagugaauauucacuuucugagccccauguauuaaggaggccguugacagcaggguucccaccaaagcagcugucuaggugggguuacuauaucucagagcaggagugcugcagagagagcuuagucgucugcguguuaugucugggaugcagguaguguaagucaguccuguguuauaggagucuggagcucagcagaaaaugaaaaguuuggaaaucuauguauacaugauauuuaaacucaguagacuggaucccacaagccccuuagaaaaugugauugacaaagguucuguggacugaacccuaggaugccacucaacggugggauaauacaggugaggccacauaguaaagaaguagccagugccaguuguauaggagacuguggucucagaaaguaugcaucugggccagcaagaugguucagcggcugaaagugcuuacuuacugccaggccugauggauccaggcuugccaaguuugauucccaagagguacauggcggagggagagaaugaaguuguccucagacucacacauacaugcuguagaacacacgcacagauauacaauauuguaaaaguuauguaauaaauguaaaacaagugcauuggcaauugaaucuuggaugaucaagugacacuuggguuagucggugcuaauagcuuuucuccaggcagcugccaggguaauuuuucuccugguuccacaaaugcuaaugagcuugggguugugaguucuaagaccagugagcuauaaguuugcccauggugucuucuccacagaaguuuucgguauuuuuccucuuuuuggaauggcucaacagcuacuguguaagguuacguaugcaaaguuuaaaacuaagaugcaguuaccuccaaguaccugacuacauguuagcccgugacuacauguuagcccgugccagcgaaaugugcaggacuuguuuuucaauaggaugccagguggcuagacuuagacuccgucuuccuggcuaugugaucuuccccgccucugcccaucccucacuccccccgguagugaauggcauccuugcuucagcauccucugagacucagaugacccuguugguugccgggacccuauuggcuuuucuugcuacagcacagcccuguacccagucgccacaaauucgucuugagucggaaaugaggcccucucuauagacuguccuuuucuauuccuuccaaggggcccuuuuaaaaauauuaccagacgguaauaaaagcaaagccuaaugccauguacaagauguauguccuacacggaaacccuuuauucucucaaggcaaacauauugccucacucuggccucuucguuaagcacaggaagcaacgcucugugagucaugauuuccuaaaaguauauuacagaaaauguucaauucagugugucauuuuccgggaguaauugcuucuaacaccaacucccaaauggaaaauauucacggccuuuguuuuuaaugucuggauucucuaauucagggagccuaucgauacugccagcucauaaagccagaugccauuuuccucugcgaagucgagacuuuucauaauaauagaagcgaauguaagcacugccucucccuccucccugaucucgccuucacucucuggucaugaugucuguagaucacgucuggaaggugaugcuuguacgugcugccuucuaugcagcuggaaucguuccauuacccauggaggacaucagucugcccaucuuuccuuggugaacggauaaucacgucuguauacaggagcuggcagggaagagaacaguuaggcucaaaaggucacagguguaaauuaggaacccgccagccuucugggugugcguauacgacggaugcaguuagcaggaguggggguggugaggagagcgugagagcaucuuuaaguaaauucuuaggcaucuuccuggagacaugcauuaaaagcaacccaugcucguuguacauugucugcguuuagugagucauacaugcugcuccccagguuuucgcaguucaucccuacuguccgccagugucuucucugcaggauagugcuggugaucauuccuucacuacccuguccuccagccagcuagagagccgagcagugguuuauaggcaccucaagaagguucacggucagacacgugagugugcuacugcgguguaccaggccgcccucaacccucccugccagggacuagaugcaguccaguuguaaccaaaaccaucugucugaugugaucugaaaucccaaagacgauuucccagcaguuggguucccuucacuccugugcugccugaguugaccagaagaugcgugccgaaucuccaagcugguccuaacuugccugcuccagcuggcucacgaaucaaauccccugaguuagcucaagcaccagccaccugggaccugucuccagacaaaggcucucuucuggcccaguggagcugcagcgaggccuucuguuuccuagcagagcagacacuuuagcuccugcugaggcuuuuggcacaacuggguguuuuguuucuccggcuguuuuacuuugcaguggaagucaguuuacaggcaccucaacagccuauaagcuguuguuuggacuggacuggcuaauaacagcagcucggugugugcaggcagccgccaugccaaauaggguucugcauagaacuugggggaaaaaaacaaaaaaaacauuuuuaggaugagaggagaugaacaucacccagccuacgccuugccuuuugauuuugugucuuguggaaauggucccugccuuaaagaguaaagaauacccacaauucccagcuuaggggacacccuacggaagaagccuuguggucugaaacaguccuguuguccuacugucgccuuaauugguggcaggucaccaagagaaacuguuauaucaguauggcauuuggccucaugaaauacauugcaagucauugucccguuuuuguuuguuuguuuuguuuuguuuucuuaaucaggaguuugugcaaaucgggaaacgggcuacagaugccucaccaacacugucauugcuuugacuggagaacucugggugauugauuaaaaaaaggaaugcuggucccccagcuaguugaccguguuaaacuguggucucuguuuuaaauauuuuauuugguauugggugguauuauauuguaagagaggcccaucguauuuccccaagaaauuuauagucuuggggacaaagcagcuauucaaacaaauaauucuacuauauugugauaaguugucucugauauuucuaaauuaggucaguggugaaugaugaugcucuaaccaagauacaggaugcugaggaaggaaaagguggcgugagggaaagagaugggggaggggcucaacuggguuucaggugcucucggggcaccuagaacgaacguaguaucuaaaaggcaguucuagacagagaccaugaggcaggagaggaacugcuucuggcagaagaauuuuauuuuaugauaccuauacuagagggccacauagaauacaaacacuguggugggaagaugguauaaacaccaggaagagaccacuggccggacaaagauccaggcaagucagccuucagagagugccuuucuuccuuccuguuuuacacugggucucauauaaccauguccaugguuggaaauuuuucuaagaguaaccaggagacauuaaaagaccacuugaccauggguugggcuucaucucaggagagauuguuuggucuucuaugcucugggaagaagauauuugaaauauugccagaacuaaccacacugcauucugguuuuuucucuuguguauaguugucuuaacgauuaugaaugagccugucugaaacacuucgccuucacugguacuuguugcugggaacaaacuuguaaaaugucucauuuuaaaguuagagacgauucacggucuucauuuuggugugucacuucuuggaaaggaaaagagagaucaaaguauauucucauucaucauaagagugaaauucuuucccacaugauuaaagucuauuucaaacaggcucuucuggcaugugcuuguuguauuaguugguuuccuauugcugugauaaaacaccaguuaccaagacaacuuaucaaagaagaaauguauuugagauugugauaccaggaguuuggaguccaugauggcagagcagaggcauggggccuagagcuggaagcugagagcucccaucuugaacaccaagcagggggcagggagagcaaacugaaaauggcaugagccuuuagcgucucaaaggcuccuucagugacauaccuccugcaacaaggccaugccucccgagccuccacaaauagcacagucauuguuguuuugaaugacaauggcucccauaggcucauacauuugaaugcugagucaucagggaguggcagugcuugagaaggauuaggaggcguggccuuguugaaauagguaugaccuugauggagggcaugugucacugggagugggcuuugagguuucaaaagcucaagccaggcccagugucacucuuguccuauugucuguggaccaagaugugaaacugucagcuacuucuucagcaccauaucugucucugugccaccaugcuccccaccaugacgauaauggacuaaauaaacccuugaaacuuguaaggaagacccaauuaagugcuucccuuuauaggagcuaaaguggucaugaugucucuugacaacuauagaacauuaagacagggaccaagucuaaaugccugggacucuggggcacaucucauucaaaugaacacacuuguaaucccaguguugcggaggcugaagcagggaucugauucuuaaaggcagcauugccgguguagugaugcucuguaaaaagcaacaaacaacagcaaaacuaaacagcaaagaacaucuuaacgcuauugccagggugaauugaaaaaaaaaaauagaaugccacagaaugcaaaaauaaaacaaaaaaacaaauuucauuuuggaacagagacucugagcucaucaaccuaccuguucaugcaaaguuaacacuauuuacuuccucaccuaauuuccuguucuccaaagaucuccaagucuucaggaccuagcugaaagagcuugguacuagcucuagguuguucuacccucagaaggaagggcccuugugccaauuguguucaggucuacuaacccugagcuuugaugugagacugaagauuucaguaguaaaggccauuugcugacauccucuuccauggccuauuuguccuugauaugaaagugcuaacccgacuguagaaaaagaaauggcauaacagcuugccaggccuagggcaguugcugucugcugcuaaggccuccacugcagaugaaaagcaaacaaacagaaaaagaaugcgagaaaagaacugaacaugagucggcuacagcuucauacaucaacgcuguuacauccaauuggccgcauugauuaaacuauaaggaaaacaaggagacaguggccaccaguacugcacgauucuguggcugggucaccgucaucacggcuggugaacugugccggguucaugcgguuuugaaacucgagguuuaugucagaccucaguauucuuaauaggaaaagacagaagaaauguauagaggcauuucacaccacacagucuccaggcugcuacccagggucccacugcacuuguucccccauugagcacuucuguuccuuuuccuuugagacagggucucuuugcauagcuguccuaggcucacuuuguagaucaggcuggccuugaauucucagagcugcuucugauucccaagugcuaggauugaagucaggcaccaccuugccugcucacuugugggcuuccauaaaugaguuuguauauucaugaccuacagucagagaaauauccucuauauacuuuuauuuacuaugggcauaugcauuacagugcaugucuggaagucagaacaaguugcuggagucgauucucuccuuggaccuugggguccccaaggauugagcucaggucaucagguuuagggguuuggugccuuuagcuccauuauccaguccauuauccagcuauuuuucugaccccaagaaacacccauuuaaugaauaauaauggucugaaguaacuacaaaagaaaaaucuacaugcuugccauuaaaguagugaauuaugcugucugaagaacaggauggggcaggaaccccaugaucacuuuacauuuugugagacuccugcucuagauggcuuugaagcugcggugucaucagauggccaguugcuuaggaauggaagacaguagcugcuagucacagggacagccaaagacaucaagaagcccauuucugccaacacccugagcgaacuuggaagaggcucugcugccauuucugucucuuuggaaggcuaagcagaggcccuggcacagcugggcccagauucccagugcucgggagaguaaaucugggcugugugaagcuguuaguuuugcaguaaguuguugugcaauagacuugguuauuuucauuuguuaugccacagcuaugacucugcugccagccuggcucuggccuaugcuuccuccccuccuacaguuuccaugccaugauccucuucugggucuggacugguguugcuacccucucauaauaaaaagaaggcugcugcugaugguuuaaauuccuacuuuuccccaacaaaagcagggccugguggacuacuaugauuguaacaguaggugauauaaaacaugaguguccccgccuugauauuguacagucacuguguuggccacaacuacaaagaugaaaugcaauacagacuagggcacagcucuugcccacggcucugcucuccagacagucagcugaacuguggaagaaggcagaacuucuuuccccggggccacacgcccacucuuuccaugguuuccucucguaaauaaccguguguagauaagcucuuugcuuacagucagguggauucacuauuuaaauaaugaaauuaccuuucagaaauggcacacuucuuuuuuaaccgauuuaugagucaguccuuagaaagcaacagcaaggaagccaauucuaguuuuagaucuucauuucccucuaaguuugagucaggcugccccugacuuccuguguuucaugucccaagcacacuauuauuugccccaguagcuggugaauaugucuuuagaaacaccauccugagacauccagaauggcaggagugcagagcagccguuuguugugaugccugcagcuguuuccggguggugcuuccagaguucuguaauuagagcacuuuccgcuuguaccauggcccucgucugaaaauggccaugucgaacagaaugcaaaaaucugcuuucauggcggguuugguucuacggugagcucuguacaccugggccauuuuaaccaaagauaaaauuagaggaauuugaugaaaaugaguuguagucaucaaaaggaauuuguuuaugcugccuagauuuuucaaauaaaaauagaguacuagccaaauccaucagucacagcugaagaaaugcaggccaagaagcauuaaaucucugcucaucuaaaucccaacacugaaguuguucacuuagcacuacaguugaaaacaaaaacaaaauguacacaagugcaugugcauguguguguguguguguguguguguguguguguaugugugugugugcgccugugguguguaugugccuguggugugugugugugcauguguaugugcauguaguauguguguauguguacauauguauguauaugugcaugugguauguguguauguguguauguguguauauauguguguaugugugcauguuuagaagcugugcaagaaaacauguugguuuuuuaccugaaagccgauuuuuaucacugccccuuuaacaguguucagaaaugaauacuugauguucuugugaagggaacaaucagaagguaaaaauccucccaaaguguuguuccuuuccugacucugcuaugugagacuucauagaaagggcuucuuguauggggcccuuuugcuucauuucacauugaucauuugccacccugauuuccauuguggaugcucgaguugugguucagcagucuucuccauucuucucuauucagcuaaaguuggauagaugugaccaugcuuacuguacaugcagagaccagauuggggguagagagaggcagccucuguguaagagggcuaguggcauuagggugacuagucacaugagcuaugcaaagaaagaaugauguuguuuguuuguuuguuuguuuguuuuuuuaaaaagagcucccagacucauugcuaugaugauaacuucucacugacaagauugucucucccaaagcauugccuuuucuaacggaacauguagaugucugacuugugcuucacgaggauaauuuaaaguuucaggaguuauuagagaaaucagaacugcacauccuugggugauugcauguacaaauuggguuucauggaucuuuggugggguugacaaaauaauuauuuuaaugaaacugguacagacauuguccacuuaaaaucuauguccaaugaccaaaaacaauacaaauaaaagugaaaauacgcauugcuuucuuauauacacucuaguacaauuuuauuaacugcuaaugaaguuuagaauccuccugggaucgucgcacaggauuguuagaacgucuuuggggaaguuuaauaggaauggcucccauccuuccagucacuugaaauguguccucauguuuacauugaugguaaucucacugcuaccccauccagugacuuuuagacucauguauccuucuuuccuuccuucuuuccuuccauuaccaccaaguccuccuggguggacuguagugagguuggcuucacccaggagucucagaacagcagccaccuuuagaaacagaaccauauucuaggguuuacaauuuagucucccuuucccagagcacaacacuagagcuccaggaacuucacuaugcuuuaugucauuuaacuccacaaagaagagaugggaaagacuacaaaucagagaguagauagauagaccaauagauaaaugaauaaguaggcagagugaccgaugaacagauagaucgagagguagauagaagauagguaaguauguagguggauagaucgauaauagauaguuaguuuguagguaagucacuagggggacagguauaaauauguuuuuaaaaguauauaguucucaaagcauagcauuuauggcuuuagaguauacagucaguggcucaugauauauuuccaaaguugagcaauugucaucacuauuuaauuacagaaugucuucaucaccccucuaagagaccgcucucuagcagucacuccuucuuuucuuggcuuuguacuccaagauccaagcaaugauaacuacucuguuccccuuuucugauugccuacacuggccacuauuuuagugugaguguaaacaaacaguaugugaucugcugugacucaucccuuucauuugaugugaugucuuccagauugcugggcuaugugugcucuaguucuuggaacagccagcuaugucccauuguauggggaaugccaaguuuaguuaucugcuuuaucagccaauagacauuugaauuguuucuauuugaagcuuuugagcuuuuuauacaguauuacauggguuuuacaaggacauaucccccaccuccuuuggguuuuuuuuuuuuuuuguauuuuaauuuaguauuuuuauuuugaauuuuaauucaaaaaagauuuauaaaaauauuaaauuaaaguuuaaugaaacaaaucuguuuucuugguguuuuaauuauagacacuuuugaugguguguauauuauaauuucaauuuaucaaaagcaaugauacuuuucuuaauagaaaaauauuucuauguuaauauauuaguaacuuaaaaauuauacacauauuaagugugcauuuuuuaauuggguauuuauuucauuuacauuuccaaugcuaucccaaaagucccccacacucucucccacccacucccccacccacccacucccacuucuuggcccuggcauuccccuguacugaggcauauaaaauuugcaggacuaaugggccucucuuuccacugauggccgacuaggccaucuucugguucauaugcagauagagacacgagcuccggggggguacugguuaguucauauuguuguuccaccuauaggacugcagaucccuucugcuccuuggguacuuucucuaguuccuccauugggggcccugugauccauccaauagcugacugugagcuuccacuucuguguuugccaggccccggcauaaucucacaagagacagucauaucuggguccuuucagcaaaaucuugcuaguguaugcaauggugucagcguuugaaaacugauuauggaauggaucccggauauggcagucucuagaugguccauccuuucgucucagcuccaaacuuugccucuguaacuccuuccauggguguuuuguucccaauucuaaggggcaaaguguccacacuuggucuucguucuucuugaguuucaugcguuuagcaaauuguaucuuauaucuuggguauucuaaguuucugggcuaauauccacuuaucagugaguacauauugugugaguucuuuugugauuggguuaccucacucaggaugaugcccuccagguccauccauuugccuaggaauuucauaaauucauucuuuuuaauagcugaguaguacuccauuguguaaauguaccauauuuucuguauccauuccucuguugaggggcaucuggguucuuuccagcuucuggcuauuauaaauaaggcuacuaugaacauaguagagcauguguccuucuuaucgguuggaacaucuucuggauauauucccaggagagguauugugggauccucugguagcauuauguccaauuuucugaguaauugguuuuucaagaaaaaguuucucuauauaucccuggauaucuuguaacuuacucuguagaccaggcuaaccucaaaugcagagauuccccugccucugccucugccucugccucugccucugccucugccucugccucugccucugccucugccucugccucugccucugccucugccucugccucugccucugccucugccugagugcuggaguuaaaggcguguaucaccaccgccugacuugugaauaaauauuuuuauuucucuugguuauaaauauaaggcugcaacugcuuagucuuauguuaacuaaagcuuuuugaggaaauccuagauuguuuuccaaagugauuguaaaaaugaugccgauggccagcaguccugcuuuaacauguuggcucugcugccccaccaccuguccccugcaugguuucuggugacaaacugacauugacugcuaccuuucugaggauuccuuauacaugugcugaauugcuucucuuucagcuuuuggucuuuaacauuuguuuaugagaugucuuagcuuugaguuuacucuacuuggagaucguggagcuucggagagguacugauuccuucuuucuccuuccugagucaucucagcacacccaucuucacauuugcugagucuucuacauccucucagacgcuugugaucccuucuuuuggaaauuugguuucguuaacugugagucacuucugucagaguguuuuaucacagcaacaaaaaaggaaacuaaggggccauguacggacacuguucuucuucgaauccucuuccuugauuuguuuucucucuuaccauccagcugaacuguuaguaacugcuacuauuauuuccagccagugccccgaggagagcaguuuucuccugagacagcucugaguuaaaugaaauuaaaauaaagugggucuuuuccaggcgcuccaaacagauuaggcagauacaguuuuccagagggguugaguucuuugggggauuucaaaacuguucugccuuucuggcaggacaucauuucugauaaccaccaagauuuaaagcugcuugccuucaagccugcugcagagcuagcuagcugccugaagagcaagggaugcugguaaacuaaagaacugcaaauuucauucucggaccaagaguuugccuuucuucucuccuugaauaaaccccuuugauugcugaaaaucuugaauauuucuaaauucuauuucugaaaaaucugaucuuuaacccuuuuuuugagcauucuaguuccuuuacugcggaaugugucauuggagguccuugcucagccauucuggacaucuuauguccuagugcugugauuugcuaugcuccccacccccugaccccuguugccuuuguaaugauuuuaagaggugagucuguugaaggcuauucucaccuaggagaaugagaccagaaugaaauacuuaugaauuagaaguuuuuuauugagccacagaguccuagcgaggggcacaaacuuuugugaccauaaaucggaaaaagcagcccugaacugaguaaacagggggguuauaagauaaaaaccacaaguuuauacaucccguagauguagcugugauggcuuuuagcaaacaugacaggauaugaauuaaccuuucauuagaauagagcacaguuguaucaccacaguauucagaaagccuugugguuacagccaaacaauguagguuagcagaaguuccuguaaguuccauacgugccugaggaucaggcaaccucagucuugagucagucaggauuuagcaaauguuuuuuucuuacuucuaguccuugcucagucacucagcugggauggagucacacuaagaaugguacccaaagccuguauugucaaccacucuguucauuccaaaacuacaaaguggcgagagcuuccucuuagucccuguuauuccccauagggcauacacugauagacuuagcaagacuugcugcauguuagugaugcaccuugagaaagcgauugacucccaggucucuggauguugauagccuuggcaucauucucugaugcagagugugcaaaugaagacguaaguguagagaagacagugcgugugcaagggagacagagaccaacacagaaugcacauguuugagguucuuacacagauauagaacucauaaguuucugaauugagaaaaguaaggcaggguauauggucuuauaggauaguuuggacaccaaaacuggaaguauagauuuguucagcauaggcauacagguuguugugagugaagauguggacauacuagacacccuauguaacagcagacaaaaauguccaagaacaagaccugaggaacaaauggaagcuucuauaaauuacaucaugaagaaacagugggcaggcguagguagaagcaaaaugggaaagcagaaaugcaggaauucagaaggaaaucgguuguaaaagggccagaccagacucggcucuugguaagaaugaaagcuggccuuccucgcccuccuuuccgccacuccucucaccugaaugagcaaggauacuugauaccaaggacaacacucuugcagauggcagaaggugaggagagguugcccugggccuaaugcaguuacuaauugaagcuuaucaggaugcugacagaaugccagcaggcaugcucuuugcgauuuuaauuaguaagauuauacuccguagcaugcaacucgguguaauggcaacaguacugaugaacugugcucaggauggauucgggagggucagcuacugugggccgacugaauuccagacaauggacuugugguuuucuauucccccaguccaagagcaccacaaugaugaugaugcucguuggcucacccccaucccacuguuggagccugcacagacgcaaaccgaagcauccugguguauagaguucaagcguaacacagggaacacugagcauucaaaagaucguuccuaacucagaucuuuauuaccuggcucugugguaaacaugaacguggcuuuagaggugccugcaaauucugucuccccucaagaaguggggcuuaacugcucuguacuugagugugggcuggguuuacacacccccuuauaguaaacggauaauauaugaauauauauagaauaugaauaugaaucaaguggcaaggugauacgucuuuuuuuuuuucaagacgggguuucucuaaauaguccuggcuguccuggaacucacugugucgaccaggcuggccucgaacucagaaauccgccugccucugccucccaagugcugggauuagaggcgugcagcaccacugccuggccaaggugauacuucuuauauuagguauguauauguauauguauauguguguauauauauauauauauagagagagagagagagagaaagagagaggugggggucggucaugacuuugcuuaagagucuucucugccucuuaccuauccauagagucacuugcccuggggugugagcugccauaucauaucauaaggauacuugggcaguuagugcaaagucccacccagucaggagcugagcccaccagagccauaugaaugagccugaaguauauuuuuuucucaguagcucuaaaauaacuaacagcuuaacugcaaccucaggagagacccagaggcucagccacucgagagaagcugcccaggauccucggcucucaggaacugcugugaauaaauacuuguuccaagcugccacuuugaggaaugacuguguauuguaucuaaucccucagcaagacucagccccauugcuucagagagauucuacagugacaggcugcauguagcacacguggcuuauuccccuccuguaccggcugcuuuuugugugucaacuugacacaagcuggaguuaucacagagaaaggagccucccuugaggaaaugcauccaugagauccagcuguaaggcauuuucucaauuagugaucaaguggggcgggguaucccauuguagguagugucaucccugguaguccuagguucuguaagaaagcaagcugagcaagccaggggaagcaauccaguaaguaacaucacuccauggccucugcauuagcucauuagcuccugcuuccugaccugcuugaguuccaguccugacuuccuuggugaugaacagcagugugggaaguguaaacuuuccuccccaacuugccucuugaucaugauguuugugcagggauagaaacccugacuaagacaccuccugaagagugaaagugguuccuccuagaccuucugcuuugcucucucuuguggggcauugggcuaugcacagacaggcuggucuccagucaagcugaggucugaaccccgggacccaguggugauaauucaccuacaugggacgguaggcauucccccauaucuccuggacucaaggcucuugucaaaguuacaguccccacagcccccacaagagaagcauggcuaguagucacguagacaaugucccaagcuucugacauucaggcuagacuccucccaguuaccuagcaacaguaaagauaacagccuaccauaagaggggcugcuuggccccaccucgaucucuaaccucuccucccuccucauccucuccucucacucuccucucuucucucacuuucucucuucacucaucucucucuaaccucuuacucuagccuuucuuuucucucuccuuuucccccuucuuuccucuuggccauggccagucucucucucucucucucucucucucucucucucucucucucucucucucucucucuuuuaccuucucuccuuucucccugccuuuccacaauaaagcucuaaaaccauagacugucucugcucaucaaggcccgcugugcuuacucucgccugugugggaaccucucucccauaacccugggguguuguugccccggggccccuggucaggggcugcuccuugucuaccccgccuccccaucgaguggggucaguggcuuagaugcccaccuagggccaaguggaaagcaucuggcagcccucccgaguccgccugcacagagcauaggaggaacucuggcuggaugugggcuauccucuucccccuucuuccccccagccccuuuaguucccacacuucucuagucccuuugaauggacuguaagaaguucugcccucuccaguaagucugaaaauagugugaaaacucuucuugggugauccugccuccuaggaaauuaaaaacuaaagaguauccauacggaaaauggucaagguucuuguauucagcccuguuccaguagggcagcugaauggaggagccauaagacagcguaugugguuuccauucaaaacucuuccugcaggagaacuuccaagguucaguucucugggaauuuuacuaagcucauacuguuucauaucuuaaauuguaauaaauaacuuaugccacuuggugaauccaguugaaagcauuguaagagccuguuugccgucugcugaacaaacuggaaccugagucaagcaucucuaguguaaaugcaguaucugaaagcuuuugaaucuuuaaacauugguuucuaagggcucugggaucguaggcaacauuaauucuugggaaccacaguccagcagcacuggagcgguagagauggcucagugguuaagagcaccgguucuucuuccagaggacccagauucaacuucuggcacccaaaugggacuccagucucauggacucugauccccucugcuggcuaccauaggcaccaggcaugcacauggugugcauacacacauuaggacaaaagacuccuucauguaaguaaaucuaaaaaccaaagaacucuuaacagcuuuggagcagagauguguucguccuguucauauaggcggugagaauucacacuuuaccauuguauaaaaagcaguaacugacuaauugcuaauauuuagugaaagauagucuuuuaucuccagguaacacuuggcuuucucuucucuaaauaagucuuucaguaacugacaugccagcauuuuuaguuaaaauaagcaucauuacagaacuaagaggagacuuagcaggaagagcacuggcacuccgcacagagguucaguucccagcacccacguaauggccaacaaccuucuguaaauccaauuucaagguguccagcacccuccucuggacucuauuuaccccccgccacugcccauacacacacagacauacacauagacaaacacacaugaaauaaguaaaucuauauuaaaauuguaacuucauuacauugcuugaucauuaucccuaauuugaggccuaacuucuuauucuaaguguugccacgacaccaccugaccuuugucugagcucccggcugggcaucagucaaccguuguaucccgagacuaauauaaaaugcauucucagacuguaaacucuuacagcuaagcaucuucauuguggauguaaauuaauguauccccugauucucugucuucugagcacacggggcugggucuacggcucugugguggugugcgcagcucaguuuguuucccuagcaacuggaaggggggggaaacuuaaaacauggaaagauuaagcaugugaccuggaacccaugggaagaaagcccagcccggugguaguugggcaccgugcauagugcagaucucuccugaucagucaguaaucacaggacauggacacaggugacuugugacaauccgaggucuguguggagacuugcaucuuuuuucacguagcuuucuuaaguuuuguguaggccuccguuaguauuugcaaggcuguacgguuuaggggccugacauuccuugaugucagacguuuccauguuuagcuuugauguguauuugggcucaugcugccagauguccugaucaucguuguuauuuuaaaaaaaucuaucucaaguguauacaaaaugggaauucgaguauugaucugacuuuccacugcuaccacacacgcaugugcaucacgcaggcuucuccccuagcguugucggacuagcuccuaguacucagucaaacacguucccgcgccuccucuuaccacugcagacugguucccgugcuuccgugguuugucacuuucaacuauaagagaaauguugcuuuucuguucuccauccguucgcccgccgcucccucuacccagcccccacgcgcacaccgucuaaggaccacaucccguguuucugaacccggagcaccuaccacuuggcacaaagugcuuguuaaaugccugcccagugaguagaugagugacuucagccuccggacuagccaggaguugaguucagaggcuguauaaacaccauucaucagcucagcacgacguuucuuguagccagagcuacaaaaagcuggaaaaucaagaacaaugcugcccugggguuuauaacuccugaagaggcuguacaaggccagagcgacuuggcaaugcuguacugcagagcccucccuccccagcucccugcugcuuaaugcuuguguucucugaggggccugggccaauucagugugggagaccucucccaaagacuuuuggcuuauucaagaucucaaaaaaaaaaaaaaaaaaaucuugagggcugcauuuaccugugguaagagugaaagaaucacuuguagaagccaguuggguguuaagaguggauccauaaggguagggggaggaggaugggaacucuaagaagccuuguuucucaguuguaagccagauccaggacuucacaggacccaggaagcgagccuuagagaaauggagguugugccuuugaagccggcuuguuucgucagucuaaaagcuguccccuguaguccacaagugaagcggugcacaugagauuuggguccacagaaagcugcaguucucaaccuuccgaauguuguggccuuuuaaugcaguuccuuguggugugcugacccccaaucguaacauuaucuccuugcugcuucauagcuguaauuugguaguguuaugaaccguaauauaaauauucugaugugcgggauaucugauaggcuaccccugugagaucauucaggcccuaacggggucuggacgcacagguuaagaaccaccaacagaaaggcuggugugugauuguagcagagaacacucucccacccaguguucucugcuacaaucacagagcgcaugcgcuggguaugaaauccugggccuguagcugcugagccuuccuucuuacucacucagaaagcagagccuucaaggcuuacucaguagacacuccagucagcagccuggagugcgcuggaguccuggcaacuuuucgggaccuuaagcagcuuuccugcucccuaagccccuagccucacuugaugaacaaagucaggacugucauuucacaaaccacuccuagagcccuuugauuguguaauuaaauguaauuacaacaaucugcccacaauaccacgggccuacgcuagcugggggagaagggguuaauuuuguuuucucgcugagauaaacagcuuaaaggcuucuuugacuucauagguucuccccuuggcugguggcuuaagugcuucugagccugugaugaggaagaaaagcacagagccagugacuugaguguggccaggacugaccaaguucccucagcuagcucuaucucuaguuccuaccaccucccaagaaugccaaacuaugaaucuaucaguggauucaucugacuagagcccacguucuucagugagaacuuuuaaaaauaauuguucccccggagguaagccaaggaucucaucauguagucuuggcugcccuggaacucacucuaucgaccaggcuggucuuaaaccaacagaaauccagccaccucuaacccugaguguuggaacugaaggcauguacuaccacguccagcaaaaguuuugucacauuugucugugucuguguccauguauauguguagagaccagagaacaacuuacggcaugguaaucaguucucuccuccuaccauaugggucccaggaauugagcccuuguuguagggcuuagcagcaagucccuuuacccacugaaccaccuugcuaaccccucagugacuucuuaauacgcugaggaccaagccuucagcacaaaagccuuagagccacuuuauauccaaaccacaaccaaaaguaaugcucugcauccuuacagugggagcaagugugauuauuaaaggguuguuccaugaagcuguaagccuugcgugcccauggcuuccuuuccucacucuuagggagguuccaccucuuggggggaaguuaacaguugacuuagcauccaaaacuuggcuuuucugcccaaagcuaugucaucuuggugagcuuccugcucauugucugcagacuagggggugagaggauaacaaucccacacguaugugcuuugcaggguugcuguuaauaaagugaggucagcauagagcaggcaaucagaggagucugacccagggaagcacuagaucugggagaugagaagucauuauguuauauguagaaaauauggacauuuucaggaaaacuuuuaauauguuuaaaaucaacuuuaauaauaaguguuaucuuucaguaucuuugauuuguaucuauaugcacauucauguauguaaguaaauuugguuuggauaauuuauauguaguaguuuuucaguaaaaauguuacaugcuaaaauuuuuauauauuuuuuuuucaguuuugucaugagcgccguggacagaguagcaaugcauauucuuuauaagugagucuuuguaaugcagcuucauguggacaucuccuaaggcaugcugccgucucacaguuacuuguuuagcgaauccuuuucugccauaagcaauccugugaggucagucccuguuugcaaaaccuuguucacaucucugccuauuuucuucacauaaaaugcaagggucagacuacauaaaguacgguggaccugcuguauuauuuauuugaaaggggaaaaaaaucaagaaacccucccuuuaaagcugcuuucaguccacagcugcuuccucuuccccauucaucgcgccaggagccacauuagccgaggaaauuccuuaccauauaggguuuucaggagaaagcaggggucucacuucuucccugguaccuuccuguagucccccugccuguccucggaucuaagugucugggcuugugcugaucauuggcguaagcaccguggaggugagggcugucuggaucgcuuccauuuuuauuguuccagcccacgcuggucucugugcuguggaggcacugaauggagggaaaggaucugugcaugccuacacacaaggggagacccuuuauccuuuauacaacuaauagagguauaaaugagaaagaagaaaagccacaagcuauuuuuccccuuaacuaaagauguguauagguuguauccagauaggcagacgaacucaaagucagaauuugagcaggucauugggacaguggccuuccugugucuaaaggcaguguuucauaguuccuucuauaaucacugauccuaaaacaagcagauaguuaauaauuauuuauauagcugucccaagacugaauauaggccuuuaucuuguucauuuaagcgagggcauaguugucuaugcuucauuuggaugcaauagaucaccuagaauaauaacgcacccucagaaccugccaaucacguguuucacaaaagcaaacugggcucuggaaaccugucugccuuguagccgagaauguuuagugaugggucugugccugugagcccagcggcaagggagucagcauguguuugccuaacuuuacuuacaacaguguuuuaaggauuaaucucauaauuucuaggccaggacacauuucauaguuaaagaauaaacguguagagauuuaaguugauuucucucuagaccugaacguaccuucauuuucccauccacauuggauacuaagauuuuguucaguuugcuuccauaugguguuuuucagauucuuuuauguaaaugucauacugaguugcccccuaucccagagugaggggggugacacccccaguguccuguagcugcgaucuagcauccaacaagaaugucuuauaagugaaauguaaauguuucacacaggaggcaugggacacguguccaagaaccauccagggaacaaaaugcccucugccucauuuucuagagcaccucucacaguucccaagguguuguucuccucauucuuugacaacguuccaaggauacuacucugaauucagauagauuuuuauaugcuauauaaaacuauaauuuauucacaacauuucaggaaaacauuuacugcauaaaacgagguauuugauacauaaaauggggagggggaaagagagcaguauaucuugaucuuagaaaugucuugggucuccucuaguggguauaaagaauggaccuguggauaucauaacaucacugaaaucucugaagugcagugucccugauucugugucucuaacccugcucuccuuguauaccucugugugugcgugugugagugugugugugugugugugcgugugugagugugugugugugcgucugugagugugugagugugugugugugugugugcgugugugaguguguguguguguguguguaugugugugugugcgugugugaguguguguguguguguguguguguauugagaguacaaaggcaugagacucuucuguccucauccuugucaccagcccuucccuuagccugaggcugugguuugcagaucagcacuguaagaauguaucagugaggaaugagcauccucucagccccagacaacuccaccucuacugcaucagaaacccgugugaccagggcagguaaagggaaugguaugagauguguagguacguggcagcuggcuaucccugaaguguaauggaaccauuacccuccgcugcagacucuagaucccuggugaagucccucccccacugcagcacccaagccuauguggccuucagcauaagugaaaucacuuaugcuguucaaagauggacagaauaaccaccccacacccccuuacuggaggaguuuugacauuucugagcuaggcaagcaggcaggccaggggugugacgucuccuugccaucucuauugugaugcaaugguguguccaagagauucuuuacagaaagcuaagagcccagauggccugcacuccuagacaaaucugacccuuuccacucgugucucacaguaucuguuaaaacaaaaguugccuaguucaaaaaaaucaggaaaacuuauauaaaaaugacuucuuuggaagaggcugaagggccugcaucccugcacggccugugcuuccacucuccaggacugccccuucuccagcuugacaucgggcccgggcuuccuuucagagcuggcugccaaguccccucuuucucagaggaggaaaggauuuuagaaagcacgcuacuaccagaaguaguuguuaaagcugcucccagagggccgcaaagucuuccuguuaugccugaccugugucccugaaggcaccggagcuuucagauugucagacagacaggugcugaugucaacucacccaagccacuuuucucuuuccuuuugcauuccaguuguuauaaaaauauguagggugguaguauggaagcaauaggguaggacgauguuaggaguggacuagcaguucgggauugcugggguuuggcuguuuagcauugagcgcguaaucauuucaucagaugaaccaugugaggauggagauggcccuuugcucccucccguccuucaucccgcguaacgagcgaacccucacugcccugcaugaaaaccagcugaggacugcucgugugcugccugaugagguuuacaauaaguaaggaguugcgaggaauuuuacuuagaaauuuuaacuaaaauacacauauagucaggagcuuaaacaucguugggaugugcagucugaaacacaacucaucaaauaaaguaagcaccuaaugccauccaaaugaagcauuuauccauacgugcgaaagcucgccguguagcccuuuacuuuaucaggaguuaauucagcagagaauaugagccuggaggaauaggccaauggguaguuugaacuauugguguuuuccuacaggaaaaccaaguaauuaggccaacacaaagcaggccuguuuuguugugcuucggaaguagauccagguuguuccuauaacagcuacugugacgaaccuuuacaguucuauaacaccacccuucgguacgaacguguaguaagaauaagagucccacccacguuccuuugcacuagaccaggaccccaggccagaggaaacaaugggggacucauguggguugaacauucucuccguccauccgaagugugcgugggaccaugggcugcaccugcacaggguagguaucauguuuugagcacuggguaaaaacaaagcagcaacaacaaaaccuaagagugguuccuugaaugauagugucuagaagaccgugugcaucaugguacugaacuggacaggccuguuagaagaacugccagguugcaaguuuaauguuaggugagcauuuauucagucuucuaauccauucauugagcaauuauugaguucccauagucuaggcagcauuagauuaaggagacaagcaauauccccuauccuuaggaaggauauauauucuauagcgcaagacugauauucaaugcuuuaaauauguaagcaagauaucuauauaaugcuguguuggaaggcauuaaagaaauacagaggagauaaaacaucagaaaagggcucucuaaaaaccuccuucuggagcucagacaagagcagauguguuagggcaaacagcaaaaggaacagugugcacaaagcccgaaugacaaaaggcugggcaucugugaguaacaaaaggagccggaacaagggagacagugauuagagaguauuggaccagggccagaucacacaggaucugccgcuguugcuucucacauggcgcccugauggcaccugauggcugaaaugacaguggcccgcacuggcgucagcacugugagagggagagaacagcaugugcuguagaggccagagcacucacugauguacuagauggcucaacagaggaacagagaaaagcccagucaguugucuaggcuuccgcuccaguacccgaguggucuguagugccauuucucagaugcaaaggucagagggcuucacucagucuagacuuuggaguccagauugugcaaacucacuuuuccagauguuugcugauauuuuuguuguuguuauugucuuuaacacagggccuccaguagcccagguuacuuccaaacucacuguuagauuguugauuauccuugaauuccacucaucccuccuuaccuccaaagugcagaaauuacagguauacccuuguucagauuguuuuuuuaaucuguaacacgagguuauuuauuauguuaaguuuccaagaucucaucccuauuaauuaauagaaccucaugaaaauuagaucauuagugugaaaacauaccgagguucgaaauuaaggaauaauguaguuugaugaauaucauuaaaauggaaugaaucaauuuaucucacaacuacuaaccaaaauaucaagguuauuuuucuccagcauaccaaagaaagugagauugcaaguauuuucuccugggagguguuuuucuggagauucuuggcaacagaguaguuugugcuguugaguaauauuauacuauaaacaguuuuguaacauugggcuaagacugcaaagcccaaacagugcauuguuugugccccaguguccuggcuucuuucuggucauuccgcauugguucaacauagauuauuucuccaaacccauacagccccaguguaggaagugggcauguuuguuuuguuguuuuucuguagagaggaccccaaacauguuccuauauagcaacauauauaucuauaucuauaucuauaucuauaucuauaucuauaucuauaucuauaucuaucuaucgauagauacauacauacauacauaaugcauauauauauacauauacacauauacacacacacacacacacacacacacacaccuguaacucuguuucugccaccugccuaccaccauuuggccuaaccuaacagucucuugcuaauguaggcaguaugauacugaacccugugucuugagguagaugugaaaccugacucaaaggacuccaacagaaaagaaauuuauugucacacagaacaaaaacaugcuggggcaaacaggcucagccguauccaugauauuggacaguugggauggagcccgauuaugugagaucugccacuggcagaagugacagggaccaugaguguacuggcugguuuugugugucaacuugacacaggcuggaguuaucacagagaaaggagcuucaguugggaaagugccuccaugagauccagcuguaaggcauuuuucucaacuagugaucaaggggagagggcccauuguggguagugccaucccugggcugguagucuuagguucuauaagaaagcaagcugagcaagccagggaaagcaagccaguaaagaacaucccuccauggccucugcaucagcucccgcuuccugaccugcuugaguuccaguccugacauccuuuggugaucaagagcaauguggaaaguguaagcugaaugaacccuuuccuccccaacuugcuucuuggucgugauguuugugcaggaauagacacccugacuaagacaaugagcuuuccacucuuagaugcugagauuguccccuccauccccagccagcugccccuguucagugaaacucaccggacaauacugagccaaagaaaugguucuuuucugcucugcaucuguccaugagagcaaaagccuuucucagaaacucacaguaaacaucccugaguuccaggaagcaguuuucugcccggagauagagacauuauucuaaaccaccccccucuucuuacucccucccugaugggccuacacaaugugccauccucugucccuaugguuacuguauuaauucugguccucauuagcucaaucuguccucauugugaaucuaugauacugaaagcccugcagcggcucuuaagcacagcuaggauaggaagcgcauguugcuuuguaacugcagcacugacucuuucucuuccuuaccugacagcucaauaagccgacagacagaugaucugauugcaguggaguuggggaaaggcccagaccccagccaugcaccacccccaccccauacaggagacccuucccuuggaucccuguaaacacaggcagaagggaauaccagcuaagaagccgggaugaacccaagugcuaaucgauggcauaggcuuaaaugguguaggaaccauuggugggauauccuugcccugagagcucggagaagggagucagaagaguucuguugguucuacugcacccacaugccauguaacacccaguaaagcagcucuucugucuuaccuuucaaacuccacugugccagaucaacgauguaugcucugauuguaucugucaaguuuagccaagcuaaacuuagaacaaaguaaaauagccacagaucaaauucaacuaauacaacgacucaaggguaaugauuucuggguaguugaguugucuuuauaggauguuaaagauguuuuagugauuucacuuagaucaucuucauguaugcacauauuuuagcaaguguguacuguacuaaguuuccauacuacccccucaaauggcccuuaaguuuacugccucucccauauuccuuccuucaucccccucuucccucucacccucuacuugcuccuccuguucuaguccccugcauccauccauaaauaucuguuuucuuccccauuccuagggagaucuaucugucccucuagucccuuacuguauaccuaaccucuguaguuccgcugauuguagcuuggucaucauagacuuaucagcuaauauccacuuauaagugaauauauaccauaucugucuuucugugccugggcuaccucacucaggaugauuuuuuuuucuaguccuauccauuuaccuguggguuuuauuauuuuguuuuuuaauggcugaguaauauuccauugugcaaauguaccaccuuuucuuuauccacucaucuguugagggacaggaugggacauuguuucccaugccugguuguuaugaauagagcaguaaugaacauggcugagcaagcgucucuguagcaggauagaagcauccuuuggguacaugcccaugaguggucuagcuagaucuugaaguaaaucaauucccaccuuccucaggaaccagcacaccguuucccacaguggcuucacacauucacacucccaccagcaaugggugaauguccccuuuacucaacacccuggucagcaugagcugccauuugucuuauugaccuuggccauucugccaggugucagauggaaucucaaagugguuuuuuauuugcaugucccuggugacuaaggagguugugcugguuuuugcaucaccuugacacaaccuaaagucaucugagagaaggaagacccaguggagaaaaugccuccauaagauugggcuguagacagccuuguaggguauuuucuuaauuacugaucacagagugcccaguucauuguggguagcaccuucucuggacugcugguccuggguucuauaagaaagcaggcugagcaagucaugaggaacaagccaguaagcagcacccucgauggccucugcaucagcuccugcagccuacccuguuugaguuccugucuucaacgauaaaauauguaccccauuuuaaaacuauuuuucuauuuuuuaguauagauuagagcuuauugagggcauggggaggggaguuaagaggguaauagaagcagagaaaggcagagagagaauagagaaguagagaagagaccggccauaagcacauggagagcaagacaaagcaagagaggagcaagagagcaagaauaaguauuuguuuucuuacaaucuaguuuuuuuuuuuuuuuuuuuuuuuuaguucuuaguguauuuuggauauuagccaucugucaaauguguaguugcuggaaaucuuuucccaugcugcaggcugcugcuuugucugaaugaccaugucuuugccacacagacacuuuucaguuuuauaggguccucuuagugccugugcuaucaguaucguguucagaaagucaucuuuuccugugccagugaguucagggcuccaccuucucuucagucagguucaguuuuauguugaagucuuugauacauuuggaguugaguuuuaagcagcgugguaaguaaggaucuauuuggauucuuuuacaugcagccauucgguuugaccacuaccauuuguugaagaugcugucuuuuuucaggguguguguuuugggccucuuuaccaaaagucaugucaacauguauggacuugucugagucuucaguuuaauucauugaccaaugugucugauuuugugccaauaccauacuguuuuuauuauuauagcucuguaguacaaauugagauuaggagauggugauaccuucuucaguucuuuuauuauucaggauuauuuaagcuauccugggucuuuuaaguuucuauaugaaaauucucuuuucaguaucuauuaaagaauuguguuagaauuuuauuggggauuucauugaaucuguagauuacuuggaaucuguagauuacuaggauuaauacagugaaaauggauggccauuuucacuguauuaauccuacuaauccaugugcagagagggaaagaccuuggaaugcuagcucuaaauagaaugucuccaucgaaucccucuccucgagacccagagaacccugaggaagaggaggcagaagaguguaagagccagagcagauggagggcaccaguagaacaagguccucuaaucagcaugaucuaugcucgugugaacccacagggacugaggcaguguguaauugcucccgcaucuccugccaucuccagucaccccaaucauuuccccuaauuuagaagaagagcguuucaagcagauuuguaauugaauaugcugauuauuguaacugaucuccugcucauaucacccuguauuuauucuguuuacaagcgggguccucuuuuugucguaugaagaguaagagguuauuuagaugcgguuuauauuuauauuauggagugcagcuuucuuaaugaggaaaggacugucagggaagaccagugaauacuuuugaacaaguaaaggagcuaucaguuugaggcaagagaggaaugaguugugaggugugcguuucagcagacagguggccacugacagugacuggcaggggucagagggagagagaagacuguuucauucucuuugcuuuauccauauccaccucagaaggaacugaggaaaagcuugucuuugggcgucgcaugaaggcuucaggccagcacaugaucggaccaccucaaucccacuuccaucuucuguguagacgucucugcuucugccauuguacccugccccugcacaccuggggcgggcugcccuuucccuggucucugcucucagacuuucuauauuugggcucgaccuuuccugacaggacugguuuugucacagcgccacaggauaugguuguugacaacugccucuuccucgggagccaacccuacccccaccuauacgcuuucacgcuugccacugggacuucucggagacucgguaccaacaagaagaugaaaacauggagcagcugucuggggcuucgagcugauucugacucuccccuaauccuguugaaugugguguuuuaaauugagaguagcagaaacaaagugauuuaggaaaaugauacuguucuagccuguuucagugacagcguaacacgguuaagaaaauggccugucagauuugaucagggauguugaagugaaucaugguuauucccagaguagcuggagugaagcuucucuggcaagagaggcucuaaggacggccaucugcuggccuggagaagcaggggaccguccgugcccugcccccaccuacacugccucuuucuucugucuugcaggcacaacguguuugaucgcucuacucucagauaaagaccucaccguggccaacguuggugacucucggggagucuugugugacaaagauggcaaugccauccccuugucucacgaucacaagccuuaccagcugaaggaaaggaagaggauaaagagagcuggugaguuugugacccccaccaccaccaccaccacccuggggaagucuaccaucuuguuuggugaucuaggugcuugcuuggagaguuucucgggagcaaauuucacgcagcaaucacauaguguagcccaggcuagcccuguucuccugccuccaccucccaaguccuucagugccaggcauggaucaauaaaaugauacugagaccaaagcccugagaaggauuauuagaucugagaguucccuacauguggaaggcaggagucccuucacugacagccgagccaugugccaggcagcuaagcagccuagagcccugguguguguguaaaccugcaggaugacucuuggucauugcagguuagcuuccuccuggugagaaaaugaaaugagccuaaugaacauuugagccuucccagcgggggcugagugacugagaauaaacgugcugaguuaguuguauuauccugcuugagacgcaggauaaauguuuugaaggaaacauuugaguggaggauuuccucggguuuucuguugguaaaauaaagccuuguuugcggagcauccauccagcuucagugagcuccagaaaagaugaauagaaaguucagacauucauuuauaaauaugcacaucaucuccccgugagagcucacccaagugaacugaagauccacauggcuaaguuuuguggacacacuugcuccuggaagcucuaucgugguguccagcaugugucguugagauuucacaaucaugcuguucccucccugucauaucugacaugcugccacucuacaguguuuccuuauagaagaaaauuugaacacugucuccaggaucaaucuggccugcucuuuuuuuuguuuuuguuuuuguuuuuucauaaaguaggcaagggucuuuuuuuuuuaaauauuuuuuacucuaagaauuucauacaauuuauuuugaucauauucacucuccucccccaaauucgccuagcuccaccccuuaccuguacuuguuagaguuccuuaaauggucaauguguguguguauaauauauuauauguaguguauuauauguauuauuguuuauacuauuaaauaaucauaaauauauaugagauuuauuugacugucuuaaaagccaugauccagcuaguccaacauggcucucucacaaugaaaaaagacaaagaacccaucaguugaauagugcacaaggcaggaugugucagcuggucuuuaaucuacauuggaucccaaagaaauagguucuaauaccagcgauauaaugccucagcaguaggauagauaaucuugccucuuccauguccuuuuaugcaugugggcugcugccagaagguguagccuagauuuagggugaauuuuuccaccucugacuauccagucaagaaaaucccucacggacauacacagcuauuuggggguguguccuagauagagucaaguugagagccaagauuagccaucacaucacucgcgcaaccuuguggcuuuucccacaccuaccuguacuacccauguaagagcauccauugggaacagagucucacuaccaagggccauacccuugaagaaauggacucuuucuuccacagcuaucaguugccaaugacuucucagcuaggguggaccuucaugcccgccucucaccuccaugcuugaauguugucugacuuggguuuucacaggugcugugcauacugucucaaugucgugaguucaugugugcaguuguccugccguuuguuucccuugugcuccucugccaccucugacucuuacacucuugcuccaugccuccucugccucugucaucuccaaaccuuaggccgagauggaugauauagauguuccauuuagggcuaagcacucuccagucucguguucuguguaccuggaccaguugugagcucuguuuuaugucaucucuauuuguguuuauuaugaccauagaugucacgacaucucucuuccuccuacuuagcaugacaggagguuccagccauauguguugaccuuucugucucugcuuuucaguaccagcaucaguguuagcuuccauucaccguguguaggagccaagccugacacgcaucauacaaguuuauacauucugugaagacuauaauguuaaaaucacucuauagccaguaaacugggacuucagagaaacuuguguccacagacauacagccagagagugacaagccagaacugaaaccaugacugacuacacaguccaggcccuuaggaacaggaccaguguucugccucccguccccuuaaagcuaacugcacuaugccugucacuccuacaagccauuccuucauccugccucacuucagugguugguagacacuaaccugucacagcaguguacugcuugaugccugugacuuucaauaaguguggcuucucucuccuccagauugucggggaaaggucuagaucuuacguaaaauagccugaaaagucuccuucuacagaguggguauuugauagcuaucugauaaauaugugaaugaacaaaguucuggcuccuuuaaagaaagccuaauggaauccagggggugguggcacaugucuuuaauccuaaugcucaggagguggagacagggaaaucagaaauucaaggccaacaacagccagauagugaguucaagacuaccuuagaccagaagaggcuuucucucaaaggugggggggaaaaggaaggggagggagaagaaagaacggauaaugcugagcgaaugugcugucaggcauggugcuagggcagguguauggacuaaugucuuaugcucucacaauacaguggaagagauauuagagucauuuggcagcuaggaagauacagcauccaaagaggggcauauuucucauccacagucacuaacuaugccuaaagggugguuuuccuugauuccaguucuugagauccacaucagcauaucuaagugugaccccaguaagugacuauuucagggcugacucccugccucuccaccugcauuucagcauuuucuugccacucucuucaaacccacaugcugaagcuacaugcugucaaucacugagcugccacagaguguuauuaaagcucugucuccacccauacucuacccuuaauauuauuguaagcauuagcacugccaaggaugagagcaugaaauuccacuccaggcccuacagcaagaugcugguggccuuggcagugacgaaggugaaggaggggugcuuguggcucagcucuguugcagcagaccagcuugugguacacucacccagaccggaacaagcuaacaggcucccucugucuuuccagguggguucaucagcuuuaauggcuccuggaggguccagggaauccuagccaugucucgaucccugggagacuauccacugaaaaaucucaacguggucaucccagacccagacaucuugaccuuugaccuggacaagcugcagccggaguucaugaucuuggccucagauggccugugggaugcuuucagcaaugaagaagcgguucgauucaucaaggagcgcuuggaugagccccacuuuggggccaaaagcaucguccugcaguccuuuuacagaggcugcccugacaacaucacugucaugguggugaaguucaggaauaguagcaaaacagaagagcacugaacccugccagaucucagcugccccaaacuagaggacucucaacauacuguucucuucauguaguaaaagguguggguauaauuaggaucaugcgucccaacacagaacccccuucccugauggccuugaaucccuuuggaguacugagcagaggguucccuugcugacaccgcagaggcugcuaaguuuguguccccccagcccuucuaucaguguuugaaacacauacauagguagccacagaucccacauaugaggcaaaggaaaggcaggccauauguuuuccuucuuaauaauguacuuuucaugaucucuucugugguccuucagggaccugacuuggcguccucucugaaccugggcagggcaagcuggugaugccaacacuucaccaugacaaugagguggccaugcccucugccuugaagcaguuuccucagaaaugcucuccccuucugagucuuggucuucaguacuccagcauccuggaaggagacaugcaacacuuuguaauuuguugccugcucuuagagacuugagaguugggaagccagugcagcuuccugcacgccagaccuccccgcuuccgcucgcuuccuucauuaguucaguagagucgggaugcaguuagccagcccuuacgccucucauggagugcagccucgccauuuguucacaccuuacgaugcaucgagggcugccgcugaccucaccgugagacgugaguuuuugucuccccucaccaagacuccccagagaggggaggaagcaggacggaaagcacaucgcaguacaguaugcccuuccaucuucaaggaggaauuaggcugggaugguucuccaugaccuuuugaaaauugcugucugcacuggagaggaaggcaggaguccuggggucaccagucacacucaccaacugcugguuucugcacagcccuucccaagcccacccuaccuaguagcuuucaugccuuucaaacagaggugggagaaacagcaaccuagaaucacccacgggugcuguucccagcuaccaccacaaguugguaucggggcgcaaacuacugggacgugcuuccuggcaagagaaagaccuuucauggucaauugcaaaucucuguccauacccaggcaaauaggaacugucugcugugaccuggagggaaagagcagacuggcuccuggggaccugugugcacugguugggaguucaagcaggaacccucagagauaagcagcagaguuauuuggggccuagauuacugcucuucccuuacuaacaccaaaguuguggggguuuuuuucccagucucuguacuuuguaaguuaauuuauaggacauauuagauuguccuguuugcugauugaaccagccccaaagagccacgauuuucauugcagaccuacaccagagccggccuuguuuuguucucucagagaggcugugugucggcaugacuucucaagcccugcucauuagcucucccuaccccggcccucuccuucagcugcagagcuuguaggaagccgagucuggagaaugaaagacuuggacucugaggacugcaaacugucuggauuccucugggaacuugcuuuccuuuggcugcaucaagaauuaauaauggcuucccaggaaaucugcuuacuuuuguaucuuguguuuucaacauuggaauuagggucuuuucugcuucucagaauguuuuaguacaaaacacauucuaucauguuagacagaagcauugauuguggagagacgugcacugauggguguguauuauggguuagguggguggggaacagagaagucagguguggguuuaaccagugaugggaugagcuuguuggcuuaggaugcucuuaccagagaguacccaaaacccaucuucuaacuaaagguccagacucaacagccuauacagucaacuucccuucuguauuugcuuaacacaaaaguauauaacaagaggaaaaaaauaaauaaauuugagacacaaauguuugggugaagaaaaaaagaaaacugccaaguuaguugguugguacuccuugagcaagcaggguuucuuaaccagcauugcugaaccccccuaguuccagagccuucuaacugagguuuauagauauagauauuauagaucgaucuuguacauuugaucuugauuuauagaucuuguacauuuugcuuugcagaaguaacuuauuuaaccaaauaggaa

SEQ ID NO: 12309 - RNA, 2274 nt, Mus musculus
caaaccucucuauucagcacuuccucucucuuggucuggugaguuguguuggucugauagcacugcuagcggcauuagaggcugaggcuaggguagaagaaaggggggcugcugggggaacagaugucuuuaauaaauccagaugagagauucugauguggagguucauguauguguguguguguguguguuuuucacgagaaugaaaaccaaaaaaaaaaaaaaaaaaaaaaaaaguguauaaauggcuacaucugagcucccggagguuuugagauacugaggcuggcuugcauguugcuauaguguauauugguggugcuugggagucacugucaugcauaggaugcugacucguguugcuggguaauacaagacaguguguggacacucggguacaggaagcaaagcgaaggcaucaguaggccuuuuuguuuuacaguauuuaaauuacaguuuuuauuuguguguaugagcguauggguugggcuggagcaaaugccaaggcgacauugugggagccaaaggacaauuugugugggagucaaucuguuccuucuagcaugugggcuguggggaucaaacucaggcccuggagcuugguggcaagcaccucuacccacugagcuaucucuccagcacccuccugcaggcauucguguuuguagugugucuuauuuuuaauagcccuaugaacauauagcaccuaggccaagaaagccuggcuuccccacccucuccucuugcaucccuaccucugccacuucaucuuacuccuauuaggcagcugggguuuuuccacuuuuuuuugucugccucugggcaggcagccagcagccgcgcccaacgcugggagggagaagaaugggccagggccuggugcuugugguugagcugugggagugaguaagcugauggaaaacugcuguuguugaggccaggacugagaggcacagaaaggugcuggcauggaucuccagaguuugagggguaggcuuugcagguuucagagcccagagcacaugugaccuucuugccaucaaugggucccauuccucugaucuccccagggggugagguccaucucuuagagaguuggcugggauagagcacuuaaaauggggacagaaugagugugauuugggucaugcucagcaacacauauccaguucucaacacacuguuggcguggguuggagaauguuacuuuugugucuccugcccuuaggucucaacgguuaccauggcaagacccuuggaggaggcccuggauguaauuguguccaccuuccacaaauacucaggcaaagagggugacaaguucaagcugaacaagacagagcucaaggagcuacugaccagggagcugccuagcuuccuggggguaaguggguccugccuguguauugcacacgugaugcaucugcaggaggaggcuggggcugguaggcacuagucuugaugcaguacuuagcuauagcuggcauauaucccugcucugggugcuugguacggaaccacaaugaaccaccuacuucacacuagcccccagcugagacaggcuuaggaugaagauaacugaagaggcagaggaaaaccaaaacaaccacauuaggcagucagugucugaaaccacagccuagaucagggcugucuuuccggagaugggcacuagaaaucgaguuuuuauuugugaagacaugaucguggaggcacacaaaugccugcagauuauccucucaauaacaccuuauauuaguuaacggaucacuauuaugacaguuuccuauuaagauaauuaaaacaagcacggggaagauguggucacauccuuucccagcuaucccauguguucaucccauaguuuagccccgaggcuagcaaggagugcuugcaaaccuuccugagcuccugacuggaggcaaauaucugguuugaguuggcuucuaauugcuccucuucuacugccagaaaaggacagaugaagcugcauuccagaaggugaugagcaacuuggacagcaacagggacaaugaaguugacuuccaggaguacugugucuuccuguccugcauugccaugaugugcaaugaauucuuugagggcugcccagauaaggagccccggaagaagugaagacuccucagaugaaguguugggguguaguuugccagugggggaucuucccuguuggcugugagcauagugccuuacucuggcuucuucgcacaugugcacagugcugagcaaauucaauaaaagguuuugaaacua

SEQ ID NO: 12310 - RNA, 5794 nt, Mus musculus
ccacuccugucccagccaccgucagccacagucgcagccggaccucgcuccucaacuugguaagcauaaguuuuugaacuuuuuagauuuuuuucuuuuuaaugaaaacaacaaagagcuacgcaugcucuuggcuggguguaucuuggacuaacguguggacguggcagaaaauggaucgggaagaugaaacugugggaggcaauuagagaagaguggagggcacgaggaagcccuaaaauuacacccuaauaacagccuguggggagaaacggcggucuuuuguucucccgggcaaaauaaguucuaggcugggugcggcugccuaacuggccugagcccgggcugggugcggccgcuagacucccuggggccgugagccccugaacccaaccaguggcggccgccagagagcugcagacucagugagaacuuggggcagcgucgcuaggcguucaugaagacuagaaagaaagcgguucagaacguagccuuccugaauucugggggacucagcugcggggaaaccgcaggcaaacagccaagacauacagaugagaaaccggagccuguugcagccauuggaaccacagacaggaaugugggaggaggccagucccucccagcucgcucuuuuccucucccccuuacuccacucccagccaucuuuuuagccacucccuacaucaccugccugucuccuaccugcuacuucaguuccccucguuucuuuaaaaaauguuuccaguaauucacauccccuccaaaaucuaccccuuccuuugacucuucaaagaggaucagcaaauguuggagagaggcccaagugcguuuuugcccuagucccaaacuaauuauagauuuuuauguuuuuaaaugguuggaagacauucaaaaggaaaagaaucccuuguaaugcaugagaauggcaugaaaaucaaauguauagaguuuacaggcaccgccacacccuuuugcuuuauguauccucacccuugcugccugacuauggcaagagugauaagaucuuauggagcauaaagagcuaaaaaauauccacagcugucccuuuauugcaaauaacagcaacagaaagcuugcggaccccugcuuuggugugucagucuuucaucacuuccuacuuauuguuuccuucuuccccuuuucaucacacaggguaccuagggcccagcaccaacagguuaugaggugaaaggagauagaugagacccugaacacuugaaggaagagcuuuggugcugguugagaaagagauaguuggugugguucccucuuuuucacauauuucugucaaggggaagcuucccuggaacguuggguguuuagguugcguuuuaaaaggaucucacugcguccuuucacagugggguuuuccuugcugucacuguucccaucaugcaaaagggcgauggugugggccgugcccucucuuucagccgcugcuccacaugggcaaaaccuucccaucugagcccucuguucuaagggaaagaagaaaggagcaucuauaggccuggaaccuccuccccagucuagcgaguccuccgugccaacucuccugcuaucaugugacacacuaauaaggcagcuagauuuuaguucugauaggaagagcauguuguguaaacacuuguuucuaggcugugguguuugguguuucccccccccccccccccuaacuuaccaauaguuuucucuccuucagacucuuuagaaagaacuuaucuccagaagaagguucagguacucugggcauuccuaggugcagugagccacagcagugcaauuuugauaauaagcugcuuaagauagguguuaggaacggggcaugguggcgcacgccuuuaaucccagcacucaggaggcagaggcaggcggauuucugaguucgaggccagccuggucuacagagugaguuccaggacagccagggcuacacagagaaacccugucucgaaaaacaaaaacaaaaacaaaaacaaaaacaaaaaaaaaaaaaaaagaaagaaagaaagaaagaaaaagaaagauagguguuaggaagagaggcugcggggcugccagcuuuugucaucuuuagcaugugcuguugcacagccugaaagcuuccaacuuucguauccagaaaguccgucuuagagagcagucaaaaacuaaauacuaaauuacauacauacauacauacaaaucauaguuaacaucaagcgagaaagugucagggugugguugacagggucuaggaaacccugcaguugcgcugcuacccacuagggggagcacaacggaucaauucuggauucugggaacagaucucaaccaggaugacucaacucaguagaauuuccuuuaggaauucugcugugggaaaagcagaguccggcacagaacuugaaugaugcucuuccuggugcaaccacagcuuugguuuaacucuguguuaagacauuccagccaccauuccuuuggaaaugaguggcguuuggaugaaacaaaggcagaacucuguagaaaggaaccuuguagccgagagccuaggggugacgcuacccugauaguugcccucucaugccuuaguucugcacaaguaaaauuagugacgucuagcuuucugcuuuacacacacacaauaaaucuauaguuucacuagguagcccagguuaacccaaacucuugauccuccaaggguauaugcacccccacaccuugcugaauauacuuucgaacgucuaaaauguccucucuccucccccccccccccccagugcacgauuacagaugugcuguucauuuucuucagagaaauucaugagaauuacuuuagggcaucucauucaaucacaguagccucuuguggaauaggucacucacuguaaucucccuccaaaguucagaacaugugugugcagauuccuauagucauaugaacagauuauucauauguuuucucacacugucuaagaauaucagaaaaguucucccuugucugagucaucuaguguuucuaagcacucggaguucuguguggaauaccuuacugcaugcacuggagcuaucaaaaggaagcucacaaaauaucacuugcuguuugccucucugaccccugauaaaugaacaagacugcaagaaacugcuucagccaaagaugaggcacugcgcuccucuggcacacucuauucucuagccuuccuaauucucaaauaaggagaauauauuacaauaaagaagauuaaauuuggauuauaauucaaaauaagaaaagaauucaauaggggcaaagaaaaauauaggaaaaauaguuuacagcgauuagaccaauauuuauauuacaguaaauggcucaaaacuaaauacugcauaauucuauacacuagaaaaaaauuuaaauauaaacauacauguauauuuaaaucaagaaaauggaauaaaagggcauacguuaauauucaacccaagaaaacugggugaaguacacucuuuagguacaguaauucucgaaauauuuuuaaccugagcccuccauuuuuguuuuccccagaagcaaaaaugccuacagagacugagagaugcauugagucccugauugcuguuuuccaaaaguacagcgggaaggauggaaacaacacucaacucuccaaaacugaauuccuuuccuucaugaacacagagcuggcugccuucacaaagguaucugucccagcccccauacccugacugcuuacugcacugaacaggagcccagcagaauggccuugcaugaaacagccuuacuccagucacaugguuguaacuaaacaucuuacucacuugaaauauggcuaaugacuuucuaaauugaucuaaauguaaauguagagaguggcuguguguguguguguauuauaggacauuugaacauguuucuaguuaggguguggcucagcccuuaguacacacuuaaucccuugagaagagagaggaaaggggagcuacuugaaggagagacagacaguacaagaagagaguacagugcaggaauacaguagaguucauugagagcagugcaguagcguugagagggagaguggagcagcagagagggaggaggagacaguuuaacugggauaguuguacagaaacacguugcaagagagaacaagcuggacacagguaaagacagaaugagcaagagaaugagaaggagccagaagauuagaaaagauugcuagauuuaguuugaaaccaagcggagcaauucggaggcugacagaaaagcuaaguugaauaagucauuugggugagcagcuagagccagaacaguugaguugaccagccaccuggaguucagaaagaacuagaaggggugaacuuacugagcagcaagucucagaggcugaaaacauucuaggccuagauaagauaguauggaggcuagaggcuuccaggaugaggccuaaguuggcaggcugaagcaguaagccuucaagaugacaauuacaucagauuauguaacguguguauguguguguguguguguguguguguguguguguguguguaugugucuguguaucuguguguguguaugugugugucucuguaugugugugugugugugucucugugucuguguguguauguguguguguauguuggagauggguggaagaugaagcuucuuauguaacgugugugugugugucugugucucugugugugugugugucucugugucucucuguguguguguguaugugugugugugugucucugucugugugugugucucugugucuguguguguguguguguguguguguauguuggagauggguggaagaugaagcuucuuauuuaacgugugugugugugugugucugugucucuguguaugugugugugucuaugucucuguaugugugugugugucugugucugugugugugugugucuguguguguaugugugugugucucugugucucuguguguguguguguguguguuggagauagguggaagaugaagcuucuuauuuaacgugugugugugugugugugugugugugucugugucugugugugugugugugucugugugugugugugugucuguguguguaugugugugugucucugugucucugugugucugugugugugugugugugucugugucuguguguguguguguuggagauggguggaagaugaagcuucuuaggcaggaccuguaacuuucuaccucaagccacucacugccucgugguuuauauaugggaguugcauccaacacuuuccaaaguugaauaacccuuaacgucacagaaagaacauaggacaaggaguaaagaagucuggauuuguguccaggucugcugcuaaagcaggucgcucucaauaaccccuucccggacuuucuacuccacugagaauaaaauguggcagcauauuaagaggcaccgaagaaagugaaauauaaagaugucauuguuuuugcagaaccagaaggauccugguguccuugaccgcaugaugaagaagcuggaccucaacugugacgggcagcuagauuuccaagaguuucucaaccucauugguggcuuagcuauagcgugccaugauucuuucauccaaacuucccagaagcgaaucuaauccucuuaguucccauccaaccaccaagucaucaccucccccgaccccauccacaccugcacugagcccagcacaccuaccacaacauguaucccacgccugcuggcaaaaauaaaacaaugccauuuuuuuuuaaaugua

SEQ ID NO: 12311 - RNA, 5794 nt, Mus musculus
uacauuuaaaaaaaaauggcauuguuuuauuuuugccagcaggcgugggauacauguugugguaggugugcugggcucagugcagguguggauggggucgggggaggugaugacuuggugguuggaugggaacuaagaggauuagauucgcuucugggaaguuuggaugaaagaaucauggcacgcuauagcuaagccaccaaugagguugagaaacucuuggaaaucuagcugcccgucacaguugagguccagcuucuucaucaugcggucaaggacaccaggauccuucugguucugcaaaaacaaugacaucuuuauauuucacuuucuucggugccucuuaauaugcugccacauuuuauucucaguggaguagaaaguccgggaagggguuauugagagcgaccugcuuuagcagcagaccuggacacaaauccagacuucuuuacuccuuguccuauguucuuucugugacguuaaggguuauucaacuuuggaaaguguuggaugcaacucccauauauaaaccacgaggcagugaguggcuugagguagaaaguuacagguccugccuaagaagcuucaucuuccacccaucuccaacacacacacacacagacacagacacacacacacacacacagacacacagagacacagagacacacacacauacacacacagacacacacacacacacagacacacacacacacacagacacagacacacacacacacacacacacacacacguuaaauaagaagcuucaucuuccaccuaucuccaacacacacacacacacacacagagacacagagacacacacacauacacacacagacacacacacacacagacacagacacacacacacauacagagacauagacacacacacauacacagagacacagacacacacacacacacacguuaaauaagaagcuucaucuuccacccaucuccaacauacacacacacacacacacacacacagacacagagacacacacacagacagagacacacacacacacauacacacacacacagagagacacagagacacacacacacacagagacacagacacacacacacacguuacauaagaagcuucaucuuccacccaucuccaacauacacacacacauacacacacagacacagagacacacacacacacacauacagagacacacacauacacacacacagauacacagacacauacacacacacacacacacacacacacacacacacacacauacacacguuacauaaucugauguaauugucaucuugaaggcuuacugcuucagccugccaacuuaggccucauccuggaagccucuagccuccauacuaucuuaucuaggccuagaauguuuucagccucugagacuugcugcucaguaaguucaccccuucuaguucuuucugaacuccagguggcuggucaacucaacuguucuggcucuagcugcucacccaaaugacuuauucaacuuagcuuuucugucagccuccgaauugcuccgcuugguuucaaacuaaaucuagcaaucuuuucuaaucuucuggcuccuucucauucucuugcucauucugucuuuaccuguguccagcuuguucucucuugcaacguguuucuguacaacuaucccaguuaaacugucuccuccucccucucugcugcuccacucucccucucaacgcuacugcacugcucucaaugaacucuacuguauuccugcacuguacucucuucuuguacugucugucucuccuucaaguagcuccccuuuccucucucuucucaagggauuaaguguguacuaagggcugagccacacccuaacuagaaacauguucaaauguccuauaauacacacacacacacagccacucucuacauuuacauuuagaucaauuuagaaagucauuagccauauuucaagugaguaagauguuuaguuacaaccaugugacuggaguaaggcuguuucaugcaaggccauucugcugggcuccuguucagugcaguaagcagucaggguaugggggcugggacagauaccuuugugaaggcagccagcucuguguucaugaaggaaaggaauucaguuuuggagaguugaguguuguuuccauccuucccgcuguacuuuuggaaaacagcaaucagggacucaaugcaucucucagucucuguaggcauuuuugcuucuggggaaaacaaaaauggagggcucagguuaaaaauauuucgagaauuacuguaccuaaagaguguacuucacccaguuuucuuggguugaauauuaacguaugcccuuuuauuccauuuucuugauuuaaauauacauguauguuuauauuuaaauuuuuuucuaguguauagaauuaugcaguauuuaguuuugagccauuuacuguaauauaaauauuggucuaaucgcuguaaacuauuuuuccuauauuuuucuuugccccuauugaauucuuuucuuauuuugaauuauaauccaaauuuaaucuucuuuauuguaauauauucuccuuauuugagaauuaggaaggcuagagaauagagugugccagaggagcgcagugccucaucuuuggcugaagcaguuucuugcagucuuguucauuuaucaggggucagagaggcaaacagcaagugauauuuugugagcuuccuuuugauagcuccagugcaugcaguaagguauuccacacagaacuccgagugcuuagaaacacuagaugacucagacaagggagaacuuuucugauauucuuagacagugugagaaaacauaugaauaaucuguucauaugacuauaggaaucugcacacacauguucugaacuuuggagggagauuacagugagugaccuauuccacaagaggcuacugugauugaaugagaugcccuaaaguaauucucaugaauuucucugaagaaaaugaacagcacaucuguaaucgugcacugggggggggggggggaggagagaggacauuuuagacguucgaaaguauauucagcaaggugugggggugcauauacccuuggaggaucaagaguuuggguuaaccugggcuaccuagugaaacuauagauuuauuguguguguguaaagcagaaagcuagacgucacuaauuuuacuugugcagaacuaaggcaugagagggcaacuaucaggguagcgucaccccuaggcucucggcuacaagguuccuuucuacagaguucugccuuuguuucauccaaacgccacucauuuccaaaggaaugguggcuggaaugucuuaacacagaguuaaaccaaagcugugguugcaccaggaagagcaucauucaaguucugugccggacucugcuuuucccacagcagaauuccuaaaggaaauucuacugaguugagucauccugguugagaucuguucccagaauccagaauugauccguugugcucccccuaguggguagcagcgcaacugcaggguuuccuagacccugucaaccacacccugacacuuucucgcuugauguuaacuaugauuuguauguauguauguauguaauuuaguauuuaguuuuugacugcucucuaagacggacuuucuggauacgaaaguuggaagcuuucaggcugugcaacagcacaugcuaaagaugacaaaagcuggcagccccgcagccucucuuccuaacaccuaucuuucuuuuucuuucuuucuuucuuucuuuuuuuuuuuuuuuuguuuuuguuuuuguuuuuguuuuuguuuuucgagacaggguuucucuguguagcccuggcuguccuggaacucacucuguagaccaggcuggccucgaacucagaaauccgccugccucugccuccugagugcugggauuaaaggcgugcgccaccaugccccguuccuaacaccuaucuuaagcagcuuauuaucaaaauugcacugcuguggcucacugcaccuaggaaugcccagaguaccugaaccuucuucuggagauaaguucuuucuaaagagucugaaggagagaaaacuauugguaaguuagggggggggggggggggaaacaccaaacaccacagccuagaaacaaguguuuacacaacaugcucuuccuaucagaacuaaaaucuagcugccuuauuagugugucacaugauagcaggagaguuggcacggaggacucgcuagacuggggaggagguuccaggccuauagaugcuccuuucuucuuucccuuagaacagagggcucagaugggaagguuuugcccauguggagcagcggcugaaagagagggcacggcccacaccaucgcccuuuugcaugaugggaacagugacagcaaggaaaaccccacugugaaaggacgcagugagauccuuuuaaaacgcaaccuaaacacccaacguuccagggaagcuuccccuugacagaaauaugugaaaaagagggaaccacaccaacuaucucuuucucaaccagcaccaaagcucuuccuucaaguguucagggucucaucuaucuccuuucaccucauaaccuguuggugcugggcccuagguacccugugugaugaaaaggggaagaaggaaacaauaaguaggaagugaugaaagacugacacaccaaagcagggguccgcaagcuuucuguugcuguuauuugcaauaaagggacagcuguggauauuuuuuagcucuuuaugcuccauaagaucuuaucacucuugccauagucaggcagcaagggugaggauacauaaagcaaaaggguguggcggugccuguaaacucuauacauuugauuuucaugccauucucaugcauuacaagggauucuuuuccuuuugaaugucuuccaaccauuuaaaaacauaaaaaucuauaauuaguuugggacuagggcaaaaacgcacuugggccucucuccaacauuugcugauccucuuugaagagucaaaggaagggguagauuuuggaggggaugugaauuacuggaaacauuuuuuaaagaaacgaggggaacugaaguagcagguaggagacaggcaggugauguagggaguggcuaaaaagauggcugggaguggaguaagggggagaggaaaagagcgagcugggagggacuggccuccucccacauuccugucugugguuccaauggcugcaacaggcuccgguuucucaucuguaugucuuggcuguuugccugcgguuuccccgcagcugagucccccagaauucaggaaggcuacguucugaaccgcuuucuuucuagucuucaugaacgccuagcgacgcugccccaaguucucacugagucugcagcucucuggcggccgccacugguuggguucaggggcucacggccccagggagucuagcggccgcacccagcccgggcucaggccaguuaggcagccgcacccagccuagaacuuauuuugcccgggagaacaaaagaccgccguuucuccccacaggcuguuauuaggguguaauuuuagggcuuccucgugcccuccacucuucucuaauugccucccacaguuucaucuucccgauccauuuucugccacguccacacguuaguccaagauacacccagccaagagcaugcguagcucuuuguuguuuucauuaaaaagaaaaaaaucuaaaaaguucaaaaacuuaugcuuaccaaguugaggagcgagguccggcugcgacuguggcugacgguggcugggacaggagugg

SEQ ID NO: 12312 - RNA, 8318 nt, Mus musculus
aggacccggcccagucagugcgcaccggccgggcgcuagaagugggaaacggaguagcggcgcccgggccggagcagcucugcaccggacgccgaguaagucugugcgcggguccgcgaggguggcggggcagugacgggcgcgggggcucagggugcagcucggagggagcggggccuccaccggcucauggcggccggccugccggagggcgggccgagcgcugcuggagcgggcgauccgggcccggcuggggccucggaccagagaaggccugcggggcaacagguagggggacuggggccgggcgcucgcucaggauccaugguacagacgccccuuuguuaggaguggagcaguagcggaccuucggugcuagaagccccugcgggcccgcgugcguccuggggccugaguguggaggccgaggaggaacgguggcggccccugcuguugcugcuguugcugcuacugcuaccgccgccgcugccgccucuguuucugacccccuugugcccaucccaagagggaggucagaguguccaugugccuaacgggaaacaggaaggaguacacucuuuagugucugucccggccccaaagggcucacauuccuauaccguuauggggcguguuuggccagcucuggguuguaacuugcuaauuacaggcccagaggcccucaaguuaguuggcuaccugcagguggguggcauuucuuuuuagccugagcuugggaauuccugugccuaagcugcacuccuggcauccaaaccagaucucacuuauccgaguuuccagccucagcugucaggguguucuaagcgcugugaggucuggagugagccggucuuccccagaacugaguuagggaaggccucccccagaaauuacuucuguuugugugagagcugggguagggggucacuucccaucccagagcuaaggugacugucuugcauuugugauggggccccuaaggucaaauauuccguuccuuaggucuuguuucuggccacauagugccuaauuucuaaggggugugguguggugugcugugugugugaacuaguucuggugccucuauucucacuggagccucugacuagguuucucucugucgcuggccacagggagacugacauuguacaguuccuuucaacacuaccccauuugccgcugcuacuucaaccuacuggccucucccugucucuggaaggcauauucuuauauaguguuugggguuggagcagggaaguuugugaaacaucccagagaagccugaggccacgguugucacagccucaccccuuagcuuuaccagaaucugcccuguauuuuugggcucauacuuuagcccgaagcaguugacuucuauugcucuucaauaucuagaaagaaguucuuuuuuuuuuuuuuuuuuaaaugguuguugauuuuguuuuuuuuuuuuuuuagauuuauuuauuucauuauauguaaauaccauagcugucuucagacacuccagaagaaggcaucagaucucauuacggaugguugugagccaccaugugguugcugggaauugaacucaggaccuucagaagagcagucagugcucuuaaccacugagccaucucuccagcccuagaaagaaguuuuuuguuuuuuguuuuuguuuuuuugguuuuucgagacaggguuucucuguauaguccuggcuguccuggaacuuauuuuguagaucuggcuggccuugaacucagaaauccgccugccucugccucuggagugcugggauuaaaggugugcaccaccacgcccggcucuaugucgccuucuuaaugguugcucagacuugagagcccugugaaaccgucucuaucccacuaucuacugucucacuggcccugagguuuucuuacaggucacacuucuauccucccagcuuucuggcucugcaggugcccaucucucacccuauuacacuugcauuggagggugggguggggaggaaucaaucagaguuggagccaggcaaaaaccuugcuuagguuucaaguaauauaauccuugugaaguccgugcuguauuggcuccucuucagccugugauucugaaaguggugccugucucugaggcaggugugugugaggaagacagauggacacuacacuggaucuccucacgugugcaggcgguauaauuuuugugaguggaagaguugcagguguaauuaaguugcagguguaaucaagguguaaucagcccuuaggggcuggaugucgccuucucucuaguucugauuucauguugauggaaugcucugucugaugugcugugccaaguagccgccaggggcgcagcaaggagccaacuggcucugaggagguguguaaggcugacuagaaacccuagucccuucuccuccuguugagucaaacguccugacccugcuugccucuggugcugcuucucuacuguggaaguucagaacaacaaagaaggacacaucaagcuugaagcccagugugcaggcccccagcagucuucacuucccagggacacagcgcaagaauccccagguugagauaggugugcuguucugugacuacccaacccccacccucuagcuccuuaccuuuuugguagggauaagcaaggcacuagacauuccuacgcugcuggagcccgggagagaggcuccacccacucggggcccuuagcuagcucucugaaucuuuaacucucgaaaggcucuaugaagaaaaacauccuaguuaugggacggcuuggagauggcccaaggcuaggguugccugugugcuugauuuuaggucucacuggaggaaaaguuaggcacugaggaacacaguagccaggcgacaaggucaggaauuagucccuauuuccuauccaguuaacccaaaagguaggaaggaagaggugggguguccaaaauuguuccuucaguuggccuucugccuucuucccuuuucuucucuauucaguuuucuccuuuucucuaggaagaaagugugcuugugugggcagucacacuuaauucuguccuuuggagaggcuuccacucuuuuuauuuuuuugguuuuuuuuuuuuuuuucgagacaggguuucucuguauagcccuggcuguccuggaacucacuuuguagaccaggcugaccucgaacucagaaauucaccugccucugccucccaaguucugggauuaaaggcaugcgccaccaccgcucggugaggcuuccacucuuaacaaauuaauuuuucagguugagguggaggggaaagagguagugcucuccaucauggggccuggaauguauaauugggaugugugugccgggugugcagcugaaaauccuuuaucgucuaucuaucugaccucugaguucauccacaagagcagugaccaggaguggggacaagaggguaaaguccuugagcuggaauacugacuggccugugacaugccgagagggauuucgcaagugcuucugugaaagguggaggcggggcuguugaaagagccaaccagacccaggaccagccuagcucagcuguggacugagggcucuguccuccuucagcaacuccauagucagugccuagugccucugcucacgcuggcccacaggcugcugcuucaguucucuccaccugggaggccaccuuucuccugucacagcucauagucucuaggucagucugcaugcaguuaccucuccuuauucacagggggagagcuggggagccuggagucucagaauuuccaggcaugcuccugguugaaccuugcuguuuuggauucccuguccccaguccugacuguaucuguacuuguacccugauuuccuuccuuuuucccucuuuaucucccuccauuucuuuucuuguuuuuuucaaggcaggguuucucuguagccugggcuggucugggacuugcuuuuccuuuguagaccuugcuggcucaaauucuuuucucacuuccuuucugaacagaggcuuauagaucauuuucugcugcccacguagauguguggagcauggugugugugcaggugucugaugcucauugugcuuuggggaugugcuugucucauucauucaaaacugagcagcccuccucuccucccccucuagacaguguaugcaguucagcuuggucucagacuuaugaucccagugccucagcagcucaagugucgaaauuacagcaccaagacucaucaccacaccugacauaaucuauuuuacaaacuaagggucuuacuuuguagcccuggcuguucuggaacuuuuuguguggcucuuccugccuuugccucugccuccugagugcugggcuuaaaggcaugcaccuucugcucacucucccuguuuaacuuuucuuuuuuuuuuaaauuuuuaauuuuuuuuauuuucaagacagggucugauuaacuuuucugauuguugacuacagcuucucggacuggguuuugcuuguccucuagguugaaauccaaaagauaagauugauaagaaaggagugcuuuuuuuuuuuaauuguagggaaucaggcccaaguggugucagcaucaccuaagguugcaucaaacuguaaauaaaugcugaacuugaaagccacugauuuccuauuacagaugaggaaaacagcuaacuuaagccaaccgauucauuccaaggcuauguagccagaguccaaggcuugugugacuaucccauucccuuugacuagcaggaacguucacucccucucugcagagugcuugcacguggccuucugaccuuuucuuuccucacucaggaugcuccagaccuuguaugacuacuucuggugggaacgacuauggcugccugugaacuuaaccugggcugaucuagaagacaaagauggacgugucuaugccaaagccucagaucucuacaucacacucccccuggcccugcucuuucucgucauucgauacuucuuugagcugugagcaugcccucaaaccuucucugguugucagccaaccuauagggcuucguguuggucuucugauacuuaguucuggacauugguguucuggccacucaggagcccaugcucccccucccccagcgcaccauugucuuccugaggcugaggacucagcauccccagccuuguccuucaaugguuuuuuguuuucauccugcacccgccuccucgccuggucaauagugaacauaggcagcuuugucagcugugggcagcccaggaggccagaagaaagguggaugccagggaauuugggaaacugaggcccagaauuaagucuugcaguacuuucucugucccauuuagggguuaggagugcuccaagggagccagacaccucuuucucaugucccuuacucaguuauguggcaacaccccuggcugcccuccugaauguuaaggagaaaacccgacugcgggcaccucccaaugccaccuuggaacauuucuaccagaccagcggcaagcagcccaagcagguaugagaggcagaugauucuggcaguugcugaguuugggugggucagaguuugaaugcuugcuuuggaaggugaggacuugguagagggugggcaugauucagguuauuauggggagagguuaaguagaaugggggcacugcugaucugaaggcugaauauacuggucuuacuaugccuagguggagguagaccuuuugucacggcagagugggcucucuggacgccagguagaacgcugguuccgccgccgccgcaaccaggacaggcccagucuucucaaaaaguuccgagaagccaggugggaggaguuggggcaagugaaacuggguggcaguuguguuuucuugcugggaggugaagguaccuugagagggugucugggggcagugggaaacuguugauccucccaccugguuuccucuugcagcuggagauucacguauuaccuaauugccuuuguugcuggcauggcugucacuguggaugugaguacugggaagugggagcacauccuuuaagauggaauaagccauaggauaugaguccuucuuccuuuaaucucucucuuugcagaaacccugguucuaugacuuaaggaaaguuugggagggauaucccauacagguaugagaagaccccuuauguaauaguguucuauagcacacaauaccuuaugaaggaaggguuucaugaauacauggcagaagacaaucaugaaagacuuaucuugaggggcuagaaguaaugaguuuggaggugugccccuuaggucugaguguccugggaucccucaccccuaauuucucucccagagcaucaucccuucucaguauugguacuacaugauugaacuuuccuucuacuggucccugcucuucagcauugccucugaugucaagcgaaagguggguaaagagaccagaugagguccuggggugaagagccuccccuuugacuucaugggaaucugggcagagcugcugggauguggggaacaaaaguugagggguuggaaggaggaacaauggaauagggaagaguccuuuggagccucuaucuuuucugcaggauuuuaaggaacagaucauccaccauguggccacuaucauucuccucugcuucuccugguuugccaauuacguccgggcagggacccucaucauggcucugcaugacgcuucugacuaccugcuggagguuaggcuuccucacaguagaggccccagugcagguuccccuugucccucaccuuccaggggaugggagagagggaauugucagugcagcuagccacaugcaaauacuacugucuaugggagucaagagccagugauaauagaugguguuuuuauuuauuuuuauagucugccaagauguuuaacuacgcgggauggaagaacaccugcaacaaccucuucauuguguucgccaucguuuucaucaucacucggcugguuaucaugccuuucuggugaguaggugcucaggcuccugccuuuucauuugucgcaggcuuucacccauggccauguuuacaacuugcccuugaaucugcaggauccuacacugcacgaugauauacccacuggagcucuacccugccuucuuuggcuauuauuucuucaauuuuaugauggcagugcuacagaugcuccauaucuucugggccuacuucauucugcguauggcccacaaguucauaacuggaaaggugaggaaggcccaccccccuuuuguaggucucacuucucucacacuguaacucuccaaauuccuugucaugcugcaacucucuuuaaaaaguaugaggguuuggggguuaacaggaaacuuagaggcagcccuuggauacugaaggauauauaacccuuuuguccuuuucacagcugauagaagaugaacgcagugacagagaagaaacagagaguucagagggggaggagacugcagcuggggcaggagcaaagagccggcuccuagcuaauggccaccccauccucaauaacaaucauccuaagaaugacugaaccauuguccuagcugccucccacaucaaugcaugaggccaagaaacuagccaagcuucccuuuaggggcauuugagcucuggggagaaaggauaugaggagucuacacugaccuuccacuucuuuuuucacccaguugccuuuaaaccagacucuaaacagccuaucuccagguagaaaggaggcuuggccacauccacauccuguugagagacauagucucauuucccucucuaccuucuaagcuacccuucuugcuaauccuucuucagcucugaggguuggaaucauaacucacauuccucauuccuaagaauuuggagcuagcuguuugccuuugacucccugacuucaagccaggguugugccuuacugucccuuuucugggccucauucugccaaagcuggaccaagguuccaucuuucuaagcucccuagcucaggccaagaaagaaagcugagcuacuuuuaacuuucucuuccuuaaauacaagucaaugaagugaaggaggguaugcauacaugccccucacccuaccccagggaccaugguuccuaggaucucacugccucccucucuggccuuccuguccccucccuucagcuaugacagcugguguggaguagaagggcaacuaguucuguuauuuauugaacauuugggguuucaguuguaaagccacaacuacagguaggaccugauauuucggcgagggaccauuucagaccaaaauguacuguuaauuuuuuuuaauuaaaguauauuaaagguuaaauaa

SEQ ID NO: 12313 - RNA, 8318 nt, Mus musculus
uuauuuaaccuuuaauauacuuuaauuaaaaaaaauuaacaguacauuuuggucugaaauggucccucgccgaaauaucagguccuaccuguaguuguggcuuuacaacugaaaccccaaauguucaauaaauaacagaacuaguugcccuucuacuccacaccagcugucauagcugaagggaggggacaggaaggccagagagggaggcagugagauccuaggaaccauggucccugggguagggugaggggcauguaugcauacccuccuucacuucauugacuuguauuuaaggaagagaaaguuaaaaguagcucagcuuucuuucuuggccugagcuagggagcuuagaaagauggaaccuugguccagcuuuggcagaaugaggcccagaaaagggacaguaaggcacaacccuggcuugaagucagggagucaaaggcaaacagcuagcuccaaauucuuaggaaugaggaaugugaguuaugauuccaacccucagagcugaagaaggauuagcaagaaggguagcuuagaagguagagagggaaaugagacuaugucucucaacaggauguggauguggccaagccuccuuucuaccuggagauaggcuguuuagagucugguuuaaaggcaacugggugaaaaaagaaguggaaggucaguguagacuccucauauccuuucuccccagagcucaaaugccccuaaagggaagcuuggcuaguuucuuggccucaugcauugaugugggaggcagcuaggacaaugguucagucauucuuaggaugauuguuauugaggaugggguggccauuagcuaggagccggcucuuugcuccugccccagcugcagucuccucccccucugaacucucuguuucuucucugucacugcguucaucuucuaucagcugugaaaaggacaaaaggguuauauauccuucaguauccaagggcugccucuaaguuuccuguuaacccccaaacccucauacuuuuuaaagagaguugcagcaugacaaggaauuuggagaguuacagugugagagaagugagaccuacaaaaggggggugggccuuccucaccuuuccaguuaugaacuugugggccauacgcagaaugaaguaggcccagaagauauggagcaucuguagcacugccaucauaaaauugaagaaauaauagccaaagaaggcaggguagagcuccaguggguauaucaucgugcaguguaggauccugcagauucaagggcaaguuguaaacauggccaugggugaaagccugcgacaaaugaaaaggcaggagccugagcaccuacucaccagaaaggcaugauaaccagccgagugaugaugaaaacgauggcgaacacaaugaagagguuguugcagguguucuuccaucccgcguaguuaaacaucuuggcagacuauaaaaauaaauaaaaacaccaucuauuaucacuggcucuugacucccauagacaguaguauuugcauguggcuagcugcacugacaauucccucucucccauccccuggaaggugagggacaaggggaaccugcacuggggccucuacugugaggaagccuaaccuccagcagguagucagaagcgucaugcagagccaugaugagggucccugcccggacguaauuggcaaaccaggagaagcagaggagaaugauaguggccacaugguggaugaucuguuccuuaaaauccugcagaaaagauagaggcuccaaaggacucuucccuauuccauuguuccuccuuccaaccccucaacuuuuguuccccacaucccagcagcucugcccagauucccaugaagucaaaggggaggcucuucaccccaggaccucaucuggucucuuuacccaccuuucgcuugacaucagaggcaaugcugaagagcagggaccaguagaaggaaaguucaaucauguaguaccaauacugagaagggaugaugcucugggagagaaauuaggggugagggaucccaggacacucagaccuaaggggcacaccuccaaacucauuacuucuagccccucaagauaagucuuucaugauugucuucugccauguauucaugaaacccuuccuucauaagguauugugugcuauagaacacuauuacauaaggggucuucucauaccuguaugggauaucccucccaaacuuuccuuaagucauagaaccaggguuucugcaaagagagagauuaaaggaagaaggacucauauccuauggcuuauuccaucuuaaaggaugugcucccacuucccaguacucacauccacagugacagccaugccagcaacaaaggcaauuagguaauacgugaaucuccagcugcaagaggaaaccaggugggaggaucaacaguuucccacugcccccagacacccucucaagguaccuucaccucccagcaagaaaacacaacugccacccaguuucacuugccccaacuccucccaccuggcuucucggaacuuuuugagaagacugggccuguccugguugcggcggcggcggaaccagcguucuaccuggcguccagagagcccacucugccgugacaaaaggucuaccuccaccuaggcauaguaagaccaguauauucagccuucagaucagcagugcccccauucuacuuaaccucuccccauaauaaccugaaucaugcccacccucuaccaaguccucaccuuccaaagcaagcauucaaacucugacccacccaaacucagcaacugccagaaucaucugccucucauaccugcuugggcugcuugccgcuggucugguagaaauguuccaagguggcauugggaggugcccgcagucggguuuucuccuuaacauucaggagggcagccagggguguugccacauaacugaguaagggacaugagaaagaggugucuggcucccuuggagcacuccuaaccccuaaaugggacagagaaaguacugcaagacuuaauucugggccucaguuucccaaauucccuggcauccaccuuucuucuggccuccugggcugcccacagcugacaaagcugccuauguucacuauugaccaggcgaggaggcgggugcaggaugaaaacaaaaaaccauugaaggacaaggcuggggaugcugaguccucagccucaggaagacaauggugcgcugggggagggggagcaugggcuccugaguggccagaacaccaauguccagaacuaaguaucagaagaccaacacgaagcccuauagguuggcugacaaccagagaagguuugagggcaugcucacagcucaaagaaguaucgaaugacgagaaagagcagggccagggggagugugauguagagaucugaggcuuuggcauagacacguccaucuuugucuucuagaucagcccagguuaaguucacaggcagccauagucguucccaccagaaguagucauacaaggucuggagcauccugagugaggaaagaaaaggucagaaggccacgugcaagcacucugcagagagggagugaacguuccugcuagucaaagggaaugggauagucacacaagccuuggacucuggcuacauagccuuggaaugaaucgguuggcuuaaguuagcuguuuuccucaucuguaauaggaaaucaguggcuuucaaguucagcauuuauuuacaguuugaugcaaccuuaggugaugcugacaccacuugggccugauucccuacaauuaaaaaaaaaaagcacuccuuucuuaucaaucuuaucuuuuggauuucaaccuagaggacaagcaaaacccaguccgagaagcuguagucaacaaucagaaaaguuaaucagacccugucuugaaaauaaaaaaaauuaaaaauuuaaaaaaaaaagaaaaguuaaacagggagagugagcagaaggugcaugccuuuaagcccagcacucaggaggcagaggcaaaggcaggaagagccacacaaaaaguuccagaacagccagggcuacaaaguaagacccuuaguuuguaaaauagauuaugucagguguggugaugagucuuggugcuguaauuucgacacuugagcugcugaggcacugggaucauaagucugagaccaagcugaacugcauacacugucuagagggggaggagaggagggcugcucaguuuugaaugaaugagacaagcacauccccaaagcacaaugagcaucagacaccugcacacacaccaugcuccacacaucuacgugggcagcagaaaaugaucuauaagccucuguucagaaaggaagugagaaaagaauuugagccagcaaggucuacaaaggaaaagcaagucccagaccagcccaggcuacagagaaacccugccuugaaaaaaacaagaaaagaaauggagggagauaaagagggaaaaaggaaggaaaucaggguacaaguacagauacagucaggacuggggacagggaauccaaaacagcaagguucaaccaggagcaugccuggaaauucugagacuccaggcuccccagcucucccccugugaauaaggagagguaacugcaugcagacugaccuagagacuaugagcugugacaggagaaagguggccucccagguggagagaacugaagcagcagccugugggccagcgugagcagaggcacuaggcacugacuauggaguugcugaaggaggacagagcccucaguccacagcugagcuaggcugguccugggucugguuggcucuuucaacagccccgccuccaccuuucacagaagcacuugcgaaaucccucucggcaugucacaggccagucaguauuccagcucaaggacuuuacccucuuguccccacuccuggucacugcucuuguggaugaacucagaggucagauagauagacgauaaaggauuuucagcugcacacccggcacacacaucccaauuauacauuccaggccccaugauggagagcacuaccucuuuccccuccaccucaaccugaaaaauuaauuuguuaagaguggaagccucaccgagcggugguggcgcaugccuuuaaucccagaacuugggaggcagaggcaggugaauuucugaguucgaggucagccuggucuacaaagugaguuccaggacagccagggcuauacagagaaacccugucucgaaaaaaaaaaaaaaaaccaaaaaaauaaaaagaguggaagccucuccaaaggacagaauuaagugugacugcccacacaagcacacuuucuuccuagagaaaaggagaaaacugaauagagaagaaaagggaagaaggcagaaggccaacugaaggaacaauuuuggacaccccaccucuuccuuccuaccuuuuggguuaacuggauaggaaauagggacuaauuccugaccuugucgccuggcuacuguguuccucagugccuaacuuuuccuccagugagaccuaaaaucaagcacacaggcaacccuagccuugggccaucuccaagccgucccauaacuaggauguuuuucuucauagagccuuucgagaguuaaagauucagagagcuagcuaagggccccgaguggguggagccucucucccgggcuccagcagcguaggaaugucuagugccuugcuuaucccuaccaaaaagguaaggagcuagaggguggggguuggguagucacagaacagcacaccuaucucaaccuggggauucuugcgcugugucccugggaagugaagacugcugggggccugcacacugggcuucaagcuugauguguccuucuuuguuguucugaacuuccacaguagagaagcagcaccagaggcaagcagggucaggacguuugacucaacaggaggagaagggacuaggguuucuagucagccuuacacaccuccucagagccaguuggcuccuugcugcgccccuggcggcuacuuggcacagcacaucagacagagcauuccaucaacaugaaaucagaacuagagagaaggcgacauccagccccuaagggcugauuacaccuugauuacaccugcaacuuaauuacaccugcaacucuuccacucacaaaaauuauaccgccugcacacgugaggagauccaguguaguguccaucugucuuccucacacacaccugccucagagacaggcaccacuuucagaaucacaggcugaagaggagccaauacagcacggacuucacaaggauuauauuacuugaaaccuaagcaagguuuuugccuggcuccaacucugauugauuccuccccaccccacccuccaaugcaaguguaauagggugagagaugggcaccugcagagccagaaagcugggaggauagaagugugaccuguaagaaaaccucagggccagugagacaguagauagugggauagagacgguuucacagggcucucaagucugagcaaccauuaagaaggcgacauagagccgggcgugguggugcacaccuuuaaucccagcacuccagaggcagaggcaggcggauuucugaguucaaggccagccagaucuacaaaauaaguuccaggacagccaggacuauacagagaaacccugucucgaaaaaccaaaaaaacaaaaacaaaaaacaaaaaacuucuuucuagggcuggagagauggcucagugguuaagagcacugacugcucuucugaagguccugaguucaauucccagcaaccacaugguggcucacaaccauccguaaugagaucugaugccuucuucuggagugucugaagacagcuaugguauuuacauauaaugaaauaaauaaaucuaaaaaaaaaaaaaaacaaaaucaacaaccauuuaaaaaaaaaaaaaaaaaagaacuucuuucuagauauugaagagcaauagaagucaacugcuucgggcuaaaguaugagcccaaaaauacagggcagauucugguaaagcuaaggggugaggcugugacaaccguggccucaggcuucucugggauguuucacaaacuucccugcuccaaccccaaacacuauauaagaauaugccuuccagagacagggagaggccaguagguugaaguagcagcggcaaaugggguaguguugaaaggaacuguacaaugucagucucccuguggccagcgacagagagaaaccuagucagaggcuccagugagaauagaggcaccagaacuaguucacacacacagcacaccacaccacaccccuuagaaauuaggcacuauguggccagaaacaagaccuaaggaacggaauauuugaccuuaggggccccaucacaaaugcaagacagucaccuuagcucugggaugggaagugacccccuaccccagcucucacacaaacagaaguaauuucugggggaggccuucccuaacucaguucuggggaagaccggcucacuccagaccucacagcgcuuagaacacccugacagcugaggcuggaaacucggauaagugagaucugguuuggaugccaggagugcagcuuaggcacaggaauucccaagcucaggcuaaaaagaaaugccacccaccugcagguagccaacuaacuugagggccucugggccuguaauuagcaaguuacaacccagagcuggccaaacacgccccauaacgguauaggaaugugagcccuuuggggccgggacagacacuaaagaguguacuccuuccuguuucccguuaggcacauggacacucugaccucccucuugggaugggcacaagggggucagaaacagaggcggcagcggcggcgguagcaguagcagcaacagcagcaacagcaggggccgccaccguuccuccucggccuccacacucaggccccaggacgcacgcgggcccgcaggggcuucuagcaccgaagguccgcuacugcuccacuccuaacaaaggggcgucuguaccauggauccugagcgagcgcccggccccagucccccuaccuguugccccgcaggccuucucugguccgaggccccagccgggcccggaucgcccgcuccagcagcgcucggcccgcccuccggcaggccggccgccaugagccgguggaggccccgcucccuccgagcugcacccugagcccccgcgcccgucacugccccgccacccucgcggacccgcgcacagacuuacucggcguccggugcagagcugcuccggcccgggcgccgcuacuccguuucccacuucuagcgcccggccggugcgcacugacugggccggguccu

SEQ ID NO: 12314 - RNA, 7001 nt, Mus musculus
uuuggauugagguaaauaaaaaagcuuuauccugcaacauuuggagauaaagagucugugcccccccaaauuucagaccugcccccccuuucacaucaggcucuuccgguauugacugugcugggaggucugucugaggugggaguccggggucugcagguccaucugccuguacaggucucucagcucccggacuuccugcagcacucucuuugccuggcuccaguuggaggaagccucucccagcagccucucugucuccagcagcagcugcuccgacuccgagucggguggagacugugggggguccuuggccuuccgcuugccgucacccagucccugaaccucugccagcagcuccugagucuucuccaguuuccuugcuaccagguccuggauccgggacagcugcccuggcugggcagggacaggggguagggauuccucagcuugaaggugaagggggcgggcuggggcagugucccucugggauaggaucuccuccagggaggcacaucggcucuucucuguacuggggaacuucuucagugcuugugggguguagggggcucccuugucugguuuuucccaaggccgagaaaggcugcuugcccgcugcgaagagggcuggauccugucugaguccgcucuccgucgacugccagccagcugggccacagacuuguccagaucgacccggaagcucucagcacaagaggcuggcuccucaggggaagggucuuccucuuggaucaggucuaauguuagcaucccaucugagguagaggucgaagccugggaaagagaugugaacaaaggcagugaacggauaacgcaagcuguggucccuucccugaaggggacgccuccacuccaaccgagacccucucccccucuccgcuguguuugaccccugugaugacgauuugaguuccucugcuucucuguaacuuauccuuuccugcacauugucuguguucugcuccucuacaagcuucgcagggcauggcuacuucuuaagcaucauaggggcggcccacgugccacaguaagauccacagacagacggacagaggaggaggcuccucugccuacauuuucucagccacacaccuuagcuccgcucugauaucugaacucugaauccuugccuuguaaugaaccuuguugucuucuuuuuuauauuuauuuuuauuuuauguauauugguguuuugccugcagcuaugucuguaugaggguguuggaucuuggaguuacagacaguugguagcugccaagugggugcugggaauugaacccuggaccucuagaagagcagccacugcucccaaccgcugagccaccucuccaaccuguuguucccuuauuucuuaaguacuguaaucgaacagaagugguaaagggaaugcaguauuuucugugcugucacgugugugcuguugugaccauuucccucagaaccgcuuuccuaaaggacucgccacugccccauguuucaggcagcccagagaccauggauguuccucaggucugcucacuccaaggccugugcucuuccaccuccaauggacagccucucccuagacuuggagcaaggcuggacgugagaaaccacuacuucauuugguagaggguuagccgugggguguguggcacuuacugucaccccucagaguggccggccaccacacagcagcacacaucauucugaacacaacacuucugcuuuucacuguccuagggguauuucucauuuccucagaaguuuuugagaacagagaugucugacuugugcuacgugcugacuaaguaauuuugguuuagaggcaucagacagggacgcaggguggagaggucucccgagccuuugaucccaacagugcuccugcucauacacagcugacggaccagcccagaacuggccccugggcagugcuuacucucuugcaguuuuacauaccacagccaugagguguccccggguuggaggacggcgggaguguuggauuuuugcucugucucgaguagggugggcaagauagcuguccuccucaacggugaccugaagagaugcacugugagucacagggcuucuuuaggacuuugucccaacugaguuuggcaaacccuaacucgccuggacugggaagcaggccauuccaccacuugcuucugagcaggguauaggcacaaggauuuacugacccaacugacccaggacuagauuaagcguugugaagugggugugggguucgaaucagcagagaaaaggcuuaagagagaaaaggggugggggugggggaaugacacaacagggccuuuaaagaagcugagaacagucaggacuuaguggcacacuccuauaauuccaacacuugggaggcagaggcaguuggaucugcuagucuggucuacagagugaguuccaggacagccagggcuacacaaagaaacccugucucaaaaaaacugggaaaaaaaaggccaagaaacugaucugggugaaacuaaagggaccccacaaagcaccccuccucaucuagugagccacagccugcuuuccgcccuaguaccccaucgcugccccacagcaagccccugaccucauccaagauacgguuuuuagcucugguaauggcagaacucagggcguugauccaugacuccuucucuucaggacucacggccaggaagaugagguugggugccugugaggggaauguucuugucuuagcuagggcauuacaaauacauuauacccacccccugaaauaauccucucacucccucacaccccgcucccggaagggagacccugcuucugggaugaucagugacggaaggaacccagagucuguuccugcagaacgcacggguuguuuuagcaaagauggguguggagguggggcuaagaaagugacacuggggacaacuaggggaggugugaaugcacuuagaucuuuaaacgucugaggacacggggugugacaaccauggcuucccuugaacuucagacacccaucagggaagaagcaccaauaauguuucucccaagagaauauguacauacacacaguagggaugugugugugugugugugugugugugugugugugugagugggggaggggagaggaagggguggggagagagagacuucuuuauggcuaaauagguuauaggcuggccugcccagaggaagggaaauggucagaauauuuuccaguuaaauaauaaaagccagagggaaaauaauuauggccccugcagcuagggccacagcgagggcgagccuaccguggugcccggcugucugcaccgggccagggugaacuugcugugauuuuucuugcuccugcucuuggauuuccggagcucuucgcacuucucauagucacucaggucaaacaccuccugacuguuuuucucaucuuuuaccuaugagaggguggggugucaugaggauaaaauuacucuuucucuccuccagaagaaaguggagcaagaaggacagcaggaagccagcccaccuaagguguguacuggggggugggacugagaccugagucccuguaugguggucuguuuaacccacuccccccaagcuaccguccccgugccucccucugcccaugacccucugucucugaaggacgcagcuuacaaguccuuaaaggggcauguccuuaaagggacauggugaauggacugcucugaucauuccaaguaaggaagacaagagugaccacuaacguccaggggaaggggaaaggcagccaacaucuggaagggacaaagggcaacaucuggaagggacaaagggcugccucuggccucagggagugaguacgaugguuccgaguguucuuuccaccugcucucuucuaucguaggauguuacaggagacuacuuccugacagcaggcuaucccucucuuccaccugguuggggauaucccaggaaugagcuggucaugucucccugggaaacaguugaaaccaagcgaacguguauaagaaggcucagcccguggccgaucugcccauccuucugaauugcugagcacaugugcugaggaggaacguggggaaaauucaucuauugccauuugccuggcaagguuuggcuccccagggcucuccccuuucuagggcucccugcuuuuugacugggaagagggccuuaaacacucuggagaaucacuccagagagauucacagcaacacagucuggaaugugggaugauacagcaaccuccucuccugugccuuucccagagaaacuaucagcagaggccagaaagcucggagggcaggaggcgagggaagagcugggugugugcagccaggggaagggacucacuuguucuguuuucccaggggaagggaagggaaggggaggggaggggagggaagggaagggaagggaagggaagggaagggaagggaaggggagggaagggaagggagcucuccuggcguggacaaggcugauaaggcacucugggagugggaugcauugacagaggucaggaagggcaagggugggaggcugggugagguaggcagcaggauaaguagaugccagugcccagaaaagacagauacccuggcaccuugcucucuauuguauucugucucuuccucacaccgaauucccaaagucucauuuaugacuacaucuuccaaauuaacccucugucucucggcccacaguuguaccaagcauucaaccuaacuuccucuacugugaagucucccuaagguauggaucaguuccuaccucugguccuugaucaggucagugaagggaugcccuuggagaguuaggaaugacccuacaacauccacggaagggcuucucuagagaaaggaguugugggagaccuugcuuuccccagaaaggaggacugagacagaaugcuuagcaggguucccuuccucuuuuguuuuugcauguaaauugcaaauacacucugcuuuugggucucacaucuucagugcguugcuuugcuacugcuuuuguuuacaggcugaauaaacagugucuuguggcagcuuugcccuuagcccaggcccacuggaccauggaacugguucugaagaagggucaguauaaggugccguucccucuuuuccacugcccuucccagcagggggcaucuggccccaggucuagucagaugcuccugagucagaggacagcggacacucuaggcugaggucauccuaucuucucucugcucugcaucucucccucucacaccagguucugccuuuuagacaaacauaagaaggggaaaaggccuuguuuuguuucuguagcccuucacuguccucugguuuccccucggaccuguaggaagcccuuccugauugcuaacuacauuuccuggcauuaugaaguucggggaagacaggagauaugaggugacacccacugcugcuuuuaaaauaaacaaaaauagaaagcaagagaaucguugggggagcucucuguaggauucgagagcagguagcaguggcccucgagagcacacucggucaaggcuucccuuagcuugcucugaggccucuccaaccguuauguuuuggccccuucaagaggggccugggggcucaacacuaguucucugcuugucucaguagacugcuuugagaugaguacagcucuccagcugcaaguguaucugcuucgacaccauaaaaggcuuuauuuacccaaauacaagggcagaaaacaagugucuagugacaaaagcagaacagguuagagcuaagggagggcuucccacucgguugguuuugggugagggcaggcaagggaggaagggccagucugaaagggacaggaacaggccaccaugaucagacagucacagggaagcaaguucaguuucucagcauucuuguuauugagucaagaguuggggcuucacaaagggggaagggaucuggauuccacgaccuggcuuuauauucugaccccaugugccgggcugugguuuccuguaaaacuacagagccaaagccauggagacacacacacaggcgcucacaguccuaacuccauucccccugucuacaaauaaagaugggcagaauaugaguuccuugaauuuuuuuuuucuuuuuucuuuuuacccuuuaaguggaguggacggugaggaacaagccugguucaggaugcuagcuccuacaagaauccggcauucaccgcugcucuaccccuggucccagagacugccuccaaguuguguuuucuaugauuuagggagacugugcuacucaggggaccuacauaugcccuccucccucccaacccccgcaggaacggagagaguggugggcugggguggggaagacaggaaggaucgagggauacgaauaccaguguguaacaaaaacaaaccccaccaaaacccccaaccguauuuuagggggccagaauagagggagaggcggcggaugucagaacuucugagaaagguguccgcaaaggcacaucaaauaaguaaacuccuaaaccccacucagguucucucacucgggggugacuuuuuucugcagacacaggacuuuugcgaccccugaacuugcagagauggaggcggggcaagccggagaacuagccgccguggggacagggucccgacggcucgcgcaagggcgggcgccuaccuccuucucggagacguagagcuggucgccuuucagcaccacauagcgguuuuuccaaaucucccugaaaaucccuuucccgcagaauuuccggacccagccgaccuucucgggcgccgcagacugaugguuuccauccggaggccccugcccggggcgagacgaggagcggcggcucagacuggucucugcgcccuccccgccccccccgccagccccagccccauuguccgcgcgccgcgcacucacccgcuugccggagccgcucuucuucauggcgggaucgggcggccgcgcccgcugcucgcucggcggcuc

SEQ ID NO: 12315 - RNA, 28421 nt, Mus musculus
gauuugaacccaaaaguuuuauuaauuagcgugacauuaacccugaagaacccacaauuuaagcaaaagguaaaauggguguguggaaaaaaaacuguauagcgaaauugguauuuuccaauguaaauacuuauuacagaauaaagccagaacaucuucagaaggcaugcacuucacuuccaguuuaaagaaccuuaaguaacaaaucauguccaaauuacauauuuaaauguuuauaaaaaauuaagcuuuuacauuuauuucuagcuuuccacaucugugugcggacaaggaauaagauugcacguaaauauaagcagugcaaaauauggaagugaacaucacaugugcuagaaaucaaauacaagacuaagaaagcaauggagaaaucaaagcuagaaaaaggugucaaacuacagguucagaacuugggugaaaaaugguaaugcccuuauuacuacauaagauuuaguggcacagauagcacuugucaaacaauccaauagcauugacuuuuuuauucauucauguuaagucacccgaaaugaucuguugcauuuaaaugcucauuaauguaaauggcugaacaaauccaucucaauggauagucaauaucccacaguuaagucacuucaacacagccucaugacaacucccacaccaaaacaguacuuuauuuuguaaauuuugacccauuauuacucccaaguuuuauauauauauauaucuuuuucagcuguuaaguguacaagaugaagaaaauuuuaguuagaaggggaugcaccuggaaaauaaauuucuuaaacuccauauacacguuucaaaacugcugagucccaaguccauuuaugaacucuagggcugccagaaucaugugcagcguauuaaagcuacacuauuugaauagcuuauuaauucugcauaaaucaggucaagcaaugugucaaccuguaacagacugugcauuuuaacugaacauggcaauauauucacucuuuugaacuuuacaucaucauuugaugucaaacaaugaagcaaaucccaacaguauauacaaaaacagcuuugcauuuacaaaggauuguuucccauacugauuaauccaggcagcuaacucauugguuuaugcaacuuuauugaagaaaaauaaaucaauuacuaggagagcuauuaguugaucacucauccauugacaacucgcaucauuuauucagugcuauauuaaacaguauuggaagauagauuaacuaauagcuccaagccuccuaacaauuuaaaugaaaauuacaaaauguuuugagacccuauuuuggaauacaaaggguguuugacuuccaauuuccauucucuguagaacaagaacaggucauuccuuuauugacaugcauaaaauacaucacauuuucuguucugcugaugcuauaauucaauaccaauucuccagccacaucaguuaugagcauaaaguauaucauguaaccucaaaccucuaacaguggaagguuuaaacaagaacggaugcugcuagaauaaugcugcuuccuuugaugugacagcugagcauccaucucccucccccucagauggcuucuucagcauguuagagcagugaggauugguuuagucucauaaccaaguuagagugaagacauuggccacauaauacacaugcuccaguuuuuaaaaaaauuucugaaucuugggcaacuguucucguguaacuacuuuacaguuucuaaaagcaguuauuguccaaagcuggaagaacuuaagucuucucagaugagcaugugaaugaauggagggagguaaacaaaaaauaaaauuaaaaaagaugaggucugauaggggagcagccggauaagaaaaucaaaaaaggaacaguaauuuaaaguuuauuccagcuauaaugcagguuauucugacuguaagguagcaucacauggcauacuucugaguccauucccgagauauucuguuguaccuguaaacaaacaaauaagcuauuuaaaaaauaaaauuaaagaauuacuaauauuauaaaggcaaggaaaauauuucuauuuuaccuguggauucaucuuacaucaccuguaaugucuaugguuagaauaaaagucaacaagagacagaaauagcaacauuggcauucaaagcaaugggggcaaugagagccauggacguguuaucuuaauaaacacaaguggugcccagauugggaggcuuaacaaagaccucucuccaucaucacuaagguaguauucuaacaagcuuucaaguugguuauaccaugcugacacauuuuuacauuuaaaaaacccuacuguacaguuuaaugauugucagaauaguauguauaugcauagaaaauuagaaauucuggccaaugaaggcuagaacuaugcaacugaaaaauucaaucugaaaccuagagauugagaaguuuguuggguauugagaaaaaaugccuuugaaaccuaggcagaauacauuagaaagaaugauaaaaaagcauuaauuuuuaaaugaaaguuuaguagcagugauugcugcuaauccucacugagaccugcugaaaauaggaagucucuaggagcacaccccauuuuuguuaaaaaagaucaauagauaacucauccgcgacccaggugacuacugaggaagacccaguacugacaaacaccauuccaucccccccacuucauuauagugcgcuaucauacaggcuaacuuaccccaaccaaaaaaagugacaauaccuuaagaaaugaguacauaauaaagaacaggggaaaaccuuuagaagaaauaauaccacuaaguuucaucucaaaccaaguaauggacuucaacuauuugaaacagcucaacauauaaaaaacucucuaccaauucagaauuacggcauuuagaaaacccucuucaaacagccagcauuuuaaaacaaacguguuuugguuuagcauaaaaagagccacaaaauauagcuagcauuaaugcaugcuugucagucaguaaugaacauuuaaguuugugagguuuaagugcuucccuuuauauuucuauuacuaucuuccugguaaaaacccccgaguaaaaccaccacauuccauauaguacugacacaaaauguuuacauuucaacaucaugguaacuuaaugaaggauaaagauacucuuacacuucuucuuacuaaagcuauauaacugcuuugccaugcaagaaucccaagcaguagugaagacagaguauaacuuucaaaaaacagagaucaagcaguuaaguaguuuucagaaaacugccauaucuguuaucuuugguuaguuaauacagugcuuuaaagcaugcagcacucaacugcuggcaguaccauaaauaagcgcaccauagaguacagauccucuuacccuacaacauagcguauuucucuguccacucucuugcuaaccuauuguaccuaauugaauaagcacacuuagcauuaauuauaacauaugaaaguuaaaugguuaagcugaacauaaagauaaaucaaauaguugauaaauuuagaccaaaauuuaaagguuuauuuuauauauauauaaaguauauauauauauauauguagugcacuguagcugucuucagauucacuagaagaaggcaucagaucccauuacagaugguuguaagcuagcaugggguuacugggaauugaacgaaggaccucuggaagagcagccagugcccuuaaccgcugaaucaucucuccagcucuagaccaaaaauuuuacacuagucuuuuuucuuuauguuuggaaaacaaacucagguuuauuuccccaaacugaauaauuaagcaaggcuuuaacacauuagaaaacaaacaucucaagggagcuacucacugucauguaugcuaugagcauauauuuauuuggcagggucucacuaggcagccuagacuaccuucaaacuucuaaugcugcagccuaagccauuaugcugguccuuacugcuuuuaauuauguuuuaguaacuagcuuaugagaaacaaacauaaaaagguacugucacaaauuucagcagaaauaagcucaacucacuaaauaaaacuguuuauagucauucauuaaacaauugcauacuuacuuaucucugucuguuuuauagauccgugcaaucucuggcacuagggggucgucuggguuuggaucacauagcagugaacaaauggauaaaagaacuaaaaggaaaaaaauccaauuucaggugucuggacaagcaaaugauaaaauuuaaaaauguacucuagaccucaucauaauuuuauuauucuauaauaucuccacagaguucuacagaaaauaaguuucuauaauuaacaguauuagaaaugaaagcucugauggcaccaaagucaguaaugauuaggccacaugcaagguggucgucacacgacauccuacuaguuugguucuuuaaaaaaagggggggggggcuauguaagagaggcaucagaauuuaaggauuuucuugguacuuucaggagauacaaaacucuuaguaguauaauagagucaaggcuuggcaaaaaaaccccaccaaaaccaaguaaggggggaaaaauagaaaaaacaagaaaacccagaggcucauucuuuguucuaccuuaggaaagguuucucacaaaaacuacaagagcugcuuuauuuccuggaaucagaagugaaaaccacugucccuagagacugugcaaaugacaucguuaaacagcauaaagucaaaguaacuaucaaagcugcaaacacagugucaaauucaaaugaggggacuaaguaaaauuggagaauauaauaacaacucaggucaguguuucuaaaucugacuugcaagcuuuuaaaucugucaaaaaaaucaaguuaauuuuaagaacaaaacaaaauccccaucaauucagucugcauuuguaaaaaauacaauucagaauuaagaguauaucaugccaggcauuggugguacacgccuuuaaucccagcacuugggaggcagaggacuucugaguuugaggccagccuggucuacagagugaguuccaggacagccagggcuacacagagaaacacugucucgaaaaacaaacaaacaaaaaguacauuccagcagggaaugagaaaaaaacaaaaaaacccagaaaccuggcauuuagauuaugaagcauaugaaaagagaauuaaaaaaaaaaaaaaauccaaagagguuaaaaaauuagucccaagacuguaagcucuuaaaagaguaauuggaaaaugcagccaaauccauguaaagauucaaaaacauuuuaacaagcauacggagaaaugccugugugguguagugugguguggugccgugccuguaaacagaacauacuuguuucacucuguauuuaccaaacucauaaaacauuuugguaaaaagcuaacaauuauuccaaguuuuaaaaauguuacacuucaggauugagccugaaaauaauaguuaacacaaauaccccuaagauuauaauuacuagcauuaaaaacaugacuaauauaaaaacauuaauuacccaagccuauaaauuacuaaaaggcaaucucauccuuaaaauguuuugcguacaauugaauuugcagaguagaaugucaaaaaaagacuugucauucagaauccaaaagaggacaggaggaacuuuccaucugggguauaccuggagaucuagaauguguuagacuuaacaguacaagaucagucuuuacguaacaaucuuuccccaaauucccuaaguauuccacauuuuauuagacacagaaugauuaucauaguuaaguaauacccaacuaaagacagguucaaaaucagauacagaaaaucuacacagaugcuuauuagaguagaaagcuguaaaugcuguaaaccaugccuggcuauauuuuccuauucucaccaaaaagauggcccaacaguuauaggcacauacuauuuguauagaggacaguuuuaguuucccaacucccacucuuggugcccccucacaacuguccuuuaacuacagcuccuggugaucuagcauucucuucuggacuccaaaacaucugcauucacgcgcacauuaccacccacaaacaguuuagcaccaaaauaaguuuauuaaaauuaauuuggaggcugaagcaauaguucaguagguaagagcucaggcuaaacaaaaagaccugaguucaaauccccgccgcccaugaaaagcugugcgugcuugaacccuagcauuggugguaaagucaggcagacacugagaguuacuaagaacuucugguuuaaugacagaaccuagccaagugaaauaaaaguauacaagaggaguuuaaugacagaaccuagccaagugaaauaaaaguauacaagaggaagauaccucuggcuucugauauauuacacuaaaaauaaacugccauuaugugaaaaaaaaacucacuaggaaaaugcccuaccaacauauuuuuaacuuuagacaaaaaucccuuuaaaauuuauuuucccugaugaaguaucaacccaaaacacccaaacccacuaacuuuuuuuuccuuuuuaaaagaucucagucuagccucagacucacucagauuaaccaaggacgaucuugacuucagauccucccgccccuauucccaaaagugccauuguuuaggcaugugccacaccugauuuauagaacacugggggugggguggggggugagugggagaagauugaacagugagcuuugugcaugcuaggcaagcauguuauacugagauacauccccaaucuugcaagcaacuuuuuuuuuuuaaaagauuuauuuauuuauuauauguaaguacacuguagcuguagucagacgcaccagaagagggcaucagaucucuguuacaggugguugugagccaccaugugguugcugggauuugaacuucggaccuuuggaagagcagucgggugcuuacccccugagccaucucaccagcccgcaagcaacuuuuaauuaaaauguuggcauaauaaagucacaguagcugaaaacuauuauauugaaauuaucauuuuaccuuuagaaauaguuaaagcaggagaccacugugaucuuagaauaucaagacaaaugcugccauuacuguuaauauuuggaugauaaauucuuguuguaaaugcaaccuaaaaaaaacaaaucacaugacacaaccuuuagauggcuuuugcaaaugaaaauaaguauacuuuaaaaagcaaggcuuaaaauacuaagucucaccagugaucauaguaaugagagaauauaaggagacaggaaaaugugaucaaagcacgcauaaccauauaaggaaauauuuauauaugggaaauuucaacaaaaucaauuuuagguaauaaaagcuaguuuuaaaaaguuaacaucagccucagcacggaaaaaguaauuaacuucgcuuugaagguuaacucuaguaguauagcuuaacuaucagaaggcaggcaaucugugaaagggaacuuaggacccucaauguaggauacaggcauauauucaaauucuauucccacugcugacacaacaaacugaguauaagcuuuauacccaaaggaacuugacuuucuuacuacacuguacuuuuaacaugacuaaagaggguuagaaaaacaccauaauuuaauacacauuauuuucuagucauucacauaccaugaauuugaacuaauaguucugagagaaaaaaaaaaucaaggacuauacgcucugaacucauuacucugcuuuagccuacagaauaccaggauuaaagguguuguuauagauccagcaacuuaaccuuuaacacuauagucaccuaagugcauuaaaagcaacuagaacauaaggcaaguugacucuacagcuuacuuacuagacuccaauacuuagcuuaagcauggaaauacuugagcuuugcaacuucaaaaaggcaaaucuuuucuacauuacaguguuaaaaucuuuugucuaaucuuagaaguuaggcaugaguaaaguaugugguauacugcuaaacuuagcucuuggaagaugaaagcucuuagaugaaaaaaguuccagaauagucuuuaacaggaguuaucuacauaaaugcagcucauuucucuauguauuacuuauuuuuauucaccaugaauacagggcuuaagcuucaauuauucagaaaccuaaauuuacaugaacauuuuauucuucuaaaacaauccauaaacuaacagauuuuggaaggacaauaauacuugccuuaggugguuugaagggguagucuguaggaaaaugaauugucaaaaagaauacaccaccuugauaugggcugucauucuguaaagagaaaaauaggcuuaauaugucaagauaauuccuuaaaaaaagagauggcuaaaaugccauuuccauacaagccugguaaccugagcucaguccuuaaaaccuauguaaaagguggcaggagaacugacuucaguguuguccuauucacaugucaucacaugcacacacccacacccacacccacagaaugaauaccuauuucaaauaacuaaagcaccuucaagaggcaaaacauaucugaguuuacuuuucaauuggcaccuugaaauucuuucauaaaaccaagaaaacuuuucuucuaaacuuaacacaauguaucauacucuugaaagucaacagcuagaaaacaaaauuucaaauuacuaguguccuuuucuccuuuguucauuacaaugugcacauaaauauucaaccaugcuaacuaauauaaagauuugaaacuacuuucuaugaguuuuaauaaaaacuaaaaugagaaauauacacuauuuccauucuaugaaauaaaggaccaaaagauacagcccauuacagugucuauagaucuauucucugcuuuuaaucugaccccucacauuuuacaguuuccacuuucuucuguacugugucuauuuacuucugagcacauuuucaagccuacuaaaauauacuugucuacuugaugagaugcauucaaaucucaaacuucuaugucaaccccauucuuccuaaaacaaaaauagaggucucauacaugauucuuuuauuuucauuugauucacaguccuaaaggacucaaagaaugucagauuuaguggcuucuuaugccuuccaucuaaggacuuugaaggccgaggcaagagaguuacuaugaguuugaaggcagcuugagguacaagguuguaauuucuaggccagccuuggcaagaugguaaagugaaguuccaucuccaaacacacacaccccuacaccuuaaaauuucuugaacuagcugcuuuuuggccauugcuauuuuaacugugauaguaugaaaugacauaaaaaugugaaguuggaucaauaacucuuuuaaacauaguuuuauuucagauuucauuuauaguugauuauccucuguccauacugacaaauacugaaaugccacagacuaaaguggaaguuauuauuuccaaaucuuuucuugccaacuaccuuucaaauuaaagaaaauuaaccacaugagagacagggaacuuauuucugaugacgugaagcauuaacgggacuacuguuaauauaaugcaaugacccucuuucccacauuuaaaucagauaaccagcacuucuuuaccaauucuuugugguuccaacuaucuuuagaaauuaaaaaaacagcauaccccauaguaacuucaagcauuuaugugugaauuuugaauugauucagagguauuugaguauaauuuaauaaaauucaaguuccccuuuucugaaaauuuaaguaaaauuuaaagaacaaacccaggaaucuccaaacacaaucugaccuaagguaguacuccaaaggaaaacauuuauuauccagauguagcggacaaucugcaacuugugugauguuaucacuucccccacuguuuuaguuuacaacugcaauuucacaaagacaugcuuacgcaaagcacaaguucuuuuuauuauuaguuuagucacuacagugaaaaaguaugaaugaaaugggcacaguacaguaugugacagauacauaagccacuaaaaaggagacagagcuguugucucauuccuaagucugagcaucuagucagaggggcaaguuuccccagcauuaaauuaaaaaugucaaauagucucaguaaacaagucaaugcuuuaacucuaaagaauauauucaacacugacuaaacaaaaaggcacuuuuaaaucaaaagacugaaaacaaagaccuguggccuuugugguuaaagauaaaccaauaccagcccgcuccuaugauuuuuagucuacuuuuaauuucaacauuucacaauuacucgugaaaugcugucagaaucaugaguuacuccuacuauguauuuuauuacaugaguaucucacacucugauaugucaauuaccugccuucccauauuaaaguuccugaaggcuaacagagauugguuuauucauaccuuuauccucaucacacagcaggugcuugcucacuuucauugagcuagaaaaugaguaagguuauuaaaacacguaaggugacucaugcuuguuaauucuaccuuucaggguccucaggugggaggggagcugaaaauuugagaacacccuguauuacagcauuauaacucugucuaaaacaaaacaaaccccaaauaacccagucauuuuuuuaauaaucaagaaaucuaacuaagaugugaauguucaauccugaaauauggguaaccagaaggcugaggaaggaauuuaagacaaacccaaaucuguugucucaaaaaaggucaauccagggcgucugaaauggcuccaugaauaaggugggguuucgggaaagugccacuaagucugacaccaaguucaaucccugugaccuacaccuaagcagagagcugacuuuuccaagugauccccugaucucugugcucauguacaauaaauaacuacaccuaaaaaguuuuauaaaaagucaauuuaagacugggaaguauuuguugauugaacccaucuaacuacuuacuaggucaaacucuuccaaaaauauuuucuuucagaauuauuacuacauaccuaaugacuauuuuuuccuacucucuacauuuacacuauugccccaccccaaaacuuaguaagauacaugugacuuaagagauccuaaaaugcccuuuaaaguuuaaaaaaaaaaaaaaaaacuuacucaagauguuuuagaucagucuaauucucugaaauucuuagaugguuauucauaauccugaauauuuaucuagcacacaguuuaucaaccgaagauagaaaggaauuuugguauaaucaagauauaaaguucucccuaaauaaauuaaaauuuuguauaaaucucuacaucuauaaaaaaaauuaaccaaacgaacacgauuauuguagauucauauuuggcaguuaugaugcuuugaggaacagcccacaguagaauccuuuccucuagauaagcucaauaacugcucuucacugccauaaagaagaaagaccgaggcaaaacaagggauuuuguggaugcagagaugguaccuaccccaggauacaaucagagauacaccauuuaaggaacauuucauuuucuuuacagagcaguguuaguaugucaucagaaacacaguaacuauauauuaaagccaaagggaaaaaaauugugauagagaaugcuggauuuucaaugaaaagcaaaacaaaaaaaagaauacuuacaggucccauaauuguggcuugccaaugaaacacuagaaagcggagggagaacaaaagaaaaacuucauuauuccaaaaacauacaaccuucugaaguuaaguuuuuaaaaagaaacuaagcuacuuacugucaucuccaacuggaccugcagaacauugugcuggagggucacgggccaaaucacuaaguuccuaaaccaagacagaaaacgguagguuauguaauuuaaaauuuaugaaaagauaugcaguuaaauaucaaacuuuuaaaaucucauuuaaagggacaugaaaaccacuaaugaggacaauauaugccaggggggagaaagaaacaagcaaucuuaaauccagcucuuggaauauagaaagaugcuaagccuuauuuguucagacacaugcugagacaaucaccugggcaugcauuuguguuuguaugguuaaacuuuucuuuuugguuuuucaagacaagguuucucuguuuagcccuagcuguccuggaacucacucugaagaccaggcuggccucgaacucagaaauccgccugccucagcuucccaagugcugugauuaaagacaugcacuacaacugccaagcuuaaacuuuaaaaacaaacaaauuuuuaccauacaaaaaugugaucucugaacaaaacaguaucaacaggaugcuuucaaguuuauaaacuuauuaggcaaggcuagaucaacaagucuuuagauaaacuuuucagaccaucuuaaauguucccuugucuguuuucuucucaaaagucuaauuucauuuccaugucacuuaagagcuaaaugcucuuaacauuuuauauucaauuuuccuaaauaagguacgcugcuaacucguuccacauuuaaaaaaaagauuuguuuaauuuuuuauuaauaugaguacucuguagcugucuucagacacaccagaagagugaaucagaccccauuacagaugguugugaaccaccaugugguugcugggaauugaacucaggcccucuggaagagcagagagcagucagugcucuuaaccacuaagccaugucuccagcccccucguuccucauuuuuuaccuauucuuaaaacucaaauuuggaagacaacuuuucuagguagaagauacaauuuucacaauuucauacaaaugcauuuccaacauaugcauuuauguacccaaucauuugaugacauacaaugcauguaacaaguauauaauacuuuguauaaaaaguaguuuaucuuagacuuacauuuacauuuaccucuaugggccaaaucaguaagcgucaucuccuuuuaaugcccugcccccaauauauuuaccauaccuaaguauagaaauagucauuaaaccaaaaaaaggcugaaugcagucauaauuagaaagcaguguguaguuugccucacacaagccacgccaagcaaucuaccaacuaccuacauuuccaguccaaaucaauucuaccugguucgggcucaaucuuccaauauuagcuaguugcccucuuuccuuccaaguagcccaauaauauguauaacauguuuuacuuaauuccugauuguaaaaaauacaaaaaaggauucaccuuggcugguaucaucaacguaucacaucaauucauugaacugaacauauuaaucuuuccucaauaaaguaacaaauucaagaaaacgcuaguaacaccaaagcaguuuuuaauaauguauuuuccagaaagggcaaaaaaugccuauagugcuugcugaucugaucuaauguuuuaaaucccugacaccuuuccccauugccuggaaauucacaauacagcaaaucuccauucuauugguuuaggaggcaaagcauuauuuaagaaguaaguuuugggcuugagaccauccuguuucugaagacaauuacacacacacacacacacacacacacacacacacacacacacacacagagagagagagagagagagagagagaagacugaagcugccaacuagggaaggaauguguuaaaagccuccauguaaaugaugaacuugaaacauaccucauacugaaaauguauccuuaacaguuuuauuucucacauaaccaagcuauuaugauuacagaacaacacacuauacagaaugcauacauguaugccauucuacucaguguucuagaaauccagagacuuucuguuuagcuuaaguacucaauucaguacuaauauucauuuuguauauuuuagauacgacuuauuguauaugauaugauguacaugaauaaaaaaacuccuagauuucaaguauggauacucuauacaugcccuacuguuaaacacuuuaaacccaagaccauauauaguuuuucauccccuugcccccacuugggaggcagaggcagguggauuucugaguuugaggucaccacacccgcucagaauucuuuaacauaugauuaacucuaagacuagcaagccucauuuccuaauccuuuucacacaagcauuccaccccuuaaaggacacaaaguucaaugauacagagguucagacgugagccuuauuagugugaaacuuauucuccaaccucugugaaugaaaauaacacuugcuguuucugcuggcuguaugguaugcaccaaccaggcuugcuacagcaauagccuauggacuaagaaauaagaaaugugauguaauuagaaaugugauaaggcuuaugagucaacacuuauggaaggcaugaugguacaauaauuuuaaucucuuuuucauaauacuaguaguucuauuauuucucuuuaacuguugagauuuuuaugcuuaugugaaagaauggcugauaugucaaacauaucagcaaauacaaauaguauaaugccagacuguacuagauggaaugaaaacaaggcugcugcuuuuucucuuguaacccuggagacagaacccacaacugcuucacauacccaaggcaagcucuuuagcagcuuaccaugagcuauauucucaucccaaacacaaaacugaccauucaagaguaugaaaaaaaaaucucauuuuauuucugugcauguauguguaucugcaugaauugaccuuggcuucuacagaagccagagggcaacagauucucuggaauggcaguuauaggcuguugugaggcaucugauauaggccugggaauggauucuaggccuuguguaagugcucuuaacaccagagucaucucuagucaccaacaauauccuuugaaaugaaggaauuucagaagcacuuuuaaacuguugugguaucaaaaguauaaaaaggcuggagagauggcucggugguuaagagcaccgacugcucuuccgaagguccugaguucaaaucccagcgaccacaugguggcucacaaccauccguaaugagaucugacgcccucuucuggugcaucugaagacagcuacaguguacuuagauauauaauaauaaauaaauucaaaaaaaauuuuaaaaaaagcauauacuaagcaaugcagcaugaaacaugcuuuucccauccuaaugcugaguacaauacagaguaucccaccaaaguccauaagcaauguuguuuauuaccucaguuucaaaagcuuacaugcaaagugacaaaguuccauucagacaaggauuuguguucuuuaaacuguuuuucagucuauucgaaaucuuuaaaacugccacucaacugguacagaaaaauauucaguuuuggaaacuuuuaguaaacugaaaucauuuaugugcacauauguuuguacacaggcaugcguuugugagcuaccauguaaaugcugugaaacaaaaaauucuccugcaaaagcaguguucuuaaccauugaguguaccauccagccccacggugguaacuguucuuauauugugcuuuggaaaagcaacaacaaaagccuuucuuuccuguguuacccagauuggucuccuguguuuaacuaauccuccaccucagcauccugaaaagugacuacaguugcgaccccaauuaaaaauuagguuuuaaauauagcuuuuaaaugccacuaaaaugacucuaguuguuuuuuuuuuuuuuuuccuuuguagcccuggcuguccuggaacucacucuguagaccagguuggccucaaacucagaaauccuccugcaucugccucccaaguucugggauuaaagaugugugccaccaggccuggcuuauuuaauauuaagcaauaguugguugugguggaaaacaugugaucucaguaguaagguuaaaguaggaauaucacuggaaguugaaagcaagcaagacugcaucaagaccugguucauaaaugaauggaucaauucaacaaugaacucauguggaaaguaaggauaacgcuaaaaagauuuuugauguaaaaaaauaaagcaugaagucagaauuaaauaaaucugguuagcaucugggugaaacaggcagguagguagaucccacccaguugaguuaucaggauaugaaaaucuuaguuggggaggacaccccaagauuaggauugguuggcauauaacucugaugauaaaguccaagaauguacucugaaauaacuaaacauuuaagaaaagacuggguacuacccucaaagugacuaaaaagcagcaagcaacagauuuauaaugcuauuaccaaugaaguaaacuggaccauuaaauacuguaagaagaauugcucaagaauggccaacuaagauuuaacuaugcuaacaagucaauucaacagacaagaauuguccugauauacaccuuugccauucugcuucucaaauauagagccagcugcuuauauaguaacuaaacagcaaaagaucccucaaccuacaaucuuaaauccuucaugcacuuugccaugagcauaugccauacuuucuuuuuccuuucuuauauuuuuauauuuuuuauuagguauuuuccucauuuacauuuccaaugcuaucccaaaagucccccauaaccacccccccacucccacuuuuuggcccuggcauuccccuguacuggggcauauaaaguuugcaugaccaaugggccucucuuuccagugaugacugacuaggcccaucuuuccauacuacuuucaacguauucaauaagauaaaauucaccuuacacacuuuagccuuugauuaguuuuacugauauuguauaggggaaacacacaaggggcuagagaaguggccuaguaguucccagcacucaacacuaggcagcucauaacuacaccucuaacuccagauacagggaaccuaaugcccuuuucuggccuugggaggcaaggugcaucucuuuccacaugcacucacccuaaagccuuaaaagaaaaaaaaccuuaaaagaaaaucauaauaguuaaaaauguuaauuaccuuagacaagugaguuauuuuauaggaauauuugacacaagaaaugucucagccuucauaugaacauacagcauuuucuaacaauugcauauaaagaagauauuuugaagccuacgucuaaaaacagaauucagguguuacuucacacauaccagcuaugccaaagguauuuuagugaaucugguugcagaacguuggguguacaaccuucaacaaaaagguauuucccuaagaagucaugaauuuuggacaggucuuuucaaguauuuaaaaaaaacuggacuuugcuguuuuuaaauuaaucaacuaucuaguauuaagcaaauaacuuuuuaaaaugcaucagguuucaagcuggguauagugauaaugccuuuaauucccaggaauggcaaguggaucucuauaaaugaaucucaguuugaggacagagugguucauauagugagucucagacagucagggauacagaauagaaaaacccuaucucaaacaagaaaaaguuaucaagucuuacagaaaaagcuugccaaucccaggaaaacccaaauguuuauuaauuauugccaacaauagcaaacuccauuaccucuacuaaauacucacuguacuuaagacucaaggugguaaaaaacaaaauuuguauacuaccaccaaacccuauggcugguccugucccauaaaauaaggaucugaauuuucaaauacuuaaauauuaccugugcaauacaaauggcaaaaaccauuuaaaaguaagguugggaguaugugcuuucuucaaauguuaucaguuuagaaccuuuuaaacuaccuaaccuagcuaaacuuauuauuuccuauauuguuuccucaauucuaaaacaggauuauuuuuuuugguuuuucgagacaggguuucucuguauagugcuggcuguccuggaacucacuuuguagacuaggcuugucucgaacucaaaaauucgccugccucugccucccgagugcugggauuaaaggagugcaccaccacaccuggcuaggauuaucuuuuuuaaugugaauuuugagaggcgaaaaagacuugaaagggacagcaggcacacaacauauucuaaaagaccauuugcaaaccacccauuuugaagccaagccuugcuaaggcuuuuugauucacuucuuuauuaaacaacaaaacugcuucugcuucauauauauaccaaauaaaauagcccuagcucauguaaauaaaucuucagacuauaugauaaauuuuguuaagcagucuaaaaugucguuuuagaucuuuaaucuaaaauuugaaucaaguguuaaaauguuuugaauguaaaugacauuuggaauaaucaggaaauagcuugaucaaaugccugcuucacaagcaugaggaggacacgaauuaccacuccucacauccaggcauagcgguuaacacuagugcuaagaaaaauauuucuaaaacuugcuggucaguccaucuaaccuaagcaauagggcugaaaaccgcaucaagauggagagagaagagaguaaauugauguugaccucuggucucuuuaacagguaggcauauacacauauauuuuacauauauuuuuauguaaacacaaaaaauuccaguaaugguuggccuaaacaaaauauccaauaaacaacuuuuaaauuaucuuacuuauaaagauggucagaaaauuguaaaguuaacuauaauacaucaaggugccauuugacaaauuuuaugaauaaggaaacuaguuuucuacaugucauuugugaaucaguaagccuuuacaacuucagaagguucagccuuuucuuaacuuuaggcucuuguuauucaaaucauuuucccccuuuaaaauuccuaaacgucuauuucccaaguuuccaugaccaaaagacaucucugcagcaauaaucaguaaguucauauacuaaaaucugcuuuauauucaauacaaacuuuagguugaggauuuaaauaacaaaaagcagcaguaugucucaauuuuaucauuugggagguaaagacggaaggauuaugcucauuuugggauaugugucuccaauuaaguggguggaaaugcuauucuaauccuacuuguguuuuauguaguacucaacaaucauaaucagaucaugcuuuugagauaauaguggcauuugaauucuuaguagguauugauggguaauuaagcaggcauuuaucaaacuaguaagagaaagauggguauuaaagagaaaaacccagguaauggcagggauuuacaaaguauacacagcuuagaaauuuuccuagaagaucaaucacuaauauaguuuaauaaucagagaucaguuaagaaaaaguuuugauuaggacuuuaagagcauccaagcauaucccaaaauuaagcaguuccuggaguuuuaagcauuaacugaauuuguuggaaauauacuagaaguaugcuauuaaaggugauaaucuuaaaucacaucuauuaguuugaucuacaaauauauuuuacuauagaucaaacaaaauacauaacaguguucacaccaucgauugugaauuccccuaaguuguuuacuguuaaaucuucaucacacuguacugagugcagucauacaucuuucugaaguuauauggacuugcaaaagacuauuuuugcaugcauguaugucugugcaccaccugugcgccugguaccuauggaggucagaggagggcauuggauccccgggaagugaaauuaaagaugguugugagccacuauagacacuggaaacagaaccaaagucaagaacagauugccaccucuccaguaccaacucauaugaucuuaaaugaaagcuaauugagacaauaauguauuucacacacagaacauugaaguguguuccuggccaauuauuauauagacuaacgaaaccagaaacauuugucuggcagauauuaguaauugcuaaaggcccuaccaccucuuaggagcacaaaauaaccuaucaguaagaagaaacucuauuaccuauuuggaaagaauuaucuuuuccucaacugcuucuuuugaaacuuggcaaucgcaugguuuaacagggagagcuaagcgcauuuccuccuggcaagcuauuuauuuuucugagagacccacuaagaagccaagaaggccacucuacccuuuuccaauccagaaaagauccuaaaagcucuccauggucuaauucaccucauuagguuaaaaccucacaaaaguauuuaguacugcaacuaacaccacauaucugaacuauauuuuuuguacgcuuaacuuguaagcagcacagcaaaacuuuguauauacuaaacaaaacucugaaaagagcaacagauauaauaauuauauucuuaaagguuauuuuuauuuuguuuuuugugcaugaguguuugcccaaggagaccagaagaguaaguuagaugcccuggaacggagcuauaguugugaacugccacgugggugcuggaacugaauaauccugucuucuauaaagagcagcaagugcucccgacugcucagcuaucucucaaacccucaaauuuuuguucaaaagaauuuuuucugagguauuucugagagaaagcucauagaauuuaaaaggauccuuacccuaaccauuaugggacaggaucucuugacaguucauuguugaaaauaggaaauggcugacagcaagacuuauacuuacauacaauagucugauuuuuuccccccuuuuuaucugauuuuugcaccuuuauuaucucaguaucuuagaugugauugaugggcugugcugucaauaagauaaccaaccuaaaacuauaauaacagcugaccaaauucuuaaaaacacuaaaaaacccaaaggaaaaauacuggaaaaacaauaugaucgguacauucagagcacuuuauaaauagaaauauaagauuugugaaugaagcuguacaauuauaucagguaagccucaauaaagauuccaugucucuaucauaguuuaucucagaccuacgauuuucaaugacaaacauuacuuaugugucauaucaacauagccaaaaggaaagcacuuauuaaagggaagaaucuauuagaaacccugucauuaagaccuaacuccauaaaccuauucaacuuuguacaguucuacuacaacccaaaaggccuaucaaauuuuaaauuuuaauucaauuaauucauuacaaagccaaauucauggauuaaauccuauauagaguguaucacuacugacccagcucuuccuaguaucaguuguuccaaucugacaccaccuuguauuucagcauaucaggauaaaagauaacaaauuuucuaucagaaacuguaauauuuuucaaaguuaauuuccuguuuuuuacuuaguucaguuuuccagaaguaaaccugacuugacuuacaacagaaucaagacagcccuugcuguaauacccagucugaguaacacuacuuaaagacaggaggcaggaauaaaaaaaaccucuaaaaauguugagauuuaaaaaaaccacccucagcuggucauuacaacugcauuacaaacugaauuucuuuuaucaauucuuauaaagaauugauaguuuaguuacuuacauauuuauugauaucauguaccuauuuguugguaucuauuauaucuaugucuacugguauuuacuuauaucccagaaauugauuucugagaaaagucucagaaaugugugguugcuugcaauaaauuucagaagguacuuggcaaaagauucugaucugaacaaacucuacagaauuguagacaaagauucaaaagggauuaucauuuaguuggcacagucuagacagggggaugaaguuugagcaagcccagaaagugacuccacugcaagaagccaaaacacaaaccacaacucacacccccuuuaaacccaguuuguuuguaaucuuuccagaggaaaccugaguuucuuuuauuguauggauuaaaagguagguucugugcacuaugcugccuuacaucacagacaaggcauuagcuuccuguuuaguucuaauuauaggugagacaaguauguuuauuagacaagguucuaagaauggccugagugaauaauacuacaguuuucuuucuuuagaucacccuugaagguaagucacuuaagauuauucaaaacuaggccuagugacaugcaaauuuagcucuacuaaaguuuuaccccagaaaaaucuuuuuguaagcaguuuugaauagaccaagaagaaagcuuuaauccauggaaucaagucaggcauuuaguagauaugaaaaacaaaaacuuagcugucuacugguaguuaauauccauuuguuaagauuaaugugaauaagcauuuccauccugaaacaucuaaacaagaaauacuaagucacaacugagagaaaucaaaacacuuuaggacaaauguagcuaugaaguuaucugaaaggucccuagauaauaaacucacaugucuaaacaagguauaaaauauaaacuuucccccuucuuuacccuacauuaacaagcuugaggacauuuuguuuuguguugcagacaauacauucccaaagugaccuccaauuuauacugccauaccuaaguguaugugucuccacuaguugccugaggaguuuuaaaauuagaauuuaaggcagacuuggcuggacacuuaagagauuaaaugcacucauuaacacuagugaaauuuuaacuaagaucauaagaagcucacaaaacuauucagauacaggguaacagaauuuugauaaaccuuugaaaauaaguuguacaaagcaauaaacauacuguguuugauguauuuuuccaaccaaagcagagauucuugauuucuuaaaugcaauuauaaccccagugaaauaccgauuaaguuaaccccaaagagguuucuuuuucuuuugguuuuugagacagugcuucuucuguuguuuuggaacucacucuguggaccaggcuagccuugaauuuacagagauacacaugccucugucacccugggauuaaaggugugcaccacugcccagcuccaucagaaguuucuaagugcaaguucagaauucucuaaugaacaauuccaugauuauauguuucuagagaugaagaccaaacauuguuguaauccuuaaaaaucuagaaucuucugaaauaaaaaauguaguaaugccaaaaacuuaucuaagcaauagcucuuauauucagcaauagaggaaauuuuuauuaaaaaccacaaagcagcuggauuugguggcauccuguaaucccagaugggagacagaggaagggcugcucuaaauccaaggccaaugcuuugacaauguagucaaaauucaucucagaaaacaaagugcaaaaauaaauuaaaccaauagauaaauauaggccgggacaggaguuccaggcaagccuuuaugugacacacugccucaaaaugcaaucugguaauuuuucuuuucucuuuuagaaagcuauggcugacgagauggcucauggcuuguuaagauacuugcccagaugaaaugacaucugagcucaaucuccagaagccaugguaaagguagggaucugacuacacagauguccucugaaccccacauccaugcaaagugcucccugaaacuaauagcacaccccucacgaauccaauaaagaaaaaauucuuugagaauugauuuggacuuuaacagacacccaaaccuaggaaguaacaaguaaaauuugacaauauaguuaaauuuauacaaguaguuuucaccagugcuaugcaggguauucaacuuaaccuuuaucugcauaacaaacacuggguaagcaugaugaaagauaaggauagugugucacaacugcuuuuaucaaacucaacauugggaucacugaucgucagcagcccucacucaccuaaguauucuuuacaguauaaauaaaccuugggaaccaaauaaaacaaaaacaaaaucaggaccacaggaaaagccuguuagccuauaaaacuuaaaauacuauuuuguuuacuuuaaaagaaucccagcauuuaaccaacacagcaguuucuaguccuuaaggaaacuacacaagacuacauuucauucaucuucauuuauaaauuaguugaaacauaaaaaaaaaaaaaaucagccucauauuuauaugagguagaagacaguauauuucacaaaacauccacauucaucuaguaggaauuuuaaugguccaaaauucagguuuuucuuucuggagaucaucuuauuagaaaucuaucacuaauagugugauugaacaagucaagagucaacuugugucuguuacuucagggaauaucucauauggcugucuugaggccuauuacacaugagaaccuaugcuaggucuuaacuaucacaaaaauccuaagaauaguauaaaagugcaguugucaucagaacaacuuggaauuagauagaaggccugggucuuaaucccaacucgguuacaucaauaccugggcgggguguuuuuuauuuauuuauuuuuugcagucaauuuccuuuauagugaagaugucaacuguaccuauguuuuuacauaagaaaaacuacuuaaagaguuaugaaacauuacaaauacuuaacauaaauuuuuguuugauuguuucaugcuugaucuccaaaguucucaaaauauguaacagucauuuugcuuuguagcagaaaauuucuuaaugcuucaaaaacacagguuuggaauucaguuucuaaaauacccauuuaauaacagcaccauacuacaauuugguccaaauaacaaaugcagcaaaagaauacauguaugguuauuugggcagcuaaaaaauagucaagcaaauacacaaaagaaaaaaacccguaucuaucuauauagaagauaauaaguuucaacuuacaccaguuuaucacuaaagcucacaguuuuauauguaagcacuuuaagaaauacuaaauggcuuguuaauuuaauacuuguuuagggggaacccaaagaauaaauucuaaacagauaauacaaaaaaaaccucaugacagugucuaacuggccccuuauuuuuagagaaguagccuuucaaaaauuaugccagcauuugggugcuuuuuuuuguuuuuuaagcagccucaugauucugacaauaucugaaggaaaaaaacccgauaugcuugaaaucagguugaaucagccauuugguacaucaaguuuucgaauauaagaaaauuuaccugugaaguaucaauacauaauucuuuaaacuuguaaaaucuguuuucccuugccaucccaguauauagaaaaauuccugguauagauuaggcaaauggauaaacuugcuuagagccugauucuaucucauguuauuuuacuacaaauguuuacacuuaaccauuacugccuugcuagagcuuuuaagucauuaaaauggugccagagcagcuggguaucaccuguaaaagaaaaaaaucaguaagaccucccuuuaaaauguucuguuuuacacuuauaagaagcuauagaucugaauuuugauuagcacugaauguuauagucuccauauuaguuaugcugcaaagcacaacaaugcaucucuaaaaagugagguugacccucaaaacugucacacuaagugauaauuuuaauguuaacuucuauuaucuauuugaagucuugaauacuaagguuuucuuucucuuugcauuaucaucaagaauacaaacaguuaaguguuuugcauaaaacuacaaagauuacccagagacagaauuuaagauuucaacaucaauauauacagguuagacuuaacuucaugaacagcuuuuccaaucaaacugaucaaguuauacauacuaaauaacuacaaauaaaguaguauuagauccuaccagucauuuuaaguccuugccuuccuuuccacagaacucuuuaaaaacuguguuacuaagccaaaguuucuaauaccgaaccuucccauuuugucuuuucuauuaagacugaguuuauucugcacaacauuuuuuucaaguuagcuguaaauacuccacccucucgauugugaaagaaccaaauacaaaacacacacacacacacacacacacacacacacacacacgcacagaaacuuagucugagaguuugaauuuagguuaagucuugggggcagaggcugugagagcucccuacaacagaauaaaaaaacguuuaacgcuaacagagaacauuaucuuaaauaguuagaaaaggagaugccggaaagaacccgagccaguuaaagcagccgccaucuuaaaaugcgggauagaaguuagagcaagaaaaugagacuaaaccaccggagagguggauccacucgcaaaauauuucugaaaaaaauucuaguucuugccaacuuaaauugacaacuuaucaaacuauaucgauuugcucaaacaagccuccuuaaagauggguuuuaagcaaaaacagucuccccauccaguuucccugcacugucaacccccacuccccccaggaucuuucagaaggcuuuuacaggguucccagugccucagauaaauagcuucgggugagagcagcgaccacacaacacaggaaguggcaacagugucgguccaccuccucccaacccuacuuacucuuguguaacugcccagauuugguuaagcuucugaacagacuucgucaccacauuuuagcgaacugagguauguuugucauacccagacucucagucaaguuuggaacaaaacguuuuucaucuguuacauuccuuucuuuugaaugccaauaagccuuagcagcuguaauaaguuuugaagaaccaagacuaggaagcagcaccaugacauuagccgagggccuguacacaauucuacuucccaaaccugacucuuaggcaaaaaaccgaggagccuaauagccacgcucccucacccauacuuacagauucuagugaaaaaagcuaacauuucgcuuacccaaaccauucaguucccuaucuuacagcucauuucaaagugcaccugccuuuccuuaacccaagaaaagguauuuucagaauuguauccaccaccagacccacgcuuuuuuuccucugggccccaagccuccuuucuucccacaacccuguccgcaccauuuaguccaaacugcucaccuuauuaauccguuucagcgccauagucugugcuuuucgccgggcuccucacuaucccgagguguacucaaagguccggccaaaauucuugauuaucccggcggcggggaaggguugucucuucuucucacaccggcucugccagacacaggcgccuuuuugcaaaaacggagcaggucagcgacucgccagggccucggagaaacccugcugacuccagaacccugaaaaccgccgcgaucccggcagggcggggcgggguggcggagccaccagcuaccgagauccgcgcuucgccccagagagggcgagagggugacgggaagcgccgagaggugguuacaaguuuaacuucccggccucuugaaaggaagacgagccccgggugggagaggaagaggcggaggagaaaggggugggugcggggcaggguccagagccgggcagaggaggagccggggccuagucggcgcuaggccggcgucacucgggcagagaaaggcaagggggaggggagcgggcggcuccggaccgacgccgggcuccuuucgguuucggcuccaagggacagcgagccagcacaaggcaaugggccccgggugcgcucccguccccacggcgagggcuguucugggucgccccugacaccaccguacucuccgccucgcagcgcgcuccugcgugcgcgcgcccgcccgcucgcucgcccgccaccucgccaccacgcgcccggcggccgcggagcuccggcgcgaggacgcgcccaugcccccucccccugcggccgggccccggcuccgccgccggccucuccccacccuaccccacccagccgcgagggcugcccgcucgggccgcccacagccccccgggcaccgcgccggccccggcccgucucccuccccuuucccgagcuguccacacccacgcguacagagggccggggccucccucgagcugcggccucggccuccuccccgcgcggcagcuggugccuccccggcccuacggggcucacgcgcacggcacagccacaagaug

SEQ ID NO: 12316 - RNA, 3007 nt, Mus musculus
auuagguaaauauuucuuuauuaaaugauuaauuuuauaaauaaauucucuucacugauauaaaauuaaaaucauuuacaaauuauuccaguauuacauuuccccucccuccccaaaagcuacacuuugauaaauaaaaaaacauucaaucuuaaaacaccugguuucuguuugcaguuuuagagugcagguagcugccccaaggacacucacagaguguccccccuccgcucgggaaggaaugagaggcgcuuucauuuacuucugucaaaggacaagcagggcuuucacuuggcccaacuaaucuuauuuugucucuauuacaauuguagaaccaagaaaggggggggggggucuggagcaaaaaaauacacuuagcaaauaauuuacaaacagaaaacagaacgucauccguaaacaugcuccaauauggagcaauaaugcccgcuccaguacuaugaagcgaagucuucuccaacugcggcugcgcugcuguccguccacaucagccccuuggcauucuccaacugcggcugcgcugcuguccguccacaucagccccuuggcaguuuugaaauacccuaaugcuacucaagaaugagcaaggcaccauucauccuccgcccacccacgucuccaugaugcuugcgcuucuccucuguccagcccacacuaggaacccuggaggcacuuagucccugaacuuguggaugucauugaauaggcuguacagucggaacgaugccucguugggaugcgggcaguuguaguuacauuugcaggacuggaucaucaugacauucuuggaaaacaucucuccaucuucgcaucggaaccgcaucuucacaguucuggucugcagaggugugcagcaccggccaucuacgcaggagccgcaguauuugggccgguauuucuugacacuggagcauccugcauaaguaaaucugacugguucuggggauuucuuggucuugcugcauuucuugcccuucuggaagaaagaacaaaagaaagccaagaaugaggauuguuguuuuuuuguuuuuguuuguuuguuuguuuggagguaugcuuuuaaccacuguacauaguguugggcuucauaaagacaauuucuuuucagauauaucauggacuuuucuuuuuuucuuuuuugaacagaggcucauaucccacccaccuguggggucaucacggucaagcccugaaagaaacuuacuuuuaggcugcuguacacugguuguccacaaggacgcacuucacagauccgggucucuuucaccaggcggcacucuggguugucauugguaacucguguggagaugccaguuccgcagcucuuggagcacugggaccaagacguggucugaacgaugcauuucuggccaugggcgugcagaggguugaaaagaacucgcgguucggugccaaagacuagaaagauaaaggaaauggaaggcuucuuagaugcuugcauacacacacugguuucuacaaaguugcagaccaagaaagcauuucugcacagugucuuaaggacucuauauccacuuaccaggaagccucuucagugagcugccuuuuccaauugcgauuaacucauuguuucucguuaacuccaccuccgaggcaucgaguccgaggaggucauccuggucguccagggaguccuuaaugcugucuucaucacaaacccacucuucacagcacugcccgcugacuuucaccagccggggguugggacagcccagauuggggagagacaguucuuggggacacagaggaaugcagcccacggcgccaucaauacaugugcacugguguuuacaguugggcuggaagcuuuccccguuuugguagauucuggaguuauauucacagggucugccuucugacugagcugcaaagacgaccaaaagagagagaggagaagguuaagauucgccgccacaggcugaaacucauacauauuuuccgcuguucaauucaauguaugguaaaguucccuacaguucccccgagacuccagagcugaacaauaaguuagucaggaaucacuuuuccguaugcgcuuuucguugggcccagacacucugaauugcauuccagacugcugaaaucaugugccuuucugccaagcuaccaucaacaaagcguccaccauacauggucucaaaauuacuaaacuucuggacuauggggacuauuauuuuuuuuaaaggggccaaaccacaagccucuuaccucugcagaucccuuucagagcgguggagcuggcgccgaaauugcauuccaaccccuugguguggucgcagggcugaguuuugcugcaguccucguugaguuguuuagcgcagaccuuacagcagccgcagccgucccggaccaacccgacucccggggcgcacuugggugccuccagagggcaguggcaggcggcggggcagguggagagcgccugcaagagggagaagcgcgugagauugcuuugcauugcucggggaggcacguaaacugcccugagccuaggucuggcuguggggcuccguccaccagaagugucucgaucgcgucccggcagccugaccaccccagcggcugcgucccaggaagaggcccccugggcauaaagcaacagcuaccuccgaacuuuucagucuaacuuucccugcggugaaagaucauggcccggggaaaggaaucgaugagggcagaccgggaagcagugguuaaaaaaaaaaauccaacucaccagucuggucaaguggagaagggugacggcgacagcgagcguccugaaggugcuggagcucauuguggcgcgcaggaggaaccggggcgagcgcggcgacacagaaccaacaagccggcgagcagcgggaucaaaugcgcccggagugcggugaggcgagggccgaggcggcggguguccuucucucgaggugcuggcggaggaggcgcagagauugcaggcgcuucucuggggcgcucucgcucacggucu

SEQ ID NO: 12317 - RNA, 3007 nt, Mus musculus
agaccgugagcgagagcgccccagagaagcgccugcaaucucugcgccuccuccgccagcaccucgagagaaggacacccgccgccucggcccucgccucaccgcacuccgggcgcauuugaucccgcugcucgccggcuuguugguucugugucgccgcgcucgccccgguuccuccugcgcgccacaaugagcuccagcaccuucaggacgcucgcugucgccgucacccuucuccacuugaccagacuggugaguuggauuuuuuuuuuuaaccacugcuucccggucugcccucaucgauuccuuuccccgggccaugaucuuucaccgcagggaaaguuagacugaaaaguucggagguagcuguugcuuuaugcccagggggccucuuccugggacgcagccgcugggguggucaggcugccgggacgcgaucgagacacuucugguggacggagccccacagccagaccuaggcucagggcaguuuacgugccuccccgagcaaugcaaagcaaucucacgcgcuucucccucuugcaggcgcucuccaccugccccgccgccugccacugcccucuggaggcacccaagugcgccccgggagucggguugguccgggacggcugcggcugcuguaaggucugcgcuaaacaacucaacgaggacugcagcaaaacucagcccugcgaccacaccaagggguuggaaugcaauuucggcgccagcuccaccgcucugaaagggaucugcagagguaagaggcuugugguuuggccccuuuaaaaaaaauaauaguccccauaguccagaaguuuaguaauuuugagaccauguaugguggacgcuuuguugaugguagcuuggcagaaaggcacaugauuucagcagucuggaaugcaauucagagugucugggcccaacgaaaagcgcauacggaaaagugauuccugacuaacuuauuguucagcucuggagucucgggggaacuguagggaacuuuaccauacauugaauugaacagcggaaaauauguaugaguuucagccuguggcggcgaaucuuaaccuucuccucucucucuuuuggucgucuuugcagcucagucagaaggcagacccugugaauauaacuccagaaucuaccaaaacggggaaagcuuccagcccaacuguaaacaccagugcacauguauugauggcgccgugggcugcauuccucuguguccccaagaacugucucuccccaaucugggcugucccaacccccggcuggugaaagucagcgggcagugcugugaagaguggguuugugaugaagacagcauuaaggacucccuggacgaccaggaugaccuccucggacucgaugccucggagguggaguuaacgagaaacaaugaguuaaucgcaauuggaaaaggcagcucacugaagaggcuuccugguaaguggauauagaguccuuaagacacugugcagaaaugcuuucuuggucugcaacuuuguagaaaccaguguguguaugcaagcaucuaagaagccuuccauuuccuuuaucuuucuagucuuuggcaccgaaccgcgaguucuuuucaacccucugcacgcccauggccagaaaugcaucguucagaccacgucuuggucccagugcuccaagagcugcggaacuggcaucuccacacgaguuaccaaugacaacccagagugccgccuggugaaagagacccggaucugugaagugcguccuuguggacaaccaguguacagcagccuaaaaguaaguuucuuucagggcuugaccgugaugaccccacaggugggugggauaugagccucuguucaaaaaagaaaaaaagaaaaguccaugauauaucugaaaagaaauugucuuuaugaagcccaacacuauguacagugguuaaaagcauaccuccaaacaaacaaacaaacaaaaacaaaaaaacaacaauccucauucuuggcuuucuuuuguucuuucuuccagaagggcaagaaaugcagcaagaccaagaaauccccagaaccagucagauuuacuuaugcaggaugcuccagugucaagaaauaccggcccaaauacugcggcuccugcguagauggccggugcugcacaccucugcagaccagaacugugaagaugcgguuccgaugcgaagauggagagauguuuuccaagaaugucaugaugauccaguccugcaaauguaacuacaacugcccgcaucccaacgaggcaucguuccgacuguacagccuauucaaugacauccacaaguucagggacuaagugccuccaggguuccuagugugggcuggacagaggagaagcgcaagcaucauggagacgugggugggcggaggaugaauggugccuugcucauucuugaguagcauuaggguauuucaaaacugccaaggggcugauguggacggacagcagcgcagccgcaguuggagaaugccaaggggcugauguggacggacagcagcgcagccgcaguuggagaagacuucgcuucauaguacuggagcgggcauuauugcuccauauuggagcauguuuacggaugacguucuguuuucuguuuguaaauuauuugcuaaguguauuuuuuugcuccagaccccccccccccuuucuugguucuacaauuguaauagagacaaaauaagauuaguugggccaagugaaagcccugcuuguccuuugacagaaguaaaugaaagcgccucucauuccuucccgagcggaggggggacacucugugaguguccuuggggcagcuaccugcacucuaaaacugcaaacagaaaccagguguuuuaagauugaauguuuuuuuauuuaucaaaguguagcuuuuggggagggaggggaaauguaauacuggaauaauuuguaaaugauuuuaauuuuauaucagugaagagaauuuauuuauaaaauuaaucauuuaauaaagaaauauuuaccuaau

SEQ ID NO: 12318 - RNA, 26346 nt, Mus musculus
ucacauucuauuaaaaagacuauaggacucaguauaccauauauauuuauguauagauauauaucauucugaaaacuguuuuacaaaaaauuuuucauaacaucacuuuugauagauauaaaacagaagacaguaauuuuuuagaauguaaauauauuuuaaaaauuaaaacaccuaagaaaugcaaucuauauacaugaaaagguagaauauuuauaugaugacagcacauuacccacaagcagugaugguguuuguuauauccagauugcgguuuaacaccacagugauagaugacuguucuuuagggaaauuauguaaggugcauagcaugaggaacuuaacagaacacuguaaauggacaauuaaugccaaguaacaguauuuucucuaaaaacauguuaguaaacaaauaccuuaaacuaaugaaccacaaaaugagcuuauuaaguuuaagauauauagucaacugcauaaaauuacauguggccacuuaaaaaccaucuguuucuaaaauaucaggagcucuggcuauugggacuuccacaggagagaaaaugucauucauuuucuucuuaugaugaggucugcuuuacgaacauuacaaccaugcucuuaagaaacgcugcagaauauugagaagucacaacgguaaagcacacacaucaaugcauucugguaccagcccaacacagcaucucugaaugucaccuagacugcauuucuguaugacuuuggcuuuuauucuccacauauuacauauacacuuaagaauuuuaauuuuuauuaaaggagccuaucacacugaucauuuaaagauacacacacagacacgagcacacacagacacacacgcgcgcguacacacacacacacacacacacacgcacaugcacacaguacuuggauaaucuaguauuuacuagaaguauauccauagaccacaaaaccaacuuuuacuuguaaaugaaauacuaaaaauuucugauuugggagaaaugaaauacagugaaugacuuuucaucccuacuguaaaaacccacguugccuauuugaacugugucuauucaugcaguuuaaugagcccucagaagaguuuacacaucuuuacacagaauucacagcagucaacugccgguacuuuuauauuuucagugucuuaucaaacuauggauagcaagguucuucucauccuaggaggcagggagaugcuuccucaggaucucuuuggaugcugcagauaugacgucugggaaggacacaucaaauucuaucaguaggucgccacgcuggucaggguuuuuuggaaauggcagcccauauccaauaacucuucuccucaucccagguuucacaauaucagugacugacauagguagguuucuuccguccauuguuggcacauuaagugagcagccacacaaugccuaaaguggaccaaauaaaaugaaguuauuaauaaacuuccaaacuaaagaauauaagauugugcuaggaaguaaaggguaacaccaugaagguaaaauuuuaacuuccaaaaggauuacaauaguuaauaaaccuuuuuccuauucuaaaaacucugcucaagagaggcauaaucagagauguuaccagagagagacaugaaaggacaaagaaagaaaaaguuaacucaaggaugucuuccacgcugacuuaggacguucaaagcuaucauagucagggugcagaaaacuaacuggagaaacaggaggacuuuagaacaggacggaacuaaacaggaacaaaaccuauuuuccagaagaccuuggggucuacugggcacaguacaguuccuguugaaccacauggggaaccauacaguggagcucugacacagagaaacuaagcaaaguaauaacagcaaauucagggaagagaaaauguacuuggagauagaagccagauuucuaucuuuuaaacuguuuggaauauuaguugguagggauacacugagccauuuaaacagggacauggccccauccaagaaguagugcaaauaaggacucaagaacuauauuaaggggugguauugugcacuauguauaauuauauacuuguuauguucuaaugcuuguucuauaaauuguacuccaaucacuucagaacaaauguauuaauggacuacagugguggguuaccaaugcggaucucacagaccacaaccuaaaacuagaguuaaccuaacacuggccauaaaguagcuaaccaaacuuguacuugaaaaccgacauuuaaauaguuaacaucaguaaauaaauuuagaaacuaugaugucauccagaagagagcuauaauagcaccacuuccuagagaguuaccaugaggaauaagucugcagagcacuggauaaaagccagcgcugcccagacagcccccuagucaaucagcagcagucaucucuccgucuuagagucucagggcugacuuacugacuuaccucccguaaacuaauuuuagcaguauaaacuauauuugauccgucucuuuuaaacuugggauguucuuugucuuuaauaacaaaaacaaugucugcugggauacuauuugguguuucaucgccuucccucggaaaagugauuuuggugccuucuuuccacccuuuuuugaucucaauggugagaauuuuguccucagaucuguaacuccuuccgucaggauuuaaucuuuuucgagaaaucuucauccguuuggugcagccacuauauauuucuucaagcgauacuuuaaguucaugaauaaugggagggucuuguuugagacgggagggucccacagaauuccugucucuuggauauccauucaugcugaauccaaaggcacuaaagggaucuccaucuauuuccauuucuucagaaucucgaccuccacccauccgucucccaaagaagauuucaaaaggguuggaaccuccgaaaaaggcugcaaauguggcaugaggaucuccguggaaaguguaccugaagguaccuccuuguccaucaguaccuccagcgccucccuucaagccuggugaagacauaagcaagauuaggaaaagggccggcagucuagacagcugaccacuuacagauugcccugcuaauaaacucugacuuaucacuuacggccugaaacaucauuagaauuaaacagaauaguuucugaagauccauccuauguuaacguuuuagcuuuuaaaucauuccuccaaauucuuugcuuuaauaauuucuucuugaaucuuuuguuucacaauaaauaugaaaaauaaaaggaaauugagacucccuuaccucaaaaacuccuguucuaacauacuuaaguauuacaaauuuaauaguuuuaaagaugccgguugaaaaccaagucuaaauccuaaggaccauuauaaaaacaaguacaguagcaacaguuaacauaguucgugcucguagcuuuacugcaggccuuugcuguuguuuucaugauguuuaucaucuugauuauguguaggcaugugugugugugugugugugugugugugugugugugugugugcauaugaguaugugcacaugugcagguaccugugaaggucaggagcaucaaaacccccuggaguuagaguuacagaugguggggagcuccugacaaugagauccagcacuuagagaaagcagccaggacccagcccucucuccagcuccuaugucucuacuguuuaauaacugaaauagaacacuuuuuagaggagcaagggagaaauauaauaaaagggacagugugaaaacuguuuuuguuuuuuaaagauuggcuuauuuauuuauuuauuuauugaauguauuucaguaugcuguugcugacacaccagaagagggcauuggaucccauuacaaaugguuguaugugguugcugggaauugaacucaggaccucuggaagagcagccaguacucuuaaccacugaaccaucucucuccaacccaaaaauuuuuuguagacacuagauuaucaucaccuuagacagcaagccuuuuuauguccacuuuaucacauccugacucacagcauuuaaaaacaggaccaaaaaaaaaaaaaucaggguuuuuuaacauguaaaauggacuaguuauuucugccugacaacccacuuuagacaguaguacuaugaccuuuugcccagagguucagcaaaguaacaugugggugacaaagauuauauauauuuaaaauagcauuuuucuaccacauaccaaagaaagauucaacuaaagcccauacagcaacauagugauguuuuaggaggccgaccguggcaaagguuucuaucagucuagugaagcuccuggcagagccuaggaucccucuccaaaacaggacggaggaaaauuaagauuacagaacuaugaaaaacucuacuuuaaacugagauucuuauaucccuauauuccuauugcucauguauaugacauugaaaaugaggaacuccagucuauugaaugaagaaaaucagcuaauuauuaaaguuguccugaacugaaacuaaaauaaguguuuagagaaucagccuaaaaaagacaaagaaaaagcaaaauaacacacacaggugagaucuaaucacugcaaugucagggaggcuuaaucugcaucuccugcuguauaguugguuucuauuauuaaaggauauauauguauguauguauguauauauauauauauauauauauauagagagagagagagagagagagcacgcugugacauccaacagucucaacuaacaucuaaauucuuaccuuuacccaugaagagaaaucuaaaggaccaagaaagaccuaaucagaguccucauuagaggagugugcaugcauacaggcaugcacgcaggcauguacacucacgcacacacguggcaugguuaguugggguauucacuguagaaauggaaugacaagucugagaaggacaaacaagguuacuaaacugcucauucugacuuccuucucuagccuuguuaauaugacuguaacuccaagugugaaaagcuagugagagauuuucuuacaugauagaugaaguauagaccucacagucaucacaugguaacugaaugaguacuuaaaucauuccaggaacuguaucccucuucccacagguuucauaaaguauaagaguuuaccaguuaaucaacaugguaagugagcaugccuauccuuagcucucuaaaaggcaaaaaucuaaaugcuuuggacacauaacagaaaagaaagaauaacauuuucaguauuacaucauagguuuggcuuuucccuaaaaccucuucccuugcucccaaaaaugguaauucagucaguauuauagucugugagaaaauuuacacgcagccugaagugacuuacucaucagagcugacaaaaauguggccuugaguuuccuagacaucaaacagucaacuguggaguccagauaaagaagggagcuacacuguaauaaugagaaaauccuaccaaaugccgcuguaguaugacaugaacugcuugcugucuccugcacugcuuaacacuugaauucuaucaagcaugccgucagccagauaguuaaccuuaauccuguacacuacaacucccagcagaaccugucaacauccagcuggauucucucugcucucuacauuuucuagacacugucuagucagggaauggacucuagauucggcaucugccuagucuuuuaaucaacuaaccaauuuaacacacaaaaacaaauagaucuuugggauacugcccauagcaacgaugucuuuuaguuaaucugacaaaaacuaugaaaagaaggaacccuagagaauuggaacugcagagaagagucaugggaccuauuaggaggccuaggcauaacaguguucgauuuguagcaagacuucagaguuauagaacagaguuauagaacagaguuauagaccuuuaaacagguuaacucacaaguaacuucuguaucuuuaggacccagaaaacaaagaggugcagcggacuaacugcauggaagagaauacugaacuagaagaaggcuauuacacugaauaguuaaguugaaacacaucaacaacuguccacauccagaguaaauuagugaguaagaaauaaucaacaaaguaaagaaggaagaaaugaaggcuagaaaaccagaacccucuaaagguguccuuugaggaaaaguuguaacuuuuauauuuuaaaacugcauuucauuauggucaguuggucuguugauggcacgugugugucaugguaugcauguagaggucagaggacaaucuucagaauuaaggucccucuuuccaccuugagggucccagggauugaacucagguccacaagcaccuuugcccacugagccaucucucuggcucaauagagaaaaauaauuuaauuguuuaauacaaaccucuguucauauccacuuaaccaagccuaaaaguuuagggcagagaauaauucaaaacccaauuauagauuucuguaguuucaugauuauuuucaaauauuuauacuaugaaguaaacugacuuauuuaguauguagacuacaugacaaaauuaauuuguauacuguucagcuguaauaaauuuacuacaauccauuuguggaauauucccaccacucucaagaggucucuacuuguauuuccugcuuauuccuauauuccuaccuccaguccuaggcaagcuagcucagcuaucagauauuucacaaauugaauuacauaauauacaguaucacuucuaucuagagucuuucauccagcauguuuuuccagguucauccaguugagacauacuucauuaaacgggucccuuuuuaauugcuaaaaaguacccacuggaguauauacuccuuguugauccauuugcuaaaccaugugacuucuggauuguuuggaugcagggaccuuaaugguccuacuaugaacaaucaggaacaugucuuuguaugagcaaauguuuugucuuguuuauuuuucuuuuugauucccaggaauaaaacuacuagauaauauaauaacuuuaaaccauaguuauuuuauucacuuuuuuaaaacgaaaccauuuuaaauuucagauguuaaaagaauuucacaacuugaauaaacaguauuaacgguucucuuaauuguaaauguggacagucuagauuucuguuacuauuggagaggccuacagacucaggaacacaagcacggacaaugcgaaggagagaaaggagaaaagcuuccucacacagaaccuccaggccaugaggguggggugcugcggauugagagcggggcucugcaugcuuagcuagugcuguggcccugagcuacaacuccuccuaagccgacagagcuuugcagucacugugugcuagguuaccaaauaguaagaaacagaagagcucaacagucuucacucuccuauauuuucagguagcuaauaacuacagaguauuucugaauaauaaauuucaacacuuuaagcaaccaguccugcuucaugcuucguuccuugcuuagagcacugaucugggcuaagaacaccaagaacaaaaaaagacucaggguauacagaaauugugauuuagucacugguaaugaucaguaaaaaaaaauaagaggaagaaaaagaaaaagaaaaagaaaaagaaaaagaaaaagaaaaagaaaaagaaaaagaaaaagaaaaagaaaaagaaaaagaaaagaaagauaauuuggggagugaguuacucuaaaaagcacugccaagagaaaacguaaagaauuaagaguaccagcugguauacuugaaaacucugaagucaaacacgauuaaugagccugaauccuacggcuuaacacagaggugcacuugagcacuccauaagauggagccaaauaaccugcguuuacacaaguggcuuugugggaacucacacaccacuccaccuacucaagaguggccagaguacuggcacugucucaagagccugcucgcuccugagaggucacaccacggcauucucaacugugugaccauggggaacagacagccucaacuauccacaucuugcuucuuguaauuacucacucacuuuguaagaacuugacacuguggauuugcacgaauuacaaccacaggcagcagcaugcuugggacugacccaaaauuaaagcaggaggaaaagggcccaccacugcucugaguugucgguuuaguuugcuuaaugcauggcccuguuugaaggacuucuaauuagggaaaucugguguuuaaaugcuauaaacaaggggaaaacaguauguuuccauagccaccgugacuuaaaagacauuaggggaagaauaaugcaaaagaacuuuagucuguuuuaacacuugaaaaccccagaacucacgugaacuaaugcaugguugccgcugcugcugacugacaauuucaaacuccuacuuuauggccacauuuacgacauuuauggacauuuauggagaugcuggacaaaauucggaaugguaaaaggagauucucaaaggcuacugagcucacugaguccugaucucagaaggcaagaaaaaaaguauggcugagggaaagggcagcugucaugcuuccucuucagccacauaguaaaauuuccaaaagaaauaguuaacuaaaacaaacucagucauuguuccaacuagguggccauuuuggguuagagaaggagagggagggcgggagggcggggggggggggggaggaagagagggagggagaaagagagagagagagagagagagaucuuguucuccuggcacaauauuaacuguuuauaauuaagcuaaaaacuuguucugguauuuuaugacaucagggaaauucuuuccucucuaggcagauugccaaaaacaacuagaagcuaaaugccugugccuucugcuucuacgacacaccacuccgucuuguucaguuucaacuagcgucgcucuaaaaggacaaaaaacuucuuguuuuucuaaauaaaacauaaauggcccagaauuugaauugccgaucuuaaaauuuuaagugacugaagauucuauuaauucuggcaauaaaaucauuaaaaacaaaacagguugcauaagacuuuuaaacaauucauucacaggcaugagaauuuaagguuucuuuuaaaauauaaaaugcuaaaacaauaagucuaacaggagaauaugaauaauacaauauucuaagaaaaaaacccacaaagacaaacaugacauuucauucauagcucauucaaauaaucaaggauuaaaccuuaguuuuaaccuguuauuuuucuuuuuauuuuaguaugucugauguucucauguaacgauaaccagaaggcugagagagagagaaaaaaaaaagcuacgauucagacacugccaaagguacagaaauaugcagcuuaccuucuucgccaaacugaucauauauuucucucuuuuuaggaucacucaguacuucauacgcuucugcgaccucuuuaaauuuuuccucugcuugaggagauuuguucuuguccgggugaaauuugagggcuugcuuucgguaagccuuuuuaacaucuucaucuguagcuccuuugucaauucccaaaaugugauaauagucuuuccccauuucgaaugccuugaaaugaacuuagauuucccuuuguaaaagaaaacagcguccccaggcuuagcaacacaaugauccugagaaaauaaagcaagcuggguaucuuacaaguuaaagcaaaucagcaacucggcucagcuguccagaggcagcaggcagcgucucuauuuaauuccuccccggcagcucacuuacagauaaauagacaccgcacggagacggccucagcuagacccucccacuucaacuacgugucucuguacuuucuagaacagcgaacgaacgaacgcuacaggacgucacuuucccagcggccucuaggcaaaguacugagcugugccucuccuccuccacgauuaacuauucccuuuccuucguccuagcuguacccuuuuauuuccuguggauuuagcaaaccagcacagaaugccgcaacuacauauacauuuacuccauuagagguaaaaaggcaacagaaauaauuauagccauuaggcaucccauguuaaacugauuauacagucagaaaagcccucaacuuacaguagguauucuaacuucaauuucaaguuaccuagcuauaaaaugugcagaacuaaaauaugagguguuuacauuuaaaaucuucaaauaauuugggucauuuucaaaauuucuggggucuaucgaucugaaaagugagggagccacuauauaaaaugucacaugguaaaaggacuguuauaacauugaaaagcaguauuuuaacauaaauaggugacuuaagaaugguuuuaacuagggguucuuuuuuuuggaggggggauaauacuuaauaaaccauuccuuaucacaaugaaacggaaaagcccauucugagggggucuuuauacugcagggaauguaggggagagaggaucagauuccagcacgcucaggucaguguaacugucacccgggaccaguuuacggccuggauggauuaguuaggagaggcaguuagguaacaaguuccuucaaaacacauuuccccuaauuuuaaguauuuacuuguugacaaagauuuuuuugaaacaaguggggggggguuuucucccuaucuuuuuaguauucccuuguaauauuaguauauuucauaccuuuaaaaaacauuuguugcgauuuguuguaauuuuuuaaaucaacaguuuuaaucauuuuacauuuauauguuaucugaugcuuuccuucuuuaaaaauguaucuugaauagaugagaaauauuuugaauguaaauaacucaucuuuuaucucuuuuguggguuuucaaucuguaccagcuggcuuugugugucaacuugacacaagcuggaguuaucacagagaaaggaucaggaucaaacauuucuuuuucacauuccaugucccaaagaccauggggaaguuaacaucagcagucaucaugagagugcgacucugaaagugcauaugccaucacacucaccuauaaauaucuaccugcuaauacagguguaggggguagacuugagagagacuaugaagagaagagaaacuacaauuaguaaauuaacugcauuuaaaaauugaauucuucuauuaacaugaagcucgaauucuccuuguuuuauuacaaguaucuagccugcuguaucaugcaauaauucaggacucagaaaagcauaaauuuauuuuuauguauaucaaaaagcuuaaaugugauuauuuuaucaauguuaacagcaacaaaguuuuugugcauaauaguauguugaagucaaaugcuacucuauuuuaaugacagguggaugggccagagguaauuaaaacucugaaagucacugauuuugcuccuagcacuuuacucaauguucuuacucgggaugcuaugcuuuaauaaccguacaagaguggucuguacagaagacagcacuuacaccccauaccuacaaguagaacacaucguccaacugacaccaucuuucucuaacuugauuuucauuucuacuuaacaaaaaacucuuagcuguugugaugguucacacuggaaucccagcacucaaggacugagguagaugaaggccaguguaaggcacacagugagcucagggccagcuugagcuauguaauaaaacccugcccuugauauacugugaggagcacaaagacaugcgcugacuucuagaacuacuuagaaaaaaaaaucaauuuuaaaauuaggucacuaaaaaggcuaacgcaggagaauggcuaguuuuaggccagccuaggcuacagagagagaugccgucuccauuaauuauuaagauaaucucaaaaauauuugagaacauacuaauauuuuacugaugugcuuguuaaaaauuuuucuaccaauauuuaauuuuuaaacaggucauguucaauccuggaguuuuucuuuuauguauauguacuggcuaguuuugugucaacuugacacagcuggaguuaucacagagaaaggagcuucaguugaggaaaugccucuaugagauccaacuguaaggcauuuucucaauuagugaucaagggggaaaggccccuuguggaugggaccaucucugggcugguagucuuggguuuuauaagagagcaggcugagcaagccaggggaagcaagccaguaaagaacaucccuccauggccucugcaucagcuccugcuuucugaccugcuugaguuccaguccugacuuccuuggugaugaacagcaguauggaaguguaagccgaauaaaccccuuccuccccaacuugcuucuuggucaugauguuuguacaggaauagaaacccugacuaagacaguauaugagcacaauguagcugucuucagacacaccagaagagggcauuggaucccauuacagaugguuaugagccaccaugggauugcugggaauucaacuucagauaaucucaaauacuugagaacagaucaauauuuuaccaauguacuuagaguuucucauauaaugaacuuauauuagaaaaucaugaccucuaguucccuacacuuccuacccaaagauuaggaauuuuuagccucuuuuauucuauguucuuagugcuucugacaguugcauaucuaaccucaaagcuaagugugcccaauggucacuacaucugucaaggcagcagauauggcagugcacuaacugcaaaucuuggcaggcugaggcagaaagacugcuguugagcuuuaguacagccuggacuauagagugagccgcaagucaucaucaugggcuacauggcaaagaaagaaagaaacagacagacagagggagagagaaagagagagagagggagagggagggagggagggagagagaaagaaagagacagagggagagagaaagagagagagggagggaaggagggagggagggagggagggagggagggagggagggaggaaaagaaaggacagaacagagagagagagaaagagagagagagggagggaaguagggagggagggagggagagagagaaaaaaaggacagaacagagaggggggagagagagggaaggagggagggagagagagagagagagagagaaagaaagacagaauauagagagggggagagacagagagagaauaugaauuuuaagggcuggagaaaagugguaaaaaugcaugucugccuuguaucagacccuggguuuaauccccaggggacagaaaggaggaagaaggaagaaaacccacagugggacuaaggaacaucuaaacaauuauuuaaaguacuuguuaaaagcagucucuggagucaagcuguggugguuuguuuaugcucaacccaagaagagacacuagguguggucuuguuggaguaggugugucacuguaggcguggacuuuaagacuaucauccuagcugccuggaagucaguauucugcuagcagccuucagaugaagauguagaacucucagcaucuccugcaccacgucugccuggaugauaaaggacuggcaccauguuccugccuugaugauaauggacugaaccucugaaccuguaagccagccccaauuaaauguuguccuuaaaagaguugccuuggucauugugucuguucacagcaguaaaacccuaggacacagccuugcuggauuagaauucugguaaugucacucaccaguuguguggccugagaucgaaacucuaugucucaguuucucuaucugucagugggguuaauaucgacuuuguagggcugccauguggauuaaauaagcuaacacacuauauuuaaauaucacugacacugugaagauuaaaggugucagauacuuuuuaugauuuuauuauaugaaauccaacaacuuacuuucagaaaacaaucaugucauguguaacacuguuauuuauaaaauuacacccacacacauaaaugcaaaaaaagcuauguuuggcucuuuccgaauauuccuguuaauauaugcuauuuacaaaccuggauucuguucaucccagcauuugagaggcagaagcaauucaucucugugaguuaagaggccagccugaccaacaaagugaguuccaagaaagucuagguugcuauguagagaaaccccgucucaacaaacaaacaaaaaacaaaagacaaagcaaaacaaaaaaagcuacaaaugucucauaaagacauaaguaugugucuauuuauuuaugcuccugguuucuaaugucagcucugccacuuaaccagguaaaaccugcucuagaguuaaacuuaaaagauuauuauuaauccagguguggcaguguaaaccuuuaauuccaucagaggcaggagacucucuaugacuuggagaccacucugaucuacacagugaauuccaggacauucauggcuauguggauagauccuaucuuaauggccccucacaaaaaaaaaaaaaaagaaagaaaacacugaaauguaugacauauacauacaaauuuugcacuauuuuaagcuauacaaacuauuuugcuaucagugaaagacuacugauaaaaaucuccauuuacucuagauuucaguuugcaaaaaagcauuuaucaaaacaaauaaguaacugucagacugaucucaaaggacucagauacccccauguuuucaugccuugagccaagauuccuucagacuuucaugucugaauuucugacuuuucuuacaccaagaaacucuucuaagccuuccuaauaauagcaauuauauaauggcuguuuggaaaauauuuucguaugcucucugauauguaugcauauauaugugcacguguugguauuuaagcaagacaaauauucauaaagcuuuuccguaauuauggcccaacaguaagcuauggugcucuuugcaaguuucuuguuuuauuuuuauugugcaacaguguagagugaagacucucuaaugcaagugggcucugaacuuauaauccugcugcuuuagccuucugaaugcuagaauuacaggcaggagccaagagacccaacagaagaccuacagagucaacuaacuugggcccauggagacucagagacugaaccaccaaccaacaagcaugcgggggcuggacuuagguccccuacacauuugaaguagaugagcagucugaucuucauauggguccccuaacaauaagagugggggucgucucagccucugcugccuaccacuagaucuccuuccccuagcuggacgcugaucaggccucaguaagagaggaugugcuuaguccuguugugacuugaugucccaggguaggguaguacccacagggaaggggaggggugaugggaggagggguuugugagggugggacugggaggagaagaaggaggggggcugccauagggauguaaagugaauuaauauuucaaguagcuuguguagcauagaagaagcucuaacuucuuaaugcugaaaaagggagaaagcuguuuaauuggucauucaaguauuaaagaacaauuuaaaaaccugugauauuuauuuuuuaguuuucuuagcaaaguaaagugauuuuugaaaaguuuuauuaauguuaauauuuuuaacuaucuaaaaagcauuucuaaaacaacuccaaaaagaucaacaggacauagaagguuaccagacgugauccuccggggacuacuacugucuagcuugucuaagaacuuuaucaccacagguauguaauuccuaucaauuuuugauaaugcuauugcucaguuuuauaacauuuacccuaaaguauuucagaauauauacacuuaaacugauucauuuaauuaucuuuaaaagagauauaagguaaaauuuuaaaaauuuaaagaacaagccuuuuuaaaauaagguaaaaauaaaauugcuuuaaguagcugauuuuaaaacuacuagagaagcuagguaugguggcacacaccuuuaaucacagagcucggagucugaggccaguaucaucuaucuauauauaguaaguucuaggacagccagcacuauguagacacaaaacaaaauuuacuagaguuacugcaaaauacuaaucagaaauauuuuguacuucaaaacuuucuugaaugggaauaaauucauuuuuauuuugggggcguauagaacuaauuuauucauacuauaauauuuaaauguuuccaaguaacaauuaggccuucuuuauuauucucuuuuauaggaagucaccaaaaauuuacuaguaacuccaaaacaaaaagagagcuaguauacuuucuagcaucuugugaucuacuuuauaguguuccuggggcuagggaggaaucuuaguggauguugugaagauucccagcauccacauaaaagccaaguggcaugguggugcaugccuuuaaucccagcacuugggaggcagaggcagagacagugggauuucugaguucgaggccagccuggccuacaaagugaguuccaggacagccagggccauacagagaaacccugucucgaaaaaccaaaaaaaaaaaaaaaaaaaaaaaaagauagauguuauuuauauuauauaaaaccauaauagauguuauuuauauuuagccucucugaaaauccgaagccuuuccuaggguuagaaauuugaaggaagggcuucagagauggcgaaaucugggugacugauggcuggcuagcuagacuggcucaaacaccuagcuccuagcuccagguucagagacacugccuuaaaaacuaaggcugagagugauagaggaagucauucaacauuuaccucuagcauacacacacacauauauaaacauacacacauacauacacacacacacacacacacacacacacacuuauuuucaagaccaacuuauguggccaaaagaaacugggauuucuagacuacuuuaaaugugucuugauucacugauaugugcuuauaacacuaacugggaaaaaaucagcauaugaauuaccaacaagacacuuuccacacuuuaggaggcuaacccuuggaaaucaguguggauccacauucacacagcaccucuuccaccaugcucaugagacggcugcggcagacaguguagggcuauugaguccugauaaccaauuuucagacucauagccuaugaacuuaaaucuaucucucucauacacaucaucucacauacauacuugggaaggucucuuaggagaauauagagaauccauuuucagucauaaaaagcauuucauaucauuuguuuaaaaaaaaaagaugacaggcucaaagguagcaguaaugcuuguguuuacacacgcucaaagguuggggauuagcucagugcaugugcacuuguuugcaagaacaagguccugaguucagucugucuggggcaagguagaguuggggguggggagagacaaaauuauaagcuaaacaagguaaaaucaaacaaacaaacaaacaaacaaacaauguaacuacacaugcucagacaagaaacacacacgugauguucaaaguaaauuaacacuaagaaacaaguaggcacgguuuuaacuuucuucacuucuagagguuuuuccucauaaacaggcagaaaaaaaaauuaacugguuggagaauaccuuaaauccuagcauucuggaggcagaggcaugugaaucuuugugagaucaaggacagccugggauacagagggaaacccuauuuugaaaggccagacaguggcggguguucguguguguguguguguguguguguguguguggugguggugguggugguguacuucuaagagaagugguaugcaguacaaggaaagaagcauuuaucaaauaaggagaggcagguagaggucauggggcugccccaugggagcauguggcucuugcccaacacugugaccaacuaacuauccagcaggauguuuagcuugcuaacuauuugcagcuauaaaaugauuucauuauaucaguaccaaauuuuacuaaaaaucacauuauauccaugcccacauaaucaaacugaugcuacuaaggagacuuaaccacaauucagacguaucgacagcuaccagaaguacuauaauauuuauaaaagugagcaaaccuauccuguaguauucaccaacugcuacaaacuggaugacugagugcuuaauuccaacuauaaugagcucaaacuccuguuuucaccuacagagggcacagauuuaaaaaauuaagauaccaaaaauaauugagauaguaauggcauaaaugauuuuaaaauauagucuuucuugggucaacaagaugacucaaguaaaugugagugcaaccaagccugaugacccgaguucaauccccagcacucacacgaugggaaaaaguacucuccccagacuguccugaccuccaacaucaugcacgacacgcacacgcacuuaauaaaaauuaaacaugcagucuuuuuguuaacuggacuacagucaguuuaucaauacaacacuuaugauaccccacuagauuagaucauugucugcauugugaaggauaaacugaauagaaggcacacagccacuggcccacaagguuuccacuguaaauucauaaggaacuugcuaucauuccucucaccagauagugguagaaaguuaaauccagggcugauggccaauaaugccuaaaauauguacugacuggacauuaauggaaaaugcuugcugacccccauaauauacaagauacuccucauaaaaggacuuuuuaaaagcacuaaacaaaaacccugcuuuuugcaaaauuccuuuuaugcuuuauauuuuaaacccucauaaaguaaaagucaacaucuuuuuucuugacuaaugguaaaaauaaaauuuguagacugacucucaaccuggccaugccuaccaagggggguauauaauauauacaggaauacuugggguguaagcuaaccuuuucucaagagguaguguauguaauauaauaguucagaaagacuguuucauaaucauacuucuuuggucaguuugaucacuuauaucuaacucaucaauccugaccauaaaugacuggccauuucccccaaaucaaauuuacuuucuauaacuguggcagaugcugaguuagcaaauucugaaucauuauuccuaagggaaauaaagguuccugcuagccucuggucauauuuucaucaaccaccccaacacauaacuucuuuuuuauauguauuccuacuuaaaagauucuuauuuuauauuguugacuuacugacauuaacucauagccaaaagugguauaacucaugccugaaugagcuuaccuaacacguguuuucucuauuagguauaucauagcuucuuauacuuagaaauauaagcacuucagcauugugcuugggauccauuuaauggugaaauugauuuaaaaaaaaaucaaugaaagugcaaaaacaacaagaacgccauacuagauaaaccuaaaaggauuuagagaaauucacuaagacaagaauacaaaaaacccgaaggcgcagaaauggaccuacacccaaaccccccacucacacagaagcggccaggcugugcacaugugcaauggcagauucugcaugcugcucauggcaggcugagaggcuucaagcuccagcuucaggaagaggccuuaucucaaaaugcaaaaagaaaaaagaaaagaaagaaugaaaaggaaacgagagaaagaagaggaagaaccccguuuuaaccucuggcauaugugcagacucagaaauuaauaagugaauacauuuuuaaaagaaugaaaaguccuacuaguccaacuugaagccagugcggcucugcaugugugcaucuucaaaugaccccaaaucaucuagaaaauugaucuggggaugaaaauaaauuugugaaguaggcacauucauaaauacagaauuggcaagaaauggggauuaacuguauaaugaugugccacuaaauaacuauggucacaaaaaagaagagaaaagaaaaggagaggagaagagaggggaggaaaggaaagaggcucgagagcaacaccugcaccaaugguaugccuuugauguaucuguuauguauaacgaacugaacuguaucuuucacuccagaaacucuccacauagcuuaagcuccccuuugagccccagccucugagagcugugcugcuguggacccuggcugagguugggcuccuccuacuccacacuuaucacuagauaucaacucucaccauacauaaaugaaugcauuuuccacuagauugcaaucuccuagagggggucucgcucccuuucucucccuuccuuucccccuccugccuucccuaccugaacaagaccuuugcauaacacagauaaacuucugcugaaugaaugaacagaaaugguuagcuacaggacuuaaaguaagauguggaugcuauugagacagaggggaaguuuuaaauagauucugcacaauuuuccaaacagcuagaugugcacauuaggacugguaucagauguugguuucugggcugaacgaagguaugcacaaguguuacuaaucaaagagaauuuaagaauaagacauuugaggguaaagucaaguucauuacaugcaugcuaugguuuuauuaauaaaggccuacugauaacaacagaaacagcgcccuaagaguugauacuguauagagaauaggaccauaaacaaagaacuagcgcuuuagcacguagaguuggagccagcacugccaggugcacucaguacuaucugaucuaacaggaagucucuacuugugacuuggucaggacuaagcucuuuacucaugguuaaaaacagagucuaagaaucaagaugacuacaaugagcauucaugaaguuauucuauguacuguaacuuaugcuaggaguuaaaaguuugcuagaugaaugaccuaucugcucauuaggcuuuuccuaucccaaucuuuaaauucauuuucuaaugaacuacagaccuggacuacuuagacuacuggaaauaacuggaugaaagaaaaugcaggaugcacagagugacucaugauuucacugacaucuaugacuaagaguauuuuugcgaggguggcaucuuuauuguuuaauaggccugcccagcucuuuuaugggauugaaaaacucaagaauuacugcauaccuacuauaggucaauccucaaaucaauaucaaguucaaggucaaccugggccacacaagauucugucuugaaaagaagaaauaaaaugaagacaaagacuacauuugauucugaggaaguuuguauauccuuaguugcuacaacuagaaaugacuaugauaaucguagaaaaacaguagcuucaaagucuuuguguaaaaaguuuaauuccaguuuucucucaaguauguaucucuuuaaauauauuuucaaaaugaaauaaaaccaacuaauaaaaaacaaugcaaaagcauaaagagaaucagagggcaaauuccagaaugaucauaguuauaaauaucaugaaaaaauaaaauucuacuaaaaacaaagcuguuaucucaagugagucuuaaaucucauauccaccaagcuuuacuuaaggauuuaucugguaaagaucuucaguuuccaagugauuuuucuccaggaagaaauguuauaaaggaaaaguagagacccugauuacaaaaccaagacgagcugaguucuacacauugaauauauuaaaccacaggcacuuaauauuaaggcaugauccucuggaaaccuaagccuuuuuuaaaauuaguuuuaugaucauuucaaaauccucucaaauuauuuaacuguucauuuuaggacucaaauuaugucauuuuaaaagauaauaucuaauaaaguucagauaaaaaaaagauuuauuuacauucugccuccuuagcaagacaacuagaacucaucuuuagaaacuagauguugacuauguaacacaccaggcaaaugugaucaaaauacacgugugaaaaugggagauagguuuuauuaauauuuugaacauauuuaacauauuagaaaugacuuuauaaucguacuaugacuguauuaaaauauuuuugcaauaaggaaaaaggaaauaugguccuaccuugaauuacaaagcugauaauaguucugguagacuauaaacuuuguuaccuuaucaggauauagcucaaaugauaagacuacuugcuuguauaggaggcccugguuuugauuuauaacauggcugggaauaaagcucuuugacauuuuaagguuuuuguucauuuaagcagauagugaaccaggaaucaaguagcuucaccucacaaaagguuuggugucagagcugauagggcaaggagacagcuuucauaggguggauuccuuugaguucaggcuagccuggucuauauauugaagucuaggaaagccaaggcuacaauagugagaccuuaucucaaacaaggaacaagaaaccccaaauuaccuucucuguguguauguuuggcuaccuccaguuucagacacugguuaaaaugcuguucucuacccuguuccaagguuauauuuguuaacuuauuuaaaauuugcauaugugcacauguguauaaauccacauauguagaggccaaaagaacucagguauugugcuauaccagucucugccuuacucaauguauagcuagacuggguaccuagugaccuuggcucugccacccaccagacauaguguuagggaccugucaaauaacugugcccaacucuuuauguggauucugggaauuugaaacuaaguccucagacuaacgcaucaagaguucuuaccugaugagccaucuguaaggauccugaguuuuaccaagacuaucuggacaugugauuuaaaguguacuacagucuauagacuagccuuccugaucaugagaauaccagacaaauuaacauauuuuagguggaccaagucccauuugcacagcaccauaugauuccuaaagaguucagaaaugccucuucugagaaugacaaggcagguuauuaucacuauguagaugagaaaucugagacacagauagcucaagauaaaaaaaaauaaaauauaguuuagguuuuucaaaaacauuuauuuacucaacaaaugggcugucaacacaguguuaggaacugauacugaugggacagacuugcucuccaguucacacuuuaagggaacuaagaaaauaaacacaggacacagauaaaugcuagagagcgugguaauaaguuagugguuguugaauggcaugagucaccgcaguggucuucauagagcugaacauaugagacauggaugaggcggucaaggcaugcaugccaagggcuacaagagcaucuagguagaggagagagcaggacuacagacuaaagcagggaagccuuggguagcaaaguggaccaaucgcuggaggaaggggaagaggccugauuacaugaauccuuuucuagggcaaaggauuuaaaguguaaguggaaauguauaggugaggccuguuuccaagaaaccaugaagagguggauuguaauucagucagaaagaaggucuauuugagcuauagaacgguagguaaggguaugguccuugcauaauaucucuaauggcuauuccggguugucaacuugacuauacuguaaugaacuacaauccagaauuggagggcucaccuguaaucuagaucuuaaggcuagaagacacaaguuucugacuuggaucuuggcauggcggcuaaggcaagaagaucuguaaguucaaggucagccggggacaaaacaaguccccagauccgggugugguggugcagcuugugcuggagaccuauguaagaauauuggaagagagaagauuugcucuucuucaucugcuugcacuugcacuuacuugccagcacacuggaaucuacuucuacagaagaccagcucaaacaacuagccugagcaacuacuagauucuuggucuuccauuuacagcauuuacagcugcccacuguuggagaguugggcuacagacugucagucaucacaauaaaucuccucaggauagagagacauaccguaaauuuugcgacucuagagaacccuaauacaauaccccuguacguagaguauguuaguuuugaguucuguacaaacguucuuaaauuuuuuuuuuuuuuuccagacaggguuucuguguagcccuggcuguccuugaacucagggauccacuugccucuggcuccugagcauaaggauuaaagggcacaaagcaccaucaccuggccaacuuuuuucaaauuuugaaagauuauuuuacauguucagguguuuuguuuguauguguauguauguaccuugugggugguaggaacuaaacccugguccucuggaaaaguaccagugcucuuaacuggugagccaucuugacaacucuacaaauuccuuaucuuuauuuuuuuuguuguuguuagugaaacauaaacaagaaggagcaaaacuaaagugcucccuuuugaucugggacuacagugauaguaauugggccagggcuggagcagcagggucaaaaagugcuggacuucauacacuggcaagaguuaauacggucaagaaaaggcaggggcagggaucaaggaagagucagaggugugaacucagugccugaagauauuuucaguuaucacaauugguggugcuuaggagagggcaaguaguggccaaagaugcugcggagauauuguaccaugcaaagcauacagccaagaauuacccaguccaaagucucucagcagcauugaggauaagaaaccguagucuaagcugaucccaaaguauuccauacuacaauacucaccuucccgguaugcaguguuguaaaaaaugagaaaugaagguccuuucaauauuuagaaaaaaucuaaacgauaauugguuauagggggaauaaauaaaacucugaauuauuucaaccagacaucuaacuaguauacaaaucuaauuagugaauaaaaacaucaauuacugaugaguaaaugcuauuugcugggcaaacuuccuuaaaacgcgacugaaauacucucauuagcuaguuuuccuacauauugcuaugauuaaaucuguagcccaauaccuuuacuguuuuucuaaauccacggacauuccuagacauccaugaacagguuaaacaggucaaacugagcuaucaaauggcuaagacagagcugguuuuaagaaaaucaugcuguuuguaucugccagcaccugacuuaguaacugauaguggguacuggacacauaguuuccggcuaucggaaagccaagggaacauauuucucucauucuaagauugguguuaagaaaaaugcuucuuagacugagaggggggaaacgucauacauuagacaguccauuuugccuuuuucuuagcuaaacugagagcagggaucauuguggcauacuaaguauaaacagaauaaaggcccaagaacccucauucaccguaguaauugccagcauuaggcuagcauggcuaagacacgcucaggaauggucuggagaaacgugguuauuggcauauaugacaaauauuagaaacugccugcaaagccaacuaguccagaaaugaaaauucagaccaugacauugaucugacuacccgcaggggcgcggggggggggguggggaaaacgcaguaaagccgguuugugucaggagcaugacacguucgugacauaaggggcacaugguaagacuggccaaagacacgcaacgcuaggugucuacauacuggaugugcaacacucacguuuuuaaaggacaaagggcggucauacuuucaccauccgcucgcccacacuauuuuacauaagagacucaguaggcaaucggcucgagaacuaagggcccgguggucugaguuccuccccgcuugugaccggcccggguggagacaugggcagaggcagcucggcgccccggagcauggugggcucccgccgccgggccgcagacgguuccgcagcgucgccgcggacgccccgcacgccccgugcgcgcggcccucgggcugugcggccgcgcgacacuguugcgugacguccccgcccgacgacgucaggccccuuacuacggaaacacggaaggacacuagcuagcucccugauccgcgacggccuuuccaaguccccuacaagcgcgggcggcacacuucccgggcgccacugccucagccgccgaggcgagggaacaauggcccgcacucgcgcugcga

SEQ ID NO: 12319 - RNA, 26346 nt, Mus musculus
ucgcagcgcgagugcgggccauuguucccucgccucggcggcugaggcaguggcgcccgggaagugugccgcccgcgcuuguaggggacuuggaaaggccgucgcggaucagggagcuagcuaguguccuuccguguuuccguaguaaggggccugacgucgucgggcggggacgucacgcaacagugucgcgcggccgcacagcccgagggccgcgcgcacggggcgugcggggcguccgcggcgacgcugcggaaccgucugcggcccggcggcgggagcccaccaugcuccggggcgccgagcugccucugcccaugucuccacccgggccggucacaagcggggaggaacucagaccaccgggcccuuaguucucgagccgauugccuacugagucucuuauguaaaauagugugggcgagcggauggugaaaguaugaccgcccuuuguccuuuaaaaacgugaguguugcacauccaguauguagacaccuagcguugcgugucuuuggccagucuuaccaugugccccuuaugucacgaacgugucaugcuccugacacaaaccggcuuuacugcguuuuccccacccccccccccgcgccccugcggguagucagaucaaugucauggucugaauuuucauuucuggacuaguuggcuuugcaggcaguuucuaauauuugucauauaugccaauaaccacguuucuccagaccauuccugagcgugucuuagccaugcuagccuaaugcuggcaauuacuacggugaaugaggguucuugggccuuuauucuguuuauacuuaguaugccacaaugaucccugcucucaguuuagcuaagaaaaaggcaaaauggacugucuaauguaugacguuuccccccucucagucuaagaagcauuuuucuuaacaccaaucuuagaaugagagaaauauguucccuuggcuuuccgauagccggaaacuauguguccaguacccacuaucaguuacuaagucaggugcuggcagauacaaacagcaugauuuucuuaaaaccagcucugucuuagccauuugauagcucaguuugaccuguuuaaccuguucauggaugucuaggaauguccguggauuuagaaaaacaguaaagguauugggcuacagauuuaaucauagcaauauguaggaaaacuagcuaaugagaguauuucagucgcguuuuaaggaaguuugcccagcaaauagcauuuacucaucaguaauugauguuuuuauucacuaauuagauuuguauacuaguuagaugucugguugaaauaauucagaguuuuauuuauucccccuauaaccaauuaucguuuagauuuuuucuaaauauugaaaggaccuucauuucucauuuuuuacaacacugcauaccgggaaggugaguauuguaguauggaauacuuugggaucagcuuagacuacgguuucuuauccucaaugcugcugagagacuuuggacuggguaauucuuggcuguaugcuuugcaugguacaauaucuccgcagcaucuuuggccacuacuugcccucuccuaagcaccaccaauugugauaacugaaaauaucuucaggcacugaguucacaccucugacucuuccuugaucccugccccugccuuuucuugaccguauuaacucuugccaguguaugaaguccagcacuuuuugacccugcugcuccagcccuggcccaauuacuaucacuguagucccagaucaaaagggagcacuuuaguuuugcuccuucuuguuuauguuucacuaacaacaacaaaaaaaauaaagauaaggaauuuguagaguugucaagauggcucaccaguuaagagcacugguacuuuuccagaggaccaggguuuaguuccuaccacccacaagguacauacauacacauacaaacaaaacaccugaacauguaaaauaaucuuucaaaauuugaaaaaaguuggccaggugauggugcuuugugcccuuuaauccuuaugcucaggagccagaggcaaguggaucccugaguucaaggacagccagggcuacacagaaacccugucuggaaaaaaaaaaaaaaauuuaagaacguuuguacagaacucaaaacuaacauacucuacguacagggguauuguauuaggguucucuagagucgcaaaauuuacgguaugucucucuauccugaggagauuuauugugaugacugacagucuguagcccaacucuccaacagugggcagcuguaaaugcuguaaauggaagaccaagaaucuaguaguugcucaggcuaguuguuugagcuggucuucuguagaaguagauuccagugugcuggcaaguaagugcaagugcaagcagaugaagaagagcaaaucuucucucuuccaauauucuuacauaggucuccagcacaagcugcaccaccacacccggaucuggggacuuguuuuguccccggcugaccuugaacuuacagaucuucuugccuuagccgccaugccaagauccaagucagaaacuugugucuucuagccuuaagaucuagauuacaggugagcccuccaauucuggauuguaguucauuacaguauagucaaguugacaacccggaauagccauuagagauauuaugcaaggaccauacccuuaccuaccguucuauagcucaaauagaccuucuuucugacugaauuacaauccaccucuucaugguuucuuggaaacaggccucaccuauacauuuccacuuacacuuuaaauccuuugcccuagaaaaggauucauguaaucaggccucuuccccuuccuccagcgauugguccacuuugcuacccaaggcuucccugcuuuagucuguaguccugcucucuccucuaccuagaugcucuuguagcccuuggcaugcaugccuugaccgccucauccaugucucauauguucagcucuaugaagaccacugcggugacucaugccauucaacaaccacuaacuuauuaccacgcucucuagcauuuaucuguguccuguguuuauuuucuuaguucccuuaaagugugaacuggagagcaagucugucccaucaguaucaguuccuaacacuguguugacagcccauuuguugaguaaauaaauguuuuugaaaaaccuaaacuauauuuuauuuuuuuuuaucuugagcuaucugugucucagauuucucaucuacauagugauaauaaccugccuugucauucucagaagaggcauuucugaacucuuuaggaaucauauggugcugugcaaaugggacuugguccaccuaaaauauguuaauuugucugguauucucaugaucaggaaggcuagucuauagacuguaguacacuuuaaaucacauguccagauagucuugguaaaacucaggauccuuacagauggcucaucagguaagaacucuugaugcguuagucugaggacuuaguuucaaauucccagaauccacauaaagaguugggcacaguuauuugacaggucccuaacacuaugucugguggguggcagagccaaggucacuagguacccagucuagcuauacauugaguaaggcagagacugguauagcacaauaccugaguucuuuuggccucuacauauguggauuuauacacaugugcacauaugcaaauuuuaaauaaguuaacaaauauaaccuuggaacaggguagagaacagcauuuuaaccagugucugaaacuggagguagccaaacauacacacagagaagguaauuugggguuucuuguuccuuguuugagauaaggucucacuauuguagccuuggcuuuccuagacuucaauauauagaccaggcuagccugaacucaaaggaauccacccuaugaaagcugucuccuugcccuaucagcucugacaccaaaccuuuugugaggugaagcuacuugauuccugguucacuaucugcuuaaaugaacaaaaaccuuaaaaugucaaagagcuuuauucccagccauguuauaaaucaaaaccagggccuccuauacaagcaaguagucuuaucauuugagcuauauccugauaagguaacaaaguuuauagucuaccagaacuauuaucagcuuuguaauucaagguaggaccauauuuccuuuuuccuuauugcaaaaauauuuuaauacagucauaguacgauuauaaagucauuucuaauauguuaaauauguucaaaauauuaauaaaaccuaucucccauuuucacacguguauuuugaucacauuugccugguguguuacauagucaacaucuaguuucuaaagaugaguucuaguugucuugcuaaggaggcagaauguaaauaaaucuuuuuuuuaucugaacuuuauuagauauuaucuuuuaaaaugacauaauuugaguccuaaaaugaacaguuaaauaauuugagaggauuuugaaaugaucauaaaacuaauuuuaaaaaaggcuuagguuuccagaggaucaugccuuaauauuaagugccugugguuuaauauauucaauguguagaacucagcucgucuugguuuuguaaucagggucucuacuuuuccuuuauaacauuucuuccuggagaaaaaucacuuggaaacugaagaucuuuaccagauaaauccuuaaguaaagcuugguggauaugagauuuaagacucacuugagauaacagcuuuguuuuuaguagaauuuuauuuuuucaugauauuuauaacuaugaucauucuggaauuugcccucugauucucuuuaugcuuuugcauuguuuuuuauuaguugguuuuauuucauuuugaaaauauauuuaaagagauacauacuugagagaaaacuggaauuaaacuuuuuacacaaagacuuugaagcuacuguuuuucuacgauuaucauagucauuucuaguuguagcaacuaaggauauacaaacuuccucagaaucaaauguagucuuugucuucauuuuauuucuucuuuucaagacagaaucuuguguggcccagguugaccuugaacuugauauugauuugaggauugaccuauaguagguaugcaguaauucuugaguuuuucaaucccauaaaagagcugggcaggccuauuaaacaauaaagaugccacccucgcaaaaauacucuuagucauagaugucagugaaaucaugagucacucugugcauccugcauuuucuuucauccaguuauuuccaguagucuaaguaguccaggucuguaguucauuagaaaaugaauuuaaagauugggauaggaaaagccuaaugagcagauaggucauucaucuagcaaacuuuuaacuccuagcauaaguuacaguacauagaauaacuucaugaaugcucauuguagucaucuugauucuuagacucuguuuuuaaccaugaguaaagagcuuaguccugaccaagucacaaguagagacuuccuguuagaucagauaguacugagugcaccuggcagugcuggcuccaacucuacgugcuaaagcgcuaguucuuuguuuaugguccuauucucuauacaguaucaacucuuagggcgcuguuucuguuguuaucaguaggccuuuauuaauaaaaccauagcaugcauguaaugaacuugacuuuacccucaaaugucuuauucuuaaauucucuuugauuaguaacacuugugcauaccuucguucagcccagaaaccaacaucugauaccaguccuaaugugcacaucuagcuguuuggaaaauugugcagaaucuauuuaaaacuuccccucugucucaauagcauccacaucuuacuuuaaguccuguagcuaaccauuucuguucauucauucagcagaaguuuaucuguguuaugcaaaggucuuguucagguagggaaggcaggagggggaaaggaagggagagaaagggagcgagacccccucuaggagauugcaaucuaguggaaaaugcauucauuuauguauggugagaguugauaucuagugauaaguguggaguaggaggagcccaaccucagccaggguccacagcagcacagcucucagaggcuggggcucaaaggggagcuuaagcuauguggagaguuucuggagugaaagauacaguucaguucguuauacauaacagauacaucaaaggcauaccauuggugcagguguugcucucgagccucuuuccuuuccuccccucucuucuccucuccuuuucuuuucucuucuuuuuugugaccauaguuauuuaguggcacaucauuauacaguuaauccccauuucuugccaauucuguauuuaugaaugugccuacuucacaaauuuauuuucauccccagaucaauuuucuagaugauuuggggucauuugaagaugcacacaugcagagccgcacuggcuucaaguuggacuaguaggacuuuucauucuuuuaaaaauguauucacuuauuaauuucugagucugcacauaugccagagguuaaaacgggguucuuccucuucuuucucucguuuccuuuucauucuuucuuuucuuuuuucuuuuugcauuuugagauaaggccucuuccugaagcuggagcuugaagccucucagccugccaugagcagcaugcagaaucugccauugcacaugugcacagccuggccgcuucugugugagugggggguuuggguguagguccauuucugcgccuucggguuuuuuguauucuugucuuagugaauuucucuaaauccuuuuagguuuaucuaguauggcguucuuguuguuuuugcacuuucauugauuuuuuuuuaaaucaauuucaccauuaaauggaucccaagcacaaugcugaagugcuuauauuucuaaguauaagaagcuaugauauaccuaauagagaaaacacguguuagguaagcucauucaggcaugaguuauaccacuuuuggcuaugaguuaaugucaguaagucaacaauauaaaauaagaaucuuuuaaguaggaauacauauaaaaaagaaguuauguguuggggugguugaugaaaauaugaccagaggcuagcaggaaccuuuauuucccuuaggaauaaugauucagaauuugcuaacucagcaucugccacaguuauagaaaguaaauuugauuugggggaaauggccagucauuuauggucaggauugaugaguuagauauaagugaucaaacugaccaaagaaguaugauuaugaaacagucuuucugaacuauuauauuacauacacuaccucuugagaaaagguuagcuuacaccccaaguauuccuguauauauuauauaccccccuugguaggcauggccagguugagagucagucuacaaauuuuauuuuuaccauuagucaagaaaaaagauguugacuuuuacuuuaugaggguuuaaaauauaaagcauaaaaggaauuuugcaaaaagcaggguuuuuguuuagugcuuuuaaaaaguccuuuuaugaggaguaucuuguauauuaugggggucagcaagcauuuuccauuaauguccagucaguacauauuuuaggcauuauuggccaucagcccuggauuuaacuuucuaccacuaucuggugagaggaaugauagcaaguuccuuaugaauuuacaguggaaaccuugugggccaguggcugugugccuucuauucaguuuauccuucacaaugcagacaaugaucuaaucuagugggguaucauaaguguuguauugauaaacugacuguaguccaguuaacaaaaagacugcauguuuaauuuuuauuaagugcgugugcgugucgugcaugauguuggaggucaggacagucuggggagaguacuuuuucccaucgugugagugcuggggauugaacucgggucaucaggcuugguugcacucacauuuacuugagucaucuuguugacccaagaaagacuauauuuuaaaaucauuuaugccauuacuaucucaauuauuuuugguaucuuaauuuuuuaaaucugugcccucuguaggugaaaacaggaguuugagcucauuauaguuggaauuaagcacucagucauccaguuuguagcaguuggugaauacuacaggauagguuugcucacuuuuauaaauauuauaguacuucugguagcugucgauacgucugaauugugguuaagucuccuuaguagcaucaguuugauuaugugggcauggauauaaugugauuuuuaguaaaauuugguacugauauaaugaaaucauuuuauagcugcaaauaguuagcaagcuaaacauccugcuggauaguuaguuggucacaguguugggcaagagccacaugcucccauggggcagccccaugaccucuaccugccucuccuuauuugauaaaugcuucuuuccuuguacugcauaccacuucucuuagaaguacaccaccaccaccaccaccacacacacacacacacacacacacacacacgaacacccgccacugucuggccuuucaaaauaggguuucccucuguaucccaggcuguccuugaucucacaaagauucacaugccucugccuccagaaugcuaggauuuaagguauucuccaaccaguuaauuuuuuuuucugccuguuuaugaggaaaaaccucuagaagugaagaaaguuaaaaccgugccuacuuguuucuuaguguuaauuuacuuugaacaucacguguguguuucuugucugagcauguguaguuacauuguuuguuuguuuguuuguuuguuugauuuuaccuuguuuagcuuauaauuuugucucuccccacccccaacucuaccuugccccagacagacugaacucaggaccuuguucuugcaaacaagugcacaugcacugagcuaauccccaaccuuugagcguguguaaacacaagcauuacugcuaccuuugagccugucaucuuuuuuuuuuaaacaaaugauaugaaaugcuuuuuaugacugaaaauggauucucuauauucuccuaagagaccuucccaaguauguaugugagaugauguguaugagagagauagauuuaaguucauaggcuaugagucugaaaauugguuaucaggacucaauagcccuacacugucugccgcagccgucucaugagcaugguggaagaggugcugugugaauguggauccacacugauuuccaaggguuagccuccuaaaguguggaaagugucuuguugguaauucauaugcugauuuuuucccaguuaguguuauaagcacauaucagugaaucaagacacauuuaaaguagucuagaaaucccaguuucuuuuggccacauaaguuggucuugaaaauaaguguguguguguguguguguguguguguguauguauguguguauguuuauauauguguguguguaugcuagagguaaauguugaaugacuuccucuaucacucucagccuuaguuuuuaaggcagugucucugaaccuggagcuaggagcuagguguuugagccagucuagcuagccagccaucagucacccagauuucgccaucucugaagcccuuccuucaaauuucuaacccuaggaaaggcuucggauuuucagagaggcuaaauauaaauaacaucuauuaugguuuuauauaauauaaauaacaucuaucuuuuuuuuuuuuuuuuuuuuuuuuugguuuuucgagacaggguuucucuguauggcccuggcuguccuggaacucacuuuguaggccaggcuggccucgaacucagaaaucccacugucucugccucugccucccaagugcugggauuaaaggcaugcaccaccaugccacuuggcuuuuauguggaugcugggaaucuucacaacauccacuaagauuccucccuagccccaggaacacuauaaaguagaucacaagaugcuagaaaguauacuagcucucuuuuuguuuuggaguuacuaguaaauuuuuggugacuuccuauaaaagagaauaauaaagaaggccuaauuguuacuuggaaacauuuaaauauuauaguaugaauaaauuaguucuauacgcccccaaaauaaaaaugaauuuauucccauucaagaaaguuuugaaguacaaaauauuucugauuaguauuuugcaguaacucuaguaaauuuuguuuugugucuacauagugcuggcuguccuagaacuuacuauauauagauagaugauacuggccucagacuccgagcucugugauuaaaggugugugccaccauaccuagcuucucuaguaguuuuaaaaucagcuacuuaaagcaauuuuauuuuuaccuuauuuuaaaaaggcuuguucuuuaaauuuuuaaaauuuuaccuuauaucucuuuuaaagauaauuaaaugaaucaguuuaaguguauauauucugaaauacuuuaggguaaauguuauaaaacugagcaauagcauuaucaaaaauugauaggaauuacauaccuguggugauaaaguucuuagacaagcuagacaguaguaguccccggaggaucacgucugguaaccuucuauguccuguugaucuuuuuggaguuguuuuagaaaugcuuuuuagauaguuaaaaauauuaacauuaauaaaacuuuucaaaaaucacuuuacuuugcuaagaaaacuaaaaaauaaauaucacagguuuuuaaauuguucuuuaauacuugaaugaccaauuaaacagcuuucucccuuuuucagcauuaagaaguuagagcuucuucuaugcuacacaagcuacuugaaauauuaauucacuuuacaucccuauggcagccccccuccuucuucuccucccagucccacccucacaaaccccuccucccaucaccccuccccuucccuguggguacuacccuacccugggacaucaagucacaacaggacuaagcacauccucucuuacugaggccugaucagcguccagcuaggggaaggagaucuagugguaggcagcagaggcugagacgacccccacucuuauuguuaggggacccauaugaagaucagacugcucaucuacuucaaauguguaggggaccuaaguccagcccccgcaugcuuguugguuggugguucagucucugagucuccaugggcccaaguuaguugacucuguaggucuucuguugggucucuuggcuccugccuguaauucuagcauucagaaggcuaaagcagcaggauuauaaguucagagcccacuugcauuagagagucuucacucuacacuguugcacaauaaaaauaaaacaagaaacuugcaaagagcaccauagcuuacuguugggccauaauuacggaaaagcuuuaugaauauuugucuugcuuaaauaccaacacgugcacauauauaugcauacauaucagagagcauacgaaaauauuuuccaaacagccauuauauaauugcuauuauuaggaaggcuuagaagaguuucuugguguaagaaaagucagaaauucagacaugaaagucugaaggaaucuuggcucaaggcaugaaaacauggggguaucugaguccuuugagaucagucugacaguuacuuauuuguuuugauaaaugcuuuuuugcaaacugaaaucuagaguaaauggagauuuuuaucaguagucuuucacugauagcaaaauaguuuguauagcuuaaaauagugcaaaauuuguauguauaugucauacauuucaguguuuucuuucuuuuuuuuuuuuuuugugaggggccauuaagauaggaucuauccacauagccaugaauguccuggaauucacuguguagaucagaguggucuccaagucauagagagucuccugccucugauggaauuaaagguuuacacugccacaccuggauuaauaauaaucuuuuaaguuuaacucuagagcagguuuuaccugguuaaguggcagagcugacauuagaaaccaggagcauaaauaaauagacacauacuuaugucuuuaugagacauuuguagcuuuuuuuguuuugcuuugucuuuuguuuuuuguuuguuuguugagacgggguuucucuacauagcaaccuagacuuucuuggaacucacuuuguuggucaggcuggccucuuaacucacagagaugaauugcuucugccucucaaaugcugggaugaacagaauccagguuuguaaauagcauauauuaacaggaauauucggaaagagccaaacauagcuuuuuuugcauuuauguguguggguguaauuuuauaaauaacaguguuacacaugacaugauuguuuucugaaaguaaguuguuggauuucauauaauaaaaucauaaaaaguaucugacaccuuuaaucuucacagugucagugauauuuaaauauaguguguuagcuuauuuaauccacauggcagcccuacaaagucgauauuaaccccacugacagauagagaaacugagacauagaguuucgaucucaggccacacaacuggugagugacauuaccagaauucuaauccagcaaggcuguguccuaggguuuuacugcugugaacagacacaaugaccaaggcaacucuuuuaaggacaacauuuaauuggggcuggcuuacagguucagagguucaguccauuaucaucaaggcaggaacauggugccaguccuuuaucauccaggcagacguggugcaggagaugcugagaguucuacaucuucaucugaaggcugcuagcagaauacugacuuccaggcagcuaggaugauagucuuaaaguccacgccuacagugacacaccuacuccaacaagaccacaccuagugucucuucuuggguugagcauaaacaaaccaccacagcuugacuccagagacugcuuuuaacaaguacuuuaaauaauuguuuagauguuccuuagucccacuguggguuuucuuccuucuuccuccuuucuguccccuggggauuaaacccagggucugauacaaggcagacaugcauuuuuaccacuuuucuccagcccuuaaaauucauauucucucucugucucucccccucucuauauucugucuuucuuucucucucucucucucucucucccucccuccuucccucucucuccccccucucuguucuguccuuuuuuucucucucucccucccucccucccuacuucccucccucucucucucuuucucucucucucuguucuguccuuucuuuuccucccucccucccucccucccucccucccucccucccuccuucccucccucucucucuuucucucucccucugucucuuucuuucucucucccucccucccucccucucccucucucucucuuucucucucccucugucugucuguuucuuucuuucuuugccauguagcccaugaugaugacuugcggcucacucuauaguccaggcuguacuaaagcucaacagcagucuuucugccucagccugccaagauuugcaguuagugcacugccauaucugcugccuugacagauguagugaccauugggcacacuuagcuuugagguuagauaugcaacugucagaagcacuaagaacauagaauaaaagaggcuaaaaauuccuaaucuuuggguaggaaguguagggaacuagaggucaugauuuucuaauauaaguucauuauaugagaaacucuaaguacauugguaaaauauugaucuguucucaaguauuugagauuaucugaaguugaauucccagcaaucccaugguggcucauaaccaucuguaaugggauccaaugcccucuucuggugugucugaagacagcuacauugugcucauauacugucuuagucaggguuucuauuccuguacaaacaucaugaccaagaagcaaguuggggaggaagggguuuauucggcuuacacuuccauacugcuguucaucaccaaggaagucaggacuggaacucaagcaggucagaaagcaggagcugaugcagaggccauggagggauguucuuuacuggcuugcuuccccuggcuugcucagccugcucucuuauaaaacccaagacuaccagcccagagauggucccauccacaaggggccuuucccccuugaucacuaauugagaaaaugccuuacaguuggaucucauagaggcauuuccucaacugaagcuccuuucucugugauaacuccagcugugucaaguugacacaaaacuagccaguacauauacauaaaagaaaaacuccaggauugaacaugaccuguuuaaaaauuaaauauugguagaaaaauuuuuaacaagcacaucaguaaaauauuaguauguucucaaauauuuuugagauuaucuuaauaauuaauggagacggcaucucucucuguagccuaggcuggccuaaaacuagccauucuccugcguuagccuuuuuagugaccuaauuuuaaaauugauuuuuuuuucuaaguaguucuagaagucagcgcaugucuuugugcuccucacaguauaucaagggcaggguuuuauuacauagcucaagcuggcccugagcucacugugugccuuacacuggccuucaucuaccucaguccuugagugcugggauuccagugugaaccaucacaacagcuaagaguuuuuuguuaaguagaaaugaaaaucaaguuagagaaagauggugucaguuggacgauguguucuacuuguagguaugggguguaagugcugucuucuguacagaccacucuuguacgguuauuaaagcauagcaucccgaguaagaacauugaguaaagugcuaggagcaaaaucagugacuuucagaguuuuaauuaccucuggcccauccaccugucauuaaaauagaguagcauuugacuucaacauacuauuaugcacaaaaacuuuguugcuguuaacauugauaaaauaaucacauuuaagcuuuuugauauacauaaaaauaaauuuaugcuuuucugaguccugaauuauugcaugauacagcaggcuagauacuuguaauaaaacaaggagaauucgagcuucauguuaauagaagaauucaauuuuuaaaugcaguuaauuuacuaauuguaguuucucuucucuucauagucucucucaagucuacccccuacaccuguauuagcagguagauauuuauaggugagugugauggcauaugcacuuucagagucgcacucucaugaugacugcugauguuaacuuccccauggucuuugggacauggaaugugaaaaagaaauguuugauccugauccuuucucugugauaacuccagcuugugucaaguugacacacaaagccagcugguacagauugaaaacccacaaaagagauaaaagaugaguuauuuacauucaaaauauuucucaucuauucaagauacauuuuuaaagaaggaaagcaucagauaacauauaaauguaaaaugauuaaaacuguugauuuaaaaaauuacaacaaaucgcaacaaauguuuuuuaaagguaugaaauauacuaauauuacaagggaauacuaaaaagauagggagaaaacccccccccacuuguuucaaaaaaaucuuugucaacaaguaaauacuuaaaauuaggggaaauguguuuugaaggaacuuguuaccuaacugccucuccuaacuaauccauccaggccguaaacuggucccgggugacaguuacacugaccugagcgugcuggaaucugauccucucuccccuacauucccugcaguauaaagacccccucagaaugggcuuuuccguuucauugugauaaggaaugguuuauuaaguauuauccccccuccaaaaaaaagaaccccuaguuaaaaccauucuuaagucaccuauuuauguuaaaauacugcuuuucaauguuauaacaguccuuuuaccaugugacauuuuauauaguggcucccucacuuuucagaucgauagaccccagaaauuuugaaaaugacccaaauuauuugaagauuuuaaauguaaacaccucauauuuuaguucugcacauuuuauagcuagguaacuugaaauugaaguuagaauaccuacuguaaguugagggcuuuucugacuguauaaucaguuuaacaugggaugccuaauggcuauaauuauuucuguugccuuuuuaccucuaauggaguaaauguauauguaguugcggcauucugugcugguuugcuaaauccacaggaaauaaaaggguacagcuaggacgaaggaaagggaauaguuaaucguggaggaggagaggcacagcucaguacuuugccuagaggccgcugggaaagugacguccuguagcguucguucguucgcuguucuagaaaguacagagacacguaguugaagugggagggucuagcugaggccgucuccgugcggugucuauuuaucuguaagugagcugccggggaggaauuaaauagagacgcugccugcugccucuggacagcugagccgaguugcugauuugcuuuaacuuguaagauacccagcuugcuuuauuuucucaggaucauuguguugcuaagccuggggacgcuguuuucuuuuacaaagggaaaucuaaguucauuucaaggcauucgaaauggggaaagacuauuaucacauuuugggaauugacaaaggagcuacagaugaagauguuaaaaaggcuuaccgaaagcaagcccucaaauuucacccggacaagaacaaaucuccucaagcagaggaaaaauuuaaagaggucgcagaagcguaugaaguacugagugauccuaaaaagagagaaauauaugaucaguuuggcgaagaagguaagcugcauauuucuguaccuuuggcagugucugaaucguagcuuuuuuuuuucucucucucucagccuucugguuaucguuacaugagaacaucagacauacuaaaauaaaaagaaaaauaacagguuaaaacuaagguuuaauccuugauuauuugaaugagcuaugaaugaaaugucauguuugucuuuguggguuuuuuucuuagaauauuguauuauucauauucuccuguuagacuuauuguuuuagcauuuuauauuuuaaaagaaaccuuaaauucucaugccugugaaugaauuguuuaaaagucuuaugcaaccuguuuuguuuuuaaugauuuuauugccagaauuaauagaaucuucagucacuuaaaauuuuaagaucggcaauucaaauucugggccauuuauguuuuauuuagaaaaacaagaaguuuuuuguccuuuuagagcgacgcuaguugaaacugaacaagacggaguggugugucguagaagcagaaggcacaggcauuuagcuucuaguuguuuuuggcaaucugccuagagaggaaagaauuucccugaugucauaaaauaccagaacaaguuuuuagcuuaauuauaaacaguuaauauugugccaggagaacaagaucucucucucucucucucucucuuucucccucccucucuuccuccccccccccccccgcccucccgcccucccucuccuucucuaacccaaaauggccaccuaguuggaacaaugacugaguuuguuuuaguuaacuauuucuuuuggaaauuuuacuauguggcugaagaggaagcaugacagcugcccuuucccucagccauacuuuuuuucuugccuucugagaucaggacucagugagcucaguagccuuugagaaucuccuuuuaccauuccgaauuuuguccagcaucuccauaaauguccauaaaugucguaaauguggccauaaaguaggaguuugaaauugucagucagcagcagcggcaaccaugcauuaguucacgugaguucugggguuuucaaguguuaaaacagacuaaaguucuuuugcauuauucuuccccuaaugucuuuuaagucacgguggcuauggaaacauacuguuuuccccuuguuuauagcauuuaaacaccagauuucccuaauuagaaguccuucaaacagggccaugcauuaagcaaacuaaaccgacaacucagagcaguggugggcccuuuuccuccugcuuuaauuuugggucagucccaagcaugcugcugccugugguuguaauucgugcaaauccacagugucaaguucuuacaaagugagugaguaauuacaagaagcaagauguggauaguugaggcugucuguuccccauggucacacaguugagaaugccguggugugaccucucaggagcgagcaggcucuugagacagugccaguacucuggccacucuugaguagguggaguggugugugaguucccacaaagccacuuguguaaacgcagguuauuuggcuccaucuuauggagugcucaagugcaccucuguguuaagccguaggauucaggcucauuaaucguguuugacuucagaguuuucaaguauaccagcugguacucuuaauucuuuacguuuucucuuggcagugcuuuuuagaguaacucacuccccaaauuaucuuucuuuucuuuuucuuuuucuuuuucuuuuucuuuuucuuuuucuuuuucuuuuucuuuuucuuuuucuuuuucuuuuucuuuuucuuccucuuauuuuuuuuuacugaucauuaccagugacuaaaucacaauuucuguauacccugagucuuuuuuuguucuugguguucuuagcccagaucagugcucuaagcaaggaacgaagcaugaagcaggacugguugcuuaaaguguugaaauuuauuauucagaaauacucuguaguuauuagcuaccugaaaauauaggagagugaagacuguugagcucuucuguuucuuacuauuugguaaccuagcacacagugacugcaaagcucugucggcuuaggaggaguuguagcucagggccacagcacuagcuaagcaugcagagccccgcucucaauccgcagcaccccacccucauggccuggagguucugugugaggaagcuuuucuccuuucucuccuucgcauuguccgugcuuguguuccugagucuguaggccucuccaauaguaacagaaaucuagacuguccacauuuacaauuaagagaaccguuaauacuguuuauucaaguugugaaauucuuuuaacaucugaaauuuaaaaugguuucguuuuaaaaaagugaauaaaauaacuaugguuuaaaguuauuauauuaucuaguaguuuuauuccugggaaucaaaaagaaaaauaaacaagacaaaacauuugcucauacaaagacauguuccugauuguucauaguaggaccauuaaggucccugcauccaaacaauccagaagucacaugguuuagcaaauggaucaacaaggaguauauacuccaguggguacuuuuuagcaauuaaaaagggacccguuuaaugaaguaugucucaacuggaugaaccuggaaaaacaugcuggaugaaagacucuagauagaagugauacuguauauuauguaauucaauuugugaaauaucugauagcugagcuagcuugccuaggacuggagguaggaauauaggaauaagcaggaaauacaaguagagaccucuugagaguggugggaauauuccacaaauggauuguaguaaauuuauuacagcugaacaguauacaaauuaauuuugucauguagucuacauacuaaauaagucaguuuacuucauaguauaaauauuugaaaauaaucaugaaacuacagaaaucuauaauuggguuuugaauuauucucugcccuaaacuuuuaggcuugguuaaguggauaugaacagagguuuguauuaaacaauuaaauuauuuuucucuauugagccagagagauggcucagugggcaaaggugcuuguggaccugaguucaaucccugggacccucaagguggaaagagggaccuuaauucugaagauuguccucugaccucuacaugcauaccaugacacacacgugccaucaacagaccaacugaccauaaugaaaugcaguuuuaaaauauaaaaguuacaacuuuuccucaaaggacaccuuuagaggguucugguuuucuagccuucauuucuuccuucuuuacuuuguugauuauuucuuacucacuaauuuacucuggauguggacaguuguugauguguuucaacuuaacuauucaguguaauagccuucuucuaguucaguauucucuuccaugcaguuaguccgcugcaccucuuuguuuucuggguccuaaagauacagaaguuacuugugaguuaaccuguuuaaaggucuauaacucuguucuauaacucuguucuauaacucugaagucuugcuacaaaucgaacacuguuaugccuaggccuccuaauaggucccaugacucuucucugcaguuccaauucucuaggguuccuucuuuucauaguuuuugucagauuaacuaaaagacaucguugcuaugggcaguaucccaaagaucuauuuguuuuuguguguuaaauugguuaguugauuaaaagacuaggcagaugccgaaucuagaguccauucccugacuagacagugucuagaaaauguagagagcagagagaauccagcuggauguugacagguucugcugggaguuguaguguacaggauuaagguuaacuaucuggcugacggcaugcuugauagaauucaaguguuaagcagugcaggagacagcaagcaguucaugucauacuacagcggcauuugguaggauuuucucauuauuacaguguagcucccuucuuuaucuggacuccacaguugacuguuugaugucuaggaaacucaaggccacauuuuugucagcucugaugaguaagucacuucaggcugcguguaaauuuucucacagacuauaauacugacugaauuaccauuuuugggagcaagggaagagguuuuagggaaaagccaaaccuaugauguaauacugaaaauguuauucuuucuuuucuguuauguguccaaagcauuuagauuuuugccuuuuagagagcuaaggauaggcaugcucacuuaccauguugauuaacugguaaacucuuauacuuuaugaaaccugugggaagagggauacaguuccuggaaugauuuaaguacucauucaguuaccaugugaugacugugaggucuauacuucaucuaucauguaagaaaaucucucacuagcuuuucacacuuggaguuacagucauauuaacaaggcuagagaaggaagucagaaugagcaguuuaguaaccuuguuuguccuucucagacuugucauuccauuucuacagugaauaccccaacuaaccaugccacgugugugcgugaguguacaugccugcgugcaugccuguaugcaugcacacuccucuaaugaggacucugauuaggucuuucuugguccuuuagauuucucuucauggguaaagguaagaauuuagauguuaguugagacuguuggaugucacagcgugcucucucucucucucucucucuauauauauauauauauauauauauacauacauacauacauauauauccuuuaauaauagaaaccaacuauacagcaggagaugcagauuaagccucccugacauugcagugauuagaucucaccuguguguguuauuuugcuuuuucuuugucuuuuuuaggcugauucucuaaacacuuauuuuaguuucaguucaggacaacuuuaauaauuagcugauuuucuucauucaauagacuggaguuccucauuuucaaugucauauacaugagcaauaggaauauagggauauaagaaucucaguuuaaaguagaguuuuucauaguucuguaaucuuaauuuuccuccguccuguuuuggagagggauccuaggcucugccaggagcuucacuagacugauagaaaccuuugccacggucggccuccuaaaacaucacuauguugcuguaugggcuuuaguugaaucuuucuuugguaugugguagaaaaaugcuauuuuaaauauauauaaucuuugucacccacauguuacuuugcugaaccucugggcaaaaggucauaguacuacugucuaaaguggguugucaggcagaaauaacuaguccauuuuacauguuaaaaaacccugauuuuuuuuuuuuugguccuguuuuuaaaugcugugagucaggaugugauaaaguggacauaaaaaggcuugcugucuaaggugaugauaaucuagugucuacaaaaaauuuuuggguuggagagagaugguucagugguuaagaguacuggcugcucuuccagagguccugaguucaauucccagcaaccacauacaaccauuuguaaugggauccaaugcccucuucuggugugucagcaacagcauacugaaauacauucaauaaauaaauaaauaaauaagccaaucuuuaaaaaacaaaaacaguuuucacacugucccuuuuauuauauuucucccuugcuccucuaaaaaguguucuauuucaguuauuaaacaguagagacauaggagcuggagagagggcuggguccuggcugcuuucucuaagugcuggaucucauugucaggagcuccccaccaucuguaacucuaacuccaggggguuuugaugcuccugaccuucacagguaccugcacaugugcacauacucauaugcacacacacacacacacacacacacacacacacacacacacaugccuacacauaaucaagaugauaaacaucaugaaaacaacagcaaaggccugcaguaaagcuacgagcacgaacuauguuaacuguugcuacuguacuuguuuuuauaaugguccuuaggauuuagacuugguuuucaaccggcaucuuuaaaacuauuaaauuuguaauacuuaaguauguuagaacaggaguuuuugagguaagggagucucaauuuccuuuuauuuuucauauuuauugugaaacaaaagauucaagaagaaauuauuaaagcaaagaauuuggaggaaugauuuaaaagcuaaaacguuaacauaggauggaucuucagaaacuauucuguuuaauucuaaugauguuucaggccguaagugauaagucagaguuuauuagcagggcaaucuguaaguggucagcugucuagacugccggcccuuuuccuaaucuugcuuaugucuucaccaggcuugaagggaggcgcuggagguacugauggacaaggagguaccuucagguacacuuuccacggagauccucaugccacauuugcagccuuuuucggagguuccaacccuuuugaaaucuucuuugggagacggauggguggaggucgagauucugaagaaauggaaauagauggagaucccuuuagugccuuuggauucagcaugaauggauauccaagagacaggaauucugugggacccucccgucucaaacaagacccucccauuauucaugaacuuaaaguaucgcuugaagaaauauauaguggcugcaccaaacggaugaagauuucucgaaaaagauuaaauccugacggaaggaguuacagaucugaggacaaaauucucaccauugagaucaaaaaaggguggaaagaaggcaccaaaaucacuuuuccgagggaaggcgaugaaacaccaaauaguaucccagcagacauuguuuuuguuauuaaagacaaagaacaucccaaguuuaaaagagacggaucaaauauaguuuauacugcuaaaauuaguuuacgggagguaagucaguaagucagcccugagacucuaagacggagagaugacugcugcugauugacuagggggcugucugggcagcgcuggcuuuuauccagugcucugcagacuuauuccucaugguaacucucuaggaaguggugcuauuauagcucucuucuggaugacaucauaguuucuaaauuuauuuacugauguuaacuauuuaaaugucgguuuucaaguacaaguuugguuagcuacuuuauggccaguguuagguuaacucuaguuuuagguuguggucugugagauccgcauugguaacccaccacuguaguccauuaauacauuuguucugaagugauuggaguacaauuuauagaacaagcauuagaacauaacaaguauauaauuauacauagugcacaauaccaccccuuaauauaguucuugaguccuuauuugcacuacuucuuggauggggccaugucccuguuuaaauggcucaguguaucccuaccaacuaauauuccaaacaguuuaaaagauagaaaucuggcuucuaucuccaaguacauuuucucuucccugaauuugcuguuauuacuuugcuuaguuucucugugucagagcuccacuguaugguuccccaugugguucaacaggaacuguacugugcccaguagaccccaaggucuucuggaaaauagguuuuguuccuguuuaguuccguccuguucuaaaguccuccuguuucuccaguuaguuuucugcacccugacuaugauagcuuugaacguccuaagucagcguggaagacauccuugaguuaacuuuuucuuucuuuguccuuucaugucucucucugguaacaucucugauuaugccucucuugagcagaguuuuuagaauaggaaaaagguuuauuaacuauuguaauccuuuuggaaguuaaaauuuuaccuucaugguguuacccuuuacuuccuagcacaaucuuauauucuuuaguuuggaaguuuauuaauaacuucauuuuauuugguccacuuuaggcauuguguggcugcucacuuaaugugccaacaauggacggaagaaaccuaccuaugucagucacugauauugugaaaccugggaugaggagaagaguuauuggauaugggcugccauuuccaaaaaacccugaccagcguggcgaccuacugauagaauuugauguguccuucccagacgucauaucugcagcauccaaagagauccugaggaagcaucucccugccuccuaggaugagaagaaccuugcuauccauaguuugauaagacacugaaaauauaaaaguaccggcaguugacugcugugaauucuguguaaagauguguaaacucuucugagggcucauuaaacugcaugaauagacacaguucaaauaggcaacguggguuuuuacaguagggaugaaaagucauucacuguauuucauuucucccaaaucagaaauuuuuaguauuucauuuacaaguaaaaguugguuuuguggucuauggauauacuucuaguaaauacuagauuauccaaguacugugugcaugugcguguguguguguguguguguguguacgcgcgcgugugugucugugugugcucgugucuguguguguaucuuuaaaugaucagugugauaggcuccuuuaauaaaaauuaaaauucuuaaguguauauguaauauguggagaauaaaagccaaagucauacagaaaugcagucuaggugacauucagagaugcuguguugggcugguaccagaaugcauugaugugugugcuuuaccguugugacuucucaauauucugcagcguuucuuaagagcaugguuguaauguucguaaagcagaccucaucauaagaagaaaaugaaugacauuuucucuccuguggaagucccaauagccagagcuccugauauuuuagaaacagaugguuuuuaaguggccacauguaauuuuaugcaguugacuauauaucuuaaacuuaauaagcucauuuugugguucauuaguuuaagguauuuguuuacuaacauguuuuuagagaaaauacuguuacuuggcauuaauuguccauuuacaguguucuguuaaguuccucaugcuaugcaccuuacauaauuucccuaaagaacagucaucuaucacugugguguuaaaccgcaaucuggauauaacaaacaccaucacugcuuguggguaaugugcugucaucauauaaauauucuaccuuuucauguauauagauugcauuucuuagguguuuuaauuuuuaaaauauauuuacauucuaaaaaauuacugucuucuguuuuauaucuaucaaaagugauguuaugaaaaauuuuuuguaaaacaguuuucagaaugauauauaucuauacauaaauauauaugguauacugaguccuauagucuuuuuaauagaauguga

SEQ ID NO: 12320 - RNA, 10237 nt, Mus musculus
cugaauuuuuuagaguguacaguuuuauugucuuuuguugaauacacauuugucuuauugccaguccagauaaccaaguauauaaagaaaauacuaaacuuugcuuuuggcagaagccaagauaaccugugcagauuaaaacgacuuacuucagucuaagaaaugguuuugaaucauacaaaucuuuuaugaaaaauaacuguccaaaagcauucuccuagcuuguaacacacuuccagaauaacucucaaaaaaaaaauucaaaaauacuaccauaaaaauaugucaauaccauauggcuuuaugaaauaacuucuaaauuuuuuugauuuuuauuuaaaaaguuucccaaguuuuaaauaaacagcuagcaacauuuucuucacuuaaaagugcauauaucugggaaugggacauacauaacuuuuugaacaaauaaugaauuuuacaaauuaacacacacaguuaagauauuuuaagaggcaaaguuuuuccaggaagucaucuagacugcaauagaugacucuuuaccuuuuccccacagccucggauuaucgaggaggggcucuggcagucuuaagacacaucacagucucuaccaggagacacugaugacagugagguccguggagauggcacuggucucgaugguucagccugaauagacacauuacucgacuggcucuccaaaucagaggcaaaggugcuuucuucucuuacaucaagaguuuguucaacugggacugccggcgagucacaauucuccacaguuuggcuggugcucaagucaucagcaagugcuguaacgucacaguccuuguccaggacaccaagcucaucuucgauugugacaacaucuuuaguuucaaaugcuccaucuuguauaggcuguggaagacugccauugcuacauucaauacccgccuuuacuucagacucuccaucgcugucacugucgaugguuauaaccaccggcgaccgugaaguauuaucuccaugguguuucuuaugcuucuucuuauguuucuucuuuuucuucuuaugguguuugcuuguguccguagccuuuccuucauaaacuaucucuacacuuaggcuccggguccuccuccuccuccucuuguguuuugucucucugucugaugaucugcuaucugaaaagcugucacucucauuuuuauaacugccauccaauuuugauuuuugguaaugacuguccuucccuuuggaagugaacucccgagccggcugagccucuucacugguaccuuccaaaugccggguuuuguacuugcguuucccuccgggcuucucauuucucacccggucgggcccggcggauguaguccucgaccuguuacuggacacgcuccuggaccggcgccuuucauaguaguaguauuuccuuucacugugauucuucuuccucgcauuuguucuuucagaaaaagacugaauucuaaauucuggacuugaagacugucuagaguaaugggcucuugaaagaguccuccuccuguaugaugauucauagccaucucuguccuuguuucugcuguaguaaguguauucccacuuauauuugcuuccauaauuauuucuuaaauaauagcgaucucgauuucugcuucgugaucuucuuuugccaugaucacugcuacgagaccucgaucuacuggugcuuccacuacuuagagaaagugucuggcuccuccgggaccagcugcuaucucuaguucuggaucucuuuuuguccuuucuugcucucggccugcuacuacucucccugcuucuggaccucuuguuccucagucuuuucuucccgugcuuccugugauuccucgggucauggccacuucuacucugggaccgggaaucugaacuccucgaccuuccucccuuccugugucgaugguuauauggggagcauacccugucaccucuuguagaugagcugucccugggagcuggcaaugauguagaucguuucucuucuuucuuugagcuuauucuugugucagaaucacaauggcuuuuacucauuuguucaucuuuuccaaggacagagcguggagaugacgcccggcuaacaucacugucaccugaacuguacgacugcucuugcuccugagucuucacugucuccacuuucucauaagggcccaacuccucagaaucagaagacaguucaacaaguuccgggguccuuucagccaauggcuuaacaaacccaacaaugacacaauuaucugacgaugaaucacugucauuauugacaucgucauuggucuguacuccuuguaucugagaugugguuccuccagagacaagcucuucaucugaacugucugaagaauuuaaaagggaagacacgccaacaugcacuugcucugaacuugaauaagaugguccaggaguuucaucaucccacggugccugccuaacaguagaugcauucauaucuagcucuugaguuucagccucaucuggugauauuguaaugacugaagaaucugaacggcugccuucuucagaugaaggagggcaaucauaauuagcaugcuggucaaaagcugccauauugaagggagaucuagcaaaacugauaaauucauguauaaaaugcucaguucgauuaagcaaaaauggucuuaagucagacacaaaugccugacucuccaaaucauagcgaguaacauuacucaugaugaugugcuggacgauauugacuagcgaaccaugggcuccaaaaagcacaguaaguucacgcuuuaaccaaggaacuaaucugugaaggcaagcuggauuucuacggaagaacucagcugaaauaucccuguagcggccaccaucuucaauacuucuaacucgaacaccagcacgauaaagaguucgccugaaauuaauaauaucuuguucuugaauuuuccgcaaagaucucucaucuguaguaguuggcccccuuaaugccauuugucucauaaauugaggaaugucaacaucucuaggucuugucgaaaugccuaacccuucaaacagcacuccacuaucugguggcgugguuguucuccuacuuacaguacuacugggugaauaaagagaggcgcuccguucucucgucauaguuguccgguagcgaaaccuucgaaccucaggguuaguaaaggaaccauuauaggaaggccucaggacauacuccuugaagucaucuucagcccucacugaauggaaaauagaaucaaagggcuguuuacacagugggcauucggcuuuguuuuuggaccacucuuguacacagcgaaaacagaacuuauguaggcaacgaucuaaguaagacacauuaucaaaucuauccaagcauauaggacacuuagaaucaggagacgcaucagcugguacugucugcugcaauuugcuagugccagcuuuaggugaaaaguuguccauuuuaaauuccuuagcagcugaggccauuaucuguaaaagagaaagaaguauaucaguaacucaguaauagaauaacuaagcaaaaaugcuucauaaagcuuuguucauacuucagcaaaaaugaauggcuuuaacauaaagacaguacauaauaaaagcauagcaauagaccaguuuccuaagauaacaauccucuauguucccaaguguuacuaucuguacuuuaauuucacccuuuaccuuuggggaaguaccagcacacaguaggcucuuagauaccauauaauagccuacauauucuuuaaauaguuuaagaaguaucugacacaaacacauaagcucagcagcaaacaaauaccuguguucccauucagacuuaguaaguaacuuuucagugagucugcuacuucaugucaugaccauuguguuucuuuccuagacugcacuuuaaaaaaagagaaaaaacccucuuguccucaaauauuuucauguaugguuuuauauuugucagacacauaugucucuaacacuauguucuaaugauuuauucuauucaugauauacuguauauuuacagaaaacaguguauaaaucaacuuauguguacucaauuuuauacaugauauaguacauuaacuuuucugaaacagcuuuuguaaaguacuuuccauauucgagaguucagccguuuaagccaauucuaguuuucggugaaaguuucauuagaacaugacuuccaguguuaagagcaggggaggcgguaccuggccaccagaccuagccuuccugccgaaucuacuggugaagccaccagguguauuacaugccuggcguguccuuccuuacugucugcaccccaucacuagauugcuaaugaucaguucuuuacauuuaucaccucagguuguagcuuacagaaugaccucgcugaagcggacaugauauguguguuguaguucaccccucucaccuauacacccuuuccugugcugaaugcuauacuaaccaucuugaagauauuuaaaaauuccuuuccuucacacauuacucauuuuccacccuuuucagagaauagaacuguaacucuccaaauaauaaacucaauggucuaaggagaaaaaacaaaaacaaaaccacuucaacaaaaacuguacugauaaaauacaagugcuccaucauagauuuuccagauuugggcaucuugacuuucuuagaaccauaccuucagaaaaagccaauuaauucaaacaaaugguucuuuaauggcccagauauuuucaguccucuuuuuagaagcauuucuuagcauuucucuuuuuauaaucaacccauucagaaaaaaguuuuuuuuuuuuguuuuuguuuuuuuuuuuuuuaagaaagacauuaaaaaaagagaaaacuuuguagaucaaagacaguaugugcucaaagccugcaaacagcagagagggagggagcugacagaugaggcaacacagacugguauccaggcuucaacuaaacacagcucuaagagccagaggaaucugcacugacuuaguuagcuaacacacgggggacuuuaaugggaggaaaagaucaguaaauuucaagauaaaacauauuuuaucuuaauuuguuucucuggaaggcagaauuuuaguguuuacugaacauuucuaauucacacgaaacuuacagcuuagaccuggggaugaguauaggaacuaagugguagcccugccuggacaggcaaagcagcccugguuucuaguccuagaacuuaaaaaagaaaaauaaagggggaaaacaauaaucauacacuauauaucuaaacaaaacucugaagucacauuagccaugaccucugugauguaguaacugaaaugcccaccacugacagauaaacacaaugugguuuaguacuauaucaacauggucaaaacccaggcagcggaagucgucugcagaaggggagaaccuccagacggcuuugcaaugcuccucuccaccuuggcaagaggagugcagacucauuacuagccaucacauuccaccugugagaacgagcacccgugauagcccagccagagaugggacaccuguaccaaacuuccucccacaacacccagggaaaauuaagcaagggugggaagacaaagccagagccagagguucgagaagcucaagauaugcuguggcugcugcacgauacucacagcuguggucaccugucuaaguccaagccaguuaaaaauuacagcauggggugagggagauguuuuacaaaggacccaggucaguaccccggagguggcaaccacaaucaaacaccaacgugagugugaguucaacuacaaugaugacgacgaccaaagaacucccaaagccccacucuuaacugaaggucuuuagguagcugaugguugcugugggaagucacuuucuuugagaaguggcuacugguagaccgcccaagccccucuggauaacccuacagcuauauggauauaagcagcacuaacaggacccaguggcuuauauaaaaaacaugugaacacaaaauuacuuagugauaaaaguaauaaaguacugaaugcuacaacauaacaucuaauaaaugacacacacacacacacacacacacuguaugguaccauucauacacaugaccaaaguaguucaauaaggaggaaaagaugccuugagcugaugagauuuucugagaagaccaaacuguuccguaauuacacuugggugauaacugcaugccucggugaauacacuaacaacuauaguggggagguagggaacaggcagacugggcggcgauguacuugcagaagacguccugacuuuagcagcaaagauggacccauuuaaauuuuguauuuuguauucuagacggaagccuuguaaacguuccucuacccuacuaaccuaaggaucagggcuacaaaccaauaccuccagagcagauuaaucagcucuucauaaaaagccaaguccaaagggaaaucuauuauuacuuuaggauacacucaacuuuuccuuuuuugaucuuccaaucugcugauucuaacaaagauuaaaauccccuuuauaccauaauuuuggggaaauuucugguaacagggucaacauaucuagggaaaauaaauggagaucaugaacuucagaauuuucucccccccacccccuuccaagucaaggcuuucuacaaaagucagcuucuaaagcacuccuuagauuaucacuggacacagaacucaaucaucugacugcacuuuaaugcagcacuacugaaaauaauacugagaauugccacuuuugggggguggggucaagaauaaagucuccccguagccuggcuggccugcaccucauggaucugccugcccccaccuccugugugcuaggauuaaaggcauggacaccacauccaacuagaaucaauacuucuuacuuuggaucuccacaaagaucaagcugggacaaacuugaaaguuacuucucaaauauucucaacucuaaaaucggcguaguuugaaaaugcuugacccaggguacuacuaggagggguuacacccuuguuggaggaaacuuguuacugucgggguaggcuaugauaaccuccuccuagccaccuggaccagucuacuucuggcuuccuuuggaugaagauguacaacucucagcucugccugcaucaugccugccuagacgauaauggacugaaccucugaaccuauaagccagcucccauuaaauguuguccuuauuaagaguugccguggucauggugucucuucacagcaguaaaaccuuaacuaagacagaauaccaauagucuuuugaaaagggggaaaaaaaaguugugugaagggauacaauuugaauaagcaaacacuuggugcaggguuugaugaugagaguucaacauaguugcuuaaguuauggaaaaguuugauauugguagugaucaucacccacaccucugacaguuuccaaagaugauaacaauuauauuuaacauaucuaagcaaagcagcuaacaacauccacaaauagauaaaacagaaugacugguaaaaagcaaucugcauucuacuuguaaaucugaauaguuuaaaauuuguuaaguccuaaaugaccaaauuuaauuucuucuuuuuuuagugaggcuagacagaguuucucuguggagcccuggcuguccuggaacucacucuguacacuaagcuggccuugaacucagagcucugccugccucugccucugcugggauuaaagguaugcaccaccacuguccagauugaauuucaauucugguaauaauaaaauuuaauugggaccaggcacccuggaauauuccugcauucccagaagacuggaauaugaaggcaagacggugagaagaccaaggucauccuuugcaaaguagggaacuccagaccacucuuggcuacaaaagucccugccccaaaauaaaaggggugaggguugcuuggaagcuagccccgugaaagccucuccuucuagauacgcauugagugugacugacugaagagcccugcacuuugcauuccaucuauuuccaaacccucaaauccucucaaacgaaacacucuacccuguacuagcucaacucuuaagacacauacguuuuuuccuucuuucuccacuuuaacauaggacggugcccaguagaacugcugcuucccaguuccggucuuaaucuccgugccuucaaucccguaacugccccucuccagucuaccaaucagaaucagcagcccaugagcaaagggcacuaacuagauguguaauaaagucacaaggcauacaagcccugcccacaauguguagcacugcacaacuccucuagccuuaacagcuuccuuaguccaaaacuacugucucggauggaaagacaaccacaccaugcauguuacauaaacacgaccaacugaaaugcugaucccauuucacagacaggguccagggcuggggaccuaccaaggucacacuuccuaacaguggcaacuguuuugcgccgacacacagcucuaucccguauucaguugcgcuccagcccuucaggcagugcagggagacacuccccucgcuugcccaccggugccgauccacaggugcccugcagcguggcgaccccagcccuugggagcuccggguggaagaaggcccagaccacagggcugcuccagggccuacuggaaccccucacccauuguucccggccgacucaccuccgaggacgcgguggcaggaaccgcugggccguuggaagccagcucccgccggcucaguaagcucggccgguggcggcaggauccgcgaaggcguacccggcggcuucggcgccuccccuccucggcaggcaccagagggggcgcuucacccuccucgcgagacagcggagaccccgguggcggcggcugcgaccccuaugacguagaacguucaucacccacaggcaguuuggaggcggagagaaggcgagaccaaccccccgagcccgcgcagcaaaacaccgcuccuccacccccuucccccgagcucugggcgcaugcgccaaaccgcugccgcacgcaggaggcgggacguuacggcacagaccccggacccugcccugcccccaccgcgggggggcacagcacaaacuccacaaucacaaccaaauaugcagaaaggcugccucaguaucaguggaaccucacaaacuucaacaaguuguuaggauucucuauggugccacgggaacuggacugagcucccagagcacccugguccuuccgucuauuucagcuggguugaccaucaggcauuucuuuuaccccgccauaacucccugcggcccgcuucccucuuuccacucucggaaaucuacacuaaaaauguaucugacacaucugcgcccaaagccgagcggcccagccucugccggccaggcuuccacucugcacaccaccagcauccugauaguuggccugccaagcugccuuucucgggacuuaguauuucaaacuugcugcagucccaagcauucgacaaacugcccgucaacacuuguuggccggcagauccaccaugcgggcuaccuguacaacauauuugaaaagauuuccagccaucagcgauaauauucuguuuguucuuggugaacggcucaacuaacaguucccaacgauguuuuuguuacguaaaagauguuuaagucaagcauaaacauaugaaggucuauccgcauuugguggaaaccgaugugggugugggacggcaacuuugauucuuccaccguggacuauuuuccaauaaacuuuuauaugcacacgauggcacacuaucuuguauuaauaccgcacugcaaaugcaggauaaagcaguuaaggaauuccuaugugagcgcaaaaaaggcgcgaucuucacauuuucucuuuuauucccucugcugccugaaaggcgggcuaggcccggaucacgugauguguuccaacuccgggcggaagcccgcgggagcgcgcagagucccgcugaaaaauggcugcugcaucggggugcaaugcgcccgcgagcaggcuguagggcccuugccaccccguccccgcugcucccuuaccaugaggccgaugagucgccgaagccuggacuggacuuacucccugguagguaccgagcagagcggagcuccagagcgcaccauggcagggcccgcgagccgaagguagacuguuggcucgcagcuuggaacuccagaacccauuccuaaauugagcguucacgcccu

SEQ ID NO: 12321 - RNA, 10237 nt, Mus musculus
agggcgugaacgcucaauuuaggaauggguucuggaguuccaagcugcgagccaacagucuaccuucggcucgcgggcccugccauggugcgcucuggagcuccgcucugcucgguaccuaccagggaguaaguccaguccaggcuucggcgacucaucggccucaugguaagggagcagcggggacgggguggcaagggcccuacagccugcucgcgggcgcauugcaccccgaugcagcagccauuuuucagcgggacucugcgcgcucccgcgggcuuccgcccggaguuggaacacaucacgugauccgggccuagcccgccuuucaggcagcagagggaauaaaagagaaaaugugaagaucgcgccuuuuuugcgcucacauaggaauuccuuaacugcuuuauccugcauuugcagugcgguauuaauacaagauagugugccaucgugugcauauaaaaguuuauuggaaaauaguccacgguggaagaaucaaaguugccgucccacacccacaucgguuuccaccaaaugcggauagaccuucauauguuuaugcuugacuuaaacaucuuuuacguaacaaaaacaucguugggaacuguuaguugagccguucaccaagaacaaacagaauauuaucgcugauggcuggaaaucuuuucaaauauguuguacagguagcccgcaugguggaucugccggccaacaaguguugacgggcaguuugucgaaugcuugggacugcagcaaguuugaaauacuaagucccgagaaaggcagcuuggcaggccaacuaucaggaugcugguggugugcagaguggaagccuggccggcagaggcugggccgcucggcuuugggcgcagaugugucagauacauuuuuaguguagauuuccgagaguggaaagagggaagcgggccgcagggaguuauggcgggguaaaagaaaugccugauggucaacccagcugaaauagacggaaggaccagggugcucugggagcucaguccaguucccguggcaccauagagaauccuaacaacuuguugaaguuugugagguuccacugauacugaggcagccuuucugcauauuugguugugauuguggaguuugugcugugcccccccgcggugggggcagggcaggguccggggucugugccguaacgucccgccuccugcgugcggcagcgguuuggcgcaugcgcccagagcucgggggaaggggguggaggagcgguguuuugcugcgcgggcucgggggguuggucucgccuucucuccgccuccaaacugccugugggugaugaacguucuacgucauaggggucgcagccgccgccaccggggucuccgcugucucgcgaggagggugaagcgcccccucuggugccugccgaggaggggaggcgccgaagccgccggguacgccuucgcggauccugccgccaccggccgagcuuacugagccggcgggagcuggcuuccaacggcccagcgguuccugccaccgcguccucggaggugagucggccgggaacaaugggugagggguuccaguaggcccuggagcagcccuguggucugggccuucuuccacccggagcucccaagggcuggggucgccacgcugcagggcaccuguggaucggcaccggugggcaagcgaggggagugucucccugcacugccugaagggcuggagcgcaacugaauacgggauagagcugugugucggcgcaaaacaguugccacuguuaggaagugugaccuugguagguccccagcccuggacccugucugugaaaugggaucagcauuucaguuggucguguuuauguaacaugcauggugugguugucuuuccauccgagacaguaguuuuggacuaaggaagcuguuaaggcuagaggaguugugcagugcuacacauugugggcagggcuuguaugccuugugacuuuauuacacaucuaguuagugcccuuugcucaugggcugcugauucugauugguagacuggagaggggcaguuacgggauugaaggcacggagauuaagaccggaacugggaagcagcaguucuacugggcaccguccuauguuaaaguggagaaagaaggaaaaaacguaugugucuuaagaguugagcuaguacaggguagaguguuucguuugagaggauuugaggguuuggaaauagauggaaugcaaagugcagggcucuucagucagucacacucaaugcguaucuagaaggagaggcuuucacggggcuagcuuccaagcaacccucaccccuuuuauuuuggggcagggacuuuuguagccaagaguggucuggaguucccuacuuugcaaaggaugaccuuggucuucucaccgucuugccuucauauuccagucuucugggaaugcaggaauauuccagggugccuggucccaauuaaauuuuauuauuaccagaauugaaauucaaucuggacagugguggugcauaccuuuaaucccagcagaggcagaggcaggcagagcucugaguucaaggccagcuuaguguacagagugaguuccaggacagccagggcuccacagagaaacucugucuagccucacuaaaaaaagaagaaauuaaauuuggucauuuaggacuuaacaaauuuuaaacuauucagauuuacaaguagaaugcagauugcuuuuuaccagucauucuguuuuaucuauuuguggauguuguuagcugcuuugcuuagauauguuaaauauaauuguuaucaucuuuggaaacugucagaggugugggugaugaucacuaccaauaucaaacuuuuccauaacuuaagcaacuauguugaacucucaucaucaaacccugcaccaaguguuugcuuauucaaauuguaucccuucacacaacuuuuuuuucccccuuuucaaaagacuauugguauucugucuuaguuaagguuuuacugcugugaagagacaccaugaccacggcaacucuuaauaaggacaacauuuaaugggagcuggcuuauagguucagagguucaguccauuaucgucuaggcaggcaugaugcaggcagagcugagaguuguacaucuucauccaaaggaagccagaaguagacugguccagguggcuaggaggagguuaucauagccuaccccgacaguaacaaguuuccuccaacaaggguguaaccccuccuaguaguacccugggucaagcauuuucaaacuacgccgauuuuagaguugagaauauuugagaaguaacuuucaaguuugucccagcuugaucuuuguggagauccaaaguaagaaguauugauucuaguuggaugugguguccaugccuuuaauccuagcacacaggaggugggggcaggcagauccaugaggugcaggccagccaggcuacggggagacuuuauucuugaccccaccccccaaaaguggcaauucucaguauuauuuucaguagugcugcauuaaagugcagucagaugauugaguucuguguccagugauaaucuaaggagugcuuuagaagcugacuuuuguagaaagccuugacuuggaagggggugggggggagaaaauucugaaguucaugaucuccauuuauuuucccuagauauguugacccuguuaccagaaauuuccccaaaauuaugguauaaaggggauuuuaaucuuuguuagaaucagcagauuggaagaucaaaaaaggaaaaguugaguguauccuaaaguaauaauagauuucccuuuggacuuggcuuuuuaugaagagcugauuaaucugcucuggagguauugguuuguagcccugauccuuagguuaguaggguagaggaacguuuacaaggcuuccgucuagaauacaaaauacaaaauuuaaauggguccaucuuugcugcuaaagucaggacgucuucugcaaguacaucgccgcccagucugccuguucccuaccuccccacuauaguuguuaguguauucaccgaggcaugcaguuaucacccaaguguaauuacggaacaguuuggucuucucagaaaaucucaucagcucaaggcaucuuuuccuccuuauugaacuacuuuggucauguguaugaaugguaccauacagugugugugugugugugugugugucauuuauuagauguuauguuguagcauucaguacuuuauuacuuuuaucacuaaguaauuuuguguucacauguuuuuuauauaagccacuggguccuguuagugcugcuuauauccauauagcuguaggguuauccagaggggcuugggcggucuaccaguagccacuucucaaagaaagugacuucccacagcaaccaucagcuaccuaaagaccuucaguuaagaguggggcuuugggaguucuuuggucgucgucaucauuguaguugaacucacacucacguugguguuugauugugguugccaccuccgggguacugaccuggguccuuuguaaaacaucucccucaccccaugcuguaauuuuuaacuggcuuggacuuagacaggugaccacagcugugaguaucgugcagcagccacagcauaucuugagcuucucgaaccucuggcucuggcuuugucuucccacccuugcuuaauuuucccuggguguugugggaggaaguuugguacaggugucccaucucuggcugggcuaucacgggugcucguucucacagguggaaugugauggcuaguaaugagucugcacuccucuugccaagguggagaggagcauugcaaagccgucuggagguucuccccuucugcagacgacuuccgcugccuggguuuugaccauguugauauaguacuaaaccacauuguguuuaucugucaguggugggcauuucaguuacuacaucacagaggucauggcuaaugugacuucagaguuuuguuuagauauauaguguaugauuauuguuuucccccuuuauuuuucuuuuuuaaguucuaggacuagaaaccagggcugcuuugccuguccaggcagggcuaccacuuaguuccuauacucauccccaggucuaagcuguaaguuucgugugaauuagaaauguucaguaaacacuaaaauucugccuuccagagaaacaaauuaagauaaaauauguuuuaucuugaaauuuacugaucuuuuccucccauuaaagucccccguguguuagcuaacuaagucagugcagauuccucuggcucuuagagcuguguuuaguugaagccuggauaccagucuguguugccucaucugucagcucccucccucucugcuguuugcaggcuuugagcacauacugucuuugaucuacaaaguuuucucuuuuuuuaaugucuuucuuaaaaaaaaaaaaaacaaaaacaaaaaaaaaaaacuuuuuucugaauggguugauuauaaaaagagaaaugcuaagaaaugcuucuaaaaagaggacugaaaauaucugggccauuaaagaaccauuuguuugaauuaauuggcuuuuucugaagguaugguucuaagaaagucaagaugcccaaaucuggaaaaucuaugauggagcacuuguauuuuaucaguacaguuuuuguugaagugguuuuguuuuuguuuuuucuccuuagaccauugaguuuauuauuuggagaguuacaguucuauucucugaaaaggguggaaaaugaguaaugugugaaggaaaggaauuuuuaaauaucuucaagaugguuaguauagcauucagcacaggaaaggguguauaggugagaggggugaacuacaacacacauaucauguccgcuucagcgaggucauucuguaagcuacaaccugaggugauaaauguaaagaacugaucauuagcaaucuagugauggggugcagacaguaaggaaggacacgccaggcauguaauacaccugguggcuucaccaguagauucggcaggaaggcuaggucugguggccagguaccgccuccccugcucuuaacacuggaagucauguucuaaugaaacuuucaccgaaaacuagaauuggcuuaaacggcugaacucucgaauauggaaaguacuuuacaaaagcuguuucagaaaaguuaauguacuauaucauguauaaaauugaguacacauaaguugauuuauacacuguuuucuguaaauauacaguauaucaugaauagaauaaaucauuagaacauaguguuagagacauaugugucugacaaauauaaaaccauacaugaaaauauuugaggacaagaggguuuuuucucuuuuuuuaaagugcagucuaggaaagaaacacaauggucaugacaugaaguagcagacucacugaaaaguuacuuacuaagucugaaugggaacacagguauuuguuugcugcugagcuuauguguuugugucagauacuucuuaaacuauuuaaagaauauguaggcuauuauaugguaucuaagagccuacugugugcugguacuuccccaaagguaaagggugaaauuaaaguacagauaguaacacuugggaacauagaggauuguuaucuuaggaaacuggucuauugcuaugcuuuuauuauguacugucuuuauguuaaagccauucauuuuugcugaaguaugaacaaagcuuuaugaagcauuuuugcuuaguuauucuauuacugaguuacugauauacuucuuucucuuuuacagauaauggccucagcugcuaaggaauuuaaaauggacaacuuuucaccuaaagcuggcacuagcaaauugcagcagacaguaccagcugaugcgucuccugauucuaaguguccuauaugcuuggauagauuugauaaugugucuuacuuagaucguugccuacauaaguucuguuuucgcuguguacaagagugguccaaaaacaaagccgaaugcccacuguguaaacagcccuuugauucuauuuuccauucagugagggcugaagaugacuucaaggaguauguccugaggccuuccuauaaugguuccuuuacuaacccugagguucgaagguuucgcuaccggacaacuaugacgagagaacggagcgccucucuuuauucacccaguaguacuguaaguaggagaacaaccacgccaccagauaguggagugcuguuugaaggguuaggcauuucgacaagaccuagagauguugacauuccucaauuuaugagacaaauggcauuaagggggccaacuacuacagaugagagaucuuugcggaaaauucaagaacaagauauuauuaauuucaggcgaacucuuuaucgugcugguguucgaguuagaaguauugaagaugguggccgcuacagggauauuucagcugaguucuuccguagaaauccagcuugccuucacagauuaguuccuugguuaaagcgugaacuuacugugcuuuuuggagcccaugguucgcuagucaauaucguccagcacaucaucaugaguaauguuacucgcuaugauuuggagagucaggcauuugugucugacuuaagaccauuuuugcuuaaucgaacugagcauuuuauacaugaauuuaucaguuuugcuagaucucccuucaauauggcagcuuuugaccagcaugcuaauuaugauugcccuccuucaucugaagaaggcagccguucagauucuucagucauuacaauaucaccagaugaggcugaaacucaagagcuagauaugaaugcaucuacuguuaggcaggcaccgugggaugaugaaacuccuggaccaucuuauucaaguucagagcaagugcauguuggcgugucuucccuuuuaaauucuucagacaguucagaugaagagcuugucucuggaggaaccacaucucagauacaaggaguacagaccaaugacgaugucaauaaugacagugauucaucgucagauaauugugucauuguuggguuuguuaagccauuggcugaaaggaccccggaacuuguugaacugucuucugauucugaggaguugggcccuuaugagaaaguggagacagugaagacucaggagcaagagcagucguacaguucaggugacagugauguuagccgggcgucaucuccacgcucuguccuuggaaaagaugaacaaaugaguaaaagccauugugauucugacacaagaauaagcucaaagaaagaagagaaacgaucuacaucauugccagcucccagggacagcucaucuacaagaggugacaggguaugcuccccauauaaccaucgacacaggaagggaggaaggucgaggaguucagauucccggucccagaguagaaguggccaugacccgaggaaucacaggaagcacgggaagaaaagacugaggaacaagagguccagaagcagggagaguaguagcaggccgagagcaagaaaggacaaaaagagauccagaacuagagauagcagcuggucccggaggagccagacacuuucucuaaguaguggaagcaccaguagaucgaggucucguagcagugaucauggcaaaagaagaucacgaagcagaaaucgagaucgcuauuauuuaagaaauaauuauggaagcaaauauaagugggaauacacuuacuacagcagaaacaaggacagagauggcuaugaaucaucauacaggaggaggacucuuucaagagcccauuacucuagacagucuucaaguccagaauuuagaauucagucuuuuucugaaagaacaaaugcgaggaagaagaaucacagugaaaggaaauacuacuacuaugaaaggcgccgguccaggagcguguccaguaacaggucgaggacuacauccgccgggcccgaccgggugagaaaugagaagcccggagggaaacgcaaguacaaaacccggcauuuggaagguaccagugaagaggcucagccggcucgggaguucacuuccaaagggaaggacagucauuaccaaaaaucaaaauuggauggcaguuauaaaaaugagagugacagcuuuucagauagcagaucaucagacagagagacaaaacacaagaggaggaggaggaggacccggagccuaaguguagagauaguuuaugaaggaaaggcuacggacacaagcaaacaccauaagaagaaaaagaagaaacauaagaagaagcauaagaaacaccauggagauaauacuucacggucgccggugguuauaaccaucgacagugacagcgauggagagucugaaguaaaggcggguauugaauguagcaauggcagucuuccacagccuauacaagauggagcauuugaaacuaaagauguugucacaaucgaagaugagcuugguguccuggacaaggacugugacguuacagcacuugcugaugacuugagcaccagccaaacuguggagaauugugacucgccggcagucccaguugaacaaacucuugauguaagagaagaaagcaccuuugccucugauuuggagagccagucgaguaaugugucuauucaggcugaaccaucgagaccagugccaucuccacggaccucacugucaucagugucuccugguagagacugugaugugucuuaagacugccagagccccuccucgauaauccgaggcuguggggaaaagguaaagagucaucuauugcagucuagaugacuuccuggaaaaacuuugccucuuaaaauaucuuaacuguguguguuaauuuguaaaauucauuauuuguucaaaaaguuauguaugucccauucccagauauaugcacuuuuaagugaagaaaauguugcuagcuguuuauuuaaaacuugggaaacuuuuuaaauaaaaaucaaaaaaauuuagaaguuauuucauaaagccauaugguauugacauauuuuuaugguaguauuuuugaauuuuuuuuuugagaguuauucuggaaguguguuacaagcuaggagaaugcuuuuggacaguuauuuuucauaaaagauuuguaugauucaaaaccauuucuuagacugaaguaagucguuuuaaucugcacagguuaucuuggcuucugccaaaagcaaaguuuaguauuuucuuuauauacuugguuaucuggacuggcaauaagacaaauguguauucaacaaaagacaauaaaacuguacacucuaaaaaauucag

SEQ ID NO: 12322 - RNA, 5340 nt, Mus musculus
auugucguucagauaaaauauuauagguuuauuuaaaacuuauuucucaccuugaguaugcaaaauacaaacuccacaaaauguucauuuuuuuuuacuuuguaguuuacaaauauacaaaauagaaguuugcuuaaauuuauauuacauauuuauuaaggcaaggaacuauauagaaaaacacauuuguucugcuuaaaggcauacuugggaauaaaccauuguacaaauuauugcacaucugaaaccacagugcauaacagacugucugcauaaaaauguuacagaaauaaaccaggcuuauuuaccuggcuuaggucaucaauguagaucggaagacaaaacuagauuuuccuugucaaaaguaugcagcaguuggagaacuuuggcucccccguuugguaccuuuagaaccacgacucaccaagcaccaucauuuaggcuguuagaacauguucuguaccugaaucgcuuccucuuccuccgacacaauaauggcuuuuuuuuuuuuuaagaaggcaaagagcauacaaggugaucuuuacguguguauugcaucaucgaaacacaauucaagggaauccuggucuucccuccccccaagcucacugauuuaguguauacccugauauccacaaacuuccagucaccccuuggcauuuuguaaguccgggcauguucaaguuggauuugguauuggaaugauagaagauccauccaguaucagaccccaucuguucugugauuuuuuuuucuuguuuuuuuuguuuguuuuuuuguuuguuuguuuuuaguauuucuguuuugucucuugaacucuuccuuucuccugauuauccauucacaagcugacuugcugggaacuugaccaugauuguagcgcuugccagcugggcuccuccccucgugggaagacagugugaaagguuagaaaaaaaaauacugaacucucucuccuggcagugugggucacauccacuacgugggauuuaaaagugccucuucauguguaaggcaaggugguccgaccuggaaaaggcccugucacacuucuggcacugaaagggccggugcccuguguguuugcgguagugccuggucaguucaucggagcgggcgaauuuccacccacagccgucccagucacagugguaagguuucucgccuguaaagggaaagagaacgggcugcugaagccauugcuagaaggaagaauuagccaccccccuuuuuuuucuuaaaaaaaagggagaggccagagagcaaauucuacugcaugccccacccucucuccuuucaagaaaguaaaaauauaauaauaauaauaaaaaaaaccuucaggaaugucuuuaugacacuuuagggccauacugaauuucagaugaagaggaaugacauguguuaugaguuuaaacucauggagaaacaguaguuaguaacuuaaaaaaaaaaaaagcagauacccucucaaagcguccacccccacaguacggaguuuucacucucgagccuaaccagcacuggaaauggacuggauuagaaguuggcucugcuaaagggaucugcaauccuauagguggaacaacauuaugaacuaaccaguacccuggagcucuugucucuaguugcauauauaucaaaagauggccuagucggccaucacuggaaagagaggcccauuggacaggcaaacuuuauaugccccaguacaggggaacgccagggccaaaaagggggagugggcggguaggggaguggggguggguggguaugggggacuuuugguauagcauuggaaauguaaaugagcuaaauacuuaauaaaaaauggaaaaaaaaaaaaaagaaguuggcucuguugaaacccaaaggaucccaugccauuacgcuggguccagaaugccacccguggcuaauuucuccagcagagccguucuggcuguuuucauaaaugcaucuggaagacucuacccacuaaaagacuaccugugcguucuuuguuauuucgagacucggguucuugaccagaucggucuugaaucaacaggauucuuucaacuuugguauuuguaacuccaaaguugagugucacccuacccagcuugcagggacaguuuuacaccagaaucccugcaaugggaaccauuaaauucuucaaacguaaauacgaucuaauuauucuaaagaccagaauagagucaaggguagguagaucuaagaggaggaggagacaacaaugaaaauaaucuagaaaauuuaaaacuuuucuuuuaaagauaccgccacaguuuugcauugcaaaguauaacuucuugauuaccaggcuaggaggggcaggcacacacaggaaacucccuaucuuuuaaaggcccaaugagaaacugcacauucaggcagcagauagcauccaucaagcaaaaggcuucugggcaaaaccauaggcgccuguuugcugcccuccucugugauccaggagauggagaagagauacaccccagcacccaagaaagcccuaaggagcccacagccagccuacggagcagacaggcaccaacccuccuccacagugcugguucccuuaccugugugaguucgcaggugugccuugagaugagaacucuugguauagguuuugccacagccugcauagucacaaguguggguggcuguucuuuuccggggccacgaccuucuuccccucuuuggcuugggcuccucuggcaggcaggaacccgguggcaugagcucugggagggggggggguaaagaaaguggggucaacuucaaucuggauagucucaagauccccagaaacaaagcucccagcgccaucucuaccagccagucccuuccccccacuaaccuugauaauggagagaggggacuugugacugcaucuggucuggcaggaaaggaggguaguugggccccggauggggauggaauccugggggaagaggcaggccagggugacagucccugcuguucagcaguuccucgggacucaguguagggguaguccugguggggagcugccgccccagggggaagucguguguguugggccgguggccguugcugagcugggguccagcgcucaaaugggccucuagggaccggcugaccgugcaggacgggaccgccucuugcuuaaucuuggggcacaugcgcggcgggccaccgcuguagggcgccacuaccacgggguggcugccgucugggcuuccuuugcuaacacugaugaccgaagggcugcuguacucgcugccagggguggucagagacgccuucagcacaaacuugcccaucagcccgccaccuggcggcugaggcugcuguggcggaauguauacuggguccaacuccggccgcaggagcucagccacgaagccgcccgaggggcucacgucauugauguccgccagguugaagggggccgugggagguggcgcagauucucggcuguagaggagcccuccaccuguguugcuggcagccacgcccgggucacccccggcccggaucggauagcugaagcugcagguggagggcgcgcuggcagggccgcugcucgccggggaagacgaggaugaagcugacgccgagguggucacgguggcggccaccgauuccugguggguuagcgaguuggaaaggauaaagucuagguccaggaggucguugaacuccucggucucccuccgggcuaggagggccggguuguuacugcugcaagcugcaccagcuccgccacucuccaggucuguggccaccgucgccgccaggucguaggggcggccgggaagugggggaagucgcuucaugugagagaguuccucacgccaacgcugcaagaacagggagggagagagaaacuguuaauuguagcacccuguugccaccccuaauauugacuuguugggugaagcacaccaacacccugcuauaggaacuggacagaacaggaaggcagccucggggacuccaggggccacacugcaaucucagcuaacaccaagguaagagguggcgcguucguucuccugcaagcuagugccgucgcuccaccagcccaguccucuuccccgccagauccgcgggacgcuccagccgcccacggaauugggacacugggacacgguggcuuucuccccaugcaccauagccaccgggucgcccacgcgcuacgaucacuccggcccaaagggucucgagacuuguccaccuaaaauauaguggacugagugcgcccaccccacgguccggacgcccgaagacuaguggggaaccgcugugcgccccuggcgguaccgcagugccgggaccacacgcacuuaaggccgacucaagggccgaggagccaccucggaaggcuguagaguuccaauggagggcaauccuuguccuaaccaaggacucuuggugacccccggauuccgcccauacaccccaccccaucugcagaaaucuacagggcacuagcgcgacacucacguuagucggggcaccugcuggacgcagugucuucucccuucccgccgggccggacgcgaacguggagaaggacgggagcagagcgucgcugacagccaugucagacucgccagguggcugccugcgggccgggcggggcgcacagggaccaggagucaggggacacccuggccacugcuccgaagcuucccuccaauccucaccccuuucuguucccaaguccaacaucucaccuaccucauuaaugugggggcccagaagguccuccggaguccgaagaagagagagggguaccugagccccaaagucaacgaagauuaaaaacuuuagaaacaaaaccucaaaccaaaacccccagauugcccgagauccuucuucuuuggauucaauauaaaccggcgaugucuuuaaaaaaguuccuuuguauacaaaaauucuuagaaaaguuguaaacucuuauaaaaauagacaaucagcaaggcagauaaguagguccgauggccaggcugcacgcucuuggacucagcagugucccccaccguugucgcggccacuguggcugucggcggcgcgggggcugugguccgggcggugggcgggcggcgccgccaggugagaauggccgcgguggcgcggaacugcgagcugggcgguggcgcggggugcggaguccuggggacugugccgggugcgcgcggccaugggcgcgggucacgggcggguugcuggguggggggcuggaggggcggggaggggcacucggcggcuccgggugccgccgccgcccgccaccgccucugcuccccgcgcgcccggagccgcgcucgcucucuuggccggggaacu

SEQ ID NO: 12323 - RNA, 43722 nt, Mus musculus
cgggaggaagaggaggagccagagcccguggguccccgcacugcucacucccgcgccacgccggccccgcagucuccucccggucccacgcugcggcccgcuguggacuucccuggugcagacauggccucgggcuccgccugcacggcggugaaggugagaucacccuacaagcugugaaugggccagcccugcaggguuccuucucgagccuccaggcuguguccccagccggagcgccccccacccaccgcucagcagggaggggacagggcgcgcggcacccagcgccaccccgauguccccagccuuugaacucaucugcauuccgggcccgagcggugguaaccggggcucugauggggagugggguaauagaagggggagcgggaugauggaggggacugcgccccgcugccacccucuuuuaguaccacucccccccaggcgggagcuggcgcguggcucagcuccugcggcugcugcgucggucccucuagucuuacgggacuuaagcuuccgcuacuuugacuaggcccacgugggagagcuggcacuugcucuuuugcaugcuucggcuucauuucccccuccaaacuuagauuuccuuuugcuuuguuuuaccucggcagcgcagagcugagggagcucugagacuuuuuaaauacugaaacagagcgcggaccgcucucagacuggaggccucugucuuauaaaccgcuuuccaaccuugaaaguuagaguuauuuucuuaggccuuagguccccagagaucuggacacaagggacucuugugcgccgggaacagcuggccagaugagagcaugaguucugagaguuggagugagccucccuuggggaguuuuaaacacauccugauugauggguagagaguggaauaacggagcccaggaaacacugguguuuaaguccuuucuaggcuguuuauuauuagccaagaacgcaguuaauuugauucaguuuaggaauuucugacccaugcuacaggaagugcacaguuuucuucaggcauccuuuugauugccugcagugccguuugaugcccuugcaagaggcccaucucugcauuuagccuucagcgugccagggcauuguauacuggggcccugcagggcuucaugaaccacucagggugagguugcugcauucggucauaggggccaacuuuuucuuuucuccauuuugaaaaggauuauuuacauuuauagaaagccaugguuccagucagcaggaacggggcagaaagggucuucaugugcaagguacaguagguacuuauuuauaaaguggagauuuuaacauauugugggcuggaaauuucacugagguagaggccugugauuugaagauagaucuauuugucaucucugucccacaaugugaguaaaaccaaauagcuagaacuucacacuuaaucaguccagucaggauaauacuaucugugcaaggaccagcauaucucaacagaaagaauuugcuuuaaucugguuagccuucugcccaacacacaguuucccugcaaaaugaaugugguccacuuaagagcagaaagagcuauguaaauauugaaugauauguauuuuuuuuaucuuggcaagcuuuugaaauaaaacuuagagauauaaauggugcucggaauaccugcugaguucucuucuugagauugcaacaggugagaacauugcuaauaaaaaaucaugaugccaacaccauauuccacaaacugcuaaggcagcaccccacauagaaaacaggaagggucccuauccagagcaaaauaaccuauaaaaacgauaucuuagcgcgagagugaaguggcuccgucucuggagugcuugcugcccaagugugagaacaugaauuuggacccucagcacccuugcuggggagcugguggcagacaccagcauccauaguccugccaauagagaggcagacacagggaaacucgggguuaacacuagccagccgagaaugccuuucucacacacacacacacacacacacacacacacacacacacacacacuguauuuuaucuggacaucagguagcauggauggauuguucauuugagaucauaagaacauaacgauucuuucuuacagaugugaagcugacagaucagcuaacgugucucguacagguuccuagauaaugacagacuuacagccuggcacucccagcaaguagaugugagauauuucuugguccuuaaacaauaguuucauuugcuuuccucugaguggggaggaaauagagagcuggggcugcgugcauacgcaggccgccucugcggaaaaccacuguauaggaggcacguuuguguccagcagguggcuuuuggcaugcaccauuccauccguuucugagaagcaacuguuuuauuguguaccucagugagaauauucccacacuggacccgagaggccuggacucucuuagggaccucugcuaggaggccagugcugaucacuccuacuuugagcuguuguuagcuuuaugucacacgcccagcucagugcuugcucuguuaaugcuaacucugguaccuuccuuuguaaauggaaauauuaccagggguucgaguuuaaauucaauaccguuugguuuaagagauaggauagaccauucagaugaaaagcaucccguuuuguagggacaguauaaugcucaugaucucgauguaaucugucuaccggcagaauccuacccaaaaaauacuuauuggaaaccugccaggcucugagaaugcacaguugagugaaacagcaucccuguuuucuuuaaguuugucuuguauuggggcuggaagacuaaguaauaugagggagcugucaggguccugggaguggcagaaaagaccuuuagguguugguuguuagaggagaaugggacuggcuggaggugauuaagucaugguuauuagagcuuccuugauggcaauaagcaccuuuguaaaaggcaucaggcccuaagagccacaugguucugccauuuaagggaccaucuauaaaccaaagagcuagcucucccugauacugaauuggccaaaaucuugaguucuccaagggccugcagauugugagaaaugcguuuguaagucugauuuuauuauagccacuuacuuaggcacaucgaggacaagcuaguaguugaaaugaugauaaggaaccuggaauuacguggacagcuaagccugaggaaaggcuggggaagaucugagcacagcggccuugaaauagaaaccgucuguacuugugaucgugagaauuaguuggguauaguaggccuucaggauauaaaccacaguagagaauuuacuaguacccugaggcagagggaggcagaauuuuagcuagccuuaaacuauguagaacacaccgugagucaacuguguacauacaguaagacccuaucuaaauaaguagauaaauaaacagacaaacaaauaaaugaagccaacaaauuuuggauuugauucuaaaugcuuuggaagccauuuaaggauugugaacagagagguagugucugauuuauguuuuuaagugauuccuuggcugcucuguacagaauugccuauacugggcaaaggacaacaucuggccagaagccauggcgcuugugccagucugggcuggcagccauagaaguagugagguucugcaggcggaguagagauagcgugugggaggguagcaagagggaaagggugcuuccugugucuggcuuccaccccuggaggugcugagcaguccuuuccaaauagaaguaaggaggcugaguucaggauuccuuccacuaacgcauuuccaagugggcgcuaaagcaggggggaugagggggggucucucuuacagcagcagaagagcugcagaguauguccagggucaaaggguagaagauaaauggagacagcaggaggcagaggccaugaauucauaggagcacguugcccaagaggacuugagagaaacauuguccagguuuagccaugggcuggcagugugcuugaucaugcagaaggcaaagcaaaccuuuggcauccagagagggagggagguuuggagaacugcuucagugauccgaguuaugccccuggcuaguuucuccaccgagggauaggaagauaauguuaaucauguuuaguuggauagggcgggaauauggucccucuguaggucaguaguagacuucauagucagaggguccugguuuggaagauggcuuuuaaaccucucuucuggacugccuugagcaugguugccacugcucugucagauugcgcugagcuuugcagcacacaguuuacccuuagccucuccccuacaaagugccaacagcaccuccucucuccugugccagacgacaugguacauacauacucucaggugccccgagaaagugaccucauauuugguuaaagaccccuaggccauugccugagagacuggcuaguuaggagagguaggaaccgcugauuugugucucugucuacagaggagauaagggccugaguugccgugaggaagucacuuuuccuucuuggucuguuguuaggagugguaggguauggaccggaaacugauaccacgacguccauuugauuuccaugcucguucggcaugcuaauuaaaagucugagccacauagggaaagaaaaugaggaaacaaacagauaagauaaauauuuguauaugauggucccgagauccuuaacugggaagaacucauuggcuugacuccguugcuucuagagacauucgcaguugucucccugcuccacgguuauacccuccaucaacacgugcccuucucccucuuaacuuccuguucucagaaccccuaagguuccauggagggcccauccagauagucucccaucucaucuuaauuuauuuacacugaauaauauuuguagguucugagguuggggugucaacaucuuuuuggaggagccucuugcauauccccugagaacccgaaugcuaacgguuacagcuguuaggaaguggggagauggaacagauaggaagucagcuuugcucuggaaguuaagucccaugaggcaugcggcuagccuggguaucgggacuacagauguagccguaucagaacuacagauguagccucauuuugcuaccuugccgcugugauuugagcagcuuuccucuccuccgcaccucgauauucugccucaccauaggguccaagugaccacagaguaaaacuuugagccaaaccuuuccuccuuaggguugauuuucucacauauuuugugucccagugacagaaugccaggugacuagcauaggaaggggucguuaugcggccugauauauuccucuagcucauauuguacaaauuuguguuuuaagcagagcaacacacuggaaccaaccaacaagcuucggauaaaacgcaugcuuuggauaaaauccaguuaucagauccucugcaguuuggggucugacauuuggcagagagggacugcugauauccaucagcugaguagcaaggaacuuaggccacauccugcccuuauuccacaagcaaaggagacuugaaaggagugcagugaguuuugaagaagaggccccggagaaaccaaauaguccauuucagcugugaaaugugccagcuucggggugcccgggggcuguuuggaucuuccagccuuuccuaauuccucugacuucuaugacuguguuagguugcugggauggccuuagcagagcucagugggcaguaucucacaguacuggaggcuccuugucccagauaaccagaggguugccaagagaguugguuucuucugugguaacccuccuugagguuuggauuugggguagccaugguuuccauauauuuugaccaaaaaaaaaaaaaauccucaaagagaauaaucaguauguugcaucccaggaacauggauacaaguggccccaaagaaaauguucuaucagugguuucaugaaguuuauuuuguuacaggauaaaauucaaauacacuggugggagcugagauuagacagcauacagcagagcaggaagucucucagauuccaucugaugaacgccuuagcuuccaguugcuacaacuuggugguuugcuaaaccagaagauuuugccuccuggaaacuaggauguuagauagguugugggugggcaagagaaccagggguguggccuaagauuugacucuggaucagccccaauccagaaguucuaaucaguccaucagcccuguagaaucuuuaagcuggggguggccucuucucugggagcuucaaugugcaggcuccuugugcucuuccuucuggguguaucuguguccguuagguucaacccugacuccaaauccacucaaguagugagcaucacaacaucuguauauagguuuggacuggggcacagucuggcccauaggcguucccuguggagaaagcuuauguuaggguuuuacugcugugagcagacaccaagaccaaagcaacucuuuuuuuuuuaaagauuuauuuauuauuuauuauaucuuaaguacacuguagcugacuucagacacaccaggagagggcaucagaucucauuacaggugguugugagccaccaugugguugcugggauuugaacucaggaccuucggaagagcagucagugcucuuaaccacugagccaucucuccagccccccaaagcaacucuuauaaggacaacauuuaauuggggcuggcuuacaaguucaaagguucaguccacuaucaucaaggcaggaacaugguagcacccagccaggcauggcgcaggaggagcuaagaguucuacauccucauuugaaggcugccagcagaauacucacuuccaggcagcuaggacuaggguauuaaauaaagcacacgcccacagugacacaccuacuguaacacggccacaccucucaauacugcugcucccagggccaagcauaauacagaccaucacauuuacuuuggggaugugcugucuaguucguauugcagguuuuguacagaccucucgggcgcaagcauuuggucucuugauccccguaagucaggaccauaaaugggguccuauaaaaccauacacauagucccuccauauuuguuggugguaacuggagcugaaggacugaaaucccagagagggauugggcuagaucccacccuagcugucuuuccucaccuugaacuugacaugcucaaaagccacccauuucguuacauggguucaucucagcuguucuaucuuugguguuugugaguaccucugggaggcagggcauacagggcucaaaaggaugguuccugagaccaggcaagguaggugaaguccugguuuugaggcaccaggggaaguacauaggguauguaucugguuuuagggaauguagcuguaagguccaaagucgcaggcauucuuuuugaggugacuggugggaaaucuaacaguuaaacaugucccucuuucagaaaccuuguuuuguguagugaagacuuucuggauguacagaguugauccaucuguucugucucagcccuuuaacccauuuuuaggcauucuagagucaccuggauuugggaucugauaagguauugcugccuccugagagugguugauggguuucucagugguguccuugaucacgguucucaaccugugggucaccaccccuuuggggauugcauaguagauaguuacauuaagauuuauuacaguagcaaaacuacgguuaugaaguaacaucauuuuaugguugggggucacaagucaggggcuguauuaaagggucacagcauuuggacaguugagaaccacugccguagaugcucgcccagcuacccagagccucucuacaguguguuccgucaccuugagcaaaagcuugccccgaccaaggguuagucucuguaucaugggcagugacccuuucuaguagacuuugagcuccuggaaguccccagaggauguuaggaguuggcacacggugcucaagcuggaaaacggcguugcugcucuuuuuguaaagcaggaauaaugccauaggaccuguguaagaagagagcaucugugaaaaucagauacgguucagcgcuaaccuggggugaagugcuugggagcuucauccagcuguacuuugcuugugcugccagcagguggugcugugggccacauguugacacugcaggccuccaucaagguucuguuuguucccugguguggcaguacaguauucaguugccagucugguuuccuguagcagguguagguuuagguguggguacagguuuccauuaacagugagagccagcuggaugaccgggugggcuuuguagacugcuguggucuucuuggucagucugcuuuccugccaaguacuacccacuccucgcuaagggcugaggucccuagugcaggcccgucgugucgcugggaggguuuggacugaagcagagcuggcagaugagggaggacgaguuucaggagcuagccuguuccgauugcugcuuccauuccuacugugcuagcuugcugcauucugagaguacuuccaaaacaaaaugagaucuguuucguauucaagccugaaaggucaguguugucaguguugacucagaaucugagaugggguagccuaggggacuucuugaaaugauuaagcaaagcggucauaaguaaaaaguuugaagguuuuuuuuguuuguuugcuuuuuguuugauuuuggcuuuuguuucauauuuuguagcucaagcuggccacaggcucccuauauaucaaaagacagucuggaacuucugauccuccugccucuaagccuaguagcuaaauucccaaugagucaacugauaguuguuucuucuguugcuuucuuuugcccagugugaggacaugggcuggacagucuguuagcccagagaugugaaagauacaacggagaagccacgccagcagaagugcugggcuuuuguaaaauagaaugauuuuauagauugguugaccuuaagcauauuaaacaaauaacuguuguugauuugaaaucaccaauauguugacuggucagucuuuccccuuuaguugauauaaaauacaucugcuguaauuucaauaauguaccacaagguggcaucagugucaacuguuuuagccaccaggaaauguaaaucugccauccuacagcaaaaucucauaaauucuuuaguuuggaacuuuacccuguugagccagaaacuucuauuuuccuuuguaagaauauuauucagugacaauucguuuacacccuuucauuguaaaaagugcuggggucuuuuucuaugagcuuucucccaaagucccauguuguagccugcuguugaccuguuuaaguccuguguucuuuagggagucaacauaaaguuucauaaugauaauguuacuuaguuuuuuaauguuaagacuuuaauguuuaucuuuguaauuguucugguuuguuucuuaggcuuuguuagaucaacucaauuuuuuuuuaaagauucauuuauuuuuauuuuaugugcauugguguuuugucugcaugugucuggcaaccauauaugcacauugccuucagcagccaaaagaaggugucggaccuccuagagcugggguacagaugguugugagacacugugguugcuggaaaugcucauaacuguugagccaucccuccaacuccagaucaacucacaggaucagguuucuuucuccacuuuuuauaagaacauggauuuccaggaagucuuaggaaacugaaaaaaaaaaugcuuaaacauaaaaaauuaaaacuacuagcggggagggggguggggggguggcgcacaccuuugcagccagccuggucuacaaagugaguuccaggacagccagggcuauacagagaaacccugucucaaaaacaaaacaaaaacaaaauuaaaauuacuuugaauaaauauuugaauuauacaauguaugaaauacugucugcuguauauguauacauaugaacagccuuugacuuaguauauauauauauauauauauauauauauuaguaugggcuugucaugucacucaucuuuaaccugcauucccuuccaggugguuauaguggcaugcaaagaaaauuucuuauaaaauaucaugguauaguaaaaagaaagcauuaucaaagaaauaggccuaaguuuuuauaucaagcuuucuuuacuccauaguaaaugugguagagaagcaaccuugaucagaaagaucuuucuacaacuuuugggcucgauuucuaaccugaaagucacguucuguuuauuugugauuuaauugggaguaaauguggugcagucagaaacagcggccuauguuuuggcuaugucaagaauggaaggggcuggagagauggcucagcaguuaagagcaccaccuguucuuccagagguccugaguucaauucccaguagccacaugguggcucacagccaucuguaauggggucuggugcccucuucuggugugucugaagagagcaauggugguguacucauaugcauggaauaaacaaauaaaucuuaaaaaaaaaauagaaaagaccaucggguuuuauuguuuuguuuggggguuuuugcuuugauucuuuuuaauuaaagggcuuguucuucaggaaucuucagagucauugcccuuuggggauuggcaggaaugagaaugggccuguaaauacgguuagguaucuuugcuuaaagugaacuaugaccagcugugagcgucuucuuucuucuccuuucuccccuagauuggaauaauugguggaacaggcuuggaugaucccgaaauuuuagaaggaagaacugagaaauauguggauacuccauucggcaagguuaguguccggcugacggagugcgggcuuggccggugcuuaugccuggcuggcuuuguuuuuacuaaguuauuuauucacuuuacaucuguaucaauucuucuuccuccuccucugguccagucccucccuccuacuccucccccaccccaccccccuuccacucuuccucuccuccacagagaagagggggcguuccaagcucaucagccaaucccagcacgucaagcaaggcuaggugcauccucucccaccgaggcuggacaaggcagcccagcuaggggaaagggauccaaaggcaggcagugucgucacagacagcccccgcucccacguuagggucccacaugaagacaaagcugcuacuuaugugcagagggccuaaguccaucccgguccuguacucugguuggcaggucuguuuuuaugagcucccaugagcccagguuagacucuaggucuagcccagguuagacucuagguuuucuugugguguccuugaccucucuggcucccugaauccuucuucccccggggucucuacaucagcuuccaacuguugcugcauuaagcuaagccccuccgacaacauuuuugcuagauuccugucugcgaauagagcagaauauaaauaauacugucaggagugggcucccucucauggcauggcucucaagcugggccagucauugguugccccuucccucaaguucugcuucagcccucaccccugcauauccuguaggcaggacaaauugugggucuaagguuuugugacugguuuggugucccagucccccauaggaagucuuaccugauuccaggagauggacaguucaggcuccauaucucccguugccggggaaucuuagcuagggucguccucacagauuccuggggguuuccauuguccucgguuucuaguucaucccagagauguccccaccccaauccauuugucuuucccaguacucucuccuccauucucccuccacauggucccuccuauucacaccccucucuccuccccuacacaguccacuccuucuguaccucccaccaugccuaaucaauuuccccccuuucagcaagauucaagugugaucuccuugggcuguccuuguugcuugccuuuugugguucugugauucauagcaugguuauccuguacuuuaugacuaauauccacuuauaauaagugaauacauaccaucuuuaucuuucugaaucuggauuaccucacucaggaugacauucucaaguuccauccauuugccugcaaauugcuugaugucuuuuuuuuuuuacuagcugaguaguauuccauuguguagcuguaccacauuuucuguauccauucuucaguugagggacauguuuccaguuccuggcuauuuauaaguaaaguugcuaugaacauagcugagcgagcguccuugugguaugguggagcauuucuuuuggguguaugcccaagggugguauagcugggucuugagguaaacaucuuuccaguuuucugagaaaccaccaaauugauuuccaaagugguuguacagguuugcacucccaccaggauggaggcuaggacauccuugauccgcauccuugccagcugucaccucaguguuugaucuuugcuauucugguaggcgugagggggaaucucggaguccuuuugguuuauauuucccugaugacgaaggacacugaacaugucuuuaagugcuucuuugccauuagagaguccucuguugagaauucugauuagcaguguauccaauuuuuuaauuggguuauuugguuuguugauaucuaguuucuugaguucuguauauuuuagguaucaauccucugccaaaugugagguuggugaagaucuuuucccauucuguaggcugccauuuuguccuuuugacuguucuuugaaauaaaagacuuaaugaugguuuggauuuccuuggcgucuguuguuaugccccccccccuuuuucuuucuuguuuuguuaauuuggauauuuucucucugccuuaguuuggcuaaggguuugucaucaugcugauuuuucucaaagaaccaacucuuaguuucauugauucuuuguuucuauuuuauugauuucagcccugagucugaucuuuuccugcagucuacuccucuuggguguguuugccucuuuuguuccagagcuuugugugugcugugcuguuuguuacugcuagcgugaugaggcacucagugcugugaccuuuccccugagcacugcuuucgucuguuuggguaucuugugcauuuguuuucacuggauucuagaagguuuuuaauuccuuuauuucuuugacccaugcucacugaguagagaguuguuccaguuccaugaggguguaggcuuucugucguuaaguccagcuuuaauccauguuggucugugagauacagcgguuauuucacuuuucuuguaucuguugagacaugauuugugaccaaguauauaaccaguauuggagaauggucccugaggugcuaagaagaagguauauucuuugguauuugggugaaguauucuaggcaggggauuggggacaggggguugucaccugguuguuggugcugcuggcaggccucugggaaucuaccggcuugauuuuuuuuuuuaagauuuauuuauuauuauaagacacuguagcugucuucagaugcaucagaagagggcaucagaucuuauuauggaugguugugagccaccaugugguugcugggauuugaacucaggaccucuggaagagcagucagugcucuuaaccacugagccaucucuccagcccuugguuuuuuuaaauuaagaguaccaguuggucuuguguggacagagguccuagcacugaauuuccucagcugagguguccauuaaacuacaggagacugaugccguccguggcuauugaacacacacgugacuucuugguuuacacuucuagaagucaagauguucauuuuccauucaaaucuguuucuaauuuagaguccaggucgcaugcaccacaggcuggcgacugacuggaugagucaguaugaaagugacaucuucugacccagaugagccagauaauauuaucccaccgagguugugugagcagggcauccaccuuccuaauuccacauugccuccuccagucacgggcauucuucugacaagaagcccucugaaaagagcuugcaucccagccaugcccucauuuucagcuaaguucuucaccugaccuggguucuuccaaguucuuucucaucuugcucuuagccucgggcuuucuuacggacauugguucucccgucuuucccugugacacuucaagcggccaucuuaggccuggacaucacaagcaugcgguucugucacugagcuccugguaaccccacaguuuucuuaaauccucagccuugccuuucacaccaugucuugaaccauccaaaugccaucaacacauauaaggucuccuggggcacuugcugccgucagagccuguggaguccaugcuagccaagagcucagucaauauuuauugacgauaaugucgaucauuagaaaucuaaacuccuuucccugagcuguagcuucaaacgccaaguuccuaccagucuguuguguuguuuaaugauucuaacuuuuaagaacucucuguguguuuuaaaauuacuaagcuguagcuguuuauuuuuuuccauugcaugcagccauccgaugccuuaauuuuggggaagauaaagaacguugauuguguacuucuugcaagguaaaguauuuaaagguuuuuuuuuuuguuuuuuuuuuuuuuuuuuuuuugguuuuguuuuauuuuuaaacauuacuacuucgggagaguuuaaauuuaacuuaaagucagggaacagguaauaauguaggugugaguuguaugucuguagagucaggacucuguuuacgacacgaggcccuaagauaaguucagauuucaaauauuuaggaagucagagaucuugacucccacaucagucuguaaaauaguugguuugcccuccucugaagcuuccgcuucuguucuaacggaaaagcuauuuccuuucaugauauccuuucuuccaucgaucagauaauaagaugcuuuguccaugacagauccugauccuuguguaggcggaguuguuuuucuguggaggggagguuuggcgucccuggacuaauguggguuacucgcuccccgaacagagcuagugggguacaccacugcacagaaagaaagcaccgucaugaggggcuccccugcucacgcguggccgcaggcugacucucaagcaugucauuaggugguaccuucuagaaggauugcauggucuagugguggggaacaagucucaggccagcccacacuuacauguguugauuuuaguauguaagacauggaaaggggacuuuucaaagcuuuguccggaacagugaaguagaagacccuuggaagccagcaaaacuaaaauggaguuguuaauugucccucccuauggauuucagacaggucuccuuccuuggucuguggucauugcuagagagcugccuauuuuuuucucaagcucagggaagaaacgauuguuuaaauuacacugauguuucacuuguucuggaaaaaccuccugagagcucuggaggugagcccuaggaaaaugugugcaucucuggguaaugaugggucccuccuuaaaugucaucuaugagcucagaguggaaacuuggggugcuguguugguucacaguuuguuagcuaucaagagaagacagaaaauuuucucucucuuuuuaauuuauuuauuuauuuuauguaugugaguauacuauagauggguugugagccuucaugugauuguugggaauugaauuuuuaggaccucuguucacucuggucaaccccgcccacuccagcccaaagauuuauuauuguaacuuucagacauaccagaagagggcgucagaucucauuaugggugguuauaagccaccauguaguugcugggauuuaaacuugggaccuucaaaaaagcagucagugcucuuacccacugagccaucucaccagccccagaaaauucucuuucaauaagaacaggaugauagugaggcauauuuaacagcucugucaagcacauagcuauuucauuauggguuuuacugaugcggagggggagcgcggggggggggggggggcgauccugucuucaagugggcugggugacuuuugggaggccagaaggaaagucaaugagagagcuuugaaccaaaaaugguugccuccuaccaaagcccaaaguucuuacuccaaugcuuggauauauuuccacacuucuaaaugugacuacuugaauaaauaauaguaugcauguaggugcauguucaaauaugcauauaaaauagauuuuaaguggacuuuccaauacugaauaaauacauaagcuauaaacaaaccuuucaaacacugaacaacggcaggcuguguguuacuugcuuccaguguauuucugucuuaucgcaggaaaagaaaugaaaacucuugauaaaacuacuucaguaggacaucauuuguguuuguuucucaagaggccuagauagucugggcaucuuuauaaaauauugcucauaagaacauaaaaaugccauguaaccaaugugaguuuuaaaauuaauuucaauuaauuuuauuuauacacauuaguaucuugccugcaugugugccuguaugaggauguuugaucugaaauagguauuacagacaguuggaguugccauguggugcuuggaauuaaacuuggguccucuggaagagcagccaguccucuuaaccacugagccaucaaucucuccagcccccuaaaaugaauuuuaaauauugagcaguuuacagcuguuggcuugaguuuccuaaaugaauguggauucucagguucauggguuuuaggugcucggauaauuuuaaccaaaugcauauguuuguccgacagagugauauuuacaugacagaugcuacggaagaagacaagggcagugcccuuggcagauuguaguuguagaggugggcaccaaggagacauagaggagacauuaguguuguagcuguaugcgguguagaugcggauacuucuugaucuuggugcugagaucuaaagagggucagggccugagcaaaaauuaagaauggaagcaagaaguccagugagucuggauuacaaaggagaaaauaacaugaagugguuccucaaaguuucgguagccagaacucggaggucaaggaauugguucuccuggggguugcgggucacuauuuuuaguaacauuuccauuucuuuuguuuguuuggcuugguuuuggucuuuuuguuugguuuggguucuuugagacagaauuucuccuuguuacccuggcuaugcuagaacucuuucuguaaaacaaguuggcuucaaacucaaagauccaccugccuuugccucccgaguacuggcguuaagagugugagcugccgcugcaaccacuaccacaguaguaauaauucuuuauggggcuugucauaggugugauaugcauaccauccuaaugaaguggcauuuaaccuggaaacccuuugaaaggguaaugcccacuugauuuguagcuauuaaaaaaagaugucaggucauuauauuuacuaaugcacuaaccuuaaggaaauuggaaacugagacggcuagucuuuugguuuuugguuuuugguuuuuucgagacaggguuucucuguauuacccuggcuguccuggaacucacucuguagaccaggcuggccucagaaauccaccugccucugccucccaagugcugggaaaaaggcgugcaacaccacggccuggcaagauggcuagucuugacagaagaaaugcuuuauguuacacuaucggucuggauccagguuuaauugaggaacaauuuuauauauauauauaaacauauuuuuuauauauauauauacauauauauauauauauauauauaaaaacauauauauauauauaacauauuuuauaauaugucuguauaagcacuuugggguaagcauugaauuuuuaucugcagaaagauuuuuuuuuaauuuuaacuaaaauauugguuccuuuucuauaauuuuuaaaaaccuuuuuguucacuguuauuaccauauacacagugcuaccuuugguguccaugucuuguucuccauuucucaguucuguuaccaacuaagaaaugccauuuuuaaaauagaagcugugggccuugcgggccuguggcuucaguuacuacacucuuagaaaguugugcuuucucuuucucgcuguuuacaacuucuuaagcaaaguaguggcucucuagagcauugucaaguuucaguacaaaaacaaauuuuugccauuaaaaauuggcauuauaaagucuggagagaucacucagugguuaagagcacugccugcucuuccaaagguccugaguucaaaucccagcaacuacacgguggcucaaaaccaucuguaacgagaucugaugcccucuucugaugugccuguaaacagcuacaauguacucacauauauaaaauaagcagaaaaaggaaauuggcauuauauugaacaauguauugagaaaugaaucaaaauaaguuuuucuuuccaaaaaaaaaaaaaaaaaaaaggacccugucuccaagaauagucacagcccuaugguccaggucaagguuagaucuacaguucagggaugggcagugguagugcacaccuuuaaucccaaugcuugggaggcaggggcagguggacgucuaaguuucagggcagcuggggcuacacagaaaauccugucuucuggauggauggauagauagauagauagauagauagauagauagauagauagauagauagauagauagaauaaaagcuuugauucaguuaagcccggaacaguagucaugaaagagcuggucugucguccagaagagcaggacaucaaugaacagcuucauaguugacuuggugaggcagaaggguuuggaggccuccaccaggaacuugguuuugccuuuucuuuguaauuguuacaguucccugcucugacggcggaugucauacuuccaucuccuuucuuagacacggcagacaacacaccaucaugccuucaaaagucaacuaccaggcaaacaucugggccuugaaggaagagggcuguacacaugucaucgugaccacagcuugcggguccuugagagaggagauccagccuggugacauggucaucauugaccaauucauugacagguaagugcugaguggcucugagagaugaugugugggaaacacggggagaggggagaggggagagaaucacuuuaagcuucucauuguagguuguuuuuuuuuguuuuuagcuaaacuggcagauacuauauauugaugaauguaauugcuauauguggacauuacauggugauugauaaaguguucaccuaucacuucacauacacaccucgcaaauuagcuuggaugcaaacauugauuuucacuguacaauagaugcaccacaucaccacaccaggcaggagauuucaaaaacguacucuuucugcucaacuaaaacuuaauguccuuuggccaauuaucucccaggcuucagguaagugccgucgucuccucaucugaguguuuuagaucgcaugugaguuugugcguucucuuccagugccuggcuuacuucaccucaccagauuccuccggguuuguucgucuugcugucaaugacuguugucuuuauuaugguugacugauuucuacugucagugugccacauuuucuguaccugugacuaggcaucgagguugagucuauagucgggauaaagcuggcuaugcagaggggccuccggaguaggcugacuuagauacuucggaugagugccccugggugggguagauccugagguuuucaccuucguugaggaaccccaaggcugauuuucauaguggcuggccuaauguacauccccaccaacaauuuguaagggcuuauugacuucuguaucucuaccaaccuuuguugccuguuuuccauucugaagaccgaaucucacuauagauaugguugacgguucccugguggcuaaggauauugacuauuuuucuuuauauauuuugguuuuuaauuccuugcugaaugaauagcuggcaaagaugcucucccaguucgugugcacuuccuaggagugcgaugcaucgcguguguaccuuuucagcuugguucuuccguuugccccgugcuguuguuuccgagcugcugggguccugaggaaggaaguucuugcccugcccaggccucuagcucagugugccuuuucuccggcaccgucaggguugcaggucugcugcuggauucacuugaugugugugcaggaugagagagggcaaucucaucccguuucaguccucugccugucuacaucugaauaucucccuuccccugcacggguuauuagcacuugucuuucucaucaugguuugggcccucacagggaauccaauggcugugguuucucucaucuuugucacugucuacugcugccuuccucuuucugcucgccucauuugucuuagaaauagguguucaguuagguuauuugagagcuuucuaaacuuuuaauacaggcguucaugacuacgcccccuuuuggaacucaaaugagugggcugugaacuuuaguacacucaauacuugaugcauauguauucacagucauuauauuuucaucauagauuguuuccauuaugagugucauguaaauuccuuuuuacccucugcuucaggguguucauuucggaucguacgugugaguaguuccugcugcugucuuucuguuucucacuucuuuaauucacuucaagaaaucccuccagguucaucuugucacacaugacuguugucuuucuggguuuuuuuuguuuuugguuuuguuuuuguuuuuucgaaacaggguuucuauguauagcccuggcuguccuggaacucacucuuguagaccaggcuggccucgaacucagaaauccuccugccucugccucccgagugcugggauuaaaggugugcgccaccaccacccagcugacuguucucuuucuuauuuaguguuuguugucugcuaggaagggcauguccucuuguuagugacaguucuccgugaguuggcuucugugcagugcucagcauccacuuugauucaauggagagaaagcaaaaauaacacugccaggcggugauggcacucaccuuuuaaucccagcauucugaagcagagacagguggaucugugaauucaaaggccagccuggucuacagagcaagugccuggacagccagggcuacacagagaaacccagucacuagaaacaaaaccacagauagauauaucuguagugaaaggaagaacuauagggcauacuaggaagguaaaauuuaguaagaugaaaguauaagggaaagagagaagugggguaccccuuuaauaccagcaguugggaagcuaggcaggguaacuagaaacuugagacuaaccagagcgacauagugagacccugucucaacaaaagguagcaguuuggggaagguugagcacacaauaaaagagauugaagggaaaagucauauauuccuccuugcugaagauggggugggugggggucagggggaaguggauacuuuuuagauccaguccagcaggucaguuugggcuggggguuuggaggcugagccuguucuaccuugccuaccagcgugagcuaagaaguggcugaguuacagccgcuaaggaagcagagcucuagucaugccagugaccuugguauguggccccuaggagguagacuacaguccuucuggcuugucgcaagugugggcugcucagaugguugcccgucacuuucaagauacucugucaucaguguuccuguguguaugacaaaccagugccuguaaacaucccugagcuuccgcgugugaggaugaugaucaaaccaaggcauccugcagugagcaggcaagacgucccaggcaugaagugcuuugccagcccuggccacaguagacucugccugcguccacccauaagucuuuacacaguucaucucaugcuucagagauccaacacuguuuuuaaaaagaaacuuuuuuacuuccccauguaaugcagaugagcacaucaggcuaagaaaggaauaacaguguuaggaggggugauagauccagauuaccauggggaaauuggauuaccucuucacaauggugguaagcaagauuaugucuggaguguaggagaucccuuagggcgucucuuaauacuaccauguccugugauuaaagucaaugggaaacuacaacagccuaauccaagcaggaugacaaaggacgcagacccaucaggaaugaagguaugggucaauccuccaggaaaagagccaagaccugcugaggugcuggcugaaggugaaggaaauacagaauggguaguagaggaagguaguuauaaauaccaauuaaggccacguaaccaguugcagaaacgaggauuauaaaguaauaugaaugcuucuguccuauuuugcuaagaauacauuugucuuucuuccaauuucuuuaacaucaauugguauguaaguugagaaacuaaaaggauguucccaagggacauugccccauugugaauuuacuguacaggaauaguuauaucauguuaggcuuacucaggacaggaccuuguuauuguuucauguggacaugaaauauuauuugugucaaguugacaaggggugaauuguaguggcuguuccuaguugucaacuugacuauaucuggaaugaacuacaauccagagcuggaaggcucgccugugacccuaaucuggaggcugggagauacuaguuucucaccuggaucuuggcauggagaucuugaggcauaguggcuaugaaccccagaagauuaagacagggagaucucugaguucaaggucaucugggauuaaaggccugguggcaacuuuucuuuauuuuuuuuuuaacuugcccaagcauuuaacuguauccaguucccuccaagccaucaaagauauuugauuauauuggccuuccuuacagcauggagucauguuuuuccacuaaugaccucccaugguuucuguuguaauuuugcuugccagaccccuucuuguguggccauccuggcgcugguagucuuguguuuaacgucugauucugagcccacccagcuucucgucuguguucuguucgauucggaauuuugagggagucgaucaagaacaccagaggcuuuguguacaauauugguagccugucuuguggagugucacauccagccagugccaccaggccaguggucgucuucagcauacccaccauuuuuccuagugcucauuaacagucccuuugaaaggauaaggaaguggacauuuccuugggccaagagaaucuuguuaggcauuucuauuuucgaaggaccuuauagggcauccaagauuuauaauuugaggucugucucccauacuacaugucuucaugugucgcacugugcccugcccgggcaccacugucacacugcuugaggaaggcagaaugaagucuggaacuggggucugcugccugcgucuuccuucaccagaccagaaggggaaacagcagagucugggacaaauucuauaguucuuugucuccucucuggguuccacugagagucaggaacgggggccagcacucuaccuuucuccucugggucucuugagagccaagcagagaggggagacagagcucuggaugaguggaccuguccgaugaggagcgagagccaaguggaccagaaggacuggaggggagauagccuuccucaggggucuuuuaguuguaggccuuccccacaaugauccuuagugaagcagcucucugagauggaccuugcuuguucuugcugauuuauuugaugguagauguaagugaauacacuuuauuugggcugagucagggguucucuaucuuuuguggaaaaggaguacccaggaagggaagacaacauuauuggcugaagacucggggcuaucuggauuccucacuagcauggagaacuccagauguuaugcccaagguccucaguuagguguccugguuaccuguucuagaacaaggagcagcuguacccuacuggucucaggucucugagguccuccagaucugagcucaaucaaccuugccuuuuuuuuuuuuuuuuuuggggggggggggggguguugguuuggguuuuuuuuuuuuuuuuuuuuuuuuuuuuuuuaucugcauuuauuuuauguugaauuuauucccaugccaugagauuuuguuucuucaguuuuuucugggauaucucuuucuucuauacaaccuccucuucgggcuuuggaacgaucuguuccuucacaaugaggaucaucucaguguggcuagggagcucauguauggguuaaucgagccaugagcucugcucuauagguucgucggugugucuuaaguuccuuguucaccuggauauguugaauaacuagacaaucuacaucgaaaccggaaguucagcauuacuuuaugcauuuuaaagcaugugcagcaaaaauuuagcacucuuuccagaauggcacacauugcuucuuuaaagugacauccuucagccucuugguggcuuugccgcuaugaggcuaugcauacccuugcuguccugggcaauuucucagauguucuuaaacugaaugaagguuugaaacucuagauuugcaugauuuugucggauguucugcggcaagagaguagcaaaccaucuucacaggucacgccuggccgcuuacaggaaaaggccuugccaguuccuuauaacugguagcacgguccuauguacuguacauuccuguggguagggacauuucucuuucauccugccaccugugggggugggcagcugacacagaggagucgauguaacuucccuccugacucuggcuuugcuauguggauaaagagagcuuagcuguucucagggcuccaguuggacuuuuagauggugaauuuuuuacaugcuuugaucccagcaucuucugaucuucagugucacuuugccacuuauagauaaagcagcaaguguauggacccccagcugcuugcuaaggggucuacaguuacuuccucaccaaaugcuaacaguucuuuuuacaaauaucuuugauuaugcaguggccucucaaccgcacaggaucuaugaugaggugccucaugaagucagagacgagagauagaugccuccucccugcugugguuuggcacgggccuuguguaaacaggccagauucuaagaagagccuuggccgaguuuagaagcauaguuguuuggauugcuuagccuuucucuuguuacuuaucagcuuuguagcuuauacuuacuucuuaaagguucguuguagaguguugcauagggggccuucuccugggggacucugcuggcuucuccccaauguugacacacucuauugucucuuccugaauuucugggcacaccuggucccuccauuuaacaccaugaccaaaaggcagguuguggaggaaaagguuuauuuagauuacacauuuagauaauaauucaucuuuggaggagauugggacaagaauucaagcagggcuggaacuuggaggcagaagcugaugcagggucacggaggggcgcugcuuacuuccuugcucuucauggcuugcucagccugcuuucuuuuagaacccaggaucaccaccagcccaccuaccguggacugggccuuccccacgauuagugaggggaaaaauugagaaauugcuuugcagcuggaccucauggaugcauuuucucaacugaggcacugaugaaucuaacuugggucaaguugacacacaaaacccaccaguacagauacuauuuuagauccuguuguuuggguagaggaaauguaauacagccaucccauucgagaggcugaggucccaggggcagggacuuccggcaaugucuucauguauccuuucuuccugugccaucaauaucugcugcaucacugaagucauugauuggacaggaaggaaggauauauguagaaauugugggugugagucuuuauuuuaaacuuaaaacaaaauucauagagacagaguaacuucugugacucaaaauaccaggucaagcaaugccugcccuucaguauccuuaccuguuaauguaagaguucugcggguauuggguucugauauguuccuucucaagcuuuuugguugguugguuguuuuuuuuuuuuuuuucccagcuuguccucuugcaggaagaauaggagaggccuggguuugcucucgcucugacucaucaggaaagucccgcacuaaauacaugggcugauaugauagaugaugccuauguauuucacccuccuccuccuagagacacagcccuaccuugggcuuccccggugaugucaucguugaaggcugaggucuuguaggggugugcucugguguccacacaggucuucuuucaucuugaguguguccacuagagucuaacgguuagaaacggacuccugagcgagaugacuugcaccugggaccucaccccugaggagugcacaguagggccauuguuugaggguaguucuggauacccagauuacauaaugacagcacccugucuaaaacaggaagggaaggcacggagacccaugaugcagaguuucccaggggccuuugcuccgucccaccccucugagaggcaaguguggacaggacaggaccauccuguuucucuggcuucuuguguguguccucacucugcugagaaagucaucuucaauguuauaaagaagcagauacuacugggcauacacucacugcaugccucugcccucccuuccaucuauaacuuguguccgaguuuuccuuuuguaucuagcaaagucaacaacccccaagaaguaguuuguccuuggagucugcucuggaaucuaguuucguuagagcucuucacagucucaccacauuccuguuguaacaacugagcuguggagcugagugccauggucaguuaauggcaggcacuccgugaucauccucugauugaugcuugagaagaccuagggacagagaugcugcuacauacuagcaaguggacccaaacucaggugauucgagccuguccccucagcucccgcucucccgccccagugagauggcucagauuuuguaacugucuucuggcacuuacucguuuguaacacugccacacccucagugagccuggcuggagccaccugucccucuucugucucugagucuccaucacaacaucuuguuccgugugcaugcucaagccuaccuucucucccugcaagcauucuggacaguucucccccuuuccaccugacagccccuuuagcugcuuucuauagcuuccuguaaauaagacaugaacuggccacaagugaugucuagggggcuguccucugggcuuuggaaagcagaaguuaaacuggcagaaaugauguucugauuagcuauucucauagacugacucagcccuuccuauaacuugguguaaauuguuccaacuuguggauacgugcuuuguuaacucuugccacuuuucuaggaaugguuucuguuuugagguuuuuuuggggagguugguuuuuuuugagacaggguuucucuguguagcccgcuggccuugaacucagaaauccaccugccucugccuccugagugcugggauuaaaggcgugcaccaccacgcccagcucuaggaaugguuucucacauaaguucauauuuagaaagccccgaaacuuugcuuguuucucuuuuuccaagugaaugugagugauuaugaugcaauagacaggaagacaaguuagcugugaauaauucaggagugaaagaaaaugucacauuccacucuuaggaacuggcaauuucuuaaauauaacuauugcuguucaaaguggacauuuuuaaaaaggucaucugacccacuaguggaauuuaaaaugcuaaagcuuuucuagccaacuuuuuuccauuuacaguuuacaauccuaagcauaaaagcacacagugguacuuuuuccugcauauaguauaucuauguguggcuauuguuuccccgguaaacagauaaaaccacuuacaucaaccuggaacaaguuggaacacuugggaaccaauaacagcauuaguaaauguuacugucccuuuuuacacacagacagacugagauucuaggacugucucuuucagagucuugagcaaaggcuucauugaugcaguguugaaauccuaacccuuaagggaacgaggucagauuuguuccugcaacucccaucagaguuaagauuucugugauugucauuuuuguauuguuuuuuuuuuucuuuuuugaagauuuuuuuuaaaagaaucauuuauuguauuuuauggauaugaacuuugccuguguguaugugugugcacugcaucugugcggucagaaaaauguguuaaaucucuuggaacuagaguuguagaugguuaugagcuaccaugugaugcuaggaaccaaacucaggucuucuguaaccaacaaguacuuuaaacacucccaagaaucauguuuguucuuauguugccuaguguacuguuagcaagaucucauuagcagacuauaaggaggaauaacgaagccucuucauugaacagucucaucacugagguuuaaacauccauuagguucguucauuuguucguucguucguuuguucuuuuuuucuguguuguuguuguuguuguuacaguuguuaaacaauugggaauacuccugagauugaaaugauccuaaugaauggaagaaucuuccccagaaaccauccuugugagcaaagccaugucaccuugcaggcacuuaugccagggcuugcuagagacagaggccgcauuuggaaccuaccucagaaguugugaugguuuuguuucuuggaaaagaaguguguuucugucugaugcauuuuuagcuucacauuucuucaugggaaagcguugacuuaacacuuucaagcuaauucaaaggugucuacuuaagaaacaaccuaccaggggcuggccagauggcucaguggguaagagcauugacugcucuuccaaagguccugaguucaaaucccagcaaccagauggugacucacaaccaucuauaaugagaucugaauuccucuucuggugugucugaagacagcuacagaguacuuaugaauaauaauaauaauaaauaaaucuuuggacuggagcaagcagagguccuaaaacaaaaauuucaauucccagcaaccacaugaagacucaaaaccaucuguacagcuacaguguacuugcauacauaaaauaaauaaaucuuaaagagagagagagagagaacgaacgaacgaaccuaccaauugguuuuucugcugugcugugucugaacuaccuugaacucauuucucuuggcaguaccaguguauauguguccuucacucuuuuaaagacacacuuugugcauuuuaucuuaguaccugagcuggucaguuuuaacugccaccuuaacacgauuuagaaucaucuagaaagagagucucagugaggaauuauuaaggccagguaggcguguggauaugucuguggcuaguuauuaaguaauaucaggagagcuagucaauugugggcggcacucauucccuaggcagggguccugagugacaggagaggagucucugcuguauuauguggacaugauaugaccaccuuucucaagcuucucucacuauaacuuccccauagagauagacucucgccuggaauugugagcuaaaacccuuucucuccuaaguugcuuguuggcagaguauuuugucccagcagcagaaaggaagcuaggagagcaucuaccccugcuugacaaccucgggcaguuuuagagguuugcaugaugugugacccaucaaaacgccaaacugccauguugguagaagagaguacagaagcggauguuccgugugcagcgauggccagugccagccccuuguauuauauuaucucauccacccuugcuuagcccaugggguaagugguuccugcccccacuuuuagauauaggaagaucugaggcagaggcgcagaggucugagugacuuucccagaagcaagcagccagugaguaguaaacaucagucaaguuuacagcaagucaguccccuaaaauccaugcucaguuagggggcagaguuaaucucuuuacuuuagaauaagaagcagaccuucagcaggaguucuuuauugcuauagaagccaugacuggguugauuauauaucaaacuacagaaacaagugcauccaugcccuguugauaguauaacaaauuauuuacaaacuuaggggcuaaccaaaauuuugucaucuugguauuauuugguuaguaguuuagcaugggucucacugggccuuuuuuaagcuguuagcaagacuauauuacucugggaguggugcuuaagauggagcccauuuccugauccuuugugcccuauccauccacagccagcacuaaaggaugaaguucuuaucauucuggcaucuacacaccuucuacccucuagcacauuuaaggauucuuguaaggaugacguuccugcauaauuaauccagaagucucuuucuguuuugaagucagcuucauacuaagccaucugcuacccuugcuuuucucugccagguuagguaaaguaaccguggguucuggggauacaccugugggguaggccuaacccaaauguaacaaugagaugcaauuguaccugaguguauugaggggcagccacuguaaguuuccauuuuuaaucaagggugcaaguggguauuuuauucuguuucagcugcuauaacaaaauaguguagacucuaaacaacagaaauuucucagaaggcuaagaaggcccagaaaagguguuaauggaccuggugucugagaagagcuagccuucuugaccuggucuuaguuuccagauguuaugaccuuaagggguaggguuucaauauagaagucuaaaaguuggacaagccuuagauguugcugugagguuuuuuguuuuuuuguuuuuuuuuuuaauguauauggaguuugggguauuaaggacuuuguacaagacacauuugacugguuggcugguugguuuuauuuuaauugaaacaaaaggaugaaaaacaucucuggcccguaucacucaacaacaaugaacuacacaguugaacuauaauugugaauucagacagguugguuugguuggaauugggaggugaccuuuccagcuuuguuagcagccucuccuccaaggcuucauuugcaagaugguucuaggcuuuguccugagguccagaagaugcaguuucugugacaggcucagagggagucacaggugacucacauuugcuuuaggauuuccuuugggguugccuuggcauuucucagcuguggcucugucccaacucauuuagcguagaccguuccucaguuuacaguccauguguggguauauucuauugauagcgauuuagcuuuugaucauuucacugagcacagugacacuugaauuaguggugcagaugccacgaguaggcgugucuucacgggggaggaaagcuuugauuuuaaugcuccuuuuccuuucguuuccuggggccucagccugcagcugacucucaggugucucuucuauguuaccggggcaccuugaugauuaacugacuucucuuacugcuucuauaaacgaagggaugagcacuguggauuauuuuuauaugcuuuuugagguagauucucacuauguagcucuggcaguccuggaacuuacuauguagaccaggccguccugaacucacagagauccuccugccucugucuucugaguaccagaaucaaagucauauggcuccaggcccagugaguacuauguuuuauuagaaaaugggagaaugaaaaauauacaggacuugcuauaacuauguaacuuguaauugaauaccuucauuuaguaagaaagauguaagcgggcugugguggcacaccccuuaacucccagcucuugaguucaaggccaaccuggucuauagagugaguuccaggacagccaaggauacacagagaaacccuguccugaagaacaaaaagaaagaaaaauguaaacuguuucauuugaaggaaggaauuaagaccagucaauaaguaucaaguaacacagcaagaugugguauguuugccacaggcagagauauagggagacagagaagucguggauauguuguuaggguagguguuccuucauggacgccuguugccauagcuacuggaaguuucaguguccuugcuuuaugauccuagaguugcaaguggggacauugcuacaacuugacucaucaucaaaacuaaaaccgggcacaucuggaagugauaacaaggcauccuuuaguuggucauucuuccagggaaaacccuguugguguaggcuagagcugucauaugacccauucuucaaccucagcuggaugccaaggaguaaacucugacuucuugaggaaugugaaaaagagucaagacucguagagcuugcuuuccuccacagcagugggacuucuucaucucaaauagagaugacuuugaugccaaguagacucggucacuagguaugacccagcccaaagaauaaguuaauuuggaacaguaccaaauuaugccagcugugugaauggaaccagcaaaaagaauuuuccauccugccccacucccaacuccuggaaaaagacaccagauuuucugcuuucaguuuuccugugucccauccuugccucaucuccauucagcaggaaaaggugggcuuugggguuuucucugaguuacucaguaguuagaaaaaucaaugcauacaaaaaaguaguugguagucuuuucugaaaguuuugaaggagaaguugagcgaacugguagugaguucauuuuagccugucuuuuauggauucccaaaacagaauuuagaaaaacagaaaacaaaacaacuugaacuagaaaacaugagaacgagucaaaggagguagaaacaagcugaacaaggggcagauuaccaguggagcagggcaaucuggcuggugugcagaaugaccuagcaaaacgugacuaggauugaggccgcaguuaucuuuacuuuaaauguggguaaggacuuucuauggaccugaaacaaaguaauuguuuaaaaaguuggguuuggguuuguuugguguuuguuuguuuguuuguuuuauagauuuuagggagaccuggguauagucugauucaauuaugaaaaagcuaacaaauaaagaguauaguacaguuugggggaacuuagugugagucugggaaauagcacacugagccaacucuucuguguacgucaugauaaaauguuuuagauugacuuugacuuggucauuacugcccucccugagguccugauuuaacagucuccaugcguacacauucguucuugguuaggaguguauuacagccggcccagagcuagaaggguccaguucaaaccugaagaugcucugugacagucaccugcauguauccacagcuauuggauaagaagugaccagaggacagagacagagcuuuaacagugguaaacaccucaccccuuuaucuuccuaggacaucccuaaggccucagaccuucuaugaugggagucauugcagugccagaggagugugccacauccccauggcugaaccguuuugccccaaaacaagagagguuaguggucucccuuacagguauaucaggagagcuuggcgcgcaaucugcagguuugucaguuggcugaguagguaauccccuuuuuauucccucaguguugguuuugaaaaucagugguuuguggguggguuggggagcagggcagggggaggguauaggggacuuuugggauagcauuugaaauguaaaugaaggaaauaucuauuuaaaaaaauauauaaugugaagaaagaaaaaaagaagaagaaaagcagugguuucauggugagccauuucccauggccaagaauaucugcauuauuaguuauuuuaagcaaaauuguuucaccugcugagccaccucuccagucccagaacuguuucugauacaacugauauuucuaaaaagccuugaaguaaggaagcccagauaaguugauuucuggacagaaaaaaaaaaaaucaggaaagccauucuuauuucaccguaugucuuuggagggacagcaagcuuuauaacaaacaaacaaaaaaagcagagcagugacuggaggacagcugcacucugggaaacgccacugggccagaccuucaaucugugugugacaagugauaccuuagcugagcgagugagaucagccaagaccugaggccucaguccagauugcagcccccgggauagccucccuaaguucuagacagugaauggaauucaaguauauaaauuaccagagccuggugugguuuuacuaaaagcuacgagcuaugccugcaguggaccugaaugugugauuguaggguaugauggccuccuucagugcucuagguucucuaaggauaugacagcaaagucuacucuagguaauuaguuugcuaaaauagaaagauaaaaucuuggacuguccaugucauuugugcucuuccuuuuccagguccucauagaaacugcuaagaagcuaggacuucggugccauucaaaggggacaauagucacaauugaggggccccguuucagcucccgggcagaaagccuuauauuccguacuuggggcgcagauguugucaacaugaccacuguuccagaggugguacuugcuaaggaggcuggaauuugcuaugcaagcauugccauggcaaccgacuaugauuguuggaaggagcaugaagaagcaguaagugggaaucccuccugaucccgugaggugugggcgacagccaccgagagaaugucucauggguuuccuuugcauuugucucggggccuuuguacaucgcuuuuagguguucaguaggcuuuguuagaucuuuucuguaguuccuguuggcauauaagaucuaccacagagggucagggagugcuuaucugagcaucaacaguguaggcacuacaucauaggcacggagauguacugagaaccauugagcccugggucugccuuuaaagagaaaguuggacuuugugugugguuuccuuaugcuguugcuacuuauguuuguuuucauggagaaggaaaaccuaguaagcaagccccaagucccuacccugcucaucacacuguggccacugccccagugccugcuucgccauccagugaaacagaacacagaaucgccuaaucaugucaccugucuacccacauguauuuugcugggcaacacaaacgaauccugguccuuugguuuucauaaacgcuuuauugcuuucucacuacagcugguaguuuuuacuuaugggagaguuuccaggcugacugugucuggccuggcagcucaagagcuccucccagcuucaugaucuacagaagcuguuugcaauuaaugggaaacacacauuuguuccugucacuuccuggcagcacauggcuuccugucagauuuucuacucagucucaggcuaggcagcuagaugccuccucuacagagggagcggugacucuuacgccacaugggugcuggaaagcacauggcucgguucugucagugggaaggcauguaaugucacaugccacaagaaagacacgcauaaacauggaauccacucaaacggccauuugugucauugugcuuuaaacaaguuacggcccgacgugacaugguucuagaguggccuaagcucaccucgguuuccuuuugacacucaacagauuauuuaguuuguuuucucugaaauaaagccaggacauggagcagaggagugacucucugcuuugugcgcgugcgugugucagugccauuguaaccaaacacaaacagauugugggaaagccaccagacagcuccugugucacacccaggaggcaaggagagcuagauugaacaagaauggggcaguaaccuuccaaggccauugucccagucacugcaacagccaucaagcccagccuccuaguacagguucucaucuguggguuacaaccccuuuggggguucaaaugacccuuucacagagguugccuaagacuguugaaaacacagauauuugcauuaaaauucauaguguuagcaaauuacaguuaggaaguagcaaugaaguuaauuuuaugguuggcgucuccacaauacaaggaacuguguacugaagugucaacagcauuaggaagguugagaaccacugcccuaaagguuacacuggcugaggaacaagcacucaaacaugagccuguugugugcaucgcagcuccaagucaugaaggggaggugggacugcucacacugcaggaguaggugucagguaagggccagaacuccaggccugcguguaaccuuccaaaguucaccccagcuggccuacuuuggucagcuacagccugccucugaaaaagaaucaguggucucccaaaaugucacugccuaguggggaagaaguguucaaaucaugagccuguggggggucaggcaagagucagaccacagcaagugguuuggagagugccgacuaccaggcucacucucaucuguaacuccaucgaguggcugugcaaaggagcgaaccuuggaaguuuaagcucgaccuggaagugaggguuggguugcugcucugagucauggggucaauaggaagggcauuuugaguggaacccaacaacaggaacaagguuaguucagagucaagggggaaagaauauggacaugaguaaaaauaaauaaggugagucucuggcugcuggaaucgccugcgugugaucccucggcuuaaaucacaucuuuguaugcaagccgcacagaagccgagcuuccaccccuguggagguccuacuuccuuagcuugucuugguguuuguggaagccaucuagaugaagagacacaaagauguguccuuggaucuuagcugucuucuaagcaggauaaaggaaggcaaggaucugggccugauggucagcuuucccccaggaaccaguucauucauacacaaagguagauaagaguccaucugagcugacuccaugcccagucauguuucaucuguaccuccguaauuuuaauccagaagcauugcaggaaguagccaaguaauuaggucauaauuauguuauaauuacuuaauaugcucaagcaaauuucuaguuccuaguuaaauauuauaaauaacauacauguuauaagugauucucuugcgggcgcucgacuggccaggaagaacgacgcugcaacaggauccuucugcacacguuuauugggagagcuugauuguagaggcgaaaagaccccgagcccagaacuggugcugcuuuuauaggccuaggagaggcgugucuuacacccggauugguuaugcacuaagccucauuugcauguuccucaucugauuggcuacucucucucaguaccucacagaaccucauuaucauaccucauuugcaugucucacaucugauugguuauacucucaguaccuuacagaaccucauuaucauguccgggccaggcagugucuuugcaaaaaacuuuacugcauauguacacauugguuguuuguccagacuuaugcaugguggccagcaguagucagugccacucugcaacggcacauguggcuucccacaugacuccugugugcaugcacacacaugugcacguacacacacacacucauacacaaauacauacaccaguuucugaagauccaguuuagcauccaguuuaugcuggguaagcauacuggcacugagcuauauccccaguccuagaaguaauuuuuuugucuuguacaggagcuuaagaugccaaguacaguuggcacacacucagacagcaagcaguaccuggccggggggggggggggggacagaagcaagagaauugugaguuugaaagcaacuugugcuaugcagcuugugcuacagagugagggacggcuucgcauaaaggaaggacagggaaaggggacaaacguguugagucuccuacacucuagguuccuaccagcuucaucuuaccguguguccuucugucuucuguauuggaugcuggaucuagauacagaaggaaaauuaaacaucauaauggugauuugugacgaacacagagugaguuggaauuuuuguuuucaggugguuugacuugguuuguucauuucuuuaggcucuuggguguagcuuaugguguuaaccaccaguccguuuacuaugagucauaaaaauaacacuucuacuuuuuuuuuuccuuaaaagaugcuuuuagaauauuuagcuccuguuuaguuauccagaguagcaaauuaaacuggaauucacuuuuuuauagaccaggaagggugguggugauagcgguggcggcggcagucacugcugguugacaucugugggcuuuucagaaauaacauuggguugcuuuaaggccuuuccucuaagaugaagagcaguguuugggcucaggggauuaaauuuggaguaaacagacuuacaacacagguuuguuuucaucuguucaggcagcuaugagaaaaaucccauuagaaguagcuucuagaccaaaaagaaggccuuguuuuuacauuucaagggguugaaaacucuaagaucaagacugacuggcuauaugucuggugagaaccuauuuuaguccuaucuucaccaaaccucacaugacauauaauucauguuuuaguuacuuuuaaauuguugugauaagaaccaugaccaagacaccuuauagaagaaggaguuuauuagagacucacaguucagagggcagggcggauaggagcaggcagguaggcauggcgcuggagcaguauggcacaccuccuccagcaagauuacauuuccuaauccuucccaaacaguuccaccaacuagggaccaaacauucaaacagauaagccuaugggaccauucucauucaaaccacaacaaugagggagcuugcuguaauaccagaccccauuccuaacagcagugccagccugaccuaauuaaucaacuucugauaccccagcuuccagacacccucaguccaagagaacgaaauuccuuaagaugaauuuggaagggagacaaacaucucacaccaguacaagacagggacauggguaaguguucugugaaaagcaguuuaugccaguaaaauucuguguucuucucucuccaggugucaguggaugggguuuuaaagaccaugaaagaaaaugccaauaaagccaaaaguuuacuccucacuacuauaccucagauagggucgauggaauggucagaaacgcuccguaaccuaaagguaggugcccucacgucugugagcagacuuguuuuauggcuuuuaacuauagucugucugucuuucugucuuucacuuucaauuuggucccucuccuugugcauuuuaugcaggccgacgcuucuuuuuuuccaacaagcuuuuuuguuaucuugugccccagauucuuuccaucguccuggaguuguccucacgucuuggcucagaaggcugaugaguuuccugugugcuucucuugugcucagcuguuuucucuuugguagauuggugcaggcuguaggcaggccuuuauagccaggacaucaauacaucagugacaaaguggagggaaauaucuccuuuaggccaauauuacuaaaauuaagaccauuauuagugauggguaaaugacaaguugcagauugguagaaucucaacucgagugucuguucuaaggauacaguuuaaauugcaagguuagagagcgccacuuuuaaugaccauuuugugacuugauuaacuggggugaguacggagccucacucucauuccacuuuaccuuuucuuguaccuaaagagaaauuuccuccagguguccuagagcuuuucugugcuccuggauccuuugacagucacugagaggguggcacagguugauagaagcuaccccuaccuggauuaguaccucccacaggagugagccacaaguuuagguagugaagccauuguaaaguaguaaaugauuaauaguguuuucuaucuugcacggaaugccacagcagagcccaauguagagccacccaaaggucgagagucgcuccagugagcugugcagcacaccacugugaccaugggucucagccuguaggacugggaaggccaggaauguuguaauauaaugucuucccugagaggagacaccccacugguuucagcaccggauaccuaggagauaaauguuuacuuaaugagugcauaauuuuccucccgugaaggguucugcuaaagugcaaaaggaccuugugauuauuuuaguucuggggggaauuggggguugggggugggggagagacaggagauaaaaauccaccaauuacaaaacagugguuugaacaaagcaauuucaaacauaugugcucagaccacucagaaguuuguuugcuggaaccaugacucacuguggccucuucaaaucaguuucagacucacaagcugugaugaucuaaccuuauguuuaccacaguuucacguuccaagucaguuccuuaaaagacaugcugagaugguacaaaucuguggucccuuugaagcugauguaguguggucauggaaauacucacuuuaaaguggauuauuuaguguagcauucaucagguuucaaaugaagugaagaauugaagguugaagaauugucuuuuuaaagacaaacuugaguaccaugaucuccgcucuggaauaauaaggaacaugggaguaaucauuuuuauucugaaucaucuaggcacgaaaaugcauauaaugaaauacguauauguucacucacgaguucauuccacaaacaccaaucaacccacugugucaagcucugaguuagaacaguacccagcuaugagguguggcaguucaugcuuuuuaugccagcaguugagagacagaggaagguagaucucugugaguucagggucagccuggucuacagagugaauuucaggucagcuggggugacaucuugucuccagaaacaaaauguaggacaauacucaaagcccucucccccaguggagaagaucccauuguguugcugauggagacacauuaaaacuucaaugacuuuacagagauacaagauaagggguagaggucacaugggcgacaauuaagcugggagacugggggaacaugugugauucucacaacaguccccugagaugaacacagccaaccacaguugucacagaagggaaggacacacaagaaaucagaguugcuccuaagguuccacauaugguuagugguuuuccuuagcuucauuuuuaauuucucgucuguguguguguguguguguauguguguguguguuuaugguuauugguuuuccuuagcuucauuuuuaauuucucguguguguguguguguguguguguguguguguuugauauauaugccauggugagugugugaaaguuaagagggcaguuuguaggauuugauucucuuuccaccauuugggucccaguaauugagcccaggugucaggcuugguggcaaguaccuuuacccgaugagccauuucgccugcccuaauuaguguuuuuuuuuguuuuuguuuuuugguuuuuuaaauuuugauuaaugugggaaguaucugaaaagcuuuaaaacuauguguccccuugaguccuuccuauaauccucaguguuucaaggauucuauuguucuguuuuugcuuuuuaugucuguuauuguugcuucugcugcuguuguugcuuuucauagaagugcuggggucguuaugcuguccgcugcuuguagccccugucaucucugcuuacuuucuuucagaacauggcccaguuuuccguuuuaccaccaagacauuaaaacagcauggcugacacaagaagacguucuacuucuagucuuugggggauuuugcuuaaacaaaaaugggaaagauccgcagccuucaugccuuugccuagaaagaaagacacuguuagcgacucaaccaagaucccaacuccuccgggacccagaaggaaagcagacagccugccaaacagagccggagagcacaucugucucacuuucccuauuaaacugacaacaaggauuacuagugaaaacauccacuacccuacagcgcuaaggagccaauacgagcucgagaugggacugugugauuguaaacuggcgccauguuuccgacacuugguauucuaagaguuucucuugaagaaguuaugagauauuccuucaaagaaucauguguaaagaagaauauuaccugccauaguaaaauaaucaaaacuaucugaauaucaaaaaaaauuagcugugccguguuuccguuauacuuagguuauggagcaaucaaguggaaaucauguuuccucacgaagaaaugauuaaucuuuuucucuacuuuuaaauauaaucaaauaauaaagcuguaaaaauuaaaauggacuuagagaacuuugaaacuccuuugguggugaagugaagacaacaacaauaauauaacugcgcuguguaugugaaucaagauauauaagccaaauaacccccuuucccaaauaaagaaauaaaggaaaaugcugugugaggagcuuacuaaaccuuugcuaagaaagauccugggucaccacacagcuaagaugauguaacugagaaagccaaggccgguguuuaaugcaagccagugugacucaucacaguguaucgagaguugacacauaaucaguuggcaauuuuuuucuuuuguuuaaaagaagaaaguagaagccuaacuuuuuauuuuucaaauuacuguuguuacaggugcccuacagcgcccguaaagggucuguaaagugagugugccugugucugaaauugacuucaagauaauaagcuguugauuguaagcaauaaaugaauuauuugcuccaguguuaaugucgagcgaggcccuggauaagugcaauuguuacuuccgcccauguugcagugcucccaucucuggcuguaagcaguccguggagacuccgugaggccugaucagggcuuuagguuguuuuuacucacugcagugucaacacuucuuuccccuuagccacugcggggugggcauccguuuuguugccuuuagaaaaugcugcucucuucaacauggagaaugacuuucuucaguggccuuucuagcaucaugugcaggcuucuuccccuuuuccuuaauccuucaucaugaugaaacaugcauauaaucacugggucuggcucaacaugaugcuguccguucuguccaucuuccuacggguaucguaauuccauucuuuuucugacaagaugaaaucuccuuguguauccuuuccgcauccuuauccaugcauguguugauggacgugugggcugcucccauaauguaccuguucugaguaguguuucaauaaacaucaguuugcagacuucucagaugaucag

SEQ ID NO: 12324 - RNA, 4745 nt, Mus musculus
gagggggcggggccggcggcggugcagaacgcugcagcucagugccugcgggcucccuacccggcgugagucgucugugccggcggugcgguucccaggcgcuagcgcucgagcguucccaggacgcucaccgaagcuacugggucuccagaggggaggagccgcucagagaccaggcuguagcaaucucacggccggcgaaggaccauuucugccacagaccggggacaagggcauguugggcggcagcagugacgcgggccuggccaccgccgcggcgcgggggcaaguggagacggugcggcagcuccuggaagccggcgcagaucccaacgcccugaaccgcuucgggaggcgcccaauccagguagcgaggguccccaggccuuaccggcagagggcgcacgagcgcggugcccuccgcggcugugaguuguaacugggcaccaccugggcagcccucuggugcuggcugugugcgggcccgacgggaggcagguuuugcaagagcaaaaauccugaaaaacaaaaacgaucgaaacaucccucggcacuagauugguuuuuuuuuucuuccuuuugcgacgcugggucugguuccguacaagcugggcaagugcgcuaucugggagcaaugucuccagcccccgaaucuuugcugcaaagguggaaaaauauaccaguauuuauucugccaucuuacagucauagaaagaagccaacacucagagagcaaauuguaaaagggagggucagauagagagaaggacacgauaacgaugagauuaccgguuacauggccuagauuggggaaucccacagaauuggagugcguggggcgagggaguucacugugaacuugugaacaacgguaugaauccuuuuuuuuuucucguuccucauaaacuuaaggauuucuccaacccagcacuuaauuccuuguaugcgggcaguaacaauguguaguuuuucacuguuuaacaggcacagcccucccaacagaacacuuggguccuuucuuucgggacgacaaagagguucccuaaacauucauuuagggacaaauugagauacauuuguucaguguuuacuaaugcuuuugugcucuccugaugauuaauauagucgccguuuucacucaccucacuguccaucucugggacuaugaaaaucagcacuccuguuaauaguaugguuuaggaaagguaccauuucucuucaguuuuuaugaaaaagggguguuuaacaaaagaauuuuuuaaaaguuaaaaaaaaauuguaaagugaguauaaagaccguauaaaaaauuuuauuuauggcuuuuacuaaaaacuuuuaaaucuuuuugccgcuguaaaaacagcccuuaccucgccaaaagaaagaaaaagguuauuguguuccuugaaggaaggaauauuucuaauguuaauauaauuuaaaacugucacaugaucauugccacuguguaaauuucaaagcacauagguccaccagaaccagugacuguuuaagacagauaccaaaaccuguuuuauuacuaacuuaaaauguagaagcaaauguuugcacaguguacaacauacacaaauagcugcaauggggagugcaucuucaaaacguuguugguuuuucuuaauuaugcauuuuuugauuuuagguaagagucaaacuuuuuauacagaaacaaaaucaccauuaaaauuuuuguacaauauaaaugaauguuaauuucauguuacaguguauguucacuguauaucauacuagguuaaaauguucuaagaggcuuuguuuccauaauguuauauaagcuuaggaugugacagcuuucuccugaucuccuaugcacaaaugaucagacuacauacagugugugagcacagacauucaugacauugaaggagcaaaaccuuuuuaaaaacugccuuguuuguuuucucaaaacaaacaaacaaauaaacaacccauuaugugguguccucauuugcuuucuguugcugugaggaacaccaggagcaaauggagcuuagagagaaaggguuuugacuggcuuacauuuaauugcuacagugcauuucugaugaagucaaggcuggaaccaaagcagagaucauggagaaacacugcuuacuggcuugcucaaggcucaaagucaaccaucuuucuuccaggacaugugggacauacacccagaguggacuggaacccccacacauacacauuugucauuaaccaagaaaaugucccacagaccaaucugguggaggcuuuuuucagcugagguuccucuucccaaauuagugugucaaacuaaccagugaguaugguuggccagaccuggaggguuagagggaaacaauaugaaacuuuauauauaaagccugguuucugguguucugccugcaagacaaggcaagguuggcacaaacuaugagaguaaccaaccaauaaugccugacuuaaggcccacuccacaagauggagcugacauugcuugagugaucaagguccagagacuauagcucagcaaacuaggguaaaaccaaauaguauuguuccaaaaaaggaaaaaaaaaaaaguaccaauaaaaugacauucugcuguacuuagacauguccggucuugcucagccauccucagagaagcuuccuucuacagcagacaugaacagauacagaacccacagccagacaauaugagagaccuuggaacacucaggcuuaagugggugucuccaucaccucccucccccacagggcuaagggaacccugcagaagagaagguagaaauaguguaagagccagaggggaugggggauaccaaggaaacaagauccucugaaugaucaaagcucuuaacucaagagacuaaggcggucugcaucugcaccuacaccucuaaccugcacuggauccuuuguguguuauauuauggcucccaguuuaauguuuuuauagaacucccgagugugugaaagagugggucucuugaguccgguaccuucucuugugcuuuuuuccccucuguuuuguucaauuccaauguauuaguuuuugucuugucuuauauuguaugcuaucacuuagaagccagauuguuuuguuuuggauuuugguuuuuguuuuuuucgagacaggguuucucuguguagcccuggcuguccuggaacucacuuuguagaccaggcuggucucaaacucagaaauccaccugccucugccucccaagugcugggauuaaaggugugagccaccacgggccggccagauuguuuucuaacaagggaaccgauccaauccgaugagaagggagauggggaggagcugggaauguaaggaggggauaucguaagcagaauuuaugugaggggaaaggucgauuuucaggaaaaggguaaaauaaaguauuuuuuauaaaguucagacuaagcuaauaaaucacuuaacgaaauaagucucuguuguccaacguuucauauaagaaauaagccauuucuccgcccuuucuuauugcuucaccuguggagaauaaaauggaaucuaugcugaguucagccuaggcuaugauggguggggaauggauugaguaagcaaaagagaaaucagacaccugaagcuugcaagcacccuugcugccucccacccccaccccacuagaaacgucaguaucaguuuuguaaugucugaggcucuuuaucuucuuuuccccucaggucaugaugaugggcagcgcccagguggcagagcugcugcugcuccacggagcagaacccaacugcgccgacccugccacccuuaccagaccugugcacgacgcagcucgggaaggcuuccuggacacgcuugucgugcugcaccgggcaggggcgcggcuggaugugugugacgccuggggccgccugccgguagacuuggcugaagagcagggccaccgugacauugcgagguaucugcacgcugccacuggagauugacugcggguucccuccgccuuccgcaaggacuucuuucuccccagccccaucuaggaagacugcaagcacgaagagggccaccagcgcccagccugcaggccuuccaaaacuugaacccuacccaguaagacaaagccaaucagaaauaacuuccuacgcauuuucugcagcuggaucugguccuugagccucaccuugaagccaaggggaucaccaaggagauuuaguauuguaugaaguucccgggcccucuaccuuucaggacgcgguguaaaauagcaagggaaauucuuggaucuccacaagcugcugcugcaggggaacuggagacagcuugacauuuguuugacauuugggugggugcagucaguaccuuccccugugaacugaaaaugcagaugauccacaggcuaaaugggaaaccuggagaguagaugagaggcacugaagugguuuuauguacugucauguguggggauucaccugcaaaauggcauuuauagaaacugagaagucaccuccagcucgacaaggaaauagugaaauugaagacaauaaauuuccacuaaacugugacccacaguugccuugaugccuggauucugacagacucaacguccacaaagcccagugaugaauuguagugguagcagguuacucuaugcaaaauaguuuaauaaccacuuuagaaauuuccuacauuugaguugcucuuuaauaacaguguauuuaaagaaaaaaaaauuuaaagaaacagugaaguuca

SEQ ID NO: 12325 - RNA, 1365 nt, Mus musculus
ucaaugcaccaguuuauuuaucagcucaaaucaucaccugucagaagauacucuaaaaagaucucuggaggccaacacacgagaauauauuaaacauauguggauuggaaugacgggcaauuauaaauauuuuuuucuuuauaaaaagguaguacuucaugggcuauccaagucagcaauuuacaaaacacacuuaaaagguggguuguauaagagaaaagagcagaguuuuuggacaguagaaugaacaggcaucaccaaucaaauacacuauucauccuucaaagcaucaaagauggggggggggggagggguggcaaaaaaacugguccucacaacacuuugaaaacuucaagaauuuaggaggugcgaccaggcacccaguucuugcugcuuuaaagcaggucuuagaguuguuggaccccucucaacacaccagcaguguacuuggcaguugcuuugcacaagugggaacugggaaacucuugcuucucuuucuccaucaggccaacggauuuggcgccuggaagugcccuuggguggggcuggaguucaggagcucaggacuucaaacuuccgcgugcugagaggggcggagcccggaguacuacggaggcggggcgcgcgcaggucccaccucccuccgugcccucggacuacagccagggccucggaacguccggaucaugggcgcacaggccgguggcaguuucuuggagcgguggcuccucgauggcucccggcgggcgcgcgcccugcugcucuaggugcagcugcaggagcgcucggcgguacaugaccuccagcuucucuagccgggcccgcagcgcccuggggcugcccggcuccuccucacggccauggccucucgccuugcgguugguggcgggcucguccggggcgagggucucgacggcggccucccgcucgccgcugucgcccggcagccgcagagccuggcggaagaggcugcgguucucgcgccugagccgacgguucuccagccucaggcgggcguucuccucgcgcagccgcgcguucugccggucccgcucgucccgcgcgcgcagggccuccagguggcuggccgccaggucggcgaagcgcuccuccagcugucgccgggccccgcccgcgcggccucgccagcccacgccgccaccgccaccgccgcccucacgggcccggcccaggcggcccgacucgccgcggcucccgccgccuuccccgccgcagcucccgcgccggguggcgccaccacgcaugcgccacaucgguccggucuggucgcgccgccaguccguggcccgaggggccgcgcgcggggcgcgggcggacuuggggccuggcugggcgcucggucgc

SEQ ID NO: 12326 - RNA, 18477 nt, Mus musculus
caugguucggccacugucccuuggagagcuaccucccagcuacacaccuccagcucgguccuccgcaccucaugugaguagaggggcuggguuuguaacuuaaacgucgcuugaacaucuguagggcuagaagucuaguguuacuggaucuguguuugaagacaagcgagagccagcaagugauuuguuaguuuauuuccuauuaucuggucagugaaaauaguuaugucuguggguucaccucuuugccuagcugacaacgaguguguguguucacgacucauaaccuucuaaaaaugggcauuuucaggugugcuuauggagaaggcacagggaaagagaguuaaaucuuccacauuugaaaccuuuaucuguagcuguuuccugcccugcauccagaagucaggaaacugggacuugaccgggagaaaagggaaagcuccuccauuguugugcugacagcuggcugaccuccuccucucucuaucccagauccuagcugggagccugcaggcuccucucuggcuucgagcuuacuuccaaggucuacucuucucccuggggugcaggauccagaaacacugcggcaaagugcucuuccugggacugguggccuuuggggcucuggcacugggucuccgaguggcuguaauugagacagaccuagaacagcucuggguagaaggugaguuacuggagcuggccguagcugcuuuggucaaggaucgagagggccaucuccuguucagagccuguguaucuggguguguugcagaaagccuaccucucucccaaucucccucagugcuguggaugaagcccagggcauugugcaagcuaggcaagucuuuaccaucaacugucucacaccuaucucucucacccauaaauggacaacucuagaugguagccucuuaugaauaagcuuguggaauauucaucuuugauuaugugucugcuuauuuagcguuuauagcuagguuucuuuuaacuguacaucagaguuuacaaauggaacaagauguauuuuucaauagccaaaggaaguaaaauguguguggggguaaguucuaaacaaaacaaagccaagugguauuguguuguauaagagaaggcagggagagacggcucugaccugcaaacucagauuagcacugugauucuaacuacucaaggggcugaggcaagagaaauacuuucagucuaagaauuuaacaauagccugugucagagagagagagagagagagggacagacggacagauggaagagagggagggagggagggaggaaggaaggaaggaaggaaggaaggaaggaaggaaggaaggaaggaagaucagugggauguagcuggguggcauggcagacugccugucgagcaugcuguggugggggagagagauggaggaggagcaagaagaaaaagaaaaguuagugcuugguggcagcagugguggugcacagcuuuaauguuuaaccucagugcuugggaucuggaggcagguggggccagccuggucuacagagaauuccaggaucuggaggcagguggggccagccuggucuacagagaauuccaggacagccagagcugcaugaaaauacucucucucgaaaaaccaaaaagaaagauuggaaggaaggaagggggaaaggggaaaacaagaaauaauaagaaaagaauuguuagguguaaaagaaaagaaaaccuugaacgagccaucugaccaggcuucugaguagacacccagggaccugcagccauuuaaugaagaaugagcauagacuuugaggcaaaagucagggucaaaugagaccaaauccucacguccuaguggaaggauuacacaacucauaauuucagcaugccucucuucuuuccuggugccugguuucauguggcugcuauuugacaaaggcaaauucaacuguguucuucccugggaaaucugcauuugugggcuccccagaccucccuagcccuggcccagacccaaggcaggccccaggucgcagccucacacccuggaguuauuucaaaugcuggcaaguccuaggauacagagcagauguuucuuggagccuuccuacaucauaggcucccacaccccaucuccacccuacccccagcccucugcagacucuuagcguucacacucuuaagacagcccuaggguccagagcagauguuucucccugccugccagucugcccccagcaucaggacacacaugugcgcacacgcauauaugcaugcccccacacaaaccacugcugcuuggguggucccaaauaacuucugaauauccugccacaauagagugagucucccucccaggcccugccuuuccucucucugcauuccccggaucuuccccaauuaaacacugcuuggaugucuacauuugcucaucccucuccggccccccuggcuagucccugcaguuaugagaaauguauuauaagaggguagcaguuggucucuuugagauaggaauucccugugucaccucagcgaccuugaccuuggguccuccugcaguggaccccuuuguguugagauuaguaagaccacagucucacuggucuuuucucuauagcugaggaguuaguugauggaguugagagcugaagagacauuuuugcuuccuguuuugcuaggacuggaaguggaagaagcaagacccucaguuagcagaguuucaaauagaggucaagacucuccuuggcuguaaaugugguguguuuuccuuuccuuuuuuguuuuuguuuuuuguuuucuguuguuguuguuguuguuguuguagguuagggaccaaacaccaauacccugaucaacuuaaaacuaagaaacuugcugggcagugguggagugcaccuaggaggcagaggccagaggaucucugagcuugaggccagcuuggucuuaagaguuucagcuggugguggcgcacgccuuuaaucccagcacucgggaggcagaggcagguggauuucugaguuugaggccagccuggucuacaaaaugaguuccaggacagccagggcuauacagagaaacccugucucagaaaaagaaaaaaaaaaaaaaagagugaguuucagagcaggcagaaaccccugucucaaauaaaaaauaaaaaaauuuaaaaaaaggagguggagccucaaaaguaaauaguuauuaggccggaagugucucagugaguaaagcacuuccggugcacacggaaccugaguuuggauccccagcaucuguguaaaagucagguacagcagcgcacaccuguaaccccagcacugggcgaguguggcaggggcauucugagauuggcagcucaucugacagaacccaugggcuccagcucaggcagaaaccuugucuccaaaacagaagguggagggacugcaaagaugccuuaguaguuaggagcacuugcugugcaguuccgaggaccagaguucagaucccaaugccccugugauaaacugaguaucacacauacacacacacacacacacacacacacacacacacauacacggcaucaaaggaguguaagcaggaggaucucugggauuuguuggcuucaggccuagcugagaaaacguaaaacccagcuucaaagaggcagaggacaccuucuuugauggacacaggcaugcgcaccugcacacacacagauaggucugugaguuacaaugcuaucauguacccugacuugaagguaaggcgcagacagcuguuugauguggaaggcaggggaucagcacccaccuauugguggagccugcagcugccccaugcucaguccccaggagcuaguagucucaggagcucaucucgguuccugucuuuagagucucucacagccagcccgcccuuccacccugugguggugccauuguuaaggugaucucaaucuuccacgaacacuguaauuauacauuggaguccuugcagccacaugaaagagaaagaaaggggguucauagagcaggaaggaagaggcugggguuuuauucuuguaacaggagauuuggcaauagagaauucuggggugauuagucugucagacaaaggacauuagccaggacccauguucucucuucucucuucuguccucagcacaugagacuuaucccagugggcugcagagcgaguucaagaccagucuugagaacuuauugcaauggugucucaacacuaaagcgcuagggccagggcgggaugcucagugggucagugcuugcugcacaagcuugugggcugcacugugaauucccaacacccacgcagaggcuguggagcgcacaucuguaacuccagcacagagggagagcagagcggacacacguggauccugcaccuugcuggcaagccgauauagcagaaggggcgagauccagguucacugagaagaccugucucaaaaaauagagugauggacaccugacaucaaccucuggccuucacacacacacacauacacacacaagcacacgcacacacgcaugcacauagacacaggcauaugcacaggcaaacacaaacacagacauauauacaugcacacacacagacaagugcacauggauuagcacacauacacaggcacacacacagucacacauacacaaacacacacuggcacacacacgcacaauuaaaaguacuuuuuaaaaaucuguacugguagugagcuaagcuagcaugccaugggccuacauucaauacuaaauacagauggauagauggauggauagacagaccgacgaacagacagaauaaaguugggggggggaucgagaagccuuccagccaauuuccugucuguucuacuugucaagaauauauuacugguaaauucuucacucaucgaagugcagugugguuguaagaugguccauggaaaauguggacucacccgguggcgcuagagaggagucucaccggccugucugaggauggucagggaagucagcuagcaaaggggcuaaggaaacaauuagccuccacaucgcccccugggguacauauaaaccuggccaagucaguuccugccuggagccuuccuguccugugcuuccuuccugucagauccugugaaggcucagacucuuacgugagcccugaacacacgcucuaggcccuggucuggcuucuucagcagaguuauggugccucccuggcucacacuugugguuuucuuaugugcauggguguuugucugcauguaugucuguguaccauauguuugccaagugccugcagaggcuagaaaaaaauaacagaugcccuggagcugguguuacagacagcugugggccaccauguaggugccaguaaucgaacucgcuccuccgaaagaacaaccagcuccuuagcugcugugccaacucuccgacuaaagcccuuugguucuuucuuaacacgaucaaacccccaaaccuuuaauagugcauagcccuggauucugaacccccuuuccuaauucaugggccaguucuuacuggcuugucaggaagugaaaacaucaggucgucugaggcucuguucggagccuacaaugauuccuguucccucacagggccugacuuucugucauaguuccuaggcccuuacaggcacaauuuuuggacugguguuugaaagcauggauacugaaauaauguaccaaaugacgcuccauggggaccucuauaagccggcagugcugccaauuuuaaauuuuuuuauugauuuaguaaauaguaauccguugcugucuuauuauucaaacaggaucgccacaguaguucacguuggccuuaaacucacaacaauccuaccccagcuacuuaaauacuggccucggcuacauagaaaguacucaguccagcacugaggccagccuggacuacgugaaaccccauugcaaaaaauaaaaagaaagccacagaaagcagaggugcgagaggacgcagcugguagagugcuuuucuagccuucgggaaacccuggcuucaauuccaggcacuacacagaagcaggcaugcuuaucucugcaggaggcagggaacuuaccauagcaaggucagccugggcuacauaagacccucucuuuaagaaaggcgccuuggguuagggggaugugccuuagggcagggcacuugccugucaugugcuguucccucagagguagcaucuacacugguuuaaccaauuaugucccuuuuuguaaaggaaccugcccucagcagaugucaucauugucuguccuccugcuuuuucccaacugucccuucucucuccuaguucccuccuuuuucugacaugucauuucucuccuggcaacucuuggcuacaauuccauaucuuaccuauggugccaggcaggucuuaggucucuuuuuuuuaaugauuuauuuuuauuuuaugugcauugguguuuggccugcaugugugucugugugaggggucagauccccuggaacaugaguuacagacugugagcugccaugugggugcugggaauugaaccuggguccuguggaagaguagccagugcucuaaccacucagccaucucuccagcccuaccugccuuuauccuaauacuaccaagguggacacuaucuguuuuuuaguuuggucguuugguugguugguuugguguuugagacaggggcucauuguauaaccaggcuguaggcccaugaaauugaacauuagcgacccucccucccuuguacggugugugcucucugcucugguaucggucaccagccuugccagcugacauuuaacuuucucuguccacaguuuacccagaggauucuuuagucuuccaguguguuugaagugaacuguguuucuuacuccagccuucuuauugugucucucccaguuucuucucccccaugccuccauguccauccuuacagggggguuccucucugcccugcccuccuuccuucuguguagcagccauuauucccagccugguggaaaaaauacugcaauauagucggagagcacuguggcaguacaggaccauuccugggggagggcaaaggauugaaccugcguagaaaccuaaauugggacguuaucagggguuugaggagagccuguggucuuggaaaaggaauuggcuacugggaaugguggcgcacacuuguaauccuagcauuuggaaaguagaggcaggaggauuguccugaguuugagaccauccugacuacacagugaguucuagaucaggcaggacuaccgagggagcaggagaggggaaggaguaggugaaggcggaucucacgccuggauucgggaggaugacagaggccaacaagaaaggccuccaggcaagaaaaagccagacagagucugggagcagaccagagccacaaugucccugguguggcucuuacccuccucccgaucguaagcgguaucccccccaaaauguuccuuccuagccggaugugguggcuccugccuuuaguuccagcauguagaaagcagaggccuguggaucucugagaguucaaacaaaauugaguuccaggagagccagggcuguuaacacagagaagcccugucucgaaaagcaaaaagaacaacagaaauccccauccuuucucgaguccccguuauacagugugacuccauggcugacagggaugcugggauuaagaacucagggcaggccuccuggcucucaccucagugaggcuggggagggaccuggagcuccugagucuccuugauuucaucucugccgcaucuugcccugguggcaggaagcgucacacugaagacccacccucucccuugcgcaugggcugcaggacaucgucacagagugcagccaucacugcaccaggcagucggacuagaauuauccuguagaccugauuuucuguaaacccuccccacaggccccagggccccuccucauccugcccagccaagcagagagggucugagggcugcugaccuguggaugguucuggaacccugaaagcucagcucacacugaucuuugccuuuugguguagugggauggagccccgggcccugcacauccugugcaagagcuccagcacugacuuacacaccuauucacgugugugugcaagcauuugcguuggaucccagccaaugugggucagucacgcuuaaaaugugggaccaccauagaguuccguagcuguggcuucuccacagcccuaaguggggaagaagaucgcagggguagggggcaaagccaccaaggagaaggcagagaugucuccacagcauuucuuucccucagggguugggaccccaucucccaggccuccgguuuaaccugggcccuucucccagcccuuuucucugugcucuggcagugggcagcagggugagccaggagcugcacuacaccaaggagaagcugggggaagaggcugcguacaccucccagauguugauucagacugcgcaccaggaagggggaaacguccucacccccgaggcacuugacuugcaccuccaggcggcgcucacugccaguaaaguccaaguaucacucuaugggaaguaaguccaggggaggccccuggggagggggcguugccgggcacugugugaagguucuagaaugaggguccaucuucugcugaucaccugugcccgggccauuacagauccugggauuugaacaagaucugcuacaaaucagggguuccccuuauugaaaaugggaugaucgagcgggugaguacccccuaggcuguucccaggugcugguggaggcauugugggaggucugaggcucaggcguggggggguugggagaugacagagggugucguagagcaggacugaugcgacccgggugucccuggcagaugauugagaagcuguuucccugugugauccucaccccgcuugacugcuucugggaaggagccaaacuccaagggggcucugccuacuugccgugagugccgccccagccagccgccccuucacccguuucaucuccugccagggacuccccugcagaaaggggaggugugggggcaugaaugaaaaaaaggagauccuugccaaguucugacugccucccaggacaggaucagagagagccugggcugcccaaggcuucccaccugccuccccucacccacggagggaaggggaccuguguggcucagacagaacacacagauccucaggcaaagaucugucugagacuuuccugcacacaucagccagcugucagcugacuuucugcuuagacugaaaagaaagccuguuagaugcagguguguguccgguuacagguuaggaccaaagguagacauucuggacccguccacauagugggcacgcccaucccaagucuuagucccuuucauguccaaagcucucgugugcgggugcagccuagcagcugaggcgagcugagcccugcacacucuccuuagggaaggacgacggaucaguguguaagagauucucgcagugaagcagggcguaugcagcagcagucugucugggggcaggcgcugcguuuugaccuucacuaaccucaggcuuuccccaggggccgcccugauauccaguggaccaaccuggacccucagcagcugcucgaggagcugggccccuuugccucucuggagggcuuccgggaacugcuagauaaggcacaggugggccaggccuauguggggcgacccugucuggacccugaugacccccacuguccaccuagugcucccaaccggcacagcaggcagguggguuccuggacaggucugccaagaaagauggcuucccagccuucucucucaccuguguguuuguguguucuaaggggugcucccgccaccuccauuuucugaacacacacacacacacacaguguuccauucucauucauuucuuucuuuuuuuuuuuuuuuuauuauauuuaaguacacuguagcuguccucagacacuccagaagagggagucagaucucguuacggaugguugugagccaccaugugguugcugggauuugaacuccugaccuucagaagagcagucgggugcucuuacccacugagccaucucaccagcccucucauucauuucuaaagaacccucaaguggcacacaaaucacuuuuuuuuuuuaauuaaauguaggugugcaccugaaugcaagugaguauaggcgccagaggagacccaaguguuggguccccuguaagugguauuucugacaguuguaagcugccuggcauuggugcugggggccaagcuccacucccuuggaagugcagccugugcccuucaccacccacugagcgagcaagccaucucugcagccccagcuccucuuguuuuguuuuucaguucuugguuuuguucuuuuuccuuuguuguuaugugguugguguguuugggggcugggauaagacagggucucacuauccagcccugauuggccuggaaccugcuguguagacggcacugagcucacagagacucaccugcugccaucucccuaagugcuaggacuaaagccugcauugcacuuuuaguucuguuuuguuuuuaagauuuauuugugugagugugugugugugaguguguguguguguguguguguguauguguguguguguguguguguguguguguguguguguguguguuugcucgcgccugugcauguguaaaaaagagagagaccuaugugcgcauaugggugccuguggaugccagaagaaggugugagaccucgcucaggcugcagauacuugugagcugugguuaugccuccuuccagcagccuguuuccaggccugugauuguuccuguaaccccuguggaauacuagcuguuaggagaggagagucagguccacugaguucugugucaggcaugggucuuagaggugcaagcccagacacuuucucuacuugcacucucucucucucucucucucucucucucucucucucucucucucucucucugucucacacacacacacacacacacacacacacacacacacagacacguguccuaagcccugagcuuacaugcuaugucucuucuuugguauguggugggaaugguaauugaguccagagcuggcuaggcaagugcucuaucacugagcguuaucccugagcaccuggagcucuggguauuuuaaaccucucucuggugcugagauggcucagccuuuaagguaaaggcauuugccaccaggucuagugaccagaguuugauucccaggccaggggccacaugauggaaagagagaacuauuucucagaagcugugcuuugaccuccacauacaugcuauuacaugcuugcauguucacuuacaugccuacacacacacaaacaauaagcauaacuuuuaaaauucuaaaguugugagcuagcauguaguugcugggacuugaacuuggguccucugaaagagcaaucagugcucuuaaccacugagccaucucuccagccuaauucuaaagauaagcuccuuucuguuccacucuaggcucccaauguggcucaggagcugagugggggcugccauggcuucucccacaaguucaugcacuggcaggaggaacugcuacuagggggcacagccagagaucuccaaggacagcugcugaggucgggccuccccugggacuuggugaggggacuugggaauugacacugucaggcuaaacagcucuggacagagcaccccacagacccacacugaguguccaggcucugacucccacucccacuccccugaccagggcagaggccuugcagagcaccuuccugcucaugaguccccgucagcuguacgagcacuuccggggcgacuaccagacacaugacaucggcuggagcgaggagcaggccagcauggugcugcaggccuggcagaggcgcuuugugcaggucaguaugggcaaggcccgaggaggguucccgaggccacgccuucccccuguccccucucacucacccagucucuccagcuagcccaggaggcucugccggccaacgcgucccagcagauccaugccuucuccuccaccacccuggaugacauccugcgcgcguucucugaagucagcaccacccgugugguaggaggcuaucugcuuaugguggguccugcuucaagcaaccuugccuccccuccagcaaguuucccuagaaaucccugucugagaucucaugucgucucuccccacagcuggccuaugccugcguaacaaugcugcggugggacugcgcccagucccagggugccguaggucuugcugggguguugcugguggcccuggcgguggccucaggucuugggcuuugugcccuacuuggcaucacuuucaaugcugccacuacacagguaaaccagaacuggggguagggggccagccuuugggggccaccuccaagcuacacagucccuccagauguuugauucccugcucugccccuccaggugcugcccuucuuggcucugggcauuggcguggaugacaucuuccugcuggcgcaugccuucacaaaagccccaccugacaccccucucccaguaagcacccauccaccagcuugaacccauccagaauucaucaaagugguuaagagccucuuggucugauuaaucgugucugguuguaaccuuucugaguugagcauucucuucuccccgcauggaaauggguguaaugcuaguugugucccaaggguugacguaaaaccagugacguaauucaagacuggugcuuagaacagcagaugcccauucauggcacacaacagauguugacugcugcggccucagaauugcauuucugcugcugaguuccugagccuccacucacucugccacaguccucuguggccugaaggucugucccugcucuguccuggcaggagcguaugggugaguguuugaggagcacgggcaccagcguggcacucacauccgucaacaacauggucgccuuuuucauggcugcccugguucccauuccugcgcugcgggccuucucccugcaggugaggcgucgcgaaugggcaggcgggcuggggugggcauggagcacggagcaggcuucauccggccuccuccgccaccuccugucuccccaggcagccauaguggucggcugcaacuuugcagcgguaaugcucgucuucccugccauccucagccucgaccugcgccggcgccaccgccaacgccuggacguucucugcugcuuuucuagguacuguuccuucaugcccgcccuuucccguccucagccucgcccuagccugugcccugcccugcauuccagccuaugacccaucugcucugucugacccuuccagccccugcuccgcucaggucauucagaugcugccccaggagcuaggggacagagcaguaccagugggcauugcccaccugacugccaccgugcaagccuucacccacugcgaagccagcagccagcauguagucaccauuuugccuccucaagcccaccugcugucuccagcuucugacccacugggcuccgaacucuauagcccuggagggucuacacgggaccuucucagucaggaggaggggacagggccacaggcggccugcaggccccugcucugugcccacuggacucucgcccauuuugcccgcuaucaguuugcaccuuuacugcuccagacacgagccaagguuaguccagguggguggggcaggauggaggcucagucugucuguuccaagaagggcagagggcugggggucagcccugggccuccugcuuaguucucauuucucacaggcccugguguugcuguucuuuggggcucuuuugggccugagccucuauggagccaccuugguacaagaugggcuggcccugacagauguggucccuaggggcaccaaggaacaugcuuuccugagcgcccagcucagguacuucucccuguacgagguggcucuagugacacaggguggcuuugacuacgcccacucccaacgcgcccucuuugaucugcaccagcgcuucagcucccucaaggcugugcugcccccaccugccacccaggcaccccgcaccuggcuucacuacuaccgcagcuggcuacaggguaagaggccaagagaccaacgggcagaaauggcacagggcgccguguuuagaacuguagguggauccugguccaucccgugugccuccagguauccaggcugcauuugaccaagacugggcuucugggcgcaucaccugccacucuuaccgcaacggcucagaagauggcgcccuggccuacaagcugcucauccaaaccgggaaugcccaggagccucuggauuucagccagguaaaaggggagcugacuugggcaaggagcacuggugggcuccagaccccacgggccaggccuuuagccaccucugccuucacagcugaccacaaggaaacugguggacaaggagggacucauucccccagagcucuucuacauggggcuaaccgugugggugagcagcgacccccugggccucgcagccucucaggccaacuucuaccccccaccuccagaguggcuucacgacaaauaugauaccaccggggagaaccuucgcagugagucccaugggagcucgcccggaaccugguccucagcccacacaggcccugacccuccaaccccucacugcgcccacuccaucuggucccucugcuccuccauccucuccacagucccggcagcccagcccuuggaguuugcccaguuccccuuccugcugcauggacuccagaagacugcagacuuuguagaagccaucgaaggggccagggcggcaugcacagaggcaggccaggcaggggugcaugccuaccccaguggcucccccuuccucuucugggagcaguaucugggucuucggcgcugcuuccugcuggcagucugcaucuugcuggugugcaccuuccucgucugugcccugcuucuacucagcccguggacagcuggccucauagugaguauuggcaggguggaugggagaguccccagcagcaacccacccugcccugucuggaccagcgcuccuccugccgggagcccuggguaagcccuacccuccgcaggugcugguccuggcaaugaugacuguggagcucuuugguaucaugggauuccugggcaucaaacugagugccauccccgugguaauccucguggccucuauaggcauugguguugaauucacaguucacguggcucugguaagcauagaccccaagaggaaaggucaggugauggguuuuuaacaacaaacaacaaaauuggugagaucaccuucugugugcugggugugguggcacagaggaccuggguucaagucccagcacccacaggugguucacaacucucuuuaacucaagauccaggggaccugcccccccucuucugaucucuuugcauuagguacacaccugguacucauacaugcaugcaugcaugcaagcaaaacacauacauaaaauuaauaaaucuagaaagaauuauaaaggggccggagagauggcucagugguuaagagcacugacugcucuuccagggauccugaguucaauucccagcaaccacaugguggcucacaaccaucuguaaugggguuugaugucuucuucuggcgugucugaagagagcaauggugguacacucauauugcauaaaauaaauaaauaaauauuaaaaaauaaaaagaaagaggacuuaaaccuaguacaguagagccucgccuucauacagaagguccugaguugaagcuccaguccugaaaacgacuauuacagcaauagcauccuagccaggcguggacacacacacacacacacacacacgcacgagcaguuccaguucaugagaggcagcagcaggaacgucucaaguucaagucauuugggcuaauccgaggcauagcaagacugucucagaccuggugugcaggggcaauuccguugacaauauagccuuguucagacaagguuccaugcagcccaagcugaccucaagcucgguaauugagggugaccuuuaauaucuuuaaaaaaaaagaucuauuuauauuuauguucacugauguuuuuccuauguauaucugugugagaguaucggauacccuggaacuggagcuauagucaggugugggcugccaugugagugcugggacuugaacccaggucuucuagaaaaacagccaaugcuuuuaaaccacugagccaucuugguuuagccuuguccuaucggugagcauucaacuacugcaguauaccagccccagcuuuuauuacagccaguuauuacagguaugcacaaccauguggggcccaguuccuacaucaaguauugacuguaucccauuuauauguuuuuuaaauuguuuuuuaauuuuuauuuuauuuuauuuuauuuauuuauuuauugguuuuucgagacaggguuucucuguauagcccuggcuauccuggaacucacucuguagaccaggcuggccucaaacucagaaauccgccugccucugccucccgagugcugggauuaaaggcguguaccaccaugcccggcuguuuuuuuuuuuuuuuuuuuuuuuuuaauguguaugaguguuuugccuguacuuauauaugugcacugugugugugccuaaugcacaaagagaccagaagaggguguagagugcccuggaacuagaguuacaaaugauugagagccaccaugugggugcuggaacuugaacccagguccucugcaagagcaacaagugcccucagucaccaggcuaucucuccagccuuaauacuuauaucuuagguagucuagauggccaggaacuaaauaaauaagggccauaucuauaugagaaagaaaugaaggccuaucuggaauaguuuaaagacagaaugaggggcuggagagauggcuuggaagugaagagauggcugcucuuccagaggaccugaguucaauuugagcacccacaugguggcucacaaccaucucugaugagaucuggugcccucuucuggucugcaggcagaccgcugucugcauaauaaauaaguaaaucuuuuuguaaaaaagggaucaggacuugcaugaauaauaauagcacuguggguaugcaggagggauucuacugaaacaaaugccugagaggcaaagaaggcccagggcuccccuagagcuccacacuuggaccagcuaaagcaccagcacaccgcucuccacaguagccuuccucucccguccccacagccccacaguaacaguaagaacaaucucugagcccgcggugauggcacacgcgguagcagcagugcuuuaauggaugaguaguguacuucagccaaaccugaccagacaucauugacaccaaccugggcauugcucuguguggccagacacaucucuaguguuaccaaagugcacuccacaaugcuuccagaccauccccaugaagcuagguggccuggcccucugugggggaaggccugggugcacccaggaauggagaaauacccacgggggacacuggcuguuuagcagaggaggaacuccagggcucucuucucuccccagggcuuccugaccagccaugguagccggaaccugcgggcugcuagcgcucuggaacagaccuuugccccugugacugauggagcugucuccaccuugcugggucugcucaugcuugcugguucuaacuuugacuucaucauaagguacaagagggcuccggaagaggggacugcccacccuggccucgggugaccccgaggccuggccaccgacccucgcgcucucgugcagguauuucuuuguggugcugacggugcugacacucuugggccugcuccauggacuccugcugcugccugugcugcucucuauccuaggccccccgccacaggugaccaaacucuccuguccucacccuaagggacaggguaguaaagcaagggagggacagacccauaaccaaaggcccucaguggcuagcagagggcucagcucugaagggcccuccuaaaagagggcugaaagaggccuccucggaugcugggcuccugccccucagccuucagugggacuggccuuacuuagccuuuuaggacccagggcagaagguggguuuggcaggccuugaaaucuucaugcucugugaaaucugaccgggagccuggcuugggacuggugugucuuucagguggugcagguauacaaggagaguccacagacccuaaacuccgcugcuccacagagaggugggcucaggugggacaggccccccacccugccccagaguuuugccagagugacuaccuccaugacuguggcccuccacccaccaccucugccuggagcauacguccacccagccuccgaggagcccacauag

SEQ ID NO: 12327 - RNA, 6687 nt, Mus musculus
cauggcggacgccuuugucgguaccuggaagcuaguggacagcaagaauuuugaugacuacaugaagucacucggugagcgaacgaacggcgcaggaucuagggucaggagggccggcaaggcggucuuggcgcugagcucccagggggagugcccccaugugccucccgcaagcuccuagccaguccagacagggaauacugaggugcggaggguggccugggcugaagccacuccacuccaccccaccccaccccggccuccugggaggggggugucgcgguccaagcuuggcgagccucguagcuggaggggaaggguagaggcagcuguggccgcagagguccgggaugggaggcuuucuaggaagcaguguaggugauccggagguggaaaggggagggaaagaagggcgggaggcuggccgcaggagaaggcaaagaggagcauggugguccagaaauugaauuccgaaagggaauagagcagauaggaguguacagagccuggaggaagacuaaagaaaaucagugaauuccaucugggaagaggugaagauacagccaggcagucagcaacaagcccuaccccuccauguugggguagugaagaggccucucucuggaagaugcccugguucucaccagccugaccuucaccuacagugugugcagccaccccugggaucagucggagacgcugcugcuagagcagggcaagacgaccacuacacauaggcuucccggccgcaccagucggccaccggaucagugcuggggauagggugaagaaagccugggaucgagcagagggugucagaagaaaggugaagagcuaugaagggagaguguggcuuggggcuggggaaauuguguggugugggcggugacacaacgccuuuaaccagcacucugggaagcagaggcaggugaaucucccgaguucuaggccuggucuauacagagagaauuccaggacagccaggacuacacagagaaaccaugucuugaaaaaaaaaagaaaggaagagucccaugauuuacuuaauaggaagacagcuugggacacaugagcucaucgccucauaggaaagcccaggauuucuuuuugaagacugaacuagagccuugugcaugcccccuacugcugaguuauacuccccacucacacacacacacacacacacccucuuuuuacucuguguaacagguucucacuaacuuccccagguuggcuuugaucuuguaaccugccaucucggccuuccaaauaguugagaacccagaacuaccuagaguucuucccauuucaacaguggggaaugucacaugaaccacuuauccaagacggccccagcccuuccuuucuugccuugagcuuagauaaagaccucuaccugcggagucccuggcuauaucauccuggucuaggaggcuggggcagggaaaacaggacugugucaugccugagcuagcuuccacuccgucuuccccgggaaggagggcuggaaucggacauguugagggauguguguaguugccucucaccuacuuccagcucuucucugaaacaggcccacaaagcaauuuguccuuuugguuuggggaauggaacccaaggcccuuugcccgugcuaagcaagcacugcgacugcugaaccacaucuccagacagggcucccaccggcaccuacccuacccugaggcucuccaggaaggcagcuggucuugucuuuuaagacaggguuuuacuguguaucccuggcucuccuggaacucccuaaggagaccagguccuguugucucugccucucccgcacugggguuagagguaugagcccacacccagcuaguuggcugucaaguuagggaguacuagauuaccugggcuuaguucuguuucacugagcugccgcugccuuccuagacuucuuuuugccucagggcauguugucuucaggccauuguucugugggugcugaacccagcuuuagucaggggacugaaauucuauuuagccuaaaaauaucgacaggcugaaggccaguaaagucuagaugcaccccagcuuccagcaguaacuggcuucacuggcacccuacaccuaccuguagguggguccugggaaaacagcuugguucacugcugaagcccaacucacacagauaccaguaggcaaagccaagccucucacuucuugcuguguagccaaagcuccugacuuauccuauagaaccaaagguucuuaggacaaagcagcccagccuaguuuaagugacuucaagcacagaugguggcuugaaggguagaguauguuauuccaagaaugauauagugagacuaaaagagaguuugggaaucuaugucacuaaacucggauuauuuauuuacuuagccuuuuugagacaggguuucacuauagcccauacucuggagcuacgcagcccaagcuggccuugaauucucggcauuuccccugcuccaguccccugccucuugagugagauucuaggggagucaccaugcuuggcccguuugacuuuggcuaagacagcaccgugucucagccucguuuguaaauggaaacuauaaagcuuagguuuagggcugucccaaggauacuuggccaccacuuagagcuugugcagugugcacagcuugcagcagaugcacaauaccauagccuuauauugggcugccuccugccacaucgcugaggauggcucagagugugcuggggccagacgacagguagucaaccauggaagauuccaggaaagcuacuaacccaaagcaccaaaggcuugacccaaggggucugugaacuuuaccugcuugagggacaccugggaccuugccuaggacucagauccaaugauuaugucaggagucuccccagggacuuccaagucaugcaguugucgcuacuuuuuucagcccucuacgucugugguagacaagacuccuuuguaucucuaaccaggaggcuuugaaacugacgcugccauacagacggcagagagcacugcugucucaguuuucuggguggaaaugggagacgacccuuguccaggggacucuagaaggcaguugacgaucucuugguucuucaguccuguucuguguguucaggagacuagaagccagcggguacccagcucuggagcgacacagugcuuagcagcuuccaucugaauugugacccuguucacaucuacaaaaucuuccaggggcaggacugcgugaggggcuggcuauguggcucacaccccaugguaccuuccuugccgcuguugccgacccugcccugcauccacaugucucauauuugacaugaguuuaacagcugccgagcuaagggaaagagcuaagggaaugagaaaauggccccacacaaagacgugggccacugaggaucgccuuccccaugccuaggccacaaacuucucuuugggucuauauaacacgucucuacccuaccuaauguguccucaacuaucugccccugcccuuaggugugggcuuugccaccaggcagguggcuagcaugaccaagccuacuaccaucaucgagaagaacggggauacuaucaccauaaagacacaaaguaccuucaagaacacagagaucaacuuucagcugggaauagaguucgacgaggugacagcagaugaccggaaggucaaggugagucagagaaaggggauggagggcacuggauggaacaccacaggguaagaggcuggcccucuuagcuccuuggcuuuuuaaccccaaggggcagguucauaaagccugcucagugcugcgauggcccagggacuaaguauaagcucuggccuguuuucuucucaccuuccugggaaggaucuaucagcugucacuggagugggcagcagagccaagauauucuuccgaccuugugccuccagcuccagcugggugaccuuguacaccaagguacccaguggcucugaggacaucagcagccauggcugugaccugaaguguuuuaggaaugaugcccagaagucagugcucuacagcgaggucauccuggcucuggcagcagaggaggcagcugggaacaacaagcugaguucuauccacagguuuccugcucuguagcucccaggcuagaccacugaccggaacaaacuguuuccagugccaccaguugacaggcaccugcguuuaccaacaggagugcuguuggguguccauagucucuucaaguauuuauuuaaggguaugggagggagugucuaccuccagugaugcucaguuaucucauggugguuaucuucuuagcagcuugcucaaaaucucccagcacugggccacgcacagaacuaaguaacaucuguaucuauagguuguccuuauacaguauccucuacaucacaacccuaaaauucaucucuucagcucuuuccuccucacaguugcccccagaaagaacaggguagguaccaaccagucuugcaguuacagaggcgcuaaagcccagcccaggaccacacagcaagcuggccgugaagauggggaaggcgcccugcugcacccugcuccaccacaugucccaccuaccuacaucuuugaacuugccaucuuccuugagagaccagauuucacauuaaauauaacagugguccacugggaugucuggacaauggggaaugaagauuccagaagguggaauauagacaggaaagagaugagugacagccaucaccuuucuagacuccuaccgacaaacccugcuuagcucuccuucugaccugcaacucccaaauuccuaaagcagauagauuuggggcagcugcccaacacgaacuagcugagauaggcuggcagcaccaaggaccgaauggucacuggagcuagagcuagagaacacuccaaggaugccuggguccuugguccaaggaccuugcaauugccgcucuuuugccaguuaagggaggucacaugguagaaacaaaagucuaauuugccaauauaucaaggcugagcugccugccaugcccacugccagagggccccgccccugcagagcaggaagcuugggcagcugggcuggaggugggcugucugcugaucccagcaccaucacugguuagguuccugguuuguccuggcucuggucacagcuuaggcucugucucuuuccacagucacuggugacgcuggacggaggcaaacucauccaugugcagaaguggaacgggcaggagacaacacuaacuagggagcuaguugacgggaaacucauccugguaagaugggcagugacgggccuuaaagcaacaaguaccacaccuucuccagcccgacuaggacaagagaggcaggggugggguccuggcuguggauuuacacaggucuugguucaagcaucagucuaaaggcuaucugacaacacauaaccuucaagggccacugaaaugggggcugcugggaggccaguguauucagaguccaaagcacuggccaaaugggaagaacgcaguaggcacccacaaacacuuccuccugcuugcuguucccugggaagaggcagaaagcaggaccaguagaucccaggcuggagaggagcagcugccauccucuccccuccugaguagaaaugcaggagucugcaggaccaagugugugccuggugggcacugccagggagcagcccccuccuuacucacaauuuugucuacugcuccuggcuuccuggaaauaucuauugucuagcuaggaggugauacaaccaggccugcagaucugcuuugggacaaguuugaaagcaucccuggaauagucccuacauccucguaggacuguaccugggccaggagcauggaccacaaugucagcaucacagaccugggucgcucaguggaacccacugauugcauauucacaugagacugggguucccacugaguuagaagugaagggccuagcucuggaagggagguaacaaagaggaucauguucacuagguagcuagaguaaggugaggccauggcugggcucuacagugccagaauacugcauguuaggggagggaggaaaaguuggcagcuuagcaguuucucaaggcucuguucuuaucacccguuugucugccacauacaccaggcacccccuuaggcaggugcugaaaugaacacaaaggaggaacaggaauguacuggaucuugaccaguuuaccuccucucucaagggccuauuuuucccccaaaucucuaaaaugcuaauuauaacaucuuaaaagauuuguaucagaaaaaaaaguaaagugccuggcacacaguaggugcucaagugcuggucaggaugaggguggggagcacucccuccucugcucugccccaucugaaaccugucuuucuuucuagacucucacucauggcaguguggugagcacucggacuuaugagaaggaggcgugaccuggcugcuccgucacugaccgcccgcuccucugccaacuggccaccccucagcucagcaccaugcugccucaugguuuuccccucugacauuuuguauaaacauucuuggguugggauuuuucuggagauacggggcaucagccuggacccaguuccuacuauguaugugguuuauuuuuuaaaacuguauccaaagggugcuccaaggucaauaaagcagaaccaaggccaccca

SEQ ID NO: 12328 - RNA, 6687 nt, Mus musculus
uggguggccuugguucugcuuuauugaccuuggagcacccuuuggauacaguuuuaaaaaauaaaccacauacauaguaggaacuggguccaggcugaugccccguaucuccagaaaaaucccaacccaagaauguuuauacaaaaugucagaggggaaaaccaugaggcagcauggugcugagcugagggguggccaguuggcagaggagcgggcggucagugacggagcagccaggucacgccuccuucucauaaguccgagugcucaccacacugccaugagugagagucuagaaagaaagacagguuucagauggggcagagcagaggagggagugcuccccacccucauccugaccagcacuugagcaccuacugugugccaggcacuuuacuuuuuuuucugauacaaaucuuuuaagauguuauaauuagcauuuuagagauuugggggaaaaauaggcccuugagagaggagguaaacuggucaagauccaguacauuccuguuccuccuuuguguucauuucagcaccugccuaagggggugccugguguauguggcagacaaacgggugauaagaacagagccuugagaaacugcuaagcugccaacuuuuccucccuccccuaacaugcaguauucuggcacuguagagcccagccauggccucaccuuacucuagcuaccuagugaacaugauccucuuuguuaccucccuuccagagcuaggcccuucacuucuaacucagugggaaccccagucucaugugaauaugcaaucaguggguuccacugagcgacccaggucugugaugcugacauugugguccaugcuccuggcccagguacaguccuacgaggauguagggacuauuccagggaugcuuucaaacuugucccaaagcagaucugcaggccugguuguaucaccuccuagcuagacaauagauauuuccaggaagccaggagcaguagacaaaauugugaguaaggagggggcugcucccuggcagugcccaccaggcacacacuugguccugcagacuccugcauuucuacucaggaggggagaggauggcagcugcuccucuccagccugggaucuacugguccugcuuucugccucuucccagggaacagcaagcaggaggaaguguuugugggugccuacugcguucuucccauuuggccagugcuuuggacucugaauacacuggccucccagcagcccccauuucaguggcccuugaagguuauguguugucagauagccuuuagacugaugcuugaaccaagaccuguguaaauccacagccaggaccccaccccugccucucuuguccuagucgggcuggagaaggugugguacuuguugcuuuaaggcccgucacugcccaucuuaccaggaugaguuucccgucaacuagcucccuaguuaguguugucuccugcccguuccacuucugcacauggaugaguuugccuccguccagcgucaccagugacuguggaaagagacagagccuaagcugugaccagagccaggacaaaccaggaaccuaaccagugauggugcugggaucagcagacagcccaccuccagcccagcugcccaagcuuccugcucugcaggggcggggcccucuggcagugggcauggcaggcagcucagccuugauauauuggcaaauuagacuuuuguuucuaccaugugaccucccuuaacuggcaaaagagcggcaauugcaagguccuuggaccaaggacccaggcauccuuggaguguucucuagcucuagcuccagugaccauucgguccuuggugcugccagccuaucucagcuaguucguguugggcagcugccccaaaucuaucugcuuuaggaauuugggaguugcaggucagaaggagagcuaagcaggguuugucgguaggagucuagaaaggugauggcugucacucaucucuuuccugucuauauuccaccuucuggaaucuucauuccccauuguccagacaucccaguggaccacuguuauauuuaaugugaaaucuggucucucaaggaagauggcaaguucaaagauguagguaggugggacaugugguggagcagggugcagcagggcgccuuccccaucuucacggccagcuugcugugugguccugggcugggcuuuagcgccucuguaacugcaagacugguugguaccuacccuguucuuucugggggcaacugugaggaggaaagagcugaagagaugaauuuuaggguugugauguagaggauacuguauaaggacaaccuauagauacagauguuacuuaguucugugcguggcccagugcugggagauuuugagcaagcugcuaagaagauaaccaccaugagauaacugagcaucacuggagguagacacucccucccauacccuuaaauaaauacuugaagagacuauggacacccaacagcacuccuguugguaaacgcaggugccugucaacugguggcacuggaaacaguuuguuccggucaguggucuagccugggagcuacagagcaggaaaccuguggauagaacucagcuuguuguucccagcugccuccucugcugccagagccaggaugaccucgcuguagagcacugacuucugggcaucauuccuaaaacacuucaggucacagccauggcugcugauguccucagagccacuggguaccuugguguacaaggucacccagcuggagcuggaggcacaaggucggaagaauaucuuggcucugcugcccacuccagugacagcugauagauccuucccaggaaggugagaagaaaacaggccagagcuuauacuuagucccugggccaucgcagcacugagcaggcuuuaugaaccugccccuugggguuaaaaagccaaggagcuaagagggccagccucuuacccugugguguuccauccagugcccuccauccccuuucucugacucaccuugaccuuccggucaucugcugucaccucgucgaacucuauucccagcugaaaguugaucucuguguucuugaagguacuuugugucuuuauggugauaguauccccguucuucucgaugaugguaguaggcuuggucaugcuagccaccugccugguggcaaagcccacaccuaagggcaggggcagauaguugaggacacauuagguaggguagagacguguuauauagacccaaagagaaguuuguggccuaggcauggggaaggcgauccucaguggcccacgucuuuguguggggccauuuucucauucccuuagcucuuucccuuagcucggcagcuguuaaacucaugucaaauaugagacauguggaugcagggcagggucggcaacagcggcaaggaagguaccauggggugugagccacauagccagccccucacgcaguccugccccuggaagauuuuguagaugugaacagggucacaauucagauggaagcugcuaagcacugugucgcuccagagcuggguacccgcuggcuucuagucuccugaacacacagaacaggacugaagaaccaagagaucgucaacugccuucuagaguccccuggacaagggucgucucccauuuccacccagaaaacugagacagcagugcucucugccgucuguauggcagcgucaguuucaaagccuccugguuagagauacaaaggagucuugucuaccacagacguagagggcugaaaaaaguagcgacaacugcaugacuuggaagucccuggggagacuccugacauaaucauuggaucugaguccuaggcaaggucccaggugucccucaagcagguaaaguucacagaccccuugggucaagccuuuggugcuuuggguuaguagcuuuccuggaaucuuccaugguugacuaccugucgucuggccccagcacacucugagccauccucagcgauguggcaggaggcagcccaauauaaggcuaugguauugugcaucugcugcaagcugugcacacugcacaagcucuaagugguggccaaguauccuugggacagcccuaaaccuaagcuuuauaguuuccauuuacaaacgaggcugagacacggugcugucuuagccaaagucaaacgggccaagcauggugacuccccuagaaucucacucaagaggcaggggacuggagcaggggaaaugccgagaauucaaggccagcuugggcugcguagcuccagaguaugggcuauagugaaacccugucucaaaaaggcuaaguaaauaaauaauccgaguuuagugacauagauucccaaacucucuuuuagucucacuauaucauucuuggaauaacauacucuacccuucaagccaccaucugugcuugaagucacuuaaacuaggcugggcugcuuuguccuaagaaccuuugguucuauaggauaagucaggagcuuuggcuacacagcaagaagugagaggcuuggcuuugccuacugguaucugugugaguugggcuucagcagugaaccaagcuguuuucccaggacccaccuacagguagguguagggugccagugaagccaguuacugcuggaagcuggggugcaucuagacuuuacuggccuucagccugucgauauuuuuaggcuaaauagaauuucaguccccugacuaaagcuggguucagcacccacagaacaauggccugaagacaacaugcccugaggcaaaaagaagucuaggaaggcagcggcagcucagugaaacagaacuaagcccagguaaucuaguacucccuaacuugacagccaacuagcugggugugggcucauaccucuaaccccagugcgggagaggcagagacaacaggaccuggucuccuuagggaguuccaggagagccagggauacacaguaaaacccugucuuaaaagacaagaccagcugccuuccuggagagccucaggguaggguaggugccggugggagcccugucuggagaugugguucagcagucgcagugcuugcuuagcacgggcaaagggccuuggguuccauuccccaaaccaaaaggacaaauugcuuugugggccuguuucagagaagagcuggaaguaggugagaggcaacuacacacaucccucaacauguccgauuccagcccuccuucccggggaagacggaguggaagcuagcucaggcaugacacaguccuguuuucccugccccagccuccuagaccaggaugauauagccagggacuccgcagguagaggucuuuaucuaagcucaaggcaagaaaggaagggcuggggccgucuuggauaagugguucaugugacauuccccacuguugaaaugggaagaacucuagguaguucuggguucucaacuauuuggaaggccgagauggcagguuacaagaucaaagccaaccuggggaaguuagugagaaccuguuacacagaguaaaaagagggugugugugugugugugugugaguggggaguauaacucagcaguagggggcaugcacaaggcucuaguucagucuucaaaaagaaauccugggcuuuccuaugaggcgaugagcucaugugucccaagcugucuuccuauuaaguaaaucaugggacucuuccuuucuuuuuuuuuucaagacaugguuucucuguguaguccuggcuguccuggaauucucucuguauagaccaggccuagaacucgggagauucaccugccucugcuucccagagugcugguuaaaggcguugugucaccgcccacaccacacaauuuccccagccccaagccacacucucccuucauagcucuucaccuuucuucugacacccucugcucgaucccaggcuuucuucacccuauccccagcacugauccgguggccgacuggugcggccgggaagccuauguguaguggucgucuugcccugcucuagcagcagcgucuccgacugaucccagggguggcugcacacacuguaggugaaggucaggcuggugagaaccagggcaucuuccagagagaggccucuucacuaccccaacauggagggguagggcuuguugcugacugccuggcuguaucuucaccucuucccagauggaauucacugauuuucuuuagucuuccuccaggcucuguacacuccuaucugcucuauucccuuucggaauucaauuucuggaccaccaugcuccucuuugccuucuccugcggccagccucccgcccuucuuucccuccccuuuccaccuccggaucaccuacacugcuuccuagaaagccucccaucccggaccucugcggccacagcugccucuacccuuccccuccagcuacgaggcucgccaagcuuggaccgcgacaccccccucccaggaggccgggguggggugggguggaguggaguggcuucagcccaggccacccuccgcaccucaguauucccugucuggacuggcuaggagcuugcgggaggcacaugggggcacucccccugggagcucagcgccaagaccgccuugccggcccuccugacccuagauccugcgccguucguucgcucaccgagugacuucauguagucaucaaaauucuugcuguccacuagcuuccagguaccgacaaaggcguccgccaug

SEQ ID NO: 12329 - RNA, 5430 nt, Mus musculus
ugccaccaacagcacugugcaguuuauuaaccauucaaguacaguagcaucuggugagauugggacagaauugggaucgcaaaguggacagauauucagcaucuaauggguuggaagaagccgccacauacucuucacaaacaucuuccacagucaauacagaacuagccauuaacccagcacaccgauugugcccgaguggaaaagaugcaacgagaaaaauagcuacauuagaaagaccaacacuuuaaaaaagaguaaaacacuuucaguuucuccccuugagccccuaaaacaucucacggucuggaucuaccuauacgguccuacaucggcuucuagacuaucugucaggagggaaaguaaaggacacuggccaguacagucuuuggauauuuaggacggggucggggagaaagucaguucucgggacaacuuagucagccucagucucauccgcggggucuuuggauucuuuguucuuccgcaccucuuccacgugcuuguccuggaagaaacuguacguaagugucaucuguccaaaaaauaacuuguugagcccuguccccugccuacgagguccaacacagcuucagucacacaacccauggaaaucccaaaccaaaaaucccgagacaucaucuuaaagcuguuggucucuuggggcugagaacagcuaggcucugacuguucucccagggaauaugcacucaugcugggaacuccuacugaaugcuaagccccaaacugaugacaaaaaggaaccagucauauuuuuauuaagacaguuuaagccgauucaccccugccugaagcugcuaacucucuaaagcaagaaaccaaccuucucucgcaagcgcuccagcuuggccgccaucugcgccucccgguucucuuuguuagccuccauuuugugggucagcuucuccuccgccaucuugcugaaguuguuguucuccucgauggcuuucuggagcaccuccuucucaugcucccgcuucuccgcgagcugcuucaagacuuccgccucaugagacugcaaaaaaaguuaacaggccccucugaaguaccuuuggcauuuguuaaaacugcaacaaauuauuuaucagggaaaggcagaaaaaagguccccugaaacuaaauauucaagcaaggagcugaaguaccugaaucacccguuuuccuacuauggaaaacuggcuguacauucaaaagcuugguuuugagacaagaucuuguguagcccaggcuagccuggaacucuguguauagcaagggcucaccuggaaccugacuuacucgcaucccucccagaguugggauuauagcuacagaacacaccggccuagcuugcucagauuuccuuccaaauuaccuguuaaggaaacccuuagaagaguuugaguaaaauuuuaaaaauaguuuuacuuuauugcuuaaaguauucagaugacuugaguaauaaucuacuuaagugcagggcaccuuugacaguaucuguccagaugggagcgucaccacguaggcaguuacuguguagucugacuacggaacacaagaccuagcucuccucucuaguuauauuguuuucuccugcuccuacaugaaagagcaggcagauggcacaccaggguaaaugcugacauccuuuuuauuuguguucugagacaggcucugacucuaggcuggccuugaacuaacaaccuugaaaaugugaucuucccaccucuaccauguaagcacucuugcagcagaaguauagccccagccaggcuggcuuccaaccguucauuuagcuacagauaauccugaccuucucaucucccuaccuucacuuuucaaguacuaggauuauagauuuacccagcuaaauccuccucccuggagauggaagagauuuuaugcacacuuauguaaaagucuuuuauaaaaguuccuaauaacaauacuguugcauggacagaaauacaugguaacaguggauaccucuaggaaauaaaaugacucuaauggcuauaguuucauguuccaacucuucuauaauuaauauuuguuaaacuuuucauuaguuuuuuuuuuuuuaauguguauggucuguauaaaaauauaugcauaugugucaggccuuuagaaaccaguagagggcaucagaucccuggaacuagaguugcaggagauugugaacuacccaaugcaggugcuaggaaccauuuuggucuucaugaacagcaagccucuuaacaucugggccaccucuccagccucucauaaggccuuauuucuuauguauuuuccuuuaugugcauggcuguucagcuugcacauuuauuuauacauguguuacuugugagugugguaccauggagacauggcggcagcuggauccccuggaaauggagcugaguguugugagcuaccccaugggugcuggcaaucauggauucucuggaagaacaggcagcuuuuaacugcugagcuaccccuucgggccucauuagguuucaaugacgguuagguuacuuuauaaugaacgugaggaaacgcgucccuggaauuuuaaaguuuuuauugcauagcucuuuaaaaacaagcaaaacuaaggaaacaaagggucacccaccaccuaauguccuguuugguaaagagaaaaggcgugagcucuucucugacguaacacagguuuagcuuaaauucugccuccagcacuuacuaacaggacuucaggaaaaugcccuaauaccauuuucaagucuguuaccugagacaauggccaccauggagccuccauuuauuacgagaaagcuccugaggugaggagcuggcucgagcggagcucauuaaacgauggcugcugcuuccuuugaaccucuggcacaaggacauuuccuacuuaagaucacaguguagcuacaauccuuucuuccuuuguaggaaaaugaaaccaguuugucucauuacauuaauaaguuuccuguaucuccugaaaaucgucaggguuaccuugcgucuuucuucugcagcuucuaauuucuucuggauuuccuccagggaaagguccuucuucuuugggggggaaagggggaaaucggggacagauucuuuugaccgagggcugagaaucagcucaaaagccuggccugaagcgcgcuucuccagcucuuucaccugaauaucuggaguugaucagaugcaugauaaugagaaagacccggcuugcuuauuuaaauaaaggguucuauaauuuuuuuuuuaaaaaccaauaauucuaaaaaacaagcagaaugaaagcuaaugaagguguuuguaguaaucgaaucaaaauacaaaucaaaagaaaucaaguaacauuuuuuuuuuaaaaagcuuaacauuuuggacuaacaaauaccaucuugaggaauuaguacuugacagucacucccuaggaaacaaagaaugguguguguaaaaccccacauuuugcuuuggaccaagccaaaaguaugaauggcugagauuucuauauauuuauccaacuaauaaacauuucucaauugcauuuuuacuuguaaauuaaauuuugaaaagaacacaaaugccaaauuaaaagcuuaaggccugcaccacuuccuauucuaaagccauaagcccgcccugauuucaguuuucuaaaucaauuaccuaccagaagaugccaugucgaacagaagacaagagacuggcuguauacucuacacaauccacuggcaaggaaagcccuggaacgauuuuucaaagcaugcaaucaauuucuccacauuucuccuaugucaucagcacaaaggggucucaaaucacacccuugacaaugucaggaaaaucauuaugugaaaaucaagaaacaucauuaaaauaucaaucuagaaacacugggacauauugagauauuuucauugaguaacgcuggcagcagaaaaucaaauuaaaugauauucuucaaagaaagaaaaucuuggaauaucaaaacucagggguucaaucacaagguugaagaauuccgucccuuaauguuuuuguccugcccaacauaagauauuccagauucaacccaacaaugagaucggagccaucuuaauucugucuacaacucauugugcaauugaaauacccaccccugcuuugucugugucugccacggugaauaacacccaagcuggcagccaaugauauucaaguccuauuguuccuaggguuuaagcuacuagccucacagugagaaaaugaaguuguaugaaccucuagguuucuuuugagggcagggucuacuuaauccaggcuggcuguaaaauuacaauccucuugccucagccuccucaggguagaggggugggguuuagcccacuggguuaacacuuaacauuugcaaagcccuggguuccauguucgaugcauacaugggcggggggggggggcagcuucugaguguugagauuacagacaagcgccaccacacccgccugagguuugucacauuugaugccuuaugucgcaaacauuuuuuucaacaguucucgaguauuuuuuuuaaaaagaucaccauucuuuuagccccgaagcguaugacuaaagguuccaaacacuagacacugcaaaaacgaagcaacgaaaaaaaaugcauuuaucuguagcagagcacccaacgcagcagacuacacagcaugggcgugguccuggcccaggcgggcaggcuggcggcccgggccaaucagaacacgcccuacgcuccggccccuggccccgccccucggcuccccgcgccuuuucgaaucuccgcgaaccucuccacgcucgggagcccgcgcgcgugggcagcgacagaaugggcggggccaacgguccuccgggguggccccgccccucucgggcuggcagcgcgcggccgucugccccccaacucccgccaaaaacaccucgcggacacgcagcccugggguggcuguagagggcucggucgcacggccuucacccacugacggagugcccagagcuguccgggaccaccgccccgaagccccgggagaccgggcgggcgccgccccucagcagcacgagcgcccccagccucgcucuccuucagacaauggggaccccccgaacagccgcgcccgccgggcgguagaugcagaggacggcucacgccuccuauugucuccacgcucgcacccgggcuaaagcccagcgcuggccgcgcccccuccccuccagcccgcaucuccagggaauagggacaaaagccaaggcuccgcccgagcuccacacaaaagaccaacgccccccacccgcuggggcucggggucuccgcccaucuccugugcccggcugggggacccgccgcguucccggcugcuccccagcccgccguagccuccgccuaagccaagccugcacccaccugcucgguccgagccgccu

SEQ ID NO: 12330 - RNA, 18281 nt, Mus musculus
gaggaggccgcgccagugacagcgauggcggcggagucggcgcuccaaguuguggagaagcuccaggcgcgccuggcugcgaacccggaccccaagaaggugagcggcgggcgggcgggcggcgcgggcgggcguugggcgcggcgcgggcccuguaacggucgcgggcagggcgcagugggguucuccuccgacccggagccaggccccacggagcggcgcggggcaguggggaguucgcggccggcgggcgcaccccggcugggggcugaggacuggaggggcggccgggccuugcggcucuccccgggguucgggcagccgcgccagcuguuuccccguugcagccgagcgacuccguccgcugcuuggggguccugcggcucgaggaccccugugcuguacccugcccuuuagccgagaaaacggggaacgccuugggguuuuucgagcucugcuccuggagcucggguccuggaugagggcgugagcguguuaacuccgcucugacauacuggaaggugggaccaggcugugaugagcaaccauguuuaauugcacuuaacuacuuuguugcuccuuuuuagaaacuguuacuuuuuaaauacauuguauccccucgcggucccccgggugucuaggcuucucugagcucuacgaagaggguauggugggaauuagaaucguuuucacuguagucucuagccgaaaacaccaaagggugugacauggcuugucagcauucuagccugggccugagguuccuaaaaggugaaguguccagcgagcugaguggaagaggaagugguggagggagacagcgagcggacuuacacaugcaaucuagguuccuagccagcaccagcucgggacuuuggaggaguucucugcucgaccugucccuucucuaguuucuuccugaaauaccagcuagacccaagugcucuuuauaaguguuaaucaccaucagaauuuccagucagggaccccauucacucuucuuguuccuaguugggucacuaccucucaaccuccgggccacuuuuuaacuacccuccuuuagcucagagauacacuucuucagaagcuguuguuauaagucagcgaaaacguaaauguuucaauugucuuguguuuuacuuucuuuggaggccuuggggaccuuuggucagacauauuuacaaguucuuuuuacaauaacccuuugugggcaucuaauaaauggucauuauuuccaagucccagauugucuuucugaacacuauaagauuugugacugaccuuaaaguaaccacccucauuuuguuguuucugccaucagguuaaaaaaaauaaaaauccuccauguaauauaauaucuguaggguuuuuuucccccauuagaauuuaaauuuuggaauggucuauuugugcaugaaaugucaaguuagaaaaagguuaaguaaauuuucuuaaacuccuaauaauuauuuaaaaggguguuuggugguuuuuguuguuguuguguuugguguuauuggcagggacucauaugcuaacacuaguaggcaaggccucuaccucugacagcccuaauuuggcuuuucauuucccagagagaaaauuaccuuggggcuggggauguauuucaguagcagcuaugugagcucuuggcuucuguacccacuggggagggagaacugaauguguugugaagagagaggugaggaaacuguugagagaccccugugcaaaggaccugaaacguugauauucagaaacacgcugacugcaaagagaaaauugcaagccugcacgcuggcuuuccaaccuccuuuuaacauagcaagcucucacagguuugugaaguggcaagaugauuauagagcaguauugaauuugcaaccaaaucuugcuuccagaccauuauuagccaaaaggcugauuccacaccuguguuuuugggauuccugcuauuggauuuugguguuuuaaguguaaauuaacuauguauucacucugccuucaucuagccucuaggcucacuuguuagagaccuuacugggagaugacuuagcuuuugcuccuaucacuggauuggaaacaauuuucaugacagauaaaguuagcaguccuuuaucagguuuugaguguaaaaacuaugaagcccauagauuggugguagguggagaaugagggggucacugcugggaacugguuagcucuaagacuggaaguggagaacccaagauuccuauguaugggacuguguaaacuuuuguuauuucugucaucugcuaccaguuuuugcugggcuacguuggguugacagcgcugguuuccaucuacuugaggauauccauaguccucucugcuuguuguugcuucauucuuggaagucacugacugaaaacuggggauggugaagucuuuuucucuuauauugggcuaaaucagcuugaacaucucaagaguuuucauugugucugcuagaccaaagguaggccacaggcaauacucacuuugccagucuguacaaagccuugagaucaacacauccucuuugacuucugacuccauuucucucucuuggcuauguagugguccuguaauuguguuuugugaccuuugccacaugaacuguaagcugucaaguagcauggugcugagaaagaguaccugcuuucuucuuuccugugaaauacucugggcaugaguuaggugucugugucucuccuuuuaaggacagugauauuaguuucuuggcuuuuuaggcaaguauggaacaacccuagacccagguucaaugucagcaaaauaggagaacaauacccacuagacagggucaaauaagacaaacuuaccaugauuccgggcacaugguggauggcauauaaauguccccuucuugggcugggcagugguggccuacgccuuuaaucccaacacuugggaugcagaggcaggcgaauuucugaguuugaggucagccugguuuacagagugaguucuaggacagccagggcuacacagagaaacccugucucgaaaaaccaaaugggggggggggggaguccccuucuccagggaccaccauuauaggagaaccacccauuuuaacucuuuccaguaacuccagauuucccuuugagaaaauguuauuagccuuaaccuuugcauaauguuuccuaaguuggaucauagaggaaguggagaguuuaaguauaauuuuuacuucauuaaguuucauauuccccagauacaccacugggccucuuauacccagucaaacaagauugucaccugugauucaauugcucugccuagagacaauguuaaguaauuaugggaguaaaaugaccagaaaaacauacuuguugcuccaccuuguaguaauaugaccgauuacagccuggacuauaaaaacaagucuugcugucuaauauuuaaaaaugaagguagagccaggcgugguggcgcaugccuuuaaucccagcacucgggaggcagaggcaggcggauuucugaguucgaggacagccuggucuacagagugaguuccaggacagccagggcuauacagagaaacccugucucgaaaaaccaaaaaaaaaaaaaaaaaaaaaaaaaaggcagauaguuaucuauuuuguuuuaugguuuuucuguuuguuuguuuuuguuuuuuugagacaggguuucucuguguagcccuggcuguccuggaacucacucuguagaccaggcuggccuugaacucagaaauucgccugccucugccucccaagugcugggauuaaaggcgugugccaccacgcccggcuuauguuggguuuuuuuuuuuuuuaagguucauuuuuauuuuuuauguguaugaguuuuaccugcauauauguauguucacaagaugcaugccugaugcccauggaagccagaagagggcacugagucauggagaacugggcuuacagacagcugugaacugccauauggguucugggaacugaacccagguccucugcaagaguagccagugaucuuaaccacugggccaucucuugagcccuguuuuuuugguuuuuuuuuuuuuguuuuuuuuuuuuguuuuuuagaaaaagauuuauuuauuauauguaaguacaguguaucugucuuuagacaaggaagccaggucuuguuauggaugguugugagccacuaugugguugcagggauuugaacucaggacuucuggaagaguagucagugcuuuuuuuucuaaccgcuaagccaucucuccagccccuguuuugacucuuuaaaaauugaaauagccgggcggugguggugcccgccuuuaaucccagcacucgggaggcagaggcaggcagauuucugaguucaaggccaaccuggucuauaaagugaguuccaggacaguagggcuauacagagaaacccugucucgaaaaagaaaacaagaaaauugaaauaguugugcauauauguguucuauaugcauauaaccaaauagguucaaucuccuguugauuuauacacauguaugugggugcccccggaagccagcagagggcaucaggugcucuaaagcuggcguaacagguggcugugacgugccagauggugcugggaacugaacuuggauucucuggaagagcaacaacuguucuuuuuuuuuuuuuuuaaagauuuauuuaugaguucauugucacugucuucagacacaccaggagaggguaucaggucccauuacagaugguugagagccaccaugcgguugcugggaauugaacucaggaugucuggaagagcagccaguguucuuaaaccucuaagccaucuuuccaggccccuguuuuugcuuuugagugaggauuuacucaauauguagcucaggcuagcaucagacuuugugugcuaggguugguuacaaggguauauauacuaccacagcuggcucaguuaucuguuuuacacugguguaccugaccacacucccuguauggaaaguguuuauaugcacuuacccauucuuagaaaaaggcuuagcaauccugauauccauuggaaauuccguaaguagggauugucugagcagugucugguccaggauccaggguaggacauggaaagaguguuggcugaugagugagaugauuagggaggagcauguuuaaccuuuaugguguugcagacaccgugacuaagcacugcacaugguuugucccaaugaauccucacagcuugcagcacauggagacuaguuuugauuugcagaugaaguaauuaagguucagggagguuacugacuugcacaugaucagccaagaagcugagacgaccucucucucucucucucucucucucucucucucucucugucucuugagcuuugcucuaccaguuuugaccuaguuuuagagucuucagaaaggaaaugggcaaacccaaaucuuucugaucuacccagacauguuugaucauuauuaacagcaaagcugagaugccagcaacucagauuggucuuggguucccauuuguguugacacuuguguuaaacacuaucccuuaaggaggucuguagguccucucuuccuucuuguucugcuuuagauauacaagucuguagaugauuucccuaaauuugcugccuuucacaguccucugcaaagucauaauugcugauggcuguguuugauuguuuuuuuuuuuuauuuuguuuuguucuguuuuuguggggaggggcagaaucucucucccucucugaaacccauaugaccuuugaacucuaggugauccgucuaccucaguuuccuaaaugcugagauuauagacauuagucacuauaccaggccaguuagugaggguuuuuuaagucauuauuuaguuucuguauggauguuuugcuugcaugaaugucugugcacuucaugugugcuuggaggcuagaagagagcaucggaacuaggauuagagaugauuugagccuccaugugaguguugggaaucaaacgcagguccucuggaagagcagccaaugagccauuuccccagucccauuuagugaguuuuaauucacuucucugucucuucuuuccccuuggcgaagaaaguaguuaaaaacacauaaucuagccaggcuuggugacauaguccuguauguaacccugcugcuauuccagaggcuaaggcaggaaguucagaagucaacgccaagccugaucucuaaaugugaaaagaaggcuagguuaggggcuggagagaugacucagugguuaggagcacugacugcucuuccagagguccugaguucaaaucccagcaacugagugguggcucccaaucaucuguaaugggaucugaugcccucuuccagggugucugaagacagcuacaguguacuuacauacauaaaauaaauuuuaaaaaaugaugucacuucagcaugccagaacuuaggggaaaaaaagaagguuagguuauagcuuggcgauagaguacuugucagcauaguuaaucaauagguucaaucucuaguauuauaaacaaaaaacccuaaaagccacaagagagggcuuaggagacauaauacauuugguaacaugcuugcuucaggagcuuuucgcucugaguucagucuccuguaccuauauagaaaugcugugcauggugucacacuuuuguaauucuguguuggagaggcagagacagaaggagccccggaacucaaugaucagugaacuuagccuaauugaugagcuccaggccagugauagaccuagcaucaagggagguggcagugauuguugguuuuuugagacugggucccuguuuagacuaggcuguccaccuccccucaccuaaacagugcugggguuaacagcaugcacugccaugccuagcaugaugauuguuguccugcccuccgcagacauauguguguauacagcacccacaauuuuaaaaaccucacagaagaaaccagagacuggaaaaccauauagacuaaaguaaaucuuguacuguuugugucuuggacuagugacaaagcaucucugagccuuucuccacgcucuaagaugcaaauagcauccauaguuguuacuaugaaggacggagcuccgagcaaguaucucaccaccagauaguaucaucuaccucagagaagauccauaugacaauagaaauuaauauuuguuuucuucuuucugcagcuauugaaauauuugaagaaacuuuccaucuuaccuaucacaguagacauucuugugguaagaauuuuuuaauuguaacuauuauguauugcagauguuucccacuauagcauguguaaagggacgcuuacagagguuaggcuuuacaaugaaagaagccagguacaaaccacuguuugcuuuaugauucuguuuauaugaaauguccagaaugggcuaauccauagacagaaaguagauaggugugugauuguuagggcuuagggaacuggaaggaacaguuucucuuuucacauucuagaguuagguugugggaaguaugaggaauuaugaggagguaaguaugaagaaaguucuagaaaucaccauacuuuaauguacuuugucaugugacaaggugggccagcauguuggaagcagcucaggguggugugcaugauagacaagugugcucagccaggcugcaugacuauuuccugguacuugaauguugggucaaaauuuuugguucaaaauuuaaagauuuauucuuuuacuuacauguaugggcuuuaugugugacuuuaugaguguuuacaugcccaaagagaacccaggcccucagauucucucagauuggaguuguaggcaauugggagcuaccugaugugggugcuggaauugaauuucuguccucugcaagagcaguaauuucucuuaacugcagagccaucacucugugucccucaaccugaaauuuaaacacacgggguacaugagagauaggugaggguuugagugcuuacugaucuucuagaggaucccaggucaguugucagcauucauaucaggcagcucgauacuuccuuuaguuaacuccaguuggccucugagggcagcuguucacacaugggguacacuuauacacacacacacacacacacacacacacacacacacacacacagaagcauaaauauuuuuuaaaaauuaaugcaugaaaagaauauuggcuuugggaucuacuacucauagauucuaauucuagaaaacuuuuaggcuggcauggcugugugcaccuuuguaggugauucagaguucaaggccaaccugguguacauacugaacccugucuuuuugaaagagagagagagagagagagagagagagagaaagaaagaaagaaagaaauccaauuuccauugcuuuccgcugauuccuuccuuaaggguugugaugagcacuuucacugucuccaagagagcgagcuggaucaaaccccaccccuccuguuucauucugugccucugggcuguccugauggccuuacauaaaccugugggcuuuguuacuuugugucagacauuugggucuaggcuacagaguaacuuagucuaaggcguaggcauuuuaggagggauguuucuugcuuuucucuauagaaaaccaugcccuugguuucacaauccucauucagucaaucccuguguuacguuuguaggagacugggguagggaaaacagugaacagcuuucggaagcaugagcaaguaggaaacuuugccagagaccugguggcccaguggaagaagcugguuccaguagagcgguaagaacauuucuucucugcuuguuuggcuucacaugucaaauuaacuaugugaccucaauuacaaaaacaacccaggguuauuguaaguuauuguagaauauaugguaaaguauuaagaauaaauuuuucuugcucucuuacccucuuguucuugcucguuugucucucuuacucuugcuucccgcuugcccguucucuccccauucccuuccccacucucuccacauggccauggcuggccucugcuucucuacucuucucccucucucugccuuucgacaagaaacgccuuaaaagcaaaaacaaaacaaaccauaccacacacaccaaacaaaaagcaaaaaccaaaccaaaaagaauaaaauuuuucuugcaaccugugggggaagggagagcucuggcccuaaagguuguccucuggccuccacauguccaugaugcaggcaucucgugggaauaaguacauaaaaaugcaagcaaauauuuuuuucuuaaauucuuuuuuuuuuuuuuuuuuuuuaaagauuuauuuauuuauuauauguaaguacacuguagcuaucuucagacacuccagaagagggcgucagaucuuguuacagaugguugugagccaccaugugguugcugggauuugaacucuggaccuucggaagagcagucgggugcucuuacccacugagccaucucaccagcccccuuaaauucuuuuugguugguugguuuugguuuuugagacagggucucucacuauagccaugguggaacucaagaccaggcuggccuugaacucaagagaucugucugccuaugcuugugagugcuggaauuaaagaaauggggcugacaugccagggcacaauucuuuuuaauguugaacauuaacacuuuguuagguguguuuuguuuucuuuuguugggggcuugaugcugaggacugagcacaggcucucucacauacuaagcauacuaaggguggagguggcugggcacguggucagagauccgaggauagguuuggagagucaguuuuuuuucugccaccaugggauuggacucagguuuucaggcuugcauggcaauaauuaucuguugagccaucaggcugcccucaauaucuucuuuuaacacaccggcucauucuaaucuagccuuggacaugcuauuaacacgaugaccuugaacaucugauucccccaacaauccuauuuuagccuccuugguacugggauuuuagaugugagccagguguggccuggucuuuguuguuuguuuuguuuuguggugagaccaggucuucuguagcccauuggccuugaauuugcuuuguagcagaggauggcuuugaacuugugauuauccugacccaacugugcccuccauggcugagguugaggucugugacuuugucuaagagauuuaugcugaggucuacuucugcuucugcuuuuauuuuagaaauagugaggccgaggaucaggauuuugagaagaacaauucccguaagcgucccagagaugcucuucagagggaggaggaguuggaggggaacuaccaggaaagcuggaaacccucugguagccgguccuacagcccugagcacagacagaaaaaacacaaaaaacuuucugagccugaaaggccucacaaaguggcucacagucacgagaagagagaugaaaggaagaggugucacaaagugucaccaccauauucuucagaccccgagucaucugacuauggccauguucaauccccuccaccuucaaguccucaucaaauguauacagaccucuccagguccccagaggaggaccaggagcccaucaucucacaccagaagccaggaaaaguccacaguaauaccuuucaggacagacuagggguuagucaccugggugaacaaggaaaaggggcuguuagccaccacaagcagcacagaucuucacacaaggagaagcacccugcagaugccagagaggaugagaagaucucugcugugagcagagagaagucacacaaagccucuuccaaagaggaaagccgaagacuacugucaggggacagugccaaggagaagcugcccucuaguguuguuaagaaagacaaggacagagaaggcagcagucucaagaagaaguuuucaccugccuuagauguugcuucagacaaccacuuuaaaaagcccaaacacaaggacuccgagaaagccaaaucugacaaaaacaagcagaguguagauggcguggacucaggacgagggacaggagacccauugcccaaagccaaggagaaaguucccaaccaccugaaggcucaggaggggaaaguaagaacuaacgcagauggaaagucagcaggcccgcuccacccuaaagcggaggagacagauguggacgaugaguuugagcggcccacgauguccuucgaguccuaccucagcuaugaccagccccggaagaaaaagaagaagguugugaaaacguccaguacagcacuuggagaaaaaggacuuaaaaaaaaggacucuaaaagcacuaguaaaaacuugaacucagcucagaaauugcccaaagucaacgaaaacaagucagagaaguugcagccagcuggagccgaacccaccaggccucgaaagguaacucugcuuccugccugccaggcugcuuguccugcuguccuaugacugguugaguucugauuguuauuauuaauauucucgagcuugcuagcacuuagaguggauagugcgcaggauaagauuuguucugggcuagggaggaagcguguguauaguauaguauaguauaguauaguauacagugcucacugagaggguaugagagccuacauuuacuucuuagcaccucaaaauuuuccaagacauuuuuugcccuauugacauuuauuucuuuauguaaauggugucauucgugacuugguuaacuacugcaggggagaaagcugauuacagggugggcucugcacugugucucuugcaggucccuacugaugugcugccagcauugccagacauccccuuaccugccauucaugccaacuaccggccccuuccuucccuugaguugauucccuccuuucagccaaagcgaaaagguaauuuuggacaucuuuuuauugauuuuuaguuuuuugaaacagggucucauuacauagccuuggcuggccugaaacucacuuuguaggcgaggcuggcuuuaaacucagauucaccugucuccgccucccaagugcuagcauuaaagauuauauuuuuauuuugccuguauuaguguuuugcuggcauuugugucuauucaccaagugugugugguacccaaggaggcuggaggagucaauguuggggcccuugggacuagaguuacagaaguggugagcugccgucugggagcucuucaccauguaguguagaccuuuugugacuuggcuuucuucuuucuacagcuuucucuucaccccaggaagaagaagaagcuggguucacaggacgcagaaugaauucuaagaugcagguguauucugguuccaagugugccuaucuccccaaaaugaugacauugcaccagcaguguauccgggugcuuaagaauaauauugacugugaguuaccaaccucgcaagcgcuuugcuccacugggacuuugucacugggagcuuggcugccauucagcacucaccugcccaccucugguuucucugcagcuaucuuugaaguaggaggaguccccuauucuguucuugaaccugucuuggagaggugcacaccugaucagcucuaccggauagaggaaugcaaucaugugaguguccucagugggaacagugcgccuccccggcucuguuuccaaagguggcuuggucucuagaucugcuguggcagaagggcaggucagagggcaaaucacagcucugggcauguuuguuuugcgagucugggccuuuaaacaagcauuuuugugccuguuccugggauccuucuuuguuuugauuguuuggggugggggguuuggcuuuguuuuuuuaagacagagucuggcucuccuggaacucacuguguagaccaggcuagccucaaacucagaaacccaccuuccucugccucuugggugcugggaauaaaggugugagcaacuucuacccugcuaccugcuaucuuuuuuuuuuuuuuuuuuuuuuuuaaagauuuauuuauuuauuauauguaaguacacuguagcugucuucagacacaccagaagagggcaucagaucuuguuacagaugguugugagccaccaugugguugcugggauuugaacuccggaccuuuggaagaguagucgggugcucuuacccacugagccaccucaccagccccuuuuuuuuuuuuuuuaagauuuauuuuuauuauuauacauaaguacacuguagcugacuucagacacaccagaagagggcgucagaucccauuacagaugguugugagccaccaugucauugcugggaauugaacucaugaccuuuggaagagcagucagugcucuuacccccugagccaucucuccagcccccccccccgcccccuuuuuuuuuuuugagacaggguuucucugaguaguccuggcuguccugggacucacucuguagaccaggcuggccucgaacucagaaauccaccugccucugccucccaagugcugggauuaaaagguaaaggcguacaccacugccuggcauuuuuuuuuuuuuuuuuuuuaauuuagugauuugccuucuuccuaguauugugguacugcuacuaagucaaccugccucccccauacuauuaggcaucggguccuguguagguaaaggggagauaggaaggagagcguguacacaagucaugccuugguccugguuucagguauuaauugaagaaacagaucaguuguggaaaguucacugucaccgagacuuuaaggaagaaaggccagaagaguaugaguccuggagggagauguaccugaggcuucaggacgccagagagcagcggcugcgccugcucacaaacaacauccgcucugcucaugccaauaagccaaaggguaaggaagcgcagcugagccuucuguccaggcugcucccgagugcggguucacaggccccgcaaaccuuagaaagcucuagaccaguggccauggguugugacuccuucugggggguucaaaaagucuuucacagggguugccuagaaccauuggaaaacacacauaaacuuacauuaccauucauaacaguagcaaaauuauagucaggaaauaacaguaaaauacuuuuauaguuggggaucaccacacaugaggaacuguauuuuuuaagauuuauuuauuuauuuuuguguaugaguacauuguugcugucuucagacacaccagaagagggcuuuggguuccauuacagaugguuguugugagccaccaugugguugcugggaauugaacucaggaccucuggaagagcagucagugcucuuaaccgcugaggaacuguauuaaaaggucacaacauuaggaaaguugagaaccacugcucuagacccucacauuggcagcaguuccuuugaguaugaagguaaauauugauguuuguauuucuacucaggacgacaagcaaagauggcuuuugucaacucuguggccaagccaccaagagauguccgaagaaggcaggagaaguuuggaaccgggggagcagcuguuccugagaaagucagguaaaaucucucugcugcaagagcauuacccugaaggagagcuggggggcaggaagugacucauuugugguggagucacucaguggagaguguucuugagugguuaccagagcuguaccuuccucuuggccuuugcuuaggugaucauuucugcuacaugcauguguucuuguaggcagagaacaggaccugacucaagaacgggccccuucugcauuaauuuuucucacuuauaccccaaaacuguuuuuauguuugaagauauagcuaugccaauaaaaugcuuaagccuagguugauucucacaccgguguuaccaggcagauggcuggugugcacuugugauccuagugcuggggagcgaguccccggccagccuagccugugcagugagcgcugggucucaguaagacucugucucauagccagguagcuccugagaaauaacagccaaggcugacuuggccuccacaugaacagaugcccugguacccacaucugcauacauauaaaagaaaacaaauuuccagggugacuagauuuuuuagggcacaugagcauuuccaaauuauagacugacauuuuaacaggaaaagcuuagugugacugucacucucaauaaagggcuaacagcuguaucugaaucuucaccagcacucaguguaccaggcccacugcacagagccccagugaagucacccagcaacagcucuguugagauugugugcucccagcuaauugucagcuuugucuguauugcaggauaaagccagcgccauauacaacaggaagcagccauguuccugccagcaacagcagcagcaacuuccacuccaguccugaggagcuggccuaugaugggcccaguacuagcagugcccacuuagcuccuguggccagcaguucuguuuccuaugaucccaggaaaccagcugugaagaguaagcaacuuuggugggaacagggcugugggccaguagggauccugacacagauguuaacugagccaaggacaggcuggcccuccucagguguuucguguuuauuagcucauggugagaccuguugcugcucugggaagcugcagggucuggguacuauugaaugugugaguuggaaaguuaaauugucggcauuguggccucaagagucagcaaagacuucugauuugccucuuaagccgccaugagcacagcggccagucuuggaaagcuguggugucagagguacuggugguucugcaccuacagggucugguagagucugccccauuucauggggauucucugacagcuuuucagacaguuccugcuagucacuucauuuguguguagagugaaguacacagccagggaauacaaacucagucuggcuuugcguggugcaugucugugcuacaucagucugaagccacugacuccuuugucuucacagaaauugcuccgaugauggccaagaccauuaaagcauucaagaacagauucucccggcgauaaacaggacuugccuuggagguugagucuggaagcaggaauacagggacgguggggacaggagaagaggauaucuacagaagacccauaucuuuugcuuuguggaacuuuuggccucuugacuccuguacacuuccaugugucccacugugugccucagcccugcacccugcuuguagcacacuucagauuucugaagacaguaugagccucaguccuacugaggacuuuaagaucaguuauacuuuuguugcuaauuagcaucuuuguaaacuauaagacauaguuuuaauaauaaauauugcccccagauguauuuauaauaaccccaggguuuuuuguuuuuuuuuuuccuuuuuuuuguuuuuuucuuuuuguccucuauauuuagccuuuuacuuuccagguccuuuauuaaaguuagaugagccuagcaaaagccauucuuguccugggucagcucuucugaguagacacuggucaaagggcaccuucagagccaguguguugcuccaagcccauauacagggccaggagugagagugccagaaugccuguccuccagcgagccucccuguuaaacccucagaguuccuugaugggcgcuuuucuuucuucaguaguguuugcuaaagaaggcuguuugcaaagucuauaguccuuugugcaucaucuucaaaucacacuccucuucccuguuuucaggcuugcuggaggacagacccuuaagauaugaauuuauguaggaccucagcaguuuuauaauccuaguuucugguucaguauuuuacauacacaccugcccuuauuuugccuuucccugcacuguggggaaacagacauagcagggcuuuuguagcucugagugugauuuugggggguugaaaugccagcacuuuauucucuuguucucuaugaauuccuaccaggagugaaugauuuaaagcacuguagugcuguggaacuugcuuuuguuugaaaggaaaggugcugaugugcccagaggaacgguauugugcuguggccagcagagaacucugugcagccuccgccuucugaguguuggccuugggaaggguggauggucacccuggucccagccaaccaguucaggaggaagauucccuauuucuaggucgcauaagggcaagguuagagcuaggaggauagugccagcuucuuccuuccugucagaaaacguggaagaggacucaauuggcuaugagccaggugaaagacacuaugaacuugaggggacagacagcacuggcacugugccuauccuguuuuagcacccucaagaccucaggcuagugaagacucccaaggcaguccaggaaaccugcacagauaaagcuaggcccaccuuacugugcauugcuaugcugggucccuguugccaugggacacagguauugcuaaguaaaacauuguuucucuugguugcuuguuucaccauaccaccucucagccugaccucaaacucuaacaucaggucucuuagcugacguuaaagggacauuuguacuaggagccaggccccugcugucuagaacagccuccuuucuagguguugaccaccucagauuuaugccuuagcuguguuucaagacuucccuuugccauuuuuuccuauugcagguucgauuguguaugauuuaauucccuuuaggaauuuguaggccuagggaaagaaaggacaugcauuugcccgucccaaugucagcaucugguuuggcacacaaagauuucugaggcacccaguuuaccuagagccagauuuucuagcccuucaagagugucugugucagggauaggacugcugagaacagugagggcccagugagcagcugucuccacagucccucaccccaugcacaauggccacaaagcagacacagucauguucaacuuuuggucacauuugugaagacucgugcaauguuuucugugcuacacuacauacaggucacacaugauggacuagcccuuuacauacagaugacacauacagaauagcccuuugcgauccuuggcguuccaagggcucucaggggcucacuuucucuguuuuggaggcaggaggagcaggagugagcaccacccugcucugcauuuguauuuuggucccaaaauguaaauacaauuuucuauguuacuuuuuugugguaacuacaagaugaauauuuuaauuagauaaguuauacaaaaaggaaaaucccaugucuaaauaaaaagcaaaaaaauucu
